United States Patent 9,328,346 (POLYCOMB-ASSOCIATED NON-CODING RNAS) - sequence listing, part 23

SEQ ID NO: 3806 - RNA, 4842 nt, Mus musculus
cagcgcagggugagggaggaggugagauagaaggaagaagggaaggcagagucgaauagggaggaggaagaggacagagggaagaagagaaggcagggugagggaggaggcggagggagaggagcgcacgcggcgagugcgcggccggguucgcugguugagagcgaagaaggggugugcauuggcaccgagagggacccggggccggcgagggcgaucgcagcuucgggagguagagcgagugcagggagcgggcccaggcgggcggaggagugagcgucaaacgggcucugggguacacggucccagccccuguaucccgggagcuggggcucccguucuggugacagccaggcuggaagucccaagaggaggggagggaagagcuagggggucgggcgcugggaaagggucgcuccgaggccucuuggauggggggugccgcucgccugagcgccccucaagcgcugguacucugggccgcacugggagcggcagguaagaccuggggguccuggcagcauccucugagggagggacaggguggggugccuaggagagggaugcagcugcucucuucccagcucacaucggaccugcaccugaucccgaggacugguggagcuacaaggagaaucuccagggaaacuucgugccaggugcaaacaggguggagacccagagcccgaccccauaucccuaggcgccguuuuuccuaggcucaggagucuggguccucgaucuucucaucuuccauaggaccaaagcucccagccccugccuucuucccucaggaguggggcccagccucugaaccucagcggcucaccaugggacauuauacaugcgcauuucaaguagugagugggagugagugcaaggaaaguguggggguggagaaauguguguguuugcagccauagacagguccuauuccugcuggaaggcacacacucgguagcucgggucccugucccgcccccucgcccggggcuucgaaguccucuuuuauaacucuucuccccuaauauucuuauccagcugugggaccugggagacuaaaagaacuacaacucccauggggcuacggggcaggccggagauugaugaguuguuuucaccccugaggcuuacugggaguuguaguucuguuuucacauagcccuuuuaaagaugggaacaaggcuuggagcaguuaugagcuccuaggaagggauuccaaaauucuucgaggaaucaggauucuggcucucauguucuuucucucuuagacccaaagcuccugauuuccucccucguuuucuuccuucagcugggguuaucccugccccaauccacacagcagguccugccuggaauccagccuauuucuguucccauagggccucccuucuggggccuggugaacgcugccuggagccugugcgcuguggggaagcggcagagccccguggauguggagcugaagcggguucuuuaugacccuuuucugcccccgcucagacucagcaccgggggagagaagguaagcuuugcaguggggcgggucuaagcagaggggaccugggcugagguggauggcgaaccauggggaauaaauaguuacucucugaagaucacccggccugcccuuucccacugcuuuccucagcuucccaaugucuacccaagcagugaaaacagaagacaacucaugccaagcauugaaaagacuaaacaaacccacucaucuucacaauaaccuacuaucuuuuuagcuuucuuuuauggaccagagaguuuauguuacuugccuggggucacacagccauccggccaagugacauggucucagugucuguacucaggaagcucucugcaguacccauuucuguagaagcgcuggcaccaugagccagaagccccagcgucauuuucuccgccguaccccagugccucaggccggcuuucucacuaggcucgcgggguccuguccaccauuguccucucccauccgguccuccugcucggccuucagcucuguguccugcaguccagccaaccaaagccccccacccccuuguggaguucaccaucaucccuaccacccaaagacugaggcagggggagggacgauucaaagccucccugucucaaaaagccaacaacaacaacaacauaaacuauggcaaauccccauaacugcccacgagaccucaaaucggggcuaggaguauuuuuuuguuuguuuuucuuuuuucuuucuuuuuuuuuuuuuuguuguuguuguuguuugagacaggguuucucuguauagcccuggcuguccuggaacucacuuuguagaccaggcuagccuugaacucagaaauucgccugccucugccucccaagugcugggauuaaaggugugugccaccacugcccggcaguucaguacuuguuaacugaauuaagacaccaguguuaagcaccucaaaagauauggucugagccuggggaguagcugaugcccaagcuauauuagauaaucguuggacuuggggaauaagaguggaggaugggagagguuccucucccugugucccccaauaguuuauaccucuccugcagcuccggggaaccuuguacaacacuggccgccaugucuccuuccuaccugcaucccgaccuguggucaacgugucuggggguccccuucuuuauagccaccgacucagugaacugcgccugcuauuuggagcucgagauggugccggcucugaacaccagaucaaccaugaaggcuucuccgcugagguggugaccccucaccugacccuccaacacuagaucacccugguuucuuagcuuaugcuucaacccauccugcuacucagggccgccucucccuacccuaaguacuaauuccuggugcgguucuggacaccaaagcccugagaguugaaaccaucuaucgucucugaaucuuccgcuaagaaacccuucucugugccuccucuuccaccccaggugcagcuaauccacuucaaccaagaacucuaugggaaccucagugcugccucaaggggccccaacggccuggccauucucagccucuuugucaaugugagggaggcaaggagggcaacuggcuuccagggugugagggacagggaggcugggaggcuagccugggguggugggucuuuguggagcaggucugggcugccgucucccucgccucgugccuccugcguagguggcuggcaguuccaacccauuccucagucgccuccucaaccgggacacuaucacccgaaucuccuacaaaaguaagucccccaagcuagggguggcguccccaguuccuaggaaggcugaggaaggagggugggcuacagaguaaguucaaggucagccugggcuacuuagcaagagccagggugacaacagaaagggaagagugguuggagaugaugcagcuuggucacgagcgccuggucagaaucucccggugaggggcugggggccuggugcagugguaccugccuagcauguccgaagccuuacauucagucuccauacgacaacagacauaacuaagucccugugcauuaucugggacccccuuuuacgcugacuugaugucugcgcagaugaugccuacuuucuucaagaccugagccuggagcuccuguucccagaauccuucggcuucaucaccuaucagggaucucucagcacuccuccgugcucugagacugucaccuggauccucaucgacagggcucucaauauuaccucccuccaggugacugacacccccacccccccccacccccgugugugcaugcuacuccuguccugagcaccaccccgguccacucacccgugguuucucuugaggcagaugcacucccugagacuccugagccagaauccccccucccagaucuuccagagccucagugguaauggccggcccuugcagccccuggcccacagagccuugaggggcaacagggacccccggcaucccgagaggcgcugccgaggccccaacuaccgccugcaugguaugcuuaguguguccccuccuucuccacguccugauagucugcacuuauucccagugguugucucagugugauacaucccuuguccuuucucaccucuccauauggaacagccugcugcagcccaccccucuuugcagcuuagucuaaggccugacacccuguuuuccuugugguacaauuacauacugguccaugcccucugccuacuguuacuugccaagaugguacgguccaggucaccuguuuacaaaugguaugacccuacuuagagcuguagucuuucugcuauucccuuucugagaaucagcgugguacaaucccucugucuuucuuacugccacuguggcucggccccgggaaaucgguuaguuucuugucugguuucucaacaugguacagcccagaagaccauauccucuccauguaccuuuaugcaaaccagccuauucugcacgucccauguggccuucuucccucccuacauggucugguccaggagcugaucauucccccaacuugguauauuccauucccccuuagcagccugacuaguagaguccuaugugcucagcucccacaccccucaagccggugcuucccuuugcaguggacggugguccucacggucgcugagacuccccaacgaggauuacgcccgccuguucugaguuuccucaccaggggaggggauucaccccaaaacaaagcuauuaaaaggacugaauguuuccgguuucucggugguuuaucagucgcgauugaggaacaucuagauauuaaaaaaaaaaaauccuucccgaag

SEQ ID NO: 3807 - RNA, 4842 nt, Mus musculus
cuucgggaaggauuuuuuuuuuuuaauaucuagauguuccucaaucgcgacugauaaaccaccgagaaaccggaaacauucaguccuuuuaauagcuuuguuuuggggugaauccccuccccuggugaggaaacucagaacaggcgggcguaauccucguuggggagucucagcgaccgugaggaccaccguccacugcaaagggaagcaccggcuugaggggugugggagcugagcacauaggacucuacuagucaggcugcuaagggggaauggaauauaccaaguugggggaaugaucagcuccuggaccagaccauguagggagggaagaaggccacaugggacgugcagaauaggcugguuugcauaaagguacauggagaggauauggucuucugggcuguaccauguugagaaaccagacaagaaacuaaccgauuucccggggccgagccacaguggcaguaagaaagacagagggauuguaccacgcugauucucagaaagggaauagcagaaagacuacagcucuaaguagggucauaccauuuguaaacaggugaccuggaccguaccaucuuggcaaguaacaguaggcagagggcauggaccaguauguaauuguaccacaaggaaaacagggugucaggccuuagacuaagcugcaaagaggggugggcugcagcaggcuguuccauauggagaggugagaaaggacaagggauguaucacacugagacaaccacugggaauaagugcagacuaucaggacguggagaaggaggggacacacuaagcauaccaugcaggcgguaguuggggccucggcagcgccucucgggaugccgggggucccuguugccccucaaggcucugugggccaggggcugcaagggccggccauuaccacugaggcucuggaagaucugggaggggggauucuggcucaggagucucagggagugcaucugccucaagagaaaccacgggugaguggaccgggguggugcucaggacaggaguagcaugcacacacgggggugggggggggugggggugucagucaccuggagggagguaauauugagagcccugucgaugaggauccaggugacagucucagagcacggaggagugcugagagaucccugauaggugaugaagccgaaggauucugggaacaggagcuccaggcucaggucuugaagaaaguaggcaucaucugcgcagacaucaagucagcguaaaagggggucccagauaaugcacagggacuuaguuaugucuguugucguauggagacugaauguaaggcuucggacaugcuaggcagguaccacugcaccaggcccccagccccucaccgggagauucugaccaggcgcucgugaccaagcugcaucaucuccaaccacucuucccuuucuguugucacccuggcucuugcuaaguagcccaggcugaccuugaacuuacucuguagcccacccuccuuccucagccuuccuaggaacuggggacgccaccccuagcuugggggacuuacuuuuguaggagauucgggugauagugucccgguugaggaggcgacugaggaauggguuggaacugccagccaccuacgcaggaggcacgaggcgagggagacggcagcccagaccugcuccacaaagacccaccaccccaggcuagccucccagccucccugucccucacacccuggaagccaguugcccuccuugccucccucacauugacaaagaggcugagaauggccaggccguuggggccccuugaggcagcacugagguucccauagaguucuugguugaaguggauuagcugcaccugggguggaagaggaggcacagagaaggguuucuuagcggaagauucagagacgauagaugguuucaacucucagggcuuugguguccagaaccgcaccaggaauuaguacuuaggguagggagaggcggcccugaguagcaggauggguugaagcauaagcuaagaaaccagggugaucuaguguuggagggucaggugaggggucaccaccucagcggagaagccuucaugguugaucugguguucagagccggcaccaucucgagcuccaaauagcaggcgcaguucacugagucgguggcuauaaagaaggggacccccagacacguugaccacaggucgggaugcagguaggaaggagacauggcggccaguguuguacaagguuccccggagcugcaggagagguauaaacuauugggggacacagggagaggaaccucucccauccuccacucuuauuccccaaguccaacgauuaucuaauauagcuugggcaucagcuacuccccaggcucagaccauaucuuuugaggugcuuaacacuggugucuuaauucaguuaacaaguacugaacugccgggcagugguggcacacaccuuuaaucccagcacuugggaggcagaggcaggcgaauuucugaguucaaggcuagccuggucuacaaagugaguuccaggacagccagggcuauacagagaaacccugucucaaacaacaacaacaacaaaaaaaaaaaaaagaaagaaaaaagaaaaacaaacaaaaaaauacuccuagccccgauuugaggucucgugggcaguuauggggauuugccauaguuuauguuguuguuguuguuggcuuuuugagacagggaggcuuugaaucgucccucccccugccucagucuuugggugguagggaugauggugaacuccacaaggggguggggggcuuugguuggcuggacugcaggacacagagcugaaggccgagcaggaggaccggaugggagaggacaaugguggacaggaccccgcgagccuagugagaaagccggccugaggcacugggguacggcggagaaaaugacgcuggggcuucuggcucauggugccagcgcuucuacagaaauggguacugcagagagcuuccugaguacagacacugagaccaugucacuuggccggauggcugugugaccccaggcaaguaacauaaacucucugguccauaaaagaaagcuaaaaagauaguagguuauugugaagaugaguggguuuguuuagucuuuucaaugcuuggcaugaguugucuucuguuuucacugcuuggguagacauugggaagcugaggaaagcagugggaaagggcaggccgggugaucuucagagaguaacuauuuauuccccaugguucgccauccaccucagcccagguccccucugcuuagacccgccccacugcaaagcuuaccuucucucccccggugcugagucugagcgggggcagaaaagggucauaaagaacccgcuucagcuccacauccacggggcucugccgcuuccccacagcgcacaggcuccaggcagcguucaccaggccccagaagggaggcccuaugggaacagaaauaggcuggauuccaggcaggaccugcuguguggauuggggcagggauaaccccagcugaaggaagaaaacgagggaggaaaucaggagcuuugggucuaagagagaaagaacaugagagccagaauccugauuccucgaagaauuuuggaaucccuuccuaggagcucauaacugcuccaagccuuguucccaucuuuaaaagggcuaugugaaaacagaacuacaacucccaguaagccucaggggugaaaacaacucaucaaucuccggccugccccguagccccaugggaguuguaguucuuuuagucucccaggucccacagcuggauaagaauauuaggggagaagaguuauaaaagaggacuucgaagccccgggcgagggggcgggacagggacccgagcuaccgagugugugccuuccagcaggaauaggaccugucuauggcugcaaacacacacauuucuccacccccacacuuuccuugcacucacucccacucacuacuugaaaugcgcauguauaaugucccauggugagccgcugagguucagaggcugggccccacuccugagggaagaaggcaggggcugggagcuuugguccuauggaagaugagaagaucgaggacccagacuccugagccuaggaaaaacggcgccuagggauauggggucgggcucugggucuccacccuguuugcaccuggcacgaaguuucccuggagauucuccuuguagcuccaccaguccucgggaucaggugcagguccgaugugagcugggaagagagcagcugcaucccucuccuaggcaccccacccugucccucccucagaggaugcugccaggacccccaggucuuaccugccgcucccagugcggcccagaguaccagcgcuugaggggcgcucaggcgagcggcaccccccauccaagaggccucggagcgacccuuucccagcgcccgacccccuagcucuucccuccccuccucuugggacuuccagccuggcugucaccagaacgggagccccagcucccgggauacaggggcugggaccguguaccccagagcccguuugacgcucacuccuccgcccgccugggcccgcucccugcacucgcucuaccucccgaagcugcgaucgcccucgccggccccgggucccucucggugccaaugcacaccccuucuucgcucucaaccagcgaacccggccgcgcacucgccgcgugcgcuccucucccuccgccuccucccucacccugccuucucuucuucccucuguccucuuccuccucccuauucgacucugccuucccuucuuccuucuaucucaccuccucccucacccugcgcug

SEQ ID NO: 3808 - RNA, 5082 nt, Mus musculus
gguguuuugguuuagauuuuuuuuuuuccgcgaaagaaguuugcuuuggccacgccucaaggcugccaccuccuccugcccccuccuccgccccugggugcacaccucugggugcagauugcaaagcuccuuucuuugcgagaagugcaaaauuggcuagagccagagacucgcccacuugguacagaaggagcgcgcgccugugucccuuggggacccacaguugcaaagagacagcugcuugauuuggucacccacucgcccagacuauaggagccucccgggacagucuuugaguugcaccuuucugcagaacugacugguugaacccccgcagcgcucuuaggauuugaagcguccugauccuggaggcuugcacgccgcgcucucccgacucugggacacauucgcccgaaccacuggagugugcgggugacugacauaucaucucaucucuucgacucuccaugagcucaugaaccugggagcagguccacggcaauggcgcggccucugagcgacaggaccccgggcccccugcugcuggguggcccggcuggggcccccccuggcgggggagcgcugcuugggcugaggagccuucugcagggaaacagcaagcccaaagaaccggccagcugugaguucuagucccacuguguuagggacucaacuguugggguggugguccacggcaccuaucagcuaggugucccaucuuugcuagucuucauuaggucacuuaggucuuccaguccaucagccuccaggaccaaaucugacgccuggagggccuaagggucaagucccuggaguguuccuacuugaggacagaguuuaggugccagaccccucuuucuuuccuuuggccucagagucuggaccccuggaguccuaggggaagggagggggugugucggaugcucacacggugcagacacgggcuugggcggggccucgcagggucacauggaaacuagggaugaggaaugugccugagcaguggagccccuuccagccccaacagacugugggggaggggaugagggugcugggggugggagaauuacugagcugucacuuuuucuuucucaccugcccaaccuuucacccacccugucacuaaacccuucuuucuaaacuuccauccucguucucugggucgcuugugcuuguguuucuuaauccccucccgggccccuaacccuauccuucuguauacuuuugccuuuucccccucuccggguccccgucucccugacccucuauugcuggggccuuguucucuuuucucucugggucuccccaagccccgucuuuaucccucucuucuuuuucuggguucucucccugccuguacccaccucccugggucuuugcccuacggcucccgucuccucacuucucuguaucuccgccauaucucuaacuuggggucccuccugugucccuccaccccauccggucucucccuggccuacaggucuccugaaggaaaaggagcgcaaggcaacucugcccucagcccccgucccgggacccggccuggaaacggcgggcccagccgaugccccgaguggggccguuaguggcgguggguccccucgggggcgcucagggccuguggcuggcccgagucuuuuugcgccgcugcugugggaacgcacuuugccuuucggggacguggaauacguggaccuggacgccuucuugcuggagcacgggcuaccgccgagcccgccgccccccgggggccugucgccggcacccucuccagcgcgcacucccgcgcccucccccgggcccggcucuugcagcuccucuuccccccgcuccucgcccgggcacgcccccgcgcgggccacucugggagccgccggcggccaccgcgcaggugcggcgaaggggcggggcugucgggcagggcggggccucgcgacacuuuuggaagucugcccaaugagaugcugcgauccuuuaggggacuuggguccccaaaugcgaaaggauuauucacugagaggcaguauucuucucuaagacaaguuuccucauguucuuggagccaagacuagaaacuuagaacaccuuaguuaacuggagaguacuaucuccagagucuggguccagaauuuugggaaacgagaugggacuggacuucaaggacaccaaaaaugggagcgagcaggccagagcgggguacuacguucccggauccuacacacgcacacaccccauuccccaaguggaugguguugcauccugccucccagucuugcagaagagaauaucgggaucccucuucuggcuucuacagaggagcuuucccaugucccuguguuggggaccuaggaucucagaacugugggaaucuggauggcaaagagcuuggcaggccgguucucccacgauccucccccauagcgcgggauggguggguagaaucauuguagauguuggagcugagaccaaaaggaacaagaagggaggcgaccccaaucaagacaaggagucucgaugugggacgccuggguacaccugucccugauccgaccuccaggcaaaaaccagugcugcacauucccucgccacgugaguccgccuuccuagcugcgcgcacgcgcucucacgcgcgaggaggcggggccgggaacgugcgggugcuugguuggggaggaggggaaaggggaagcuguaggccacacgugaugcggcccugaacugguguccucggcugacccgggcuuauuuguucuuaaagacacaggacucaaccuuuuuuagccaggcucuugaaacuuccaucacuccuaggagugcuggucuaacaggucuaagcucugagaaaggguucaguaaguaggacucggacacagcagugggaacaaaacacugagucugaaguuuagagguuuuagaagauucacgggauauuuaaggccagucauuucugccuuacaaugauagaauugccuuccgguggcaaagcaucuuugucacaggguuuaugccugacaggauuuguguuaagacagcagaaaaaaccuguucugugguggauaagcuuggcggagcggugcucugagaacgcagaccucgaacuacucacacauucaagcgauaacguauuucucuaggcuugacaucuagggacacacccaguccuguggacccagacaccguggaggugcuaaugaccuuugaaccugaucccgcugaucucgcccugucaagcauuccaggccaugagacuuuugacccucggagacaccgcuucucagaggaggaacugaagccucaaccaaucaugaagaaggcaaggaaaguccaggugccugaggaacagaaggugagcgcgcccagaugugggccuuggccuugcucaaagcugagggaagcuucucucucuggggaggaggucucagagcuucguggccuguaggcauagccuagcucaugaggcuucuggggacaaguuuuguccuaagagucaagucucccugugcacaagggcucagguuccaagaggcucugcugccaauuacagcucucauuggcugucccaucggccugcugcucagcggcuggccucgcuggagcugcucuuuggcuuucaaccugaaacaucuguagaacugccucugccuuggugcagacuugaccauccagggaccuggaagucauccuuuaccggccauauucuaauuuguggggauuucagcagcaaacaccuuuuucuagcauucugguuuugcucugaggucucucaugucuuugccauggccuuguaugcaucauagccauuccaacaucuaguuccaucuaagaaaccuauuccaugcgagugguuuucuucugcuacagagcucagcuguugcuaggagauggauguguccuaacaagcuggagccuuuaauuaagagggagccuagggaagcaucuuuuccagcugggugaaggacccaugguaugauccucaggggaagccucagcccccaacucuuccaucagucagauacggaauggcucccugaccucaguucaaggguagaggcugcggcuacuuacagcucauguuuacuuucugaugagaugcgguugccuuggcaaccaggacaccaaaccccaucacuaggggagcuauccaaccuuuccuuagcaaccaggaucuggaaaggugaugucuagagcaguguacacuucagugagauaacccccccagaccgugaaggccucguugcuagguaacaaacauccauagcaaccggcuuuccauggguccuugucaaguggggagucuugcucugucugcacaguggagaauuugaagaccagcuuuuuucacaugugcaccuggaaucuauuuauucucuaccuuuccgccagagaccuguucuuagcaaccagagcaguagacaacagaaguuuggguuucugucccagcaaagaccaauagcccuuaggccucacugcuguacagaaucagauaugcagaguuccuuuuguuguaucucagugccccuuucaccccuccacccucaggaugagaaguacuggagccggagguacaagaacaaugaagcagccaagaggucgagagaugcaagaagacucaaggagaaccagauaucugugcgggcugccuuccuggagaaggaaaacgcccuguugcggcaggaggugguggcugugcggcaggagcugucccacuaccgugcugugcuuucacgcuaccaggcccagcaugggacacugugaggccaccuccacccugccagggcagaguccuguuccuugcucagacuuacaccugacuuccuccuugucccauggccaguggucuggccagcuaggugcccgaagaacgucaugaugcagacaaauacauuuauauuuuuaagaaaaagcuagccuucccccaccucccuuguggggguggggaggguccugugugugcucuuagcauguuggggaacccauccauccaaccgccuccaucaacacaauccugaauaaaucuugagaacccgggagccagcuguuguggcggacaaagcagcuacuggcucugacucaaggcug

SEQ ID NO: 3809 - RNA, 8542 nt, Mus musculus
uuucacaugugcaccuggaaucuauuuauucucuaccuuuccgccagagaccuguucuuagcaaccagagcaguagacaacagaaguuuggguuucugucccagcaaagaccaauagcccuuaggccucacugcuguacagaaucagauaugcagaguuccuuuuguuguaucucagugccccuuucaccccuccacccucaggaugagaaguacuggagccggagguacaagaacaaugaagcagccaagaggucgagagaugcaagaagacucaaggagaaccagauaucugugcgggcugccuuccuggagaaggaaaacgcccuguugcggcaggaggugguggcugugcggcaggagcugucccacuaccgugcugugcuuucacgcuaccaggcccagcaugggacacugugaggccaccuccacccugccagggcagaguccuguuccuugcucagacuuacaccugacuuccuccuugucccauggccaguggucuggccagcuaggugcccgaagaacgucaugaugcagacaaauacauuuauauuuuuaagaaaaagcuagccuucccccaccucccuuguggggguggggaggguccugugugugcucuuagcauguuggggaacccauccauccaaccgccuccaucaacacaauccugaauaaaucuugagaacccgggagccagcuguuguggcggacaaagcagcuacuggcucugacucaaggcugcauccaagcugggugcugcugcuacccuuauaggaccacaauaacugaaagggaugucggguggaaggggugaaggccuagagggaagcaacaaccuuuauugcauagaccuuuucaauugcuuuuuagacuagggagagggacacacaagacacagaacaucccaucccuaacuggccaggggaggaacauuagugcaaaucuggggaccaccugggggaaccugccccucaagggcugauuggccagucaaguagaggcaccggaguaggcaagaagaaacccuggcuggucaauaagcugaagaagccuugcuagcucauacauuccaggccccaucauuggacaucaagaaaggcaggccccacccucgagccucuagguccucugggaacugagggucaggaccacucuccacccuccucacaguucugagugcgggccccacuucuaccuguaaaugauagaucuuagccuauggggcgcugguuccaccaacucgccaugcuuuuaggcucguucaggcuuguggcuuuugaccugcaggcccagugagcagcguggcgagaccugggugcaccugcgccuguauuggcccauacuccacuaacuccccaucuacagugagcaggccacgaggcgugagugguucaaggcggaaggcacgugcugcagcauagcccagaugggggcagcccaggcugaagugguuuccaugcuccauggccagcaaaaugcguagaagugcagcccgugagaugccgcuccgcacccaacacaggugcacaacgccaucaucaaagcgugcauguggggcugccaucaggucugcgcagagguggcucggcaagaugcccaacaugaguacaaacucccccucuauugucacccagucuuggggcaguggagagcccaggggagggaggaggugguccacugggccccagguagaggcuucuggggcacugugggugggaggcaggaaccccgaagaugcuggcauuucugggggcccuucagcgaugggugaaagcugagcuguuuugagagcguugggggaugaaggcagcagugggucuggggacagaggugcauccccagcuccuccccagucuccagucagcucuggaccaccaccauugagggacaggucaggcaggggcucaggggagccaggggagaccaaggcaggcuggggaaggggcaggggcaggucagacacagaucgauguagaggcgaguggguggcggcgggggcuggggcuggagccaagacuaguucugacuuggcucgaggcagacuguggccugggaugggcaaggcugguucugugguagcggggagguaggagaggcguccacgguagguaugcaacgaggccaggccuagcacugcacccagugugaaucgagcgcugcccagggcccugaagcgcucacugugaauguccacaucugacaagaauccccaggccacugacaggaaggaaaaacagcgggaucccgaggcuagcgucacagagagcagguccagaggauggcugccaccacggcagagaagaagcgagcaguugagcaacaggucaacaccgacaaccugcucaaaccuucaaaaucagagaaaggugucacaguggggaagaggaacggggagugagacaagaaggguaaaggagaaaggcaggggcagccgugccaucagggacacaucccggagcccuguaagcacccgacggaagguggucugcagaccaggguaaggggcagcaggaugaugagaugauaucaagccccguagucccaaagacucaucccucucuuuagcagguaucccucaggaguagucaacguacccgccaugaugguucaccgccccagcuagcgcauugcccgauccacaggggaggacaccaaugggcauccgcacggcauccucccagucuggccgaucaaggagcccauucagcaccugcaguugggagaggacggccugggucccggccucccucuucaguuccccccagggcagggccagggugucugcaggucuaccucguaaagcagcccgucuccagacacagugacaaugccuucccacucacucaggcuuaaccccugcaccagcucacgggcaugguucugucguucuaagggggcaaaucaaaagguuagucgggaggccuccucauccuaucccgcccuccagaaaauccaggagcaacccucuccucccuacugccagcagcccuaccugucuguaugagguugaaggacagcccagcuucagagaucauuggcaccacgugguccauacagcgcugccaggccaggccccgccccccaaagggauugaccaauaugagcagccugggcuuccggggcagcaauucaggggugauuucugaagcagagagaaaggaagggcugaaucuuggagaggcuggagaucccgccuccucccuagcaacaguaucuguaaaugggucccaaggcuacuugauaaggaaaggagagguucccaaggccugcugggaguuucugccucccugcugucaccuggccagugaggucgggccaguuuuuucucacuggugcuaagacaaagcguuaguugugaaagcaaguauaugcccuuugaaccaguauguggcaggugggaaagacaugaucccuugucaacuguuaaccaacaucggguuccugucagugagccccuaagcagugagaaucacacaggaaagaggcaggcacccugggugagggggcgcugcuggaaagccuccucuuuauguagaguggagcuccaggaccucugagcugccugaagguccuagugaccuggguuguaccuggcauucucagccuccugcuggcccucgccuggcagucuuacucagcugucaauggaggggcagacaauggcgccaacagcagaggcccuuacugggcuucucucugcugggucucauucuucugagacagacccaaaagauacaaagcacagacguacggggacacauggcaacacccauauggcccuggcccagcaucucacccugguccccugacagaggcacuccucggaggagacacgugagggcaguggcccagcgcugggccucugcacgauucuccucauaagugguggccccauccgcccggaagguccgcguagcucugcgccggcccccucgacggccacguggguagguguagaugcagaaguaggcugcaguguccucggggcuacggcucugcagggugccacagcccgagaccucauccagagagacuagaccaucucggggccgggcuucuggcuuugggcguagucgcuguauguguagggcuuguguugugagggugagggcaaaccgugggccguuggccggguaggaaccaaacucgccgugcaggauuggagugcuggcagccacuggcaguaguggugguggggccaugacccugguucagucccaagcacuccuaggcucuuggcuuguggucagcuccuggaccagccucuguggggaagaaggaagacuguggucagaacccagguuccccugguacgugggagacaggagagacgugugaaaaggagacggaguguaggaaaagaguaccuuagagucagaaaugcauagauugggggggggugagaugccugugugcagguaugaaauuauucaggacucuguugcaacaacuaguuaauaaauacucccugaaggucaggcauaguggugcauacaggcagaacuaggaaaucaaaaacacagguuugaggccagccgggggauaucuuguuucaaaacaacaacaaaacccaugccaaucagaagaaagagaaagcaagcaaccugucagacuagagggcaaacaaaggcuuaagggagaaagacacuggaugacagaggcaggaggaaaauaggcugagagggaagacacuguccccucccacacaccgagucacugccggguggagagaggagaaccacauagacacacaaagaagaaagggacagcucugaaaagcagagacacugaacaagcaccagcuuuggagguacaggcugauaaauacuugaagccgggcagugguggcucacgccuuuaauccaggcacuaaggagguagaagcaggcgauuucuguggacuggagggcagccuaguguacagaguugaguucaggacagccaggacugugcagauaaacccuauggggaccuggggagggggaacuuaaaaguuucucucuccagugaagaaaaccuguugcuuuccugccuguuacagaagggaaagaagaugacacacaggucugagggggagccaccugugggagcccaagacagugaccaccagcuugucugacuggaagcacuaaccugggugucuggccgaguuuccuccaggaagagggugagccaggacugagccccuucuugguccggcucgucagaagguuccaaccuucuaacugcucaccuuugggcaguucaacccaguugccugacuaguuugucaccuuucucagucuugcagcagccugggacacgcccccaugaauauucucccucaggaucuaccucugcccgcugcucugggccacuccuuuaaugcccauguaucagccccacccuuaaaaccuguagggaccggucugaggcccucaaaucagacacuagcacagagcuuaugaaugcuccauucuaggcugggucuccgucucccaggaccccagaucuuggcuccacccacaggcucccggcccaccaccgauuguccccggucuccccagccgguacaaccacuccagggccgcaacgcaggaccagaucugagucucuaucccggggccagaccugguugccguucccagauuucucccaguacuucgcaccaggccugaguguccgccccucuggggucacccccaaaccccgcaaccugcgugcacgcugcgucguccggcagccccuccggagucugcacuaccgcccccagcuaggggugggggaagggugugcguccguccagccaauggcugccccgaauccgagccgcaccaaugagaggacaggggggcggaggcauccgccuucauaacuacgcgccggggcuaggcggcggucgacggaaaucgggcggggcuccagccgagcuaggcagcucccauuauaagugagggcacacuggcagcagaugaaaggacguggucgaaugcaaagcuuaucccgccaucuuuguugaggucaaaacaagcccuucccaacagagucaauaaaaagggguguggaggaguuccucaaccaacucuccaacguugguaacagagauagaaacugagaugagugugaugguguccuguaaucuuaaaaacuagggaggcugaggcacaagcaucaggaagugcuagagcugccucugcucuuagagccagucgcgugacaccuugugucaaacaaaccccagaaaaugaucgacacagguggagaccauucuggaaugaaccaggcucgggaggcucauggacuuacaaacugauuuggacgacagccuuccuggaggaagaaugagauuaacaucccaggaaaccaccaugugacaagacagccccagaaagcagcauagguaagggaaagcauuggaaacccagagcugggaaggaacugagggccaggaaaaaaagagguggacagagacaggcaaggaaagggcggcaggagacacaaucggguguaugggugugugcgcacaaacacuggugucuaaauguaccucucacacgcuggucuaaauguaccucucacacgcuggacaaagcgugcucacacuaaccuacacucuguuaaggcagggacaaaacuucuuaggcaaaaaauaagaggaggagggagucugcuuauugccaaauaccccuugcaucgcauccacagcagcauucgccccagauaacaugccaagagguggagcucagggagaugcagaacccgggauacagccagagcgccgcgaaaacccugaccaaagaggcugaaacgggaacaggaaaggggaaacgcuaacucacccaaacugagugaccucgcccugcggagcccucagaagcccagcugagagaaaaggacugcucacccugcccccaggggaagucuggggccagcggcagaagggcccugacagacauuaucaccccugguaugacaaccacagacuucagaccagugcuucucaacauucacgaugcugggacccuuuaauauaguuccuuauguuguggugauccccaaacauuucauugcuauaacuguaauuuugcuacuguuacaaacuguaaauaugugguauacaggauagcugauauacgacccugugaaagggcccagacccacagguugagaaccuauucuguagcuagagccuuaccugguuccauugccccuuggauuuagguguccagugggcacccaggccucugcugucacagcagggcuugagccccaaacuggaggccauguauguauaggcgguuuucguaaagagucuugcuaacucccugugcagggccagguugggguucugaagaggagggcacauugcaggcucaguaucccagagccugcuucucucauccagcuggccugucuuguacuacccaaguucagguacuccauaccaaaagagugaagacacuuucagggaagacacccuaaaagggagucuuuuucaucacucucuuuuuccaaacaaggaaaaaaaagcaaaacagaaaaucacuuacccaagaucacaacuuuaaauggcagagccaggccaaguguugaaagacggugaucccagcuacuucggaggcugaagcaggaagagugagucaaagccagcuggggcaacuuugugaaaccuugacuuaaggggcgggggggggggugagugggggacagagcuggcacuagaacuagcuuacuaaauggugaggugccaacuguucaguuuuguaucuuugucucuccuucugcccgggguucccucaccauuuuuccuucucacccucgggccuccacaccuccaaccaccgucauggucucuauuucagucucucuggagcuuguuaucuacccgcuuuccaaaccgggaguucugcgugccuucucugcacaucaauauguacaucgaaaauguugggccaguucaaccagucugguuuaggaagggggaaaaaaaaaagggcugucccuaaggacgaaaacaaaggagagauccgagaagaggucaucuuuaagggcagggggaaaagcucaacacaaaauauuaaauaauaauaauaauaagguauuauggguugaauagcagcaagaaagucucgggugagagaucuaguaggauuuccugaacuucaguucuguuuaguaaguugagcauaaggaaaaggcagccgagaauuuaaggaagugugagaugagcuuuuucuucagggcgggauaagccucaccuccgacacacagcccaccggguccuccgcgagccaccgagaagcggucggcgugcggccagagagucaccacgcgacucguccagcaagcuccgaucaugucucugauucuccggucccuuuaccccuggagaguguuagagcagggacggggaaaggccagagaggcuccgggucccagcccuuuccucaggcugacuucucuuugguucuggaagccucgguuuacucgguccucccacauaccaucgagaaacccaaauugugguagagcuccgcgucgcgcucaugugacgucacccg

SEQ ID NO: 3810 - RNA, 710 nt, Mus musculus
aggucacugaguuccauggcccaaaggcuugugagcaggggugcuggcccaucuccaacccgaggacugaagagcuucugaaaaggacacguuguaucgggaacccgaaacacuccaacugcugacccccaaggccaggacgaggggcaggagguguuccaggaggucacacucggccauccaggaggucaaggaagcccccggccuggcuugggugcuauccacgccgccaggccaccaugguccuuggcuggccacugcuucugguguugguucuuugcccaggugugacaggcaucaaggacugcgucuucugugagcugacugacucugcucggugcccuggcacacacaugcgcuguggggaugacgaagauugcuucacaggccacggaguagcccaggguguggggcccaucaucaacaaaggcugcgugcacuccaccagcuguggccgcgaggaacccaucagcuacaugggccucacauacagucucaccaccaccugcuguucuggccaccuuugcaauaagggcacuggccuuuccacaggggcuaccagccugucacugggucugcagcugcuccugggccuguugcugcugcuucaauacuggcugugacccacaagaacugcagggccuagggcugugccccgggcuuccgccuucaucccuuucccccauuaaauggccagaggugcagucuac

SEQ ID NO: 3811 - RNA, 5787 nt, Mus musculus
ucagaggacuuguagcuuggugucuggggccuuauugugguccuuuauuacagcagaagccccagacccuccuccaguacaguaguggucagcacaggagggcaccccagauggcucccuacuuggaucucaaccaaaucuaacuggccagaaggcagagagagaauuaaauuccacuggagugacacagacccagacuuggcccagcuauggcaaaacccuuaaaguuccugaaguugaucaacagccagaauuaggucccuggucagagguccuuggggucaagccaggagucaacacugacaaaaaucucauccugaggccguaucugggacaggcaaggaucuuugccugcaccuagucuuugguguaaggcagggccaagggucaauccaaauccuuagagauaccaggucaguagaguccguuccuucuguuccacguaggccaguugaacaagucuuccuuccugaggugcagucuacaggccuaaugauccuugccaaguuaaccgauccaguucccauguggagccaagucuugaggccaaguguuggccaccucaaacacugauggugcggaagacggugaagccugacagggcggugcugaucaggacccccgggcacugugggugccaguguagcuccuucaggucagucucaccuuggugcacgaacagcaacugcugggggagugccgccagcccagggucugucucugucucccccgacucugggucccguucaacugccaggucccauugugugaucugguugucagcaccugaggcugcgaagaccccacuguccugagggugccauucaacagaggucacgggggccauauguugcuugaagguggccacaggggagccagacuacaagagaguguaggagucagaccucagugugaguaccagacucugucucagaagccccucccauacccauacaaagccagggcccaggaaagaaacacggggaaaggacagagguaagaugacuuauccuugggcugcuggaagcuuucauacaaaucagccuccuaacaaggugacaggagccugcccaugcaugucgcugaacaugccgcaccauuccuugccuauaacaagaacagagggguggucccuccaacacaugcuuggcugaucuuuuaagguugaagccuuaacaggaauuuaacaguuuccuuaagcucccugaugcuaccaaaagacagcaccuaaguuagaagaaguggugcuaggaacacaagucccuggggacguucguuuggcauggaggacugcaccucccucuggaagcuuccccaggacgacucuauagaacuaaugaaacuggaagaggcugacgucauggugaugcagggaaggccuggagccaggacaggccuggcuuccucuagagcuuggaaaugccucuuccaccggccuagaauacugaucagcucuacagccaacucuuaacuuagcugugaugucaccucugcuccuguuccauaucuuaguuuccuuuccuauaaggaaugaauggggcucaaaaucccaacuaacgcugaagcagacuaaaacacacuacaauucccagcagcccaaggccaugggcuacguggccagcuguaucucugccaaaugggcaaaugacaguuacagucucugaacugcccagcuggugugggggcaaaaccacuggguaccucccagugcagacagcaagaaagcaagcagggccacgugugaacgggaagacagauguaucgggugcucagaagucucaggaauagaacagagaagaaggggagagaugcgcaggguugagggagugaccccucugcucacacccacauccugcggugccuaccuucucaccaggauuuaaugcccagagcuucccagcccuuaggaacccagcugggaagauaccuuaaacugucgcaggucccagacuuugagggcaccaucauccccaccgcugagcaggaagggcucccugcggcuccagcugaugacauuaacaucuccaucaugggcaguggcuguggugagcaugcaggccuugccuggggcugcucggaugucccagaugcgaauagaggcaucagcagagcaggaggcaaacaccuaaguaggguccaacaaguuacaacuggaaagaugcccuaacccacaggcugcacugucauucacugucuccuugucugaucagggcccaguuuggguccccuucccucccaagccaggguucagguuccuaaccugcccucauccccaucagaccuacaugccuaggccuccagccuuuccucaccguguccucaguuggugaccacugcagauccuccacagaccguguguggcccacaaacggccucugguccacauuccaggaaccacccuccguggguguccagagguggacguucuucugacagucaccagucagcaagcggccuagacaaggguuaggaggucaccuuacccaccuggagggaaaggcacuucuugccuuuccaggaguccuacgacccauccucccugaaccaugagaaaauccaaacucaccgggcacccgaggggaccagucaagagcaaagcccucucccauguggccagcaaaggagaagauggguuuuauucgggccugcucaucucggaggaagauggccagggccugggggucauccaccaccugcaggagccgccgcagugcgaacaccuccacuuggcccuucucugaccauacuccagccacagguuccucccccagccaagauaccugccagagggguacacaaaacaaagaggggagaggccuaagguuagacaauagacccccaaaacuauaaccuuggcaugucuacagacaaauauaguccccagacagcuuuguaggaggaaacuacaugcucccagaccagcugauggccaggucaccuccuggcucugggaacagaaacagcaaaaggaugaagcucaagcucccaguggaguucuagaaaacacugcggguucuaccgcucucacguccuucccccucuacagucacuccaagauccuuaaacugcccuauuaccauagacaacacauuccucugaccaucuccacgguggcuaguuuuaugucaacuugacauaaacuagaguaaucugagagaagagcuucaauagagaaaaagccucagagacauagggcugcaggcaguaggacgcuuuguuaauuaggagggcccaguccauuguggguggugccagccuugggcaggcggucccagauucuauaagaaaacagcuuaguugggcagugguggaacacaacuuugggaggcagaggcaggcaaaucuuugcguucgaggccagccuggucuacagagcuagguccaggacagccagaacauacaaagaaacccugucaaacaaaacaauaugaaaaagacugaaacaagcaagcugaguaagccaugacaagcaggccaguaagcagcaccccuucauggccucugcaucagucccugccaccacauucuugcuguuucaguuccuguccugacuuccuuuggugaugaacagugauguggagguguaagccaaacaaagccuuuccuaucuaaguuacuuuuggucaccgcaucuuaucacagcguuaguaacccuaacuaagacauucaccuucagucuaaaacauugagacccauguuuggcugucuccuuccucacacccaucuacgcugcgccucucaaaacuuuucuaaccaccuguacuguggccacccuucccgugaguuguuccuuauguaaucaaacacuuuuggcucucugcagucaauuuuccacacagaagccagcgggagccucugaaaacaaguaccagaccaaucacuccucuacuuuacguccuccacuuauuccuaauuucuccugaagcagaaaccaagacuuacauuagcccacaagggcaaagcaaccagucuuccaggcgcucacccugcacaucugucacuguccccgcuuagucuauucugcuccacacacagucgccucuccaguuuccccugagauucugaaucaugugugccaggugcaccccagggucuuggcacuuucguuuuucuucucugcaaaucuguuuccacaaacaccccagcccugacacuugcugcaggucucuaguccaagaacaccgacuuacccaguccuccucaaauucaccauuuacaaaaaacaacucuacccuaggaacacccuuauacuaccacacucagcaucuuguaacaaacuacaagcuuucucuuguucccuuucccacuaguauguuauguucaugggcccagagcuuucugucuacaggcuaaaccuucugggaauaauguaacagauacagguccaacagagacagguccagcuacggguuggcuuuugcucuacaugcuccuuguauaccgucucccuuuuuugcucaucuaccugaucauaaagugcucuauuuauugaacuugaggugagcgcucuaccacuaagcugccuuugaacucauucuauccugccucaguuccuaagcaacagcucaguaacacccuugcguuucaccacaaucaggagcuguuucagccuuuauuaucuguuuaucagcucauagagugaaaaugucugaaaaugaggggggagggagagaagcugaggggcuggaggagguacugagagacauuuggaucuagggggaggggugugcugcagagaauccuuaacaagccccuggaaagacuguacccgaacucgguugaugccaccguagugaggaaccauggccaguuccagcugagguuucugcuccuccucauccucuucaucuucaucuuccucaucgucaucacugcccucugagggugacggccuggugccauggagauugugcauccgaagcaucaucagucuggggaagcaaauacggguuagaaacugagugccgggauguugaaggaggagggaggcuggggucccagacuuuuaggucuggcauuagcagagagcccuaaugcguggggccuuguggaugucuugcaaagguccugggucucaccuauugcucugggcgcucuccgccuggguucccgcacacagguaaagacugagagggagcucuguccgguugucgcccaagugaucucgaacuaugucaaagcugagacaaggggcgccuagggaugggcggggagauuagaguugcugaguaggaacgagagacugggaacucggccuccaccuccuccaaaggccggcagucugcagggucacaauccucagacuccagacccuucgucccccagaccccaagacaggccuuucauuucccuggacccgagagucaggucccucugccuaccaguuugcgcacgaugguacagcacguaggccucuucauccauuaccagcuccucucccucgcucaguggcggcccucugccgggcagguagaccugggaugggccuucgguuccugggucgcagguuucagccuccauggguucuccgguuucacacgugcgacuccggcccuugcgcgccgccaucuucgaaccuucuugccccggacgcgaagugagagcgucacuuccggguuucaccucccacagucuaagacccgucccacuguacuguuaccuuggaaaccugugaaccagccagaagaagguaaugcgcagagagauggccgccacaaaguaaccgcguccuggcucagugagaagacuuauauuaggagcaauuuugucuuucgugugaccuugggg

SEQ ID NO: 3812 - RNA, 5787 nt, Mus musculus
ccccaaggucacacgaaagacaaaauugcuccuaauauaagucuucucacugagccaggacgcgguuacuuuguggcggccaucucucugcgcauuaccuucuucuggcugguucacagguuuccaagguaacaguacagugggacgggucuuagacugugggaggugaaacccggaagugacgcucucacuucgcguccggggcaagaagguucgaagauggcggcgcgcaagggccggagucgcacgugugaaaccggagaacccauggaggcugaaaccugcgacccaggaaccgaaggcccaucccaggucuaccugcccggcagagggccgccacugagcgagggagaggagcugguaauggaugaagaggccuacgugcuguaccaucgugcgcaaacugguaggcagagggaccugacucucggguccagggaaaugaaaggccugucuuggggucugggggacgaagggucuggagucugaggauugugacccugcagacugccggccuuuggaggagguggaggccgaguucccagucucucguuccuacucagcaacucuaaucuccccgcccaucccuaggcgccccuugucucagcuuugacauaguucgagaucacuugggcgacaaccggacagagcucccucucagucuuuaccugugugcgggaacccaggcggagagcgcccagagcaauaggugagacccaggaccuuugcaagacauccacaaggccccacgcauuagggcucucugcuaaugccagaccuaaaagucugggaccccagccucccuccuccuucaacaucccggcacucaguuucuaacccguauuugcuuccccagacugaugaugcuucggaugcacaaucuccauggcaccaggccgucacccucagagggcagugaugacgaugaggaagaugaagaugaagaggaugaggaggagcagaaaccucagcuggaacuggccaugguuccucacuacgguggcaucaaccgaguucggguacagucuuuccaggggcuuguuaaggauucucugcagcacaccccucccccuagauccaaaugucucucaguaccuccuccagccccucagcuucucucccuccccccucauuuucagacauuuucacucuaugagcugauaaacagauaauaaaggcugaaacagcuccugauuguggugaaacgcaaggguguuacugagcuguugcuuaggaacugaggcaggauagaaugaguucaaaggcagcuuagugguagagcgcucaccucaaguucaauaaauagagcacuuuaugaucagguagaugagcaaaaaagggagacgguauacaaggagcauguagagcaaaagccaacccguagcuggaccugucucuguuggaccuguaucuguuacauuauucccagaagguuuagccuguagacagaaagcucugggcccaugaacauaacauacuagugggaaagggaacaagagaaagcuuguaguuuguuacaagaugcugagugugguaguauaaggguguuccuaggguagaguuguuuuuuguaaauggugaauuugaggaggacuggguaagucgguguucuuggacuagagaccugcagcaagugucagggcugggguguuuguggaaacagauuugcagagaagaaaaacgaaagugccaagacccuggggugcaccuggcacacaugauucagaaucucaggggaaacuggagaggcgacuguguguggagcagaauagacuaagcggggacagugacagaugugcagggugagcgccuggaagacugguugcuuugcccuugugggcuaauguaagucuugguuucugcuucaggagaaauuaggaauaaguggaggacguaaaguagaggagugauuggucugguacuuguuuucagaggcucccgcuggcuucuguguggaaaauugacugcagagagccaaaaguguuugauuacauaaggaacaacucacgggaaggguggccacaguacaggugguuagaaaaguuuugagaggcgcagcguagaugggugugaggaaggagacagccaaacaugggucucaauguuuuagacugaaggugaaugucuuaguuaggguuacuaacgcugugauaagaugcggugaccaaaaguaacuuagauaggaaaggcuuuguuuggcuuacaccuccacaucacuguucaucaccaaaggaagucaggacaggaacugaaacagcaagaaugugguggcagggacugaugcagaggccaugaaggggugcugcuuacuggccugcuugucauggcuuacucagcuugcuuguuucagucuuuuucauauuguuuuguuugacaggguuucuuuguauguucuggcuguccuggaccuagcucuguagaccaggcuggccucgaacgcaaagauuugccugccucugccucccaaaguuguguuccaccacugcccaacuaagcuguuuucuuauagaaucugggaccgccugcccaaggcuggcaccacccacaauggacugggcccuccuaauuaacaaagcguccuacugccugcagcccuaugucucugaggcuuuuucucuauugaagcucuucucucagauuacucuaguuuaugucaaguugacauaaaacuagccaccguggagauggucagaggaauguguugucuaugguaauagggcaguuuaaggaucuuggagugacuguagagggggaaggacgugagagcgguagaacccgcaguguuuucuagaacuccacugggagcuugagcuucauccuuuugcuguuucuguucccagagccaggaggugaccuggccaucagcuggucugggagcauguaguuuccuccuacaaagcugucuggggacuauauuugucuguagacaugccaagguuauaguuuugggggucuauugucuaaccuuaggccucuccccucuuuguuuuguguaccccucuggcagguaucuuggcugggggaggaaccuguggcuggaguauggucagagaagggccaaguggagguguucgcacugcggcggcuccugcaggugguggaugacccccaggcccuggccaucuuccuccgagaugagcaggcccgaauaaaacccaucuucuccuuugcuggccacaugggagagggcuuugcucuugacugguccccucgggugcccggugaguuuggauuuucucaugguucagggaggaugggucguaggacuccuggaaaggcaagaagugccuuucccuccagguggguaaggugaccuccuaacccuugucuaggccgcuugcugacuggugacugucagaagaacguccaccucuggacacccacggagggugguuccuggaauguggaccagaggccguuugugggccacacacggucuguggaggaucugcaguggucaccaacugaggacacggugaggaaaggcuggaggccuaggcauguaggucugauggggaugagggcagguuaggaaccugaacccuggcuugggagggaaggggacccaaacugggcccugaucagacaaggagacagugaaugacagugcagccuguggguuagggcaucuuuccaguuguaacuuguuggacccuacuuagguguuugccuccugcucugcugaugccucuauucgcaucugggacauccgagcagccccaggcaaggccugcaugcucaccacagccacugcccaugauggagauguuaaugucaucagcuggagccgcagggagcccuuccugcucagcgguggggaugauggugcccucaaagucugggaccugcgacaguuuaagguaucuucccagcuggguuccuaagggcugggaagcucugggcauuaaauccuggugagaagguaggcaccgcaggaugugggugugagcagaggggucacucccucaacccugcgcaucucuccccuucuucucuguucuauuccugagacuucugagcacccgauacaucugucuucccguucacacguggcccugcuugcuuucuugcugucugcacugggagguacccagugguuuugcccccacaccagcugggcaguucagagacuguaacugucauuugcccauuuggcagagauacagcuggccacguagcccauggccuugggcugcugggaauuguaguguguuuuagucugcuucagcguuaguugggauuuugagccccauucauuccuuauaggaaaggaaacuaagauauggaacaggagcagaggugacaucacagcuaaguuaagaguuggcuguagagcugaucaguauucuaggccgguggaagaggcauuuccaagcucuagaggaagccaggccuguccuggcuccaggccuucccugcaucaccaugacgucagccucuuccaguuucauuaguucuauagagucguccuggggaagcuuccagagggaggugcaguccuccaugccaaacgaacguccccagggacuuguguuccuagcaccacuucuucuaacuuaggugcugucuuuugguagcaucagggagcuuaaggaaacuguuaaauuccuguuaaggcuucaaccuuaaaagaucagccaagcauguguuggagggaccaccccucuguucuuguuauaggcaaggaauggugcggcauguucagcgacaugcaugggcaggcuccugucaccuuguuaggaggcugauuuguaugaaagcuuccagcagcccaaggauaagucaucuuaccucuguccuuuccccguguuucuuuccugggcccuggcuuuguauggguaugggaggggcuucugagacagagucugguacucacacugaggucugacuccuacacucucuuguagucuggcuccccuguggccaccuucaagcaacauauggcccccgugaccucuguugaauggcacccucaggacaguggggucuucgcagccucaggugcugacaaccagaucacacaaugggaccuggcaguugaacgggacccagagucgggggagacagagacagacccugggcuggcggcacucccccagcaguugcuguucgugcaccaaggugagacugaccugaaggagcuacacuggcacccacagugcccggggguccugaucagcaccgcccugucaggcuucaccgucuuccgcaccaucaguguuugagguggccaacacuuggccucaagacuuggcuccacaugggaacuggaucgguuaacuuggcaaggaucauuaggccuguagacugcaccucaggaaggaagacuuguucaacuggccuacguggaacagaaggaacggacucuacugaccugguaucucuaaggauuuggauugacccuuggcccugccuuacaccaaagacuaggugcaggcaaagauccuugccugucccagauacggccucaggaugagauuuuugucaguguugacuccuggcuugaccccaaggaccucugaccagggaccuaauucuggcuguugaucaacuucaggaacuuuaaggguuuugccauagcugggccaagucugggucugugucacuccaguggaauuuaauucucucucugccuucuggccaguuagauuugguugagauccaaguagggagccaucuggggugcccuccugugcugaccacuacuguacuggaggagggucuggggcuucugcuguaauaaaggaccacaauaaggccccagacaccaagcuacaaguccucuga

SEQ ID NO: 3813 - RNA, 3418 nt, Mus musculus
ucaggcucgugguuaaaugaauuuauuuucuaggggacacagugcucauucacguuuccgcagguggauguagacagugccgcugaccagagcgaguggaaaagccacccaggccagggcgaagcaguaaccgaagcugcccccacucgggugcuuggccaggaucuccucgguguggauggcauagaugagugccccggagaacacagcugcaccugcgggaccaccaacagcaguguggggcugggugcacaggaggccgcacuguccuagguccuccucaguggccucccagaaccacuaccaccucuggucccuaacugcucaucugugaaauaaggccauggacagcuguguauccauggaaccuuuuugaguuuuucaugagccaaaaaugcaagcaugagauaaaaaugaaggggguucucugggaacccaggaagauguuuucaaaaccaccaugauuaacucagcccuuugcaaccuggaaccaaaaaaaauuaaaaaaggaaaaauagaccugugcuuucagaucucauugaccuccccucacccccacacugucucaaaccucaauuuauuugaccuuaaaaaaaaaaaaguggggccaggcggugguggcgcacgccuuuaaucccagcacuugggaggcagaggcagguggauuucugaguucgaggccagccuggucuacaaagugaguuccaggacagccaggacuacacagagaaacccugucucgaaaaaccaaaaacaaaacaaaaaaaaaaaagugggacauaauggcccaccucugcucucucagcuacccagggugcuggggcaugaggauagaaaguucaaggucagcugggaccauuuauccaaccuauuuccaauaaaauaaauaaaaagaguugagagcacaugccuagaauccaccaguguggagcugggcacaugccucagagaugagaguccgucuggcacgccccguguuauagccccgguauugggagaauagaaaacaaacaaacaaaacgacuucuugaacaggugcccaagaaaccacaguuggcggauaugaugcagaacauuccuucuguggauccuuuagcugcccccaucccuggaacccagcucauuuaccaccacugacuucucaagcacuggcucaccgcagagccucuaaggcacacagcuccacucucccucuccugugggggccauggaggcugcucucaggagagggcugggagccuccaguggcccgcucccauuccucgccaccguuccccaagcugggggaagugcuuacuggugcaaagcuggcagaggccgguagcguagaagagcccuccgcgccgcaugguguagaguuggaacaugaagaggaugaaggacaggcagcagaggaugagagacagcaccaugagggccugcacugccuucagccagccuacagggggcgacacaggugaggucacagcuggaaccgcuguucccacuggcuggacucuacucacuguagguucagccaggcaagcuucagagauguccguguuacaaggauuacaaggguuaccagggaaacaucuuacugaugagccccauccccacacucacuggcggucacuucgaauccugaaaggaggcaggccacuccaucucuuagaacucuggccucucccuauucucccucccacaucacaacacucgcuccauuucuuuacaacucugaaaagucuucucagaauuuagggagcuuucuccccuguuccuuaagcuacagcauguggcuccaaccucucuggauuuauuggugccuuuccauccagacaagcugccuauggccaccccaggugcucauagccuagucuaggcucccaacccuggcccuggcaggccuuccccugcccucagccauaugcucaccauucucacugacguuacugcaggcccauguuugaguggugguguuccacgugcagucauaccacagguucagggacucuuugucugggagaguccaccaggacuggaagggacagagaccggggagggugaggugagacacaggacaaaagaugucagggagaguggggaugacuccugauggccaaaugcaugggcuaggccaggggaaaguacacacgcagaaguaagaguagggaaggggaggaguggggaggaggaggcacagagguagggaggaagggaagcagaggcagguagguggggucuuagagaugggcuauaucugggguucccagugagcuggaaacuuaccuuguccaaaguggccacaaaaagcaagacaagaaugaggauguggagggcagagaccaccaacaggaggagugacauggcugccagaugucuggcucagggcaggagaggcaagccugcaaagggugggagcacucaauccuaggggaggagggcuggagaauggcuuucuaaaucagagaggagggccagggagguagggaagucucuggugugagggagaaggggaguaggccgagcaguuccucccuggggagaagggcaagccaggggacuccugcucuuggaggcgggcagagacuguccuagauggacuuuugggagacagaggaacgggcaggacuaacagugagcuggugcaucuucaacacucugucccugggccgugugggucuccauaugaaccaucaggagcaggaauugcccccgggacaggcauccuugacucacugacucucuucuuucuccuggagugagucacgagugacucauccccccucccuccaacaccagggaaaugccagccucuggcugagucucugguccucacccgaccugacugcagaccccggcucuagacacucagggagguggauuugcagcagggaggguguggucugaguggagagaccaccuccuaccacccuucaguguccagagaacucagccagcccugggagcccuccugcaccccuucaucuaagaagggaguggaagaccccagggagaagccacaggacauucuucauggugggcucuguugggacaagucucauagacagcucuaagcucuccuguauucccacuacaaaggcugagagaucaguucuucaauuaccagucuccucuggagcuaagaguggagggucucuuccugccuaaggugccccgcccauggugccaugccgcccaguaaauaaagccccaucugaauaacggauugaaaaacuuaccgagaguugcugaagaagucagaguuggagucuguccucguugggccucuugccccgcccuucugcucccuccuuccacucugaggcccccgccucccucaccgccuuccucccacccuuuaauacccacccuucuccgucugccuucucccucccucccuuucucucucuccucuggugguuuucugcuucucucg

SEQ ID NO: 3814 - RNA, 3418 nt, Mus musculus
cgagagaagcagaaaaccaccagaggagagagagaaagggagggagggagaaggcagacggagaaggguggguauuaaagggugggaggaaggcggugagggaggcgggggccucagaguggaaggagggagcagaagggcggggcaagaggcccaacgaggacagacuccaacucugacuucuucagcaacucucgguaaguuuuucaauccguuauucagauggggcuuuauuuacugggcggcauggcaccaugggcggggcaccuuaggcaggaagagacccuccacucuuagcuccagaggagacugguaauugaagaacugaucucucagccuuuguagugggaauacaggagagcuuagagcugucuaugagacuugucccaacagagcccaccaugaagaauguccuguggcuucucccuggggucuuccacucccuucuuagaugaaggggugcaggagggcucccagggcuggcugaguucucuggacacugaagggugguaggagguggucucuccacucagaccacacccucccugcugcaaauccaccucccugagugucuagagccggggucugcagucaggucgggugaggaccagagacucagccagaggcuggcauuucccugguguuggagggaggggggaugagucacucgugacucacuccaggagaaagaagagagucagugagucaaggaugccugucccgggggcaauuccugcuccugaugguucauauggagacccacacggcccagggacagaguguugaagaugcaccagcucacuguuaguccugcccguuccucugucucccaaaaguccaucuaggacagucucugcccgccuccaagagcaggaguccccuggcuugcccuucuccccagggaggaacugcucggccuacuccccuucucccucacaccagagacuucccuaccucccuggcccuccucucugauuuagaaagccauucuccagcccuccuccccuaggauugagugcucccacccuuugcaggcuugccucuccugcccugagccagacaucuggcagccaugucacuccuccuguugguggucucugcccuccacauccucauucuugucuugcuuuuuguggccacuuuggacaagguaaguuuccagcucacugggaaccccagauauagcccaucucuaagaccccaccuaccugccucugcuucccuuccucccuaccucugugccuccuccuccccacuccuccccuucccuacucuuacuucugcguguguacuuuccccuggccuagcccaugcauuuggccaucaggagucauccccacucucccugacaucuuuuguccugugucucaccucacccuccccggucucugucccuuccaguccugguggacucucccagacaaagagucccugaaccugugguaugacugcacguggaacaccaccacucaaacaugggccugcaguaacgucagugagaauggugagcauauggcugagggcaggggaaggccugccagggccaggguugggagccuagacuaggcuaugagcaccugggguggccauaggcagcuugucuggauggaaaggcaccaauaaauccagagagguuggagccacaugcuguagcuuaaggaacaggggagaaagcucccuaaauucugagaagacuuuucagaguuguaaagaaauggagcgaguguugugaugugggagggagaauagggagaggccagaguucuaagagauggaguggccugccuccuuucaggauucgaagugaccgccagugaguguggggauggggcucaucaguaagauguuucccugguaacccuuguaauccuuguaacacggacaucucugaagcuugccuggcugaaccuacagugaguagaguccagccagugggaacagcgguuccagcugugaccucaccugugucgcccccuguaggcuggcugaaggcagugcaggcccucauggugcugucucucauccucugcugccuguccuucauccucuucauguuccaacucuacaccaugcggcgcggagggcucuucuacgcuaccggccucugccagcuuugcaccaguaagcacuucccccagcuuggggaacgguggcgaggaaugggagcgggccacuggaggcucccagcccucuccugagagcagccuccauggcccccacaggagagggagaguggagcugugugccuuagaggcucugcggugagccagugcuugagaagucaguggugguaaaugagcuggguuccagggaugggggcagcuaaaggauccacagaaggaauguucugcaucauauccgccaacugugguuucuugggcaccuguucaagaagucguuuuguuuguuuguuuucuauucucccaauaccggggcuauaacacggggcgugccagacggacucucaucucugaggcaugugcccagcuccacacugguggauucuaggcaugugcucucaacucuuuuuauuuauuuuauuggaaauagguuggauaaauggucccagcugaccuugaacuuucuauccucaugccccagcacccuggguagcugagagagcagaggugggccauuaugucccacuuuuuuuuuuuuguuuuguuuuugguuuuucgagacaggguuucucuguguaguccuggcuguccuggaacucacuuuguagaccaggcuggccucgaacucagaaauccaccugccucugccucccaagugcugggauuaaaggcgugcgccaccaccgccuggccccacuuuuuuuuuuuuaaggucaaauaaauugagguuugagacagugugggggugaggggaggucaaugagaucugaaagcacaggucuauuuuuccuuuuuuaauuuuuuuugguuccagguugcaaagggcugaguuaaucauggugguuuugaaaacaucuuccuggguucccagagaacccccuucauuuuuaucucaugcuugcauuuuuggcucaugaaaaacucaaaaagguuccauggauacacagcuguccauggccuuauuucacagaugagcaguuagggaccagaggugguagugguucugggaggccacugaggaggaccuaggacagugcggccuccugugcacccagccccacacugcuguugguggucccgcaggugcagcuguguucuccggggcacucaucuaugccauccacaccgaggagauccuggccaagcacccgagugggggcagcuucgguuacugcuucgcccuggccuggguggcuuuuccacucgcucuggucagcggcacugucuacauccaccugcggaaacgugaaugagcacuguguccccuagaaaauaaauucauuuaaccacgagccuga

SEQ ID NO: 3815 - RNA, 2037 nt, Mus musculus
gucauggaggaaucaggauuuuacuguaagugcugugggaggccauuagaauucucacagcacucuagucccaggguuauagugugaacuaucauuuauucucagaguuaggggcugugggugaugaacuaggacugaugaaguuagggcuggggaucuggaugauggugcuagagcugggugugaugaccuaagccugcaggggugagugaccagcuggcuuggggauugcgagacugggagcuggguaccacacagcacagccucugcagcauccauuggcagugugaccauaggcguuacugaugacgucuccacuauuuuccuucaucuguaaaagagggauagcaucgcggcuagcuuagaucuagagcagugccugguaauacuguacaacuuagagcgggcuuuggagccccgaguggagucgagggaacucuggcucuaguaauuggagaaagggcaaagacuugaggccagugcguccggaagcuaaaguuuggaaucuuaaaugaggauggauggaggagggggacagaaacaaggggaagucuaacucugacccuggagagaguagagagugggucacugaggacaaaauuggggggcugggauggaagcuuguacuucuccaugauugcagggacaggaggcugcaucccaggccugggaggaguguggaccaggagcaaggaagcuccacuggcugagaagccagcugggauguuuuaauauuccuugagaguugaaaaaguucgguacuuggggugccuaggggaggcguuuagggaauccccaacaauagugcccaauagaaguggaaguaucuggagacacuagagguagggguggugggaucuccccugcccaagccucuaaggagcgcggcaucgcagcacuuccucccacaggaaaccgcaggcgucgggcacacccagccuucaggcaguggcguccacagcccgcuugcaagaggaccacgugggaugaagagcuuggccagaugggaccgcuggagguuccgcccacucccacuuccggcucugcccugcguggccccaaaccguugguugcgcaugcguagugaaccuguguaggaacugagaucguggugagcguuccuccaaaccaugaauuucccaaauaaccaguccaaggcacgcacuucuuggaccccgaaggacccugccuagucccaaagucuagucuucuaaacguuucccuucaguuuccacugcccauagucccgagccccacgagugucccucccaggcauucaagucaaucuccagcaccucgcuuggcucuuuuuaaauaacagggcccgccccgcccccaaacccaaggccccgccuucucacuaaacucgccggccgcucccuucuaguccccgccccuuacagaccgugagcaucucuccccuauaguuaacgcucuguacaggacugaugccacccucugcuugcaauccugccccuuauagcauccgagccccuccuccuuuuauuaacagccucuggcuccgccucuuaguacuacacuuucuccccuccccuuuuacaaugagaucuuccccaggcuccgcccuugauccuaccuaugcuccuccccuuccccgcucuccuaaccuccacucccuugacuccccuggcucuuucuauggcggggauucucaaccuuucuaaugcugcgucccuuuaauauaguucuuuauguuguguuuacccgcccuaccguaaaauuauuuuuguugcuacuucauaaauaucuguaguuuugcuacaguuauguauuguaaugcaaacaucuguguuguccgauggucucuggugacuccuugugaaaaggucguuggaggcuacaacggggucgcgacucacugguugagaaccgcuguucucuagggucuucucagcccugcccccgcccacucaggcccgucuucuggccugccccugcucuggccuggccuccucuggguccaagacuaaaguuggcugagucuuccacugaucucuccugcccgccccuuccgcu

SEQ ID NO: 3816 - RNA, 2037 nt, Mus musculus
agcggaaggggcgggcaggagagaucaguggaagacucagccaacuuuagucuuggacccagaggaggccaggccagagcaggggcaggccagaagacgggccugagugggcgggggcagggcugagaagacccuagagaacagcgguucucaaccagugagucgcgaccccguuguagccuccaacgaccuuuucacaaggagucaccagagaccaucggacaacacagauguuugcauuacaauacauaacuguagcaaaacuacagauauuuaugaaguagcaacaaaaauaauuuuacgguagggcggguaaacacaacauaaagaacuauauuaaagggacgcagcauuagaaagguugagaauccccgccauagaaagagccaggggagucaagggaguggagguuaggagagcggggaaggggaggagcauagguaggaucaagggcggagccuggggaagaucucauuguaaaaggggaggggagaaaguguaguacuaagaggcggagccagaggcuguuaauaaaaggaggaggggcucggaugcuauaaggggcaggauugcaagcagaggguggcaucaguccuguacagagcguuaacuauaggggagagaugcucacggucuguaaggggcggggacuagaagggagcggccggcgaguuuagugagaaggcggggccuuggguuugggggcggggcgggcccuguuauuuaaaaagagccaagcgaggugcuggagauugacuugaaugccugggagggacacucguggggcucgggacuaugggcaguggaaacugaagggaaacguuuagaagacuagacuuugggacuaggcaggguccuucgggguccaagaagugcgugccuuggacugguuauuugggaaauucaugguuuggaggaacgcucaccacgaucucaguuccuacacagguucacuacgcaugcgcaaccaacgguuuggggccacgcagggcagagccggaagugggagugggcggaaccuccagcggucccaucuggccaagcucuucaucccacgugguccucuugcaagcgggcuguggacgccacugccugaaggcugggugugcccgacgccugcgguuuccugugggaggaagugcugcgaugccgcgcuccuuagaggcuugggcaggggagaucccaccaccccuaccucuagugucuccagauacuuccacuucuauugggcacuauuguuggggauucccuaaacgccuccccuaggcaccccaaguaccgaacuuuuucaacucucaaggaauauuaaaacaucccagcuggcuucucagccaguggagcuuccuugcuccugguccacacuccucccaggccugggaugcagccuccugucccugcaaucauggagaaguacaagcuuccaucccagccccccaauuuuguccucagugacccacucucuacucucuccagggucagaguuagacuuccccuuguuucugucccccuccuccauccauccucauuuaagauuccaaacuuuagcuuccggacgcacuggccucaagucuuugcccuuucuccaauuacuagagccagaguucccucgacuccacucggggcuccaaagcccgcucuaaguuguacaguauuaccaggcacugcucuagaucuaagcuagccgcgaugcuaucccucuuuuacagaugaaggaaaauaguggagacgucaucaguaacgccuauggucacacugccaauggaugcugcagaggcugugcugugugguacccagcucccagucucgcaauccccaagccagcuggucacucaccccugcaggcuuaggucaucacacccagcucuagcaccaucauccagauccccagcccuaacuucaucaguccuaguucaucacccacagccccuaacucugagaauaaaugauaguucacacuauaacccugggacuagagugcugugagaauucuaauggccucccacagcacuuacaguaaaauccugauuccuccaugac

SEQ ID NO: 3817 - RNA, 7033 nt, Mus musculus
aaauguaugcagaaggauccuguugcagcgucguucuugcuggcgagccagggcacgugcaagaagugaugccgaaacccgggaaaagaaacaucuucaggcacuagugaagacccccugcuacagggagaauucagaacugcaucauggggaaggagcaguuaauaaaguguucccguaaaacagacugcugagaaggauccggcguggauucagaacucuucagcuggggaacggugguaccaguaagucucccaaauugaucccuggguuaaagggggauauguuuuuuaagaaaaaggaaaagaaaagggaggaaaaauaaaaggaaucagugauaaagaaaaggaaauagugaaggaaagggagagggaaaggaagggaaaggaaaggaaaggaaaggaaaggaaaggaaaggaaaggaaaggagagaagggaaagagagaagagaaggaaagaaaggauugagaugauaauguucccagcuuugggacaaguuaagguucccggcuuugggacaaguuaagguucaugaguuuuucucccauugacucuuuguggguaggucugauaguuuuggucuuguuuguucugauauauggacucuguuacuguuugaaacuguguguagaggcagucaagacaggucagaaaauccuuacagagcaacaagagaguaugucggaagaggagaagggcgagccagggcgcgcgcaagaggccauaaccaaaagcaaccugggaaagaaagguuuuaucugucuuacaacaauuagaucccgcucuaucacugagagaagucaaggcaggaacucaagguaggaaccugcaagcaggaacugaagcaaagaccacagaggauugcugcuuacugcccugaacccugugccaugcucagccugcuuucuuauacaauucagggccaccugcccagggguggcacugugugcccacugugagcugaaugcuuccauaucagccauuaauuaacacuacaggacagucuuuaaaaaaaagaaagauuuauuuauuuuaugugaguacacuauugcuuucuucaaucaagcacaccagaagagggcauaggaucccauuacagaugguugugagccaccaugugguugcugggaauugaacucaggaccucuggaagagcagucagugcucuuaaccgcugagccaucucuccagcccaagauagucuuguagaagcauuuucucuaucgauauucccucuucccagagaugucuagguuugugucaaguuuacaaaaacaaguacauuuuaaaauuucuaagucuuaacauauuuguagacaauaugagaagcacaaggguuuggauccuuucuuuugcuuuuguuugauuauucuacugaaauauggcuaagaagcuaaaacucgccaggcagugauggcagaugccuuuaaucccaacacucaagagauagaggcagguguaauaucuaaguuugaggcuagccuggucuacauagucaguuccaggacagccaaagauacacagagagaccuugucucacgagacagacaggcaggcaggcaggcaggcaggcagacagacagacagacagacagaaagaaagaaagaaagaaagaaagaaagaaagaaauaaagaaagaaagggaaaauuaucagugaggacagguauccagugaagggugagcuccacagcccugagccacccaaacaccugugacacaccaccuaacacaagugaucuauaagacuuaacaccugugacacaccaccuaacacaggugaucuauaagaccuaacaccugugacacaccaccuaacacaggugaucuauaagaccuaacaccugugacacaccaccuaacacaggugaucuauaaggccuaacaccuguaacacaccaccuaacacaggugaucuauaagaccuagcaccugugacacaccaccuaacacaggugaucuauaagaccuaacaccugugacacaccaccuaacacaggugaccuauaagaccuaacaccugugacacaccaccuaacacaggugaucuauaagaccuaacaccugggacacaccaccuaacacaggugaucuauaagaccuagcaccugugacacaucaccuaacacaggugaucuauaagaccuagcaccugugacacaucaccuaacacaagugaucuauaagaccuaacaccugugacacaucaccuaacacaagugaucuauaagaagaaaugguuuacuuugauucacagugucagcccacagucaccugacccuguugccuuugggcuuaugaggaggaacacuggaccaaagcagcucacagagaguccaggaacuauagaagggaaaccgcuggggcgccaauaucuuccucaaaggcacgucccugucauccgcuguacaccuggagggcaaaguggagccgugauaaauagguuccauggggcucugguccagccuacagugcugggaguguuacagcucuuagaagggaggagguuuggguagucuucacaggggggcuagccgagaucccaggucucuugucagcuacugcagcagcgacagugccagcggcagaggggaggcagcagcagcugugcaugagccuggccagccaaggcggguccaagguccagggaugaugcuucaggagagagaacucuuccccaagugguacagcucaguaaaacagcuacucucagacgauccucuugugugcuucacuccaucuggacagagacuauauaaacauugaggaguggggcgggauuuagggguagguguuuccuauuggcucuuugugagcuguuagugaugcucuauuagcacaaagaaggacuccaguguucaauacauacgugacugagugcccaugguccucucagugggguguugcgguuacauguuccugagcacguacggaaauggguagagaagggguccaccccugcugaugaucccaagccucugagauuccuagggucugaccucacucaaccuuaccaguucuucugucugguggccuggcccacuugcccacaccacccccaagugaucugacuuccucccaucuagucacaccuccccaaggucccagccucuccucauguggccauaggcugauaaccaaaccuucaacauacaagccugagacacuccuuuuuuuuuucuuuuuuuuauauuuagaggcaggguuucucuguauagccuuggcuguccuggaacucacucuguagaccgggcuggccucgaacucagaaaucugacugccucugccucccaagugcuggaauuaaaggugugcaccaccacugcccggcucugagacacuccugaucgcagcuacugcuggacacaaaaucaacagcccuguagcucaguuggugaggcgugcuugucuagcccgcaugaagugauggguuagauccccuacgcugcaugaaccaggcgugguggugcccaucuguaaccccagcacuuaggagguggaagcaggaagacaaucagggccagcagcuucugccacaugucaaagccaaggccagucaggguugucugcaaagcccagagccccacuccccaucccccgccauggccuguucugcuguaaaugugcacgaugggaccacuggguccauggaaagcuccaagaguugccauuuuuuccuuucccaggacugccucuccagguugagguuguccugucagcguggggcaagagcaugaugcggaauagaggccuuaacuaacccacaagaagcaagaauacuggagcaagagaaaccuggguaccagagagucaggugcugaggauguuugcagccuaacccagccugucccaauacagaugccagcagagccagcaauggauaggcguguuaaggccuagcuuacuguugccugucuagcuagcccuuugagguguuacuaauguuauaaggaaacuuuuccaugugcuguuacuagggaacuuccucaugcccgaguugauugcagauucuguuauguucuguggguugguggucuuagaaaccagucacaauagaggucaguuagaacugcuuuguauagguagccacaauaagcaaggaccggaaccaacagcccagcggcacuuccugcgccuacucaugaguuuuuaugguauuugcuucuauaagcugccccugggauggaccccaagauuagaaagacaccugcagcaauauaaaaagcuauuuggaguaaaacuuccauuuugaguaggggucgaauaaaguuugaauucccaacaccucgugggaacugacauccuccuuaacagaaggagacaugaaaauccaggcuggcaaguuaagauaugaauguuaggcuagccaagucccacaccacgggugaacggcccacucaaugagaacaggauaaguguacaacaaagacuuguuucuaaggaaaccccuaucccuaaguucugauggguggaauaacuuggcacagauauuuguggaucucaggcuuaaaagcucuguagaauucuggcuggugguugcaguuuagcuccugagucuguacuguaucccugaucuuggggugugccuucaauaaaccagcccaauuugacugagaugguaugugggcaguuuuuguagugauucccagaccccgacagauggauuaaugcaugcaugcaugcauggguagacagagcuagggaugggcucacaagucuuucucugagcuggaaacagaugaagccaugucugaacacacuuguaggaaccaggcuuggaaaaacagggcucugaccuuuauuuccuauaguuacaguucaccuagucaauggagggcaauccaguuaggagacagagacauaggauggagggaagcuugggagagagaugaggagguaaagaugggaaacaaggaggaugagaacagagaggcaaggccaaggcagaggcaguaaccauggggaaagaugggaagagacagagggaaaccgaagaggccugggcuuacagggauuagaaaggagucucuagggagaagcagggcagacauuagaaaaccugccaagaguugaggcaggaagggacccgcagcccuaguuguagccccuggaguccuugcuaguagaggagcugggccuggagggaggggcaggacuggaugcauggccacugcuggaacugaggccucuacucaacucagaucccaugcucuggcugugaacgccgccugcugugcucucgcggccucugcuggucucuagguagccuguagaccccagguagcugcuggagcucguggguuugaagcccccacggccccccugggagcuccgacuggacacaggugcuccacuggcacuggcagaagccauggccacagggccugcagcagaggcagagucaccaaaggugacauggcucacggagccagugccacggccucgguucgucuuguggcucaggauggauucggggacuacacuggucuucuuggaaugcuuggggacagugaccagggagaucuguggacuggagagagucaagcucgggcugcuguccagcuucuuggcggacuccuccucguccuggagcugcagcuggaggugggcaacauuagggucucaacagguuuagaaguccuuccccgcagccccagacccaggggcuccacucucaccgacuucaugacuuggcuuagcaacuccuccuugcucauaggguaauccucuuugauuacagccccugaggaguccucccucaggugggacaaagggagaaagucugauuucagagcucuaccucguacacagauuccagcucuccugauucuguccccacccccuuggagcaacagcaccccaucuucccacucuacucccaccucccuccaaguucccaagucacccccuguguccgagaaagccacaucugaaagucacacugaaagugcccuccacccgaccccuuuugucuugcccauggggucagcccccuucccugcuuggcccaagccucacaugguaucaggaggcuugaguggagucgucuucuuggaggguuccuguaggcucuggcccagugcuagaagugcagcaucagccaaaggggcaagguucugagaguggggaagccuagaguuagcacaggcuuagccaagcuggacgcccacacccaagugccugccuacccaccuggaccuggaggaaggccugcacagugaggagcugcaccagccgccucucaaugguacucaggaagaggccuaugucccugucccgcauguaggucuugaccccaaggagauccuugaugacacugcugucacacuuagccuugucgaagagcaccuggauaucugggaugagagagggacguugugucggggccccgugcuucccucacagccucccugcaaaggugaguuucaaagagugagcgacccugcgcagcccagccagccacaaugucugccuagccucagcuucgagaggguaaagggagaguugccaagaugcuaccuuggcagggcucagaucccaccuggaacacaugcaucccagaagucaccaggucaccccucaccccucacccauauggccugugguguuuaacugguuaacaggcaaacagaagccuguucaugacagaaacaccacaguugagcccugccuccccacacaggugagccugucccuccagcuuagaagccucaugacagcucuggauguucuuuaaacauaucaauugauuucucuuuugugcuuauaucuuccuaaaggugucucggccacuccacuaacaggaaauaacagcaaaccaccagaaaucaccuaacugucccaaagagggacaacucugccaacagucaucauuauaggugaagucuaacccuuucccuccccagcaccucgggaugugauuugugaggggacaaggccccucaaaacuccuaacacaagaggacacacuaugugauucagacaccccuaaccuuaugaaacagauggggaaacgcacacauauaaacauacac

SEQ ID NO: 3818 - RNA, 50688 nt, Mus musculus
cgcgccugcgcagagcagcuccggggcggguccugggcuugucagcccagcgaggagaaggaaggagccggcugcgugcggugugaggggcgggaccgggcggguugcggaggguaggcacgcggaggccgggccaugcgugcgggccggugugccgcggcgcugcugcugcugcuacugagcggcgcggggcgcgcgaucggcuccgaggacaucgugguaggcugcggggguuucgugaagucggacguggagaucaacuacucgcucaucgaggugagccccggccgcgcguagccgggugggcuggaugacccuuggccaggcucucggcugcucugcacucuuccucagccgcgccgaggagcgggaaggccgagagggucugcccgaccccggcucccccauaccaggaccuccgaaacucuaaucugcccaacccauauugcagaacuuggaaaccacacgugucacucuccguacuaaagaccccaaggcucggacuuaccgcuccuccauccucccugggaugaauuuaaagaugaucgauucccauugcuaaguccugacauggaacaguguaacaaccucuggggcugcgaagcugcccuaccuuccccaccucuccuuuuuaaaguugccagccaccuugcauaguugcuggaauuacacuagagauuuguggaguuauuuuugacugagucgaaaguuaaugugaagugguuaucaacccggugggauucugacccagaaagccugugagaagagggggugggguagaaguagacacaggggauuggagagagagcuaggcuagguuuucccaggagggcugguagugcugccagagaaaggagggagaugggaagagguaaagacuggugcccaaggaggagaaauguggaggugccaaagagaagggcacccgagagcccuuugagcugacccaguggggccggggggaaaaggugagaagccguucccacccugaauuccugugggcguagccuuucuucaaacuaccuuucuucuaggugggguuagaggugguguaagauuucccgacgcggagaaucaacugucaucuuccaggcuuucucuguagagucccucuaccucguugguugauuuauaauugauuuuccaauuuuuugagacacaguauggccuuagauuuacaauauacccaaggcuggcuuugaacucuggacacucuugccucuguuucccacagugcuggauuacaggaguauguccugguuccaugucaccaggggccgugccaccuacuggcuuuguagcauugggcaucucagaagcugcccuggaaggcuuuucagcuugagcuuucugcagcuuugagaggaaggagaggacagucaggggugucagaggacagucaccucaccccuaagcacuaacagggauuacgagagcagagaguagguuuugugguccauugugaacuguggugcuccagccuuagggcuccuuguccuccucucugaagcaacccauccuuuuguaaucucugcuuacaacaucagacaucucaugcauguuaucuccacggaggguuuucugagcuguacuucacaaaagacuuguacugcaugguccagagagaaguauggcagccaugcuuuugauuuugaauuaaugggcuucuuaaauacauguauagugagaguuugaguuuuuuuuuuuuaucacaaaaaauauuauauguugucauuuuaaucccaugugugggacauggggcugccucagauuguccccaguaucugaugaugaucucccucaggcacuagcaggacaaauuuugccagcugcagauaguuucugugagugugugacauuuggaauucuggggacucuucagagggaauauaaaugcuagggcccugagaggugggguguugguugguuguuuuagauauccugacaguaaagaucaaacuugcccugaggaacugguuggucaccccuaaucagcaggaagcaagcagucuagcaaugacuucgcccccuuuccccucuaucgguuuuucucuccuaucugguguuagggacugaaaggguggaaggaaaggggguggaaaaggcuggaagaaaaagaacccacaaaguagcuaaagguaugguuacaauguagcaagccagaguacaauaauaaacagcaaccagcagauacacagaugacaaugcagcaucaaaaugaguguucaaaacagccauugacugaagaaguccgcuggacgcaauacagggagcccuggacagagcaggguguccuuccucucacaaacaaguaacaauguauggaggugauaccaucaauucaggugcuuacaacagcuggggaaacugaugggggaauugaggaaucagcuggaguccugguugagcuuucucuccaugauugaguauaacacuccugaacuuguggcuuccccaggcacuuuuauaucauaggaggaagaauaguaacaucuguugggaaugguccaccuuccaccugugcucagugguauuuuacuuuugggguauuuugcuguucuuuucccucccugucacagggauggggccagccaguccuuggaagacacuuugaaacaagcuugcuuaggucugacagggagaagggacaucacugcucccagagccagcuuccgagugagcucaaacagcaugugacaauuuaccaauauagucuugucuucuuucucucucuuucuuucuuucuuucuuucuuucuuucuuucuuucuuucuuucuuucuuucuuucuuucuuucuuucugagacaggguuucucuguguagcccuggcuguccuggaacucacucuguagaccaggcuggccucgaacucagaaauccaccugccucugccucccaagugcugggauuaaaggcgugcaccaccacugccuggcgaguguauucuauaacauguaaauauuauggguauuucacagucuuuccuccccuuccuccuccuccuccucuuccuccuccucuucuuuugggggcaugcccaggcagucuggaacuugugauccuccuaccaggccuccaggccuccaggugcuaggccuacagggcugugcagccacgccuagucucccacucuuuucagucgucuucccucuguuucuaccugaggugccuuccuucaacaacuguuuugguacacgcugaagacuugucccaggugggggaucguagugcaguaaaaggaccagacaaagcucugaacugugacauucuguccuuuaauaguagccuguauaagcuaaaaagaagaauuuuguggcuggagagauggcucagcucagagguuaaaaguccgugcugcaucuuauugugaguccgcgcaugcugugcgggaggccacaggauggcuuugugaacucaguuccuuccucccacccugauguuggcuccgggacuugagcuuaggucuccaggcuugugcaguaaaugccuuaaccuguugggcguccugcuggccugggaaucuggauuuucacaagugccuugcuaauagcaaacuuagaaaguuuuagacucagacauuuacauaagcaaaacagaagacaacuacugaagccaaggaaaagcuucaaagaaugagacuuuagggguagguugaaggugguuucucuaagaaaaauauaaaugacauuauucuggggugcucugacuucuuucccugugucccuguagccguuucagcagcuagccaguaauaggugcucagcuaccacgggccaauagaacgcauggaggugucauguggaaacuuauucucuaagccaauauuagagcuuuaggguuuuuuuucuccuuucuuuccagauaaaguuauacaccaagcaugggacuuugaaauaucagacggacugugcuccuaacaacggcuacuuuaugauccccuuguaugauaagguaagagguagagggacuucagucucuaugagugacuuuuaugauaggaaauaauuagugugcccaagugacagugguggccaggagcauggccuuucucccaugugcaaacauuuuguuguaaagaucaguggaaugcagauuuccaacgguugagugggcucgguggggcugcaugucucuggcaugcuuggcagugucuccagauauugcccaucacagccacagaggggaugcuacaggcagcuuagcaagaggaggcagaggugagccagauguucugagcgcugcacaguuuacggcaguugucauaugugcugccauugaaagacuuggauuccauagaaucuuguguuuucuuuuaagaaauauuucaaaaacacccauuuguuuguuuguuuguucguucauucauucauucauucauucagcauguggaaagugggaauggguacagccugccuacuuugguguguguguguguguguguguguguguguguguguguauacagugcaagggagaaagaggaucagcagacagaaagcaaccuuugggagccaguuuucuccuaccuuuuuguggguuccugggauagaaugcaggccgccaugcuuguacagugaguucucuauccacugugacgugucgccaacucaaguccucagagcucacacauggguuuccucauggccaucuccuugcugcuagauggaaaauccuggguguccagaauccagccggcugccccuggaaugcagccaccaccacuuagaagagccugguguaggauuuuauuucagacagggcuguuuugggugaaugaacuacacuucauugucugcccagggccgucuggucuccugccuucaccuuucauggcuuuccuuguagggggauuucauccugaagaucgaaccuccucugggcuggaguuuugguaagugagcugaguaacggggcgcuucgcagggaccgcagugcacgcuggucauuuuccuagaaacuccucccuggucuguaguaacucuuucugaaaagacagcuuugguagagucaguucauugugcaggcuagacacaagaacaggaccuucuuccgguuccaguacuaggaccagggcuguuugugguuuuggguuucauguguagcccaggcuaaccucauacucagugcuuucuugugucaagcucaugcaguugagcuuaccagugugugcugcugugucuggcuccccccaccucuaagcaaagggaaguguuugaacacuguaagauucuguaguagaguccuaaucuguguggggcugggaugguggcucuguggagggaagacuuguccuugggcagugagaaugguccuugucuauagucuguacaagaguggggcccgagggguuccuuacagugacagaagggccccugcagcuucuuucuccagagaagcccuauuucagcaagguuggggcccagaaagcuggagggggccagccugacugacccccggggagcgugggucacuuuucuggccugcccggccuuuuguuuccacucccuccagccagcccuucucaugaacuauagaaguucacaagcagugaauguaacagaguccugcagguauuuugauggagcugauuuuuacagagcguacacgccuggcuaacuggcagauaaugugguagaauuguuagcaccccggcagcccgccacggugcucauuaaucuccugcggugccuacagaugacagcccucaccugcagugacaggggcucugauuuucuuccuguguuaaagacgagccuacgguccuguauaagcgaugucuccagcgcucuuaacauguuuacuuuuggauuuucuucauuuccguacagggaguuguuaaguuguccaggcuggcuuugauccucuaauccuucagccucagccucccgagcagccucgaugagagccuggggcaccaugcuuugugccggugcauuuuguuuugaacuugaacuaagugaauuccuacaggcugcucuuugugucugguuucuuccagucuugcuuaggaugcucaccuguuuucuguaugguucuaagucauuuccuucgcuguguaggagucucugugugugugcgcacaugcauguuaggguuucugaugcugugauaaaccaccauaaccagaagccacuccgggaggagaggguuaauuucagcucgcucucugugguccacacuccauugcuaagggaagcuggggcuggaacuaaagcagagacaauagaggaaauccacaugauagcuugaucgcccuggcuuguuccaccaguuuuuuuuuuuuuuuuuuuuuuuuuaaacacaguuuuucuuauacaucuuuccagggaugacaucacccacaggggguggacccucccacaucaaucauuaaucaagaaaacgcucuacagacuggccuauaggccaaccugauggagagauuuuucucaguuaagauucccucuuuccagauaggucuagguuucuaucaaauuggcaaaaaacaaccaggacuugugugugugugugugugugugugugugugugugucugugugucuguguguguacacacauguacauauguguguaugugaaggccagagguugauaucaggugucugucucagucacuccccaccucaguuuugagacaggcugucuuacugagccuggagcucacugagucggcuaagcuggccggucagccguugagccccagggauccugggucugucucuucaguucuggggcuacagaugcacacugugcaccgcugugcugugggugcugcugggaucagacucaaguccucaggcuuguguggcaggugccuugccgaccucgccgucuccucagccuuuucuaguguuuuaaaagcucaacuuucguuucuauuguggugagccuuuuaguguucuaaagugaacacauuguguugacauugaaggaugaaauagauucucuccacacugguauuugugagggguuggaagcucugucagagggaugggguauguguguguguguguguguaaguauacauguggcaagauucagucagggcugccucuuucuuuugucauuguccccuuacccugcucugcucaagucccuccccaugugguuccuguugucauggggcugacggaccuuguuagauauggaaccagugugcgggaucacauuggagcugugucacaugcucuguggaaagauccucugaccuuuucaugacuccacuuaaugccucugaaauuuugaaucuccugaagaguugaaugcacuggccuuggugccugguacagaguggaugcuuuggggcuggggaauggcuccguugguaaaguauuucuuguguaggccugaggaucugaguucagauuccugucagagccaagcagggccggcauggcucuguaaccuagagcuagggucagaggagagagaggguccugaaaugccggccacucagccaaggcagggagauucgcuccagguccagugagagacucugccuccaaagcuguggaggccuacgaucaacacugacagcuagccuccaggugcgcgagcauaugcccaagauguaccccaacgccacaucagugugguucucggugaccccucagugauggacgccagguggcugggcggguaggauaacuucugccacacgagggcaucacauguagaaacauguagacgggucuggcugggaaguguauccccagcacacguguugccuugcaucucaugucccuaccucuccuuugccgguuuuccugcagagccaaccaacguggagcugcgaguggauggugugagcgacaucugcacgaagggcggggacaucaacuuccuguucacuggcuucucugugaauggcaaggucuggcuccgggcugccuccuguccuccacacuacucugccuugucuccucucagccuuauaaaagggaggugucugugcccauaggucacccgcagugagccucaggggucuguggugugugggagucagcuugaacauggaggauguccuguggugggggugcagauagggaggugcccaggaccugaguuguuacacucgcuguguuagagcuagguuguuaggcuugcuguguuagagcuagguuguuacacucgcuguguuagagcuagguuguuacacucgcuguguuagagcuagguuguuacacucgcuguguuagagcuagguuguuaggcuugcuguguuagagcuagccucagcuccuuccggggagguuccugcuggagguggcuccuccccaggcucugcgcugcuggggaccgauguguagacuugcaaguccuccuuugcguugagagcgaggcccucagcucuguuuccugugugaauuucuuacuggaagagaggaucuugggcguguuucuuagagacuuguaaaauagugauacuuuuuauaagauuuauuuuauuuucauuuauguguggauauauauaugagaguguauguguccuuagaggccagaggcaugggacccccuggaguuggaguuaguuacaguaguuacaagcugccugauaucggugcugggaaccuaacugcaggccucugcaggaauguaccuuaaccaggcacagagcagccuccagcccccucuuagacucaguggagcucuguccccucuccacccagcccccaaaaaccuucccugacuacuuccacaucaaauaggcccuugacugaaaaaaaauguuuuaggugcccuguggggagcagaagcaagcauuaaacuccucccugaggaggggccuugccuggcugaacugcccguugggccccaacguccuccuuuucacagguccucagcaaagggcagccccugggcccagcaggaguucagguaucccugagaagcaccggugcugacucgaagauccagucuacagucacgcagccuggcggaaagugaguagucacggggccgggcugugggcauguggagagcuuuggguugaggugggcucugggcucggguccucaucuggccucuuaagcaaguucaugcuuuccagucccaacuuccucuugaagugggguccugugaugcgguguguaggagguggcugauugguuaucaccugggcgauugauuaucagcuacugacuggaaaggccaugcuccagaccugggguacacuaagccuuugggguuggcuuuggagcccaguagccauggucaaaucugggugccucuguucgcucuuggacuugggacaaaucaccucucugugcucuguuucuuuuaauuuguccaugaaggucaugguagaaguuacggggaagacaguacuugucucagauuguccagcuuggugcuugguaaaugguugucgacgaccaguuaacuccguuaggauuuaaagacagcaucauuuuaucacuuacagggaagccaugugguagcuggaccuggcgguuauuuaguuaacuuugcagcgugaaauguaaagggcuauuuaguugcacugugaaguggggcgagcucagcuguaaccgcuagcagaugugugaggauuaauacaggaaucuuggagcugguacuguaggaggcgcucagaacauguuuacaaaguucacaaaguccaccacagcaguaccugaagcuccuagucagcuucuggugucuuauccaaccuaaaauuacuguuguugauggugucuccuugaucggagccuaguccugaacugguggagcacggggcuguguuucuucauggcucagccugggcugagugucccucagccagguucuugggaccagaaggaccucugaugugggguuuucucgaauuugguauguuuucauacaugcaccauucuuaguuuaguuucucagugccgauuauacacaauugauaaucugucuggcucaugguuuuagaccauggucaccuagccaucaucuuucugggcuccuggcccaagugacacacuuccugcugcgcggccccuuucaccaugguccucacuaccucccaauaguugauccugccuucuccuucagcaagcugaucuguugguuaggccaaagcccuccugacccagagcuucuccucugaacucugcucuggagaaccaagauuucaacacccgugccuucagggauagggcucacuucugaaugugaacuucauuuaugucuggugcacaucuuaaguaugcagacuggaacuacucauacagcauuuuacaucauuauuacaugagacuguuucacggucuagaguuuuccacuuuuguggcauaauauugcuacucaaaaaguucuggguuuuggaguucugauuauuccaaugcgggaugccccagccuaugccaggagacaguggguuguuggccgucugagugcacagugcaguuuuccuucuucccggcacauggggaguguucagagaguggguuuggacagaacuggauugagcagcucuuagaggcuuacaguaaucccuauauggucccugucuaaaacuaagugaacacucuuuuguguuucucagguuugcguuuuucaaaguucuuccuggagauuaugaaauccuugcaacucacccgaccugggcgcugaaggaggugaccuuugacccaugccugccgcggugucaguuugggaucaaauguggggacagauuuaggacaugaagucacaguuucuccugaugccuuggaagaacaggggugcugaagaugcgguuguuaccagagggaacuccccugcugcagcggugcugcugccgccggucccuucuguggguggcggauuuuauaaaguccagcaaccccugucgcugcuuugagcaguaucaacaccagaaauucccagugaauuuuuguuguuuuucugucaaaaccagaagucuacaaauaugcuaaauauucuagaggccuguuguccguguaccuuaggggaggagagcucucagacagcuugugugacuguuaagggcggaugggguugugggucagcacacccugagugucaggcgaguguucgagccagagaaaaccuuuuguuccaaggaaaggaaaaacagugauuucccuucugguuuaaaauuucaaccuuuuuuuucuguuuuguaucugaacuuuuaaucagaaguggcugagauguuagcagcagucauugaaggaaugucuaagcagggaguggcacauaccuguaauucuaguacuuugaaugcugaagcaggaggauugcugugagauuuuuggcuagccugggcuauguauagugaguucuagaccagccucggcuauagaccacccugucuccaaacaaacaaacagcccaaagaauauuuaaaagguuuuaaguguuugaacugucauauaaaggcugauuucuaaaauauuauaguaguuaaauuucucuuugaggcugucacccucugucuagcccaggcuggccucuaauucacaauaaucucccuacuccagcuucccaaugcugggauugcuggugucagccgccaaguuaggcugucaggguuuagugcuauugaaucugaagacccuuuucuuuucuaggcaaguaccacggugcgugugacgaacucgaaugcuaacgcagcugguccccucauaguggcuggcuauaauguguccggcucuguccgcagugacggggagcccaugaaaggggugaaguuucuucucuuuucuucuuuagugaacaaagagguaagcauacaaaagugaggagccaaggucagggcgggcaguggcaggcagggccgccguugagcauaccaauggcgguuaguuucuccagugauggcaccacaaggcuguggagguggccggugcucaggcuuugacgagguucacacaguaucagguccuaaugaacgcccuugcucuguggcaucuugggugcaucguuucccuuccuuggccaguuuucuuuguuauugggaggagccucaccgucuucccuaaggagacugcucauuuuuaacuuuggaagcuggauguaaagauuuguguuccauuugccugcauggauccccuggcuugagaaacccaugcauugaccucuacaaguuggccuggccuuaccuguggcuguugggcaaucggaacguggaaauagaaaucucuucuuucucuccauaggauguccugggcugcaauguguccccaguguccggguuccagcccccagaugagagccugguuuaucugugcuaugcggucuccaaagaagacggcucauuuucuuucuauuccuugccgagugggggcuacacuguggugagugagugggugggcaggucucuuaucuguucgggacaccauggcuugagaggaaccugugugagucagcuuuccauaugaugacauguaugaugggguaaacagaugucccggaauagagcuuaucuuagaucauaguuucaguuccugacugauggaggugaggcacgagggugcgggcaaagcccgugguagggaauccucuucacuucauggaggcugaagugcacagaacuuggaagagcagccgggcugggauuuugacguggcgucaagggcaugcugccagugaagugaccuucuuccacuggguuccugagggugccaccaccucccagcagugccgacaggcaugccuguagcacaggaguggcuagccuuuugacacugcaacaugacccugcuguacccggauguuugggggccacauccauagcuauccugcgacauaccagcacaugagcuuuuaggggaauuucagguccuagucauacauauugaaugaccaaaugguggguugaccgucgugaacacuuggccuagcaaggauagauugagugucccuaaaacuaaaaacccccagaccuaaaacacuguaaaaucugaggacacugcuaaguuugcuaccagccugugacucuguaaggugugugugacauacacuggaucuuggauucagacucagaccuguccauaaggugucucaugaugcccguacaggcacuccggcacccgagcaguuccgcauugagaaacacuuagguugcaagugggucacaguagagugcaaggcuucuccuuagaccaccagcaacugcgguucacgguccucuggguuguuuggcugcuagaccuuggugagcgcugauugcugcauggcgaugcagaugcuuccuaauccccagcccgccccucccaggugcccuucuaccgaggagaaaggaucaccuucgacguggcgcccucccggcuugacuucacgguggagcacgacagccugagaaucgaggugaagccucccagugcucucugcagguguuuggguucccagcccagggcgcagaugguucagacguguccacagcagcaccuguccauugcuaucggaggaaaugggaccgcaugcaguggcccgggguaccauagguguacuuccucucuuacacagcaucuucaucuugcagagauagcuagugucuuagucaggguuucuauuccugcacaaacaucaugaccaagaagcaaguuggggaggaaaggguuuauuuggcuuacacuuccaugcugcuguucaucaccaaaggaagucaggacuggaacucaagcaggucagggagcaggagcugaugcagaggccauggagggauguucuuuacuggcuugcuuccccuggcuugcucagccugcucucuuauagaacccaagacuaccagcccagagauggucccacccacaaggggccuuucccccuugaucacuaauugagaaaaugccuuacaguuggaucucauggaggcauuuccucaacugaagcuccuuucucugugauaaccccagcugugucaaguugacacaaaacuagccaguacagcuagggucccggucagugcuguucuuucaguaagaugucuugaguucuguuccacguuggccaugcaguaggaugcaacagucuuucuggaaguuacgauuuagugaugggagaagccaggccuguuuaucuaagcaaguuaguaaguguuuuagaaggcaguaagggcucucugggacagaagggccuugcaguucagggcagggcuacagggcagcaucucauguugguucucucugaaggugacugagcuacagucugaaggggagcaggcgaauuauaccuaaaguguggugaaugccaaggucuuaaggcaggagugugucuggagugugaggcacugagugggucagggaagcuggagaggagggcacagaggcuuggagaggugaugccucagagccugguguccacuuuccucuugugcugccgagagcuccugaggagaggugagaugaguggagccggccugggccaguuacaaggccggggcagugauaaccacaugagcguggaccacgugguaggaaggcauggcgggaucuucacaacacuguaaauguguucauccuucugcugcgacuuuaagaaccgaugacagguggucccugcuggcagcuugcaauauggaggaagcacccaggggcacccggagguaguguuagugaaaagccacucuauauuuucauacuguacugaaaagcaaucugcuaaacuagugcagggucaaaggagcuggccccgccuuccaaccuugcauagggcaucuaagugugggagcaggaggccaagaaaaugagccuggagcuuuuauugccuguacaaccuugcaggaagggugcggcaggugcuugggcaaaguacccagauggaggucaaaugcaggucuuaacugguaaaaaaacauggcguuucaagugagggccuagaagguuccaucaggccaggaagcauccuugucucacccgugugcugcagcaccuggcacacaguaagagccugagaagaacguugguuggcugugagugaguaaggggauccuuagcugcuuaccacauacucucagaaggauuauuccuaaaaggaaccgcuuucuuauucuuccuugccccuccuuucuuguuuugagauaguaccacuguguaucccaggauggccuuaaacuuaugauccuccuggcuuagcugccugagugcugaggucacaggugugugccuccugagugcugaggucacaggugugugucuccugagcaaugagaucacaggugugugccuccugagcaaugagaucacaggugugugccuccugagugcugaggucacaggucugugagaucacaggugugugucuccugagugcugaggucacaggugugugccuccugagugcugaggucacaggugugugucuccugagugcugaggucacaggugugugucuccugagugcugaggucacaggugugugucuccugagugcugaggucacaggugugugucuccugagugcugaggucacaggugugugucuccugagugcugaggucacaggugugugccuccugagugcugaggucacaggugugugucuccugagcgaugagaucacaggugugugaggucacagaugugugaggucacaggugugugccuccugagugcugaggucacaggugugugucuccugagugcugaggucacaggugugugucuccugagugcugaggucacaggugugugucuccugagugcugaggucacaggugugugccuccugagugcugagaucacaggugugugucaccaugcccugcauagccacaccuacugcuuguauuauaagagugugaguguguugucaugccaagcuaacacuguaccacuuucaagcucucuuucauagugccugccuuuguucaucaaggaggcacugggugccugcuguguagcaaguagcuaaggcaggauaggcaucagugagucugcaagucuacauuuuuaaugagacagggauaagguauaggaagucaaacaagcauuccaggcccugaggaguuggaugaagauaugaaauuaaguuagugggguuucaguugaggagccagaguucagggggauuggagcucagugccucccgggagagcccaggcuuggugcucugagcacgcaggacacacucagacagggcaccaggcuuguugugaggaaggguggguuggaaagaaccugucuuggccuggguucuggccguuagguguggguucuuggacuuugaaaggaaagggcaggccaguggucuuaggugauauugguagaauaggguggggguuucagguucugcuugaagggacgugcugagagugaaggaaaaagccauagucccagauaauguuuggggugauaggucagcggucucaggggaugcagaagucaggucgggguugccagggagacccacaagccagaggcaguaaucugugugaguugggaagugagucugcaggcuguuuuuauucaacucugaucaugcaugcacgggaaaugcagccaagaggacagcagcagugagagggagaggggcugguggaauuagggcugagagggaggcauggcaccaacacauggugcugugcaggagggggucuugguggcauggucaugugaaaaucugcucuucacuuuugcagccuguauuccacgucaugggcuucucugucaccgggagagucuugaauggaccugacggagaaggcgucccagaggcuguggucacccugaacaaccagauuaaaggugggcaggcacggugguccugagucugauuaaagggcuuguuuugcaucauggaaggauguagacacaagggacgagcucagugaccuuacaaccugcugcguccucauguaccugucaggugcaaacuuuugcagcucagcuuuuguucacgugcuuugguuucacagucaaaacgaaggcugacggcuccuuccgccuggagaacauaacgacagggacauacaccauccacgcucagaaggagcaccucuacuucgagauggucaccaucaaaauugcccccaacaccccacagcuggcugaccucaucgcuacaggguaagugugcuguccagguaggguuucuguugaugugacggaaccccgugaccaaaagcaaguuggggaggaaaggguuuauuuggcuaacacauccaucauaucacaguccaucacugagugaaggcaggucaggaaugugaaggcaggagcugaagcagaggccauggaaggcugcugacuagcuugcucggccuccuuuuuuuuuuuuuuuuuuuuaauuuauuuuauuuuuuauuagguauuuuccucguuuacauuuucaaugcuaucccaaaggucccccauacccacccccccaguccccuacccacccacucccccuuuuuggcccuggcguuccccuguacuggggcauauaaaguuugcaaguccaaugggccucucuuuccagugauggccgacuaggccaucuuuugauacauaugcagcuagagacaagagcuccgggguacugguuaguucauauuguuguuccaccuauagaguugcaguucccuuuagcuccuuggguaauuucucuagcuccuccauugggggccgugugacccaucuaauagcugacugugaucauccacuucuguguuugcuaggccccggcauagucucacaagagacagcuauaucuggguccuuucagcaaaaucuugcuaguguaugcaauggugucagcguuugggagcugauuaugggauggaucccugcauauggcaaucacuagaugguccauccuuucaucacagcuccaaauuuugucucuguaacuccuuccauggguguuuuguucccauuucucagccuccuuucuuacacaacccaggacuuugaugguggcucugcccucagugagcugggcucuccugcaucagacagucaagagagcgaaccacagguuugccuacaggccauucuuguggugguauuuucucaguugagguucccucuucugaaaugaccccagcauaugucaaguugacauaaaacucaccagcccauggguacguccccgcuccucuuggcaguaguagagaagaaaaugagcuuuggucugaaaauuucugucuaggauucacaucgagacagcugucgagucacaauggcuuccuuuuggaaagaugaguggugaaccuugauagcugcaggcacuuacauguuggacacaaaauuguuuucucuugcuuucaaguuaaaauggguuuguuaaaguagaaagagaaggggacaggagaugguaagugcguugcgugccuggccuggugacuugaauuugauaccugggggguuacgggcuggaagaugagaacagacucagacagguugucccucccagacuuccacauauguacaaacacaauaaagaaaugucugucugucugucugucugucuuaucuguccaucuauguuagcaaaagauuucugaaguucucccucccugagaguacuuuccugugugacccugagggcuuuguggggugcgcugacagugguggauguggggugugcuaggaggcauuucuggucauuggcagaguucaucacuuagucacugauauguacagcaaggacaggauggacagacauuuagaggcucacagccaaugagaggugguguuccagacaggugaugaggguucaaguuuggugucacaugaccacuagguggcacacaaucucccagauuggaucuguguacauccagaugauuggcauacggguggccugggcugguuugcuaaguggguaagggcagucuugcccacugagaccauugggucagcaagcgccugauggagauguggcauuugaauucuuuuuuuuuuuuuuuuuucuggcuucugggugggugaguaggaauugguggggagccaggguguuggcagaggugcagauaggggcccauggcaguugucuggaagagaugagaguuggaggugucuuagccaggggcuggcaggagaggagaggagaagcagauggacuugauagaugaucggaugcagagagucagugagcacauacugacaggcuggugugugugugugugugugugugugugugugugauaaguuucuuauuuaaaguauaguauuugaacuaaaguuaagaaaacaagacauuugaacaucuuuggaagagcuuguugcuuuuucggaggaacccagagaccaagcaagcacauuugcauuuauuuuuggaugguguugggacacaaaccuagaccuuugugcacaggcagacguauuaccucugagcuucauaugccccuccuuaaugcauugguguuccuugccuuuuuuauuuauuuuuaaauuauuuauaaaaacacauuuuaaaaauacuuaacauuuauuuauaugcgugugucuugcuugcauguaugucuauacaccauguuugugccaugcccucagaggccagaaggggguguuuguccccuggaacuggaguugcaaacaguugugagcugcccuguggguggcaggaauugaacccagguccucugcaagagcagguagugcucuuaacugcugagccaucuccccagccccuauuuaauuuuuuaaaauuuuauuacauuuacucauuuauguaugagucagucucucuccucgcuccucccccacccuguguguguguguguguguguguguguguguguauguaugcacacauauaugcacauauguaaauggugccuguggagggcagaaaaggguaccaggucucagaaaaggacaccaggucuccuggaguuggacuugaaugaaaaugaagaccugaccaaguucuuuauuguagaugugagaagagaacagccagagguuucuggaagaguccaggcugaacauggucagcagaauagaucaggccauggaggggaugagggagagaagagagaauagagagaggccaaaagaaccaagagagccugugggcucucauugaaccaaauggcuggguuauauaggaaagagaaguggggauuugaaggagccaaaaaggguagggggaggguggggaguaccgagaggagacaggacuuuggacuagcugggagagccuggcugagagccuggcagccagcaucugccuugauauguuaguuggcaccucagucauuuguccugaguuucuuugggaugucugugcucuacacgguagcaugugcucuuauccccugagcaucuuuccagcucugcaaccauuucuuuaucucuucccugaugauccaguugggacagacacgcuucuacaguagucagucuggcccgugacugucagaggagaaaguucuucaguauugcuguguccgaagcggcagggccugcucuguguuucucagagggacuacucacccggaaucuggaauccaagucacuccuguccgcaggguccuuccgccucugugagaggcauuuguggcuuccaacuccugaggaguucaguugagggccaccuaacuguaaacgaggaagacccuuugguauucuuauggucuguuaaugguauuguuuugcagacagcugaccacucuccuuuugagagguagcccaggcugcuguagugauuggguuaucugaagcaguuuuuccugcagauggucucugcagccguggggauaggggcucacgcuacccaguucauccauagcucugcccugggcccagugcagacuuuggcagguggccccugaaagugaaugucacagagucuacaguggguccagagggcacuugucucggguccugggaaccugccugcugcgugugagucuugcugggaugaucaggcuucucccugcagguucagcaucuguggucagaucgccaucguccgcucccccgacaccaucaagcagaugaguaaauacagagugguccuguccucccaagacaaggacaaggcuuugcucacuguggacagcgaugcccauggaucauuuugcuuuaaagcaaaaccaggggccuacaaaguccagguacaugauggguuugguuuauagugucggagggcugggaaggcugggaaguggcucaggcaauagaaugacugcugauaaggcucucucauccccagaguccauaugaaaagccagaugugcuggcaggagcucgucauuccagggcugggcaggcagagacaggcuggucccuggguucacuggccagccagacuugcuuacuggaguaagcuccaggccagugagagauuccaucuaauuuugaacaagcuagauagcuucugagcaaacaacacccaagguggucucuggucuccauacacucacaugcccaccggcccccaaacugaaagagcaaggguuuuccagaguguuaggagcuauagcggggcacaaggagccuuucauuuccuuccuccugauguccagcugaucucacagcccauggaugcugugaacagagaggccugcccuuucucacuggcuguaggugcaggguugggagugagcucuuguaccucccugggcucuggcugcucuaggauguccaugaggccaagaacagagcaaagcuagcucuugaagcuucugagagccugaaggccagggaggagcccugacuccaggacagcuaacaggccuagggagccugcccaaucaggcagagaagcagggcagccccuggccuggaguuuccccacaagggaguugcccugagcgcagcugggcugagcgacaacacagccagaaguuugcccuguucaccuucuggugcaguggcccuguccucuuuggauagaccauguaucuguagcugacagggcuugccaaucaaaucagcccugcucccagcucuagggagggaggccuaggaguguccccuaagcguggguccucuagagugagcccuuccuucuguaggaacaaguggagaugggccgucaccggcacaacuugucugaagguagccacaguggcauccugcagagauuccaucagauguuggaguugggcaauuccuuacugcugguaaaauaggggacgucuguccugucacucagagaaaagggagccaggugugauggcucauaucugcaggcccagcccuggggaggcugaaacaggacugugaaguucaggcuagcccgggccacguagucucugucuuaaagcaacgcacaagaaaauaaguacaggcuggagagaugauggcucagcaguuaagagcacugacuguucuuccagaggucuugaguucaauuccuagcaaccucaugguggcucacaaccauauguaauggggucugaugcccucuucuggugugucugaagacagcuacaguguacucacauacauaaaauaaauaaaaucguaaaaaaggaaaagaaaaagaaaaguacauggaaaaagagugagcuaauucugcaggcgccucgggaggcaucagacacagccucucucugagacuugguuucacacagcccaggcugacucgggccuuggguguuccuugugccucggccuccugaauguggauugcaggcuggugcugcugugcccggcuaggacuguguuacuauaaaaauauuacuucuuagguuugcugugauuacaaccuucacccuucacugucugcuuagcuugaggcucaggugaagcuucuagcaccucguaggccgagggagagcuguucccugcaaccucuaguguagcaguucucaaccugugggccugugggcugugaccucuuugggguugagugacccucucacaggggccaccuaagaccauuggaaaaugcagauacuugcauuaugauucauaacagcagcagaauuacgguugugagguagcaacaagaguaaguuaugguuggggacgccacaccgugaggaaggcugagacgcccugcuccagugucucgugugcucacagguggugguacccgaggcugagaccagagcagggcugauguugaagccgcagguauucccccucacugugaccaacaggccugugauggauguggccuucgugcaguuucuggcaucgguuuccgggaaagucuccugucuggguaagguaucaacugcacgugagagccucuaguucagagugggcagugggaggagcugggcccaggcgguucugaaggggguggagagaaagguggucugucccauccugucuugguaggucugcaggggcugagcagagguguagaggagggcccgacccccugccagggcgucacugccugcugcugaccacagccucggggugcugggaacugggucacucacuguaccgagcuuaggaagcggggccuccagggcuugacgcucaggcuaagcacucagaagcuuguaggguuugcgauggcagucaagugagguccuccggucucuccucuacagauaccugcggugaccuguuggugacccugcagucccugagccgccagggugagaaacgcagccuccagcucucaggcaaagucaacuccaugacuuucaccuuugacaaaguucugccugggagauacaaaaguaagauggggccugauacucucaggagcucgcucucccaagccugcuccucugugggcuuacuguaggccucuccuagggaacucugucccaggaccuuaccugccaaguuagcuccuuugucacagagguucugcccugcaugugcucugggacggugccuggcaaaaacuguuuuauuucuaaaugccagaaggagcacgauaguucuguucucaugucugccacuuaggccuagcuagagugaccuugcccagucauucuuucuccuccccugaccgauaccuuacccuugaaacgguacaguggccuuucucaaggagagacuaagaggcagagcacagggccuggucggcagggcagggccccacgcuggugcccuuccugcccucgguaagccagcucuugccucuguuuugaagagcagcuugcagcugguggcagggacuagacuucuaccuagugagguagacuuuucucuugggggcuuguguuucucugucucagaaagagcuggcugccuguuucuuuaguuucacagaguccugacgugcccaugagcucguaugacuguugcugcucacaguucccuggcagaguccagaagcccagacccgcaaagcugacuagaauccgggugccgggcgggcggaggagggagagucuuuugagucaaggaguuugaaauuugccaaaacaacaacaaaagucagacaauuuacaaaaaguguagcggcccaugaauaucuuguaaccuggcaucuucugccuagauggauuuccuuauuuguggugacaguggccacugaugucaguuuuucuuuggcagcgaccugcccugaacauugcuuccugcuuagguauuuuuauguaaaguguauuuucuuuuuagacaggguacugagcugaggaagcggggccuccagggcuugacgcucgggcuaagcacucagaaacuuguaggguuugcgauggcggucaagugagguccuccggucucucuacagauaccugcggugacaggcuggcuuugaacucuuaauccuuguacuucagccuucagaguacuaggauuaaagugcacaauucuguguuuaguacauguguacuccucugcagcuagcuagcagguccccaguugcucagugcugcaggccccuaguugcccggcaccgugaggccccagccccauguguuggcuuugcaguaagcaucaugcaugaggacuggugcuggaggaacaagagucuggaaguggaagugcuggaggacgacgugucugcgguggaguucaggcagaccgguuacaugcugcgcugcgcacucucacacgccaucacucugguaugugcugcuucugagggaccucagagagagugcccagcggggcgggcaagacagcucagccucagagagagggcccagcggggcaggcaagacggcucagccucagagagagugcccagcggggcgggcaagacggcucagccucagagagagugcccagcggggcgggcaagacggcucagccucaaauccugcaaguuacccucuggucuacacacacacacacacacacacacacacacacacacacagagagagagagagagaaugagagagagagagagagagagagggagagagagagagagagagagaaguaaauggcuuauagcaauugcuggagccuggcacagcaagaguguaaugacaguuaagccaaguucccuuuucuacccuggguucccaccugccagggaaggcauccucagccugcaguguuacagguccuccucagcccgugggcagcugggcagcucgguguggugcggugcggcugcguggucuugucucuuccugccgcguugggaucacagugcccgcuccucaggcugugggaggucagcaagcugugcuguguguagcauuucuguggugugcccaguacacuguugacuagugcagcugaguucucuaggcugcuuccugugggcagagcgcacucacucgcuucuucucuuguuuuccuuuuauuuucguuuugcaguucuguggaccaaacccaggguuucagacaugcugggccaacgguuacugcugaguuguaugucugguccuuaaaccauuuuuaaaguuauuauuauuuuguuguuguuguuuuuugguuuuuguuuuguuuguuuguuuuugagaucagcuuucucuauuauguagcccugauuguccuggaacucaccauguagaccaggcuggcucaaaacuuagcagauccaaaugccuugcccucccuagugcugggauuaaagagggcggaaccgcagcuggccuagauuauuguuuuuuuuucuuuuguguauguggguguugugccuaugugugucuguauuaccugugugcuguguuuguggaagccagaugugggcauggauccucuagggcuggaguuacuaauggcugugagucuccacggaggaaucagaaccagguucucgggaagagcagccagugcucuuaacugcccagcccccucccaccuuuucucuuucugguuuugaggcugaguugugcugcauugcccaggcuggccucgcacuuucugucgcccgcuucccucaguggagugcaggccagugccugucugcuuggccgcaggcacgggggcuucagggaugaucucugucguuccuuagggguaggagcaaaugucauuguuggaucccaccagagagcugggcggauggcaacagcauggcugcuugugacacugguaggacccgagccggugucuccaaggccaggcugcugccucagcugcuacaaaccccgaaguacccuuuuuauuccagggauggguugcuguacagucaagagucagcuaacagacaccccucccccuaagcccuguagauuucugcucucucuagacuaugucugaacuguguaaggaaggcugccuuuccucccugugcacugguccccagggccccaguggcacuuguuucucaguccuagcugagcugcuugucucugcugcgcuggccuuucacaugugcaucccugugcccgaggagcugagccuucuucaccauugaggcccagcuacuguuuccucccaagacgggggcccaagguuagggccccagagcuccggaacacuucucuguggcggguggccccucugcucacugccuuggccucucugcuuuacauucugucugaaaccacugauuucccaaauuaaaaggucacucugcccuccucaaggguccugaccugagucugacccagagcagccacucuguacacaggagcugacugagugcaaauagcacauuucagucauaaguuuuugaagguuugcaguuuucuuguggcacccaguuguuuacaugaauaaugggccaacaugauggcuaguucagaaauggaaaucuuuuuuuuuuuuuuuuaauguaggaguugcuguguccguauguucaccuguauuugagagcaucaguucucuuuauagaugguugugagcuaccaugugggaauugaacuuaggacuucgggaagagcagccaaugcuuuuaacugcugagccaucuucccagccccacugaaauauucucaaucaccguagugucuuuccccaugagucaccauguugccuuuggcccuacaggaauuucaucaggacggaaauggcccugaaaauguggggauuuacaaucucuccaggggagugaaccgcuucugccuguccaagccuggugagccugggaggugggaguguggcgccggccugggccugaaggucggagaccccggguccaaaacccucagagauguuagugacauugcugccagcagucuaucuuugcagugaugugauguccugccuugccucccauccuccacggccgcuccagcucgaucaagauagaguuuacagggcgugaagcucaccugcuucggggcucagugguggagcacuaacccagugugcucucagagccucagcuuaccccaguaccacaaaaaaaaaacaacaaaaaaacaaaaaaaacagcauacauccccuuaagaugugugauacaugcuugccagcaagcugaccagguuguucagucauggccacagacccagcccuggcuacagcuuaguuacguuuuaugccuccgccugaucucagccuugacuucuuagagguagcauaguuuuggaguugagcuacauuguaguauaacagugcuuuguucuuuuucacugcugaguuauauuccacuguguguacguagcacauucucuguguguagccguuuugcacauuaccugcgucugagcaggugcagccucagggagucauugaguucccgacaaugucagcacuccugagugggugagaaggagggggcccguggcacaggagagcccgcccgguguucgcagucccguuaccucaggucugugauaagcuuaagcuuucagucugaggcgugcugccucccuagcgagcacgcgugcuggcagagccuucuaggcucagacaguuacacuugguuuucucuguagguguguacaaagugacuccccgcuccugccaccgguuugagcaagccuuuuacaccuaugacacguaagcuuggggacagagugccuugggggugugugcuuuacucuuuugucucuucaucuguucccgggcacacggguguauuucuguugggugucguuuguuuguuuuccuuugaaagagguaagauuaggcauuugagugaaaucucgguauagguuuucugauauccuaauggaggcgggccggcaagagggcucccugaguaaagguguuugcugagccagcuuggagaccagaguucgaaaccgggaaacugugucaaggugaaaggagaaaauggacucacaggcuguccucugaccccauguguguuccauucaacgggcuccacccucccugugaaaaucacaacaauaacgauaauagaguucuggaaauucagaugggagggccaugcuguuaaaaaauggucuuugaacuaauucuguucuuaaaauaucacacccuuauucucaguagaucacacacacacuucuaaaaauauaaacaugguggccugagccugaguuccuucccaucagugagggcccggagguuuggcaucuuugguggauguguucuuuagguuucuauuguggugguaaacaccaugaccagaccaacuucggaaggaaccguuggcuuauauggcuuguauguucuaaucccaguccaucaugaagggaaggaagucagggcagguacugaaggaggaaccuggaggagcggaggcagaggccguggaggagugcuguugacuggcuugcuuccuuuggcuugcucagccugcucccuuacucacuccagaccaccugccuggguguggcucuguccucagugagcugggcccucccaggucaaccaucagucaagaaaaugaaccacaggcuugcccacagccggcccagugggagcacuuccucaaccauucccgcuugugucaagugacaaagaacuaguuaggacauuguacuugugagguuuccugaguuuacccacuccagccuauggguuguuuucucucucucucucucucucucucucucucucucucucugugugugugugugugugugugugguccaaggcuguaccgcgaccccuuggaguaccccuucgggguugcugcuagcagagugucuguuugauuucuaggucuucacccaguauccugacgcugacagccauucgucaccauguucuuggaacaaucauuacugacaaaaugauggacgucacagugacuaucaagugagaugggugcccgcuguggccggggagugggggcugcucuaaguguguacaccgguggccucccucucuuacacucuggugacacagcaacugcgugaggaggggcuuccugacagcugggucuuugucuuaagucuuaauuguuucuuuucuuuuuuuuuuuuuuuuuuuuuuggcuaagggaaaaaucuucuaggguuuguucacuguaauucaagcgcguuagugacuuaaaauugcuucauuuucuuuagcucuuuucuugaggucuugaguugcgauggcuccuguauagguuggagaagguccuugggagacaggccuugcugagggauguuccaugcuggugagguguaucugacagcacaguuuucuuugggcagcauggcugucucacacagaugaacccugaggaacucacccccuucaucugguugaguuggcauugucuccagccagaucccugcccaucugucauggaugcugaggacaccacucagacacacauacaugugcacauccacacccacagauauguacauacagacgcacacacagauaaacacauaaacaaacacauacauguauacacguuccccacacgcguacccgaacacacacaaacacagaguaauguuuguuuauugguccaagggauugaacccagaacccaggaccuuacacaugcuaagcagacucuacaccaagccacacccacaguccuuaacuuucauuucagucagguuguccaagcuggccuugaacuugcugugugaucgauccuucucucucagcaucguucguagaugaaaugcccagccugugacauggcgccauugagaacaauaccauugagaauugucaggguugcagcccaggguuucgugggcuguaaaugacccugugguacugaagcaaacacacaacuauaaguguaugacugugaccguguuugagucugaccuuugagccugugacagggaagacuggcagcguuuugacagcagagcuggcugggugggaacaggguugaguguggggaggguccauugcugagucucuggggugcaggcccuucgggugcccuggcuucauccugcuugcuaaguguccaucauuggucacagugacuccagggcacugguaugcgucuucauuauuaacuuguuuagcuuugggaguguguggaggagucuucugucaccggcuugugcugacagacagugugagcuguguuucuggcuggacauuaccccuuggacccuucugggggacccugacccugcuaggcuguaccccagcugcuggcucuugugucagucgaccugcccuguagucucccuuuguucagaaauggcagcucccguccuuuuccugcuccuuggucauuguccucugcuuccccugguccagccgacucaacaaagcuuugccuuuacggugaaaguacguucaggucucuucccgguccaguacuugacuguccacaccguucccacucacugguuuugagccucugcagcagccucccguccuuccaacucugucuuggcugugccucaugacucagugcucuccacgcaguggccagagugauucugcugcuguggaggucaguccugccuccacugagaagcccagacucacccagagcccacacaggacuuugaagggugugugacccugcuucccgucuggccccuucugaccugucugcccuggguucucugaucuugccgucucuugaacacacagugaauuuucccccaggggacaucaccccaccaugacccacuuuccugaggccucuccacccucacccuaggccacucucccacucuuugccacugucaccguuccagaaugaucuugaccaagcaucauggcacucugcucacugugcccacaacggcugcuuuucuucuuacauggugucugcugugccuuuucuguuaucacgcucgccugccugugccugccugccugccugccugccugccugccugugcuugccugccugccugccugugccugccugccucccucccucccucccucccucccucccucccucccucccucccucccucccucccuccuuccuucccuugcucccucccucccuuucuuuuuguuucuguacaggguuucucugcauagcccuggcuguccuugagcuugaucugugcauuaaacuggucucaaacucagagauccgccugccucugccucccgagugcugggauuaaaggcaugauccaccauugccuagcucccugcuucuucagauucguaaaaggugguguaaaagggcagaggaccgggucaugcguccaggcaccaagugcaggcggguggcuuuccaucaaguugcagggucuucuauucuggcuuucugcuagugucugcugcuguguugcagcugauguuccaucuuuauuuauuuuauaguuuguaugugcacacauguaugugcagacauguaugugcaggugcacacauguaugugcaggugcauguguguagaggucagcagccagucuuagguguuguuccucaggagccauauacuuugucugagccagggccucuuacuggccuggagcaugcugcucagguuaggccgucugauggggucugccugucucugccuccccagcaccgggauucuaagcaugcugccacauaacuggcuuugaagacuauuuggguuuggggacucagauccucauguuuacauguuaagcaaguacauucccaguccuaguuuuuauuuuuuugcuaaauaauuugugauuauuauauuuuuauuuuaguuuaugugggguguuuugggugcauguaugucuguacuauguacgugcagaggccagaagagguccuggaaucaaaccuagguucucuggaagagcaaccagcuguugagccaucucuccagcucccuaauuuguguuucuagaacaaaagagugugccacugugauguuguuguaaggugucuggcuuuugcucaugacuccccaguuguggaaaugucacguucccaucuaaugcaggaugagcuccgcaucccauagccugccugugucuccuccaggucuuccaucgacagcgagccagccuuggucuugggaccucugaagucugcacaggagcugcggagggaacagcagcuggcagagaucgagacucgcaggcaggagagggagaagaauggcaaagaagagggcgaagaaggcagggcccggccuccugggcaggagaugguggaugaguuacagggccccuucuccuacgacuucuccuacugggcccgguaagcgcuugggccgugcguggucugucuuccggggacagagccaaccagccacgcugaacucuucucacuccuucaggucuggagagaaaaucacuguuacacccucguccaaagagcuccucuuuuaucccccauccauggaagccacugucaguggagguaugcguccaccccaugagcggguauugugccuuuguuucucuauuuguguguguuuaaaugggugcugugcuauauuugugcagccaugucugcaagccacccaaaagccucuuuggugucauuaguggaugaaugcauggauguauguauagauguguauagaugaaugcauggauggauggaugcauggauggaugauagauggauggaugacagagccagcuuagucagucaacagggucucaagagagggagggaggauugaaaagaaaaguacaauuaggcaacaguauaaccugacuccagccagugcugaggcugaagcagguuuauuuuuucccagccacuuuuauaccauucuaggcacuugcagagaauagggucaguucuuagaucaaagacagaguaaucaaacgagguaauaaacaaagcccccuggucacuguuucuaggggcuaaucaggaugaccaagauaagaggcgugugacacauuccuaggcuucguucucccugagcuuuauguuaacccaggugugaauguucuuaucggagcccagugacagguacuugccaaauuucuauaaguggcaccaagaguuuuccacagauguaugcauguauguauguauggaugaauggacgauggauggacgugugcauggauggaugaauagucuaaguagagauagcuucugugacuauagguguaguggugugcagugagaauuuuggaauuuugguuucuuuaaacacacacacacacacacacacagagaaauacuauaagaauauguuuuuguuuuaaucccaggugugggaugugggcuguuucagauaguccacagcagcuaugauuugccucauguucuaguagggccguguuuuugccagcugcagauaguuuuugugauugugugacauuuggaauucuggcgacuucucugggggauauauaaauacuagggccccuagaagugggcuggucaugguuuguuaaauaguuaugugaaaagcagaaacaagaagaagaaagaagauacccuggagcugaaggaccagcuugcccuuagucagcagggaauagucuaaugacacuguugcccggguuuauucagggaucucuuuccuuuccucucuguccuuuuucucucuuaucuuguguuaggagguugaaaggguggaagaaacaagaacccacaaaguagucaaagacaguugcagugguguuuucuggaggaccagucuuccuuugauuuuacugguccagaaggcagaggaagagucacaguaccaguugccaaacuugcuugaguuugguucuucugaugguuuaggucugccuguucccagguguggagggaaggucuucuucaggaacagguuaucacagugauuugcccagggaacauuuuauggcaucuuuagaguugaguauguugggagagcgaguuucugcuguuucuuccucuccccucaccgucuucacaccgggucugaguuggaccagcaccucuuuggaagauuuuagguggcuugcucugucuccaacuuacucucuggagacagggucucucacugaaccuggagguagacuggcagccagcaaccccagccaugcucuugccuucauccccccagugccaaggcuacaggcacauggcuaaacuuggcugcuuacauguguauugggcuucaagcucagguccugauccuugcagcacagcacggucucuccagcccgaguuccuccuuaguaaccucaggucugggcucccuuugcucagagaacuccaguugaacaccugcuucccuccuguuuucuuccuucuuagaaagcuguccagggaaguuaauugagauccaugggaaggcgggcuuguuccuggaaggccagauucacccagagcuggagggagucgagauugucaucagcgagaagggagcaaguucacccuugaucacugucuucaccgaugacaaaggugccuacagguauguucccaaagagaaaccacuuggcuggcugcagggaacguccugaggcaggucagacuuccuggcgagggcugggcuucccuugaagcugaaaacagccauuuguaggguuuggcucucuuuccugcaguguugguccccuacacagugaccuggaguauacugugaacucacagaaggagggcuacgugcugacugccguggaaggaaccgugggagacuucaaggcuuaugccuuggccggcgugagcuucgagguaaugugcguccaaggccacuucacugagggcaacguacacgaucauagaacacacaggaaguagacagucaguuucauacauggccaaacaccauacaaagcgcaguccuucacgccgguaccuccucuuucugucagcgacuuuccaucuuccagaacauuuauuauauaaguggaauugugccccgugugcuggccuggcuuccuuuacugggguaagcuguggagagagaucaacuuuccuguggcugugcauguuggcugucauccccugacuuuggaagcagggcgucuagcucagauuagccucuaacccucuaucucucuguguagucuaaaacacauccuugaacucccaauccucuuuucucucuguaccaaacucugagaagacaggcucaguauaugcagauguccauccucagucuaggcagcccuggggauggcgcccagggcguccgucgugcgugcugggcaggcacucaagcaagcucccucccucccuaggaccuaggcugccauucccaugguggugccaagugucucuuuugucccucauucucugugugagguguggugugacaugggcugggcaggaguugagugugacucuguagcgcacuucccaugcagccggaggcgucacugccgaguguguguuagaccagaugcggucauggaagaaccguaugcaccauagauggugcccgugguuuauaagacaccccuagaucacugagaacacagccauucguggaagcgauucaauggcuaggaagauggaagacacacucugauucuacagcuacugagcaagugccagggagauuaccacauagaugcuauuugggggauggaguuguaguaaguccaaauucuuuauuuguggcgugagccuauuuggccaugcaaagguaauuuaugguacugcuguggcaaaaugccuaaccuaguacaagcaaugaaggaaggcaggauugcuuuagguucauuguuugaggguccauguccguguuggugggaagcaugguagcagcuguaacggguagggcacagcuggccugcuggcuauggauugcugaccucaguucuagaauguucugaucgauuaccuucuuccagauuaaagcugaagacgaccagccgcucccugggguccucuuaucccucagugguggcguguuucguuccaaccuccugacccaagacaacggcauucugacuuucucaaaccugguaaggcccugccagggacacagcacaggucacuggauguguggcuggacaguguaagaacaguuggccauguaacgggcucuggagauccaccuguuacagcauggcucuuacucaggacccggcugcuucugaccaguguuuucuuuacagcaaggcaguguaacuaacugccuggccacagccgcuccucccucaggcauccuuuuguuuuccacagaugugugugugugugugugugaguguguguguguguguguaggggaguaugacagugacuggcuuacuuguguuucuuuggcaaaguccgcuccaugugugaaggucgugauauaccaaguuuuuauccgagguggcauacaaggccaccgccagugggguucauucaugcaggaacaugcguugacagcuggucacuccugagagucgggcuagcacgggccugcccacauagaagggcacaggcuuugcaugcccagccucagcgcaucccugccacuuguuugcugaguccuuuccaguuguucaugcugguucugauucuuccuaaaguugaggcguggcuucuguucugcugaugugcuaaaggugguaacaacucccuguucacaacauguaggaaccaccauuucugugugucugggaggcucugcugcccugucaucugauuguagcucacaguggcuuuaagccaucugaaguguggcagccaccucaguugugccugucucuuggcagagcccuggacaguacuacuuuaaacccaugaugaaggaguuccgcuuugagccauccucacagaugauagaagugcaggaggggcagaaccugaggaucaccaucacuggcuuucgaacugccuacaggugcguguccuccccaagcugcaggugugugcccuccccaggcugcaggugugugcccucccccaagcugcaggugugugcccuccccaggcugcaggugugugcccucccucaggcugcagguguaugcccucccucaggcugcaggugugugcccucccccaggcugcaggugugugcccucccccaggcugcagguguguguccuccccagguugcaggugugugcccucccccaggcugcaggugugugcccucccccaggcugcaggugugugcccucccucagucugcaggugugugcccuccuccaggcugcagguguguguccuccccaggcugcaggugugugcccuccccaggcugcagguguaugcccucccucaggcugcaggugugugcccuccccaggcugcaggugggcuauacugggacucugaucuagaaaugccugccaggguuacacagugacuaaauuuggggagggcuuugagguaagguagaggucagaaagguggcucuuucuugcgauguguaggugacuacuacccuccucccacuguccccccacuuuugugcccuccuuccaguaugucaccugcugcccacucaccagcauacucucugaaaacuugucuauggcagccuagugccuuacuuaaaaaaaaauuguuuuaaaaauguuugaaauaugauuauguuuuuaagaggaggaaacaucauaaugagcagaacuugcagauguuggaagagagucgauggcggaaaguuagcuuucugacuggauauaauggugcacacuguuaauccaaggcgcaggcaggcaggguugugaguucuaggccaggccugauuuacauagugaguuccaggaccuccagggcuacacagagagauucuguuugaaaaaaauccggaacuggagagauggcucagugguuaggagcacagacuguucuuccagagguccugaguucaguucccagcaaccacaugggaaccaucuguaaugagguccgacgcccucuucuggugcgucugaagagagugacugugaagucacaugaauaaaauaaauaauaaaauaaaucuuaaaaaaaaaaaagaaaaaaauccaaauuaaauggaaccaaaacaacaacaaaaaccccaccaaauagauagauugacagacagacagagagacagacagauagccuuucuguucuugccuccucaacccccagguucccuuccaggagguguccagaauuuccauuucuucagaguauucucaggggcagcugagugauggccacgaacccugugcauaugagcagauauacaaacaugcauguuuacauggguuuauaaaagcacuuuggaugaaggauaaucagcucaggcauagaaaaggggaucauuuuaacugauuauguggaaugaaaacccuuauggguuauuuacauuauccagugcaucacaguuucagaucagcagcgguggaagcauccuuaugauaagagcagauuugcccuggaaccgcugguccacaagugcccugugcaucagagaccccaaggugauauauuccauuucuccucuugucaccccagcugcuacggcacugugucgucuuuaaauggagagccagagcagggugucgcgguggaggcuguggggcagaaagacugcagcaucuauggagaagacacggugacagacgaggaggggaaguuccgguuacgugggcugcuggugaggcugugugauuucucggguguuucccucuugcugucagugguguccuucugggauagccugggccaacaggcuggagggagagacucuggaaucccugugcucguauuuuggccgacaggguguguguuuagccaacaugccugucuuguucugugggaaaauaaggccccuaaagggggauuggcauagcuuugcccagggcugaaaucucuugaaccagcaggccuucacaguucaaaucacgcucagugccaccacguuccauauuccuaggauagaccguuuggccccacuuaaagcaauccacaguccccaaauccacauccucccaagcaaacacuuggucaagacuaccgcagccauacccugcuccugguaccagcuucugucuuaggguuuuacuacugugaagagacaccaagaccaaggcaagucuuauaaaggacaacauuuaauugggucuggcuuacagguucagagguuuaguccauuuucaucauggcaggagcauggccguguccggaaagacauggcacuggaagagcugagaguucuacaucuuguucugaggucaaacagaagauugacucccaggcagcuaggaggaaggucucaaagcccacccccacagugacacacuucuuacaacaaggccacaccucccagugcuacacccugggccaagcaucuucaaaccaccacagcuggagaugccuucuuagauaagaaucucagagccacuuucgugaucccuggcugccuuugcuugucucacuuagcugaccagggugccuguggagauaucucugacaaggcauggcugcuucauggcugaagucaaguuggagaggaaaggguuuauuucacaucacugcgcaucaucaaagacagacagggcaagaauucaaacagggcaggagcucaugcagaggccauggaggggggcugcugacgggcuugcuuuccccugacuggcucagccugcucucuuauagaacccaggacuaccaguccagggauggccccacccacaguggauggaguucucucacaucaaucacuaauuaagaaaauguccuacagacucaccuauaggcaagucugauaaagucauuuucucucccaaaaugacucuagcuuguguuggcuggcauagcuggccaguauagcugccagaggcuauaggcaaauccuuggcacagcuagccaaggguugaaaagguuccucgaagguguggccugcaggcccuagcccugggcaaguggcaguggccauauucccaguguuaauagucccaucuccucucuugagucucuuacccucaaggagcaaauaacuauuuaacuggaauguccaggccuaauuggacaugugucuaauuguggccucaccuuuuaacuggcuucacaguguuuuauuuauuuuuaauaauguuuuauucuuugagaauuuuacacacuauauuuugauauucuuuccccucuucaacuccucccagauucucuccaccuucuuacuugcccaccuuuguuuuuuuuuuuucucucuucaaacaaacaaauagaaacaaagacaaagaagcugagguaaagugagggauuuaguguguguuggccgacuucucccgagcagagggcaugcccuaaagugguugaugguauucagugucacuuaauugaagaaaacggauuugucucuaucccaguuacagauggcuuggguaugggugggucucugugccuacuucuccaugcugagcuuuuugucuggcuuaagcugaaguucugugugcacugucauacucucugaguucauguguguaucuaucugcacuguugucuguagaaaacaguuucuuugacaucuccugccccuggcucuuacagccuuccugcacaggcccuugggcaguaaggugaagagugugauaacagacaccccacuagggccgagcccccccaagucucuuacucucugcaugcuguccacuuguggauuucuaugccauuguauugcuauguucauuuggcaucuuaauagugguagcaguaggcuuuccugcaggcccauggccugucuacgcuuacauucuuagcagcuguagcagugucaggaaugggcucaauccuguggagcaggcccuaaauccaaaacuaaagaagacuccuggacauuagagccaccaucucacuaaugggcacaugguacacacagguugugccuguagcuugcaggcugugcaguuaggugagacuuguaaguacuuuucacucugguguugcaccuggcaccuuccagcucuaauuaauaaugcuagccagcgggagugaugcuuccaggcgagugccaagguuucucuauguucugugacauaggugugcaaucuuagcaguaggcacugccaucagcacugggaccaugguguaauguuuggaggucuagggcucaucuuuggcacaauguuuuuauuuuucuaaguaaaagauuuacuguccuuguaaagaucucaugucuccuuuguagaacucaaguaacaugugaaaacgaacaugacucuaaaagggagaguggccuauggagcccuugcucugcccguggcguagggcaaugcucagagcuguguagcagcaugagaccagagcucugcuauccagucugugcuggcugaaaaaucacugcucacccugggcugcucugcuccuggaggcgcacagacaccugggaccuuaacccagugcuucagagcauggccuuacagcugugcuguuggcggccggggguugguaccagagcuguuucaauaguacuuuuuuguuuguguuucgagacaggguuucucuguauaguccuggaacuggaacucacuuuguagacuaggcuggccucgaacucagaaauccgccugccucugucucccgagugcugggucuaaaggcgugcaccaccacugcccggcucuauaguacguuuagugaacauaauaauaauccuguaaauuugaguaauaaaacaaagacauaaauaaggacauuuaagucucucuuuuuuuuuuuuuuuuuuuaaaagaaaagcagccucaaauccuauccauugucaggaccaucagugugguugcaguuguaacuggacuguacaggucaaggagggggugagcagaggccagaagagucuacaagaauaagggagacgcucguaaucaggaaacgagccccauuuaaccugugaaaugagagugugcuucaguaggaaggguuauuagcaccgguggcaucuugucaccagggcacuucuaaaggggucucaguggaaagugcaaacugggaaauggggggauacagauguccuguguggugaccacuugucgcaaagucacucucaggucaugugugacagacuuuauagagaaguaacaacggaugucuucauagccagggugcauguaccacgugcagcugaaggcagaaggcaaugaccacaucgagcgggcgcugccccaccaccgggugauugagguaaguaggcaucacuccugccacguagcgcuguggcuuccgguuggugcucucgggguggcuuguaaguccuaccuuggcauccuugcgaguggcgucugaagaggguuuuuuuucuugguguggucuuuuuguguacauguguggugguguguauguguguggguguguguacaccugugaagauguguguggaagccacagguugaugccaggcaucuuccuugauugcucucuacuuacuuacuuacuugcagaaccuggaacucacagauucagcuagcucggccagccagcuugcccuggggagcccuugucuauacuuccugagugcuggcgguauaggcugcccacccuugucuacacuucccgagugcugguguuauagacugcccacugugcccaccugccuuuuacaugggcucuggggaucugaacuuuacucuugacacuuguguagcaaguguuuuauccacuaagccaucuccacaacccuuaagagagguucuuuugcaaaaacuaauuacuuagcugggccauaguagugcauguuuugaaccccagcacuugggaggcagagguagguggaucucugaguucaaagccagccuggucuacaaaacuaguuccagaacagccagggcuacccagagaaacccugccuugaaagacaaaaauccaauuauuuaauuauuuaauauuuuuauuuauucuuugagaauuucacacauauauacaauguauuuuaaucauaccuaccccucgccucccuuuuucuaauccccuccaaaucuuucucaacauccguccuacauucaugucuuuuuauuucgguaacccacugauucagugcucucuguacacgaauggguguggccguccacuggagugugggcugccugccagaggccacacccccaaaggaaaauggcuccuccucccccuggagcugucuacuaccuguagcuccugagcuaggccuuguccccccaucugugcaauggcuuugaauggcuugucauguugggguaacugcagccucugugaguucgugagggcacuggccauccggaagguggcuuucacagcuccccucucaccgucuuaccuucuuuccagugucccugagucuucgaggugguggcuugaugcauugucccauuuagacaugaguacucauggucacuguucucagcagugcagugugucucugcacugaccauuguccacugcaaaauuaagcugaguagcacagaccuguggguuucuaaacauacuacguggaacaacagugaguuccacucuagggcccggaagccucucaccuauacgcuuuuggccuaugccauucacaggaaguggcucggacaccauuaaagugguguucuuuccaguagccuggaggguuucggggcgcagaacuaccuaccaaggccccaagagugggggccuuggagcagaguggggggcccugugggacuugcugaucuagagcuggauugcuggccucugccacuuuaaaccgcugggcugcugcucacaccagaggccuuuccugauuuuucucuccgugcucaggccgggcucuugggcaacaauguagacugcagucaagcaggucugaaagagcagugagcccucuggugcccccgcgugggugggcacagauagccagggcucugccuugcuggagcugccagacgagcuuuaaaaauguuggcaggcagugaaaacuuagaaaacaaauacccucauguaccacugugucugcgagcuggcuguuagccaguugcugcugugugugccugggacagagccauuuggaagcagccccccgcacucugcucaaugugcgccucucucuuagguugggaacaaugacguggaugacguaaacaucauaguuuuccggcagaucaaccaguuugaccugaguggaaacguaaucacuuccuccgaguaucugucuaccuuguggguaagaguccugaaaaagacccagaguccacgggagagaugguuguccucgcugacucuggcuuuagugugcuacgaggucacaccuggcuugggagcugaguaucaggugaugggggagagucuggauugggaugucaaaguugucagcccucacucagccuggcagccugcaguagagcaauaugaaggcucagcgcaguggagcgcccaugggagggugcaguguaccccgugcaguucauucuccuagucugggugcugagcauggccugagccaggcaggcuggcugccaggaccacacaucuuacuucccuaucucucucuucucucuuuuaaaaccugaaccuuggaccuccaccuuucucccagcucugaccaauuccauggaagauguagagcuuuuauaaaaagacuugugaccucugggaguuguuaaugguuuaucccuggggucugggcaguacgcuuagaacacagugaaagguuagcccgguuaggauguacuuggccucugacuugcucucaguacgcuuaguugggaccuggaugacaucugugucagguggguagauagugucagagugccgugaaggugagaguggacugaguagccacacuccuauuuugaggggaggguucagaggggaggaugguacuguggccugguuucgccugguuggugcugggcuagaguuuugguucaggguucaaaucacuugaauuuucuagaaaagcuagaaaucggagucagcugaaaucaccuccuuuuccacguagcccauaaauuaagauuuacucgcaaagcuguaugugaccaaagagcacagacauggucuagcccucauaccugugccaugccauaccuguugaucuguggcucucuccugcauccuggugcacgguagagaggguggccucuauuccugcagaucagugcagaaccggaguuuguaggaagcgcugcagauccaaaggccacugcacacacguguaguucaggucccagugagugaggucacaugggugacgcugccucuggaugagacuuugugaccccagguguguuuagcucucuggagcucaguggaggcauggcgugcuguccuuaggacaggugacaucguugagaaagugcucacugcacgcaugacacacggaggcuguucuuuuccgucuuugccaccaaggcauuacugacuguuggccuugcucacacuggagucgugggggcaaggacuguauccugagaccugucgggagggaacggcugcuuucucaugagccacacugccccaugugcaaugaagucaccucaauaucuuaagcugugcccuuuucuuucugcgcccaggugaagcuguacaaaagcgagagucucgacaaccccauccagacggugucucugggccagucgcucuucuuccacuucccaccgcugcuccgagauggcgagguaagccaggcuggggcacgccagcuuugcaaaugacucucacuucuuagucuuaauacugcucugcagagaugagugccugucagucaaaggggguuggggggaggaugaaucucucaguucacugucuuucuguuuacaaaagcaauacauauuccuaggaggcuugggaaacaaauugaaaccgucagacauaacgccacauccagaacuaaggagugggagguuguugauuggcuuccuuugggucuuuuucagugugugugugcgcgcaugugugccuuccaguguguguauauaguguauuaugaguggguuuguaugugucucuguguauguauguguguacauguguguuuauguguaguguauaugugugucuguguguguauguaguauauguauguauuuguauguaugugcacaugugugcucguguguaugcauuuguaugugucuauguguauaugcauguguauguguguguauuuaguauuuaugugugccugugucuguauguauauguaguguauguauguguuuguauaugugcacacgucuguguauguauguagucuauguauguagucuaugugugugugugcacgcgcacgcguguguacuaagaauugcaguuacugugcagauuuagagcugcccugcucuguccacuguuuggagucagugcuguucagggaugggucugucccuuaccugcuugcugucaucagcucuuugauuauaugcuacccaaugguugcuuguggcuccacuguugggaagugugguaaccgaaccagggcaucccauacucuuagcgcucccgaccgcugugcaucuuuucuuggccuuccuuggucucauugugugcuucuuucuccuguguggcaagucucuugccgcucuguguauccccaucgccaaggauaggaccagggucucacauaugucuggcaagcucugucacacagagcggcauccccuucugugucuggcaaucacagugugucucugaguucuccugcuuggccuuuucugagcucuggccugggugucuguccuccaccccagagucgggugguuuccggccacuguugucaucgucaguuauugacuguccguucacuugacaggugugccagagaacuugguuuccauggcuuuagcuuggggcuguucccugugaaucuaggguauaacgcccucuccuggagcucccuacuacccuggagggcugcugcauggcgccucuuuguguaaacugugggggcugucauggagcuugaggcugcuguccacuguguccauccacaugcuauuuauaaugcuuacuccugaucugugagauaaagugagcaccgcaggccucccacggucacggccagaggccagaguuagaugcagaccucugucuucuccacgaccacuguagaggcacuacuuuucuagaacuugccagcuuaggagccaguuaagucagcuuuguuuccugucagcggcagcucccacggcucaucacaccgucuuucgucagaaccgccuuguaggaacuuguguguuuccugaagcugguccucaaggacuguagucacccaggcccacuaugcucauaaagaagucccguggcccugacagaacccagaagaugcaggcccagagccaccagagaccuguggcucuuacagccugagaguuggugaucagggguggaugcacagacucaggggaaaaugugaagugccgugcauggcugccacguguccccugcuuugccugaacugucuguccuccuccacccacagaacuauguggugcugcuggacaccacgcuccccagaucccaguacgacuacguccugccgcaagucucuuucacugcagugggcuaccacaagcacaucacucugguuuucagucccacgguaaguacgagugggaaguuaaaaaaaauccuuagauggaggccgugaucacagcaucuccuccugccacaucacuuucccauguuggagcuccguggacaccuuucuuccucugugcacugacgccugcuguugggcaacuaguugugagcaagcagaaugguuuaggucacuggcuugguguuugaggaggagggacaccguuucccuuuaaccuguggcauuacauuccuucaugaggaggaacauuuagcaaugcagaggacacgggaguguggaagugucagcaggcaugaauaaacaggaagcaggugacaagauggccguggggaaagacccuggucaguuuaucagccccuguaguaggccccuucacugcugccaucaaaaaccagugcguuccacauucaggagaucauuucaguugccucuggaagcuugugugugguggaaccacuauaaacuuaauagagaugucucugguggaagagguaggguccagguccaagcuuaggaucguggacucugaacaugguuagggccgagaguggcaccccagagacugccuuacaaaagagaagccaugccaucgaggucacucagcagguaagggcacucaccaccacgccuggugaccugaguucagaccuggaacucccacaaguuauccucugaccacacacacaguguaaaacauucuuuuagaaaaagacaagacuuacuuugcagcuauaguugcucauugcuucuggggaaaguaagaauuuaauaaacguuucuuugaggugucuguggagcacuaggcuccguagcuguacugucucguauggaggcacccugugucucagucuguucaggcugcuaagaaguccacgguagagcagguuacuucaagcagcaucugcuccucaugguuccggcaccugggcuuggcgaguccaccugcagauacagugggggagugccagcuccacuccgcuccaucaauggccgugccuggagccacagguggcugaaccagcuccucucagccggacuucaaagggugcugaccccauugaugaaggaucuucucucauuacuuaaucacccuucugucaguaugucaucuuaauuucagaugggacaggucucaauagaggaauugggggaagacaguguucauaaccacauagcacgguguauccagcucguucccagguggugcacacagcuagcugcuugcuuuuagcucuggcauucgggcuuuugagugguugucagucugucuuuggaacugacgguggugggggaguugcugagucaagaaucugcagagcagggauggagcagcacugguguagagcccuugucuagcacacacagagcucugagcuagaucccuagcacacaucagccaggcaugggcacauuccuuuaaucucagcacugaggagguagggccaggagggucacaggcucaaggucgucucagccagagugagcuuauuugugauaguaagagaauucuaagccacuggagucuccuugugccugaauuccagaucugaguuucagggcuugggugaugcacacccacaccccaguuagcuucuuuuuggauaucaagggauuguggguaaccuugggugccaguguggguggcugaguggguugaagcucuggaugacaguggucgaugagugauaacuuacaaggagucauggcugucuuguugcagaggaagcucccugaacaagacauugcgcagggguccuauauugcccugccucugacgcugcugcuccuguuggcgggcuacaaccaugacaagguagggaagccaaggccucaugggaagucggggggcaggagauaggcuaugggagggugcccggugucauggaaguuguagaagguuaagguuggaggagacgaggcaaauuccuacaucuucuuccagugaugucauuuccaauccucagggagguguugccuguagagagucacagccucuguaaaaccucucugccagccuucugcaggcccggggcucccauaaggggaugcacggcgccuuccagguguucauggucucucucauuccagcucauuccuuugcugcugcagcugacgagucgucuucagggagucagagcccuuggccaggcggccucugacagcagcggcccagaagacaugaagagacaaaccaagaaacagaagaccagacgcacgugaggaagaaggaggccccgucuccugcagaugacacagccagggcugccgccugccuggggacaaaggcacaugcucacucacuucaggcaggcccugggcccugucacccuuguguugguguccugccugucuguccucuccuguguagcccuguggugcaaugcgacgaauggacccuccugucacccugcugaacacaauuuauuuucugaguugaagauaauuuauuauuauuauuuuugucagagaaguauuuaagcugagcugguggcgugagaacauaaucuaaucuuccacauucguuugcaagaagaguccaggaaacauggcguuggucugcugugccuucuggacuuuccccaaaccgcccccugcacucgaggcccgugccagaagcugcagcaacaucugucccucccagaagggucugucaacagcuggaugaauaaagucagccacucguuuguguuguaacuuggcauaguguggggugcauacagagcgggugggcauucagccccagcgacagaggcuguggggacugcccuguguggcacagccaaccuguggcugagcucagcucacuguggucccuggauguacguccuguaucuuagagaagccagaagaacucuguugugcugggcuuu

SEQ ID NO: 3819 - RNA, 16898 nt, Mus musculus
auuuggacgauucuuuuaauguuaggcagagagcuuuuucuuuucacuguaagccuuucucuaccacgugcacuuuuaauucuauacaggugacaucguaagcaaaaucaaauagguccuuggaaaagcuagaaggccacuuaaccgagcugcuucucuuuccuagaugcuagagguagcaugcuaaucaaacggacaggcggaguguccgccugggaccuguggucagaagacauugagucucuucccuucguucccggugcugcuggaauaguuaccaucagacuagcccucauauagaaacagucaagaacucacaggcaaauaaaagcagcccucugaggagaggcuacaaacucacaggagugaaggcugugagacucagagaaaggaggugcuauuucagauugaaggauucuaauacaauggcagcuagugaacuguucagggaguccauaccaaucagguccuuugguggcaagagacaguguaguuacccauuggucacuguggggcguugauucuaaaacccaugauaguccaguccuuacgugaggcucuguagcauuaucauagaaccuccacauccuucaguggacuucagcucuucuccaggugacuugugauagcaaguacaguguagacgauggagagacgguugucaugcuguguuuugggaauacugaccaagaaaagaaaaaguauaauuaaaaaaaaauugagucccccuccuucuuuaguacugggacuugaagcuagggcuuuauguauacgaggcaagcacucuaccacucaaccccuuuuuauguuugagauuggaucuugcuaagaagcccagguaaggccuaaguagugggaucccacccccaacuuugucacagguggugggcaggcuuguuuuccaccauuuuugacccugauuuguugaagguacagauauagagcccauggcacugaggagccuuggagugaaggaguuuaguuugaugguugaauuccuagguggugugcuggugcugauagugacaagcaagcccacacgugcugggugaccgaccagguacuagacuucccagagaucaaaaugaagaagagugagagaggggagcagagauggcgaaaugcacagaccugggugggaaggaagauggaugaugcucuguguagcuuguccaaccuuuuuccugaaaugacuuaaaaaucuaaaaagggggcuggagaguuggcucaguggugaagacugcuuccuacucugcucuucaucucccacacuggguaguccugaccuucuguaacuccaacucuagggcucugaugcccucugccagucucuguggguggcccauacacacacacacacacacauacacacacacaaaucuuuugaaaucuuuacaaaauaauuaauuucccuugaagggcaugguggcacauaccuguaaccccagcacucaggagccugaaucaggaggaugucugaguucaaggucaucuugaucuauagaguaagucccaggacagcuaaggcugcauagaaaaaccaauaacaacaacaauaaauuuuuauaaagaacucuuuauuguuccacugauaaauuugaugaaauauuuaaggaaacagauagcaccaauuugauaucaaucuuuucagaaaauagaggacacuuucuauaauacuuaauggaauuaguguaauucugauaugaagccccaaugaagauauuaccaaaaagagaaaauuacaauaucccucauaagcauaaacagaaagucuuuaacaaaauacuaaaaauagagcugagggagggauagcucggugguauuccauuuccacagacagucaccugcccccucucacacacagacacacagacacacagacacacacacacagauacacauacacauagacacaugcagacacacauagacauauacagacacauagggacacacacacacagacacagacauauacacagacacacacagacacacacagacacacacagacacacacacacaccaaaccuuuuuaucugaggaaugaauccuagcuuuuaguugugaaggucuguguaauuuucauaguaaucagaaaaaccagaaacauucuggucacugugugaacugaugcaugaagccugcagacagcaccuagcggccauagugaggaaacguuaaggaucuuaugcaguuuaguauagugcauuuguaaacugcugucaucaaaggaaaugucauagaguaaggugagugucuccucucuuguuguugguuucaggucuguccagugucagagaccaaggaaaaucaacaagaggcuugagaucaaaggagaagggaaaacuguucauggauugaccugacuaucccaaauauaugaaacaaauauuaagacuaagaaagcaauuaaaaauuggaguauuuagaaccagaacuuaaaggccauuucaaaaauauauaguagcaucaaagaaucaaaagcagugucuuuuacacuuaaccucaaaaaguauaagcuacuuagagcauaaaccuaagcaaaaaugugcaccguagagacgcccuugggcuggggaaccagcuccaugagccaacguccuugcugugucaggugacaaaguuugcaucuguaaccccagugcccaugauggagucguggaggcugagaggggagagucaagggaagcuugugggucagcaagccuggcuucuacagccaaaggcuggcaccuaaugguuguccucuaaccuccucacaugcucuggggcauccgcaugccugugccugcacgcaaggaugaguuuccacacgcaugcacucagacaucacacaagcacauguacauguauacagugaugaccauggugguggugauggugaugaugguggugguaguggugguuaugguggcgaugaugguaguggugaugguggugguagcgaugaugguaguugugaugguggugguggugguggugaugguagugauggugaugauggugugaguggugauggugaugguggugugguguaguggugauggugaugguggugugguguaguggugauggugaugauggcgguggugaagguggugugggugguagugguaauggugguggugguguggugaugguggugaugguagugauaguaauggugaugacaauaaagaugauaaacugccaggcacugcugaagaaggccuauggagacaucugucacauccgcucaguggugugacaauggugcuaaguuuuuaucuuuucccaagaccauuugcagauaauguaaucccaaucaauggcccaugagacuuuggggggcauaguugacaagcugguucuaacauuuaugcggaaacauaaaugaccauguauccacuguaguuuuauaaaagaggaauagccuuaaugcaaguuacugcguucaugugacccaacuucaacauggcuauacauggugugucaacaacaaucauaaaaacagccugacuuuuacaaaggcagagaggacuuagauagacauuucuccacaggcuaagaagcauagaaagagaugugcuuggugagugacccccccagagaaggguaaacacgaugggauagcagcccguacccaucugacuauaaacccgguggccagugucagccuuauacuucucuagcguaaggcugaaggcaaacccuaaaggacccucaagagcaaucagcacuuuucagagacaaauguauaagauugugcagagggugaaauuuagggcuuuccuuaccuggugcucacagcguaugcugucucauuuauuucuacuaaucauauuaaaugcccauuagugucuuuguuuuacacaugggaacacuagaacucaaacaagcuaagcaccuggcccagcugcacagcggguuggcgggcagaacugggcugccaccuagacaccuugccuugagauagauuugucuuuuccuagcccagguggccuuguuaucacccugggacaugggagggaagugcugaggguacagaucagcuugaguuccguugaugccucuuuauggucugaaaaaugcuuuucuggccuuccuguugaucuuacuagaauggaccuagcugacuugcuggguccuuccaguucaggucuugucuucuuugcuagccuggaagcagaacgugggggucaggcuggagagcacaguaguuugggagcuugggguuauagcucauuugguuaaguacuuguaguauaagcaugcagacugcauuugaccgccagagcccaugugaagaacugggcauggugguauauacuuaucacgucagcacugagaaggcagagaccggcaaaucccaggacucaguggccagcaagccuagccuauucagugaguccuacacaaaagugagggacccuaucuccaaaaagcaggguggaccaguccugaggcacgguaccugagugaccucuggcuugcacauacacauuuuccuguggcuugguugcaguuaacaccuuuaauucaagcaguuaaauauaaagaaaauaggcccaugaaucugggccuuugucucuugcuagggcacccaggaaaccagugagucuccugccugggccccuccugggguaaagccccuucuagaccuccuccucagccccugcugccccagcccugcccuguuucucagccucuuggugggagcaggcugcagggcugguguugcucuugguaguuccagcuuugucccacuggcaugcucugugcuguuuaaccucagucuugcagguucuucccuucuucccuucugugggcauuacuagguuccuccccgcccccuucucugugugugugcgugugugcaugugugcgugcaugugugugugugugcgugugcgugugcgugugcauguguuuuaugucugugccuaugcauaugcacacuauauuauuuuugccuuuauguguucaggcaagacaaaccuuuuaaagagaugauuaaaaaaaaaaaccccaaaaccaauuugcuguuccgugcggagacuucggcuuuuguuuucaugcccuggcugcaucugagcaugaggugcgauuugagaacgacagcaccauuauagaagggguuuucuccaggggaauggccaggucuagaauagaacagccaucugcugccagauggccaggguuccacugcgccguggguuugacccggaggcuggccuuuccuuuguguuugcaucauuggagaaucccccacgccuuggcucccuuugcuugcagacucuucccagccccuccccacccaagguugccucaucccuuaggggucacaguugccccugauggccugaugcuggggacaccuggaugauccagaggaagccagcagcacacuguuuucaugcagcgagguggcaccucagcaucgaaauacccaaauuaauucccugucauuagcagcccucccagcugagaagccccagcaggcaggucagaguguuccaggagggcaguuggggagagguggguucuucugcccauggugaucugauucaccugacacuucguuguuuccgaagcuggcggcuuggggggaauauggggauggguggguggggacauuagaggcggggguaacagagcucacuccucacauccaagaggaaagggugcccggguccucgcugcgcugcuccccuuccgcucaccgcucuccucuaccuugaguuuccuuucuuucugccccugcucuaucgccugcgcuuuugucuuuucugaucauuuuaaaagacagaaugguaagaaaaauaugugauaacagaccccgucccucccucuuccccaauaguagaguggccaccagagaggucugaguugucugagaacaggcugcagcaaagccaggcagcagcaagaaacagagguuucuuuucuuucuguuuucuauuuuguaagguucuuacuauguaaacuugacuggucuggaacuugcuauguagacucaaacucagaggccuccugacucugcuauucagugcuuggauuaaaacucugugccaccaugccuggcacucuuauuuuaacuauuauuauuuuuuuaaaauucuacacaagugcuauauuuacaucacauuccauccuacuuccuuacuccuaaaguucauggguucuucuguaauuauuuauauaaauacauacacauguauauacauacauacauacauacauacauacauacauacauguguauccauccacccaucuaucuguccacccauccauucauccacccacucauccauccaucaauccauccaucuauccaucuauccaucuauccuucuauccauccaucuauccauccauccauccauccuuccacccacccauccauccacccacacauccacccauccacccaucuauccacccauccauccuccuauccauccauccuuccuuccacccauccauccauucuuccacucauccauccauccauccauccauccauccauccuucuauccacccauccauccacccacccacccauccacuaauccugcugugucccuuuagugaugugcacaugugugugcuuuuaggcuggcacuuuuacuuuagugacuauucuugcauuucucaggccucaucugaucgcaaugaaguaucccuacucucuugugaugggcagucacuuuauucacgcucuuacauuguaucaguuccugcuuauuuccuucccuccucuccccucccccccuuuccuuucuauccucgacaggauuaugcugcagagcccaagcuaaccucaaguuuaugauccucuugccucagccucccaggugcuaggauugcaagugugcacuuuagucuuuauacaacauugguucucugucacccagcauccuuaugcauucuuaggaugcccugccuuuucugcucacugucaaguacucaugacugcccacuguagccuuccuauuuucucuuguuucugauacugauggcuuaaucauugguaaagguacacacaggaggccugugggccccuuuggauucacguguggcuacauugggguucuagccucgguuggcuaaaaccuguguugaucuuaggggccuguagggauauguauaugcuuacaucaagaucaagcccaccuaagcauauuauucuuucaggguggguuuuggucucacugcgugguccuggcuguccuggaagggaauauuguucuuuaaaacaaugggccaauuaugauccucacacauccucagauuuagcacuacaaaugcacgccuggccccgagacuguggcagagguccacacaucauguuucccaggcauaaugaccuuugauaccuagggccugaggaccaguggaggucaagucagccuuuggcuacucaggcuucccuccaugucuuuccuggcugcgaccugcugcuuuacuccagucaggugugucacugggcagaaugauaccaggcaggauggcuccagcccugcccuuccuuggacaugucuuugggcagagauuuuaauagagggcuccagaguccccaguuccuggaggcuaacccagacaccacaugaucaucagggcuggguuccccucuccuggggauuccauuuuaggguauaaacaaaagcuuauccuuuuauuggcuuuuauuauuacuuuaugagguaggcaggauagggauuuauuuuuaaaaaguaauuuuaaguuucuuguucuaaaaauaauaugugcucauuguagaauugcauguacuuuaaccaccccagagagaaccgcuuaaaauauuccaauauauuuuccacacuuuucuaugguaguuuugaaaacaugagacgguuauuuuauaaucuagauuuucccaucuauaacaauauugguuuuguuucacuuguauuagcuauccuuuaaaauaguuauuugacauuaaaaaaaaucucauuacuguuuggauaugucacaauuuaugugguuauuuuuggaaauuuagguuguuuacgagguuuugcuauuagaaguuggacaguucuauacugaaaugcuuggucaaagcuauauuuuuauuuuucacuguaauuuuaaauuuauuuuuaaagguauacuuauuuuauagcuggcugucucccucccuccuuucucucucucucucucucucucucucucucucucucucucucucucucucucucucucuuugcccgaauguauguuugugugcuacauaggcccuuggaggccagacaggggcuuuaaaugcccugggacuggagguagagaugguugugagcugccacgugugugcugggaacugaacccugguccucuguaggacuggccaaugcucuuaaccacugagccgucuuuccagcccucaacuguacuuuuuaugugugggguguuuugcuucuauggaugucuauggaugucuguacagugugugcaugcagugcucuuagaggucagcagagggcaucagauuccuggggaguagaauuacagacugagccaucauguagauucuuagucgggcagugguggcgcacgccuuuaaucccagcacucgggaggcagaggcagacgaauuucugaguucgaggccagccuggucuacagagugaguuccaggacagccagggcuacacagagaaacccugucucgaaaaacaaaacaacaacaacaaaaaaaaaugaacuugaguccucuggaagggcagccacucuuaaccaucaugguucaauaaccaucucuccagcuccuagguauuauguaauaaggaauacaguaccaugggaauucuauuucuuuucccagacagggucucauguauccuaggcuggucuggaacucuguucauagcugagaaugaccuuggucucuuaaucuuccuuauuucucuaauuguaggcccgugccagcacacuggcuaagcaugcagacuuuuuaaaagcuugagaauagguuuauuacagcaagaacuucuaaaguugauauucugguucagucauuguugguacggaugagggugugugagcaugcuaagccccagggcccuucacuuaggccacagguucuuaaaagcccuuuacgaucucccugcugguucccuuggccagagcuaggauagagaguagaucguacagagcaagaagugugaccgaccuugcguugacugagggcccagucuuccuuauuaggacacgagaagaaugccaguccaucaucugcucucagauggggacaaugcacgugaggacauugcaaacaccaggagcccaguggugccacaaauccgucucguuuuuuuaucucagagucaaauaacacgaggacaugaccacucauagucgaugggcacugaagccucagagaccacucagccuuggcuccuuauucuacagguucagaaagcagaggcucaggggaccuaaugcuguccagugucacccggcggggcaucuccauacucuugucucuguaucacaucccuguucaaagguuucucugguucugcuucauaguuuuacccaguccuuuuaacauccuguugcauugugcuaauuuacucuuuguggcguugaaagaaaauggaauccuaggaaauuacagaugcucagcuucauugcuucaucuugggaaucagugagccagaucaugggaaguguagcagauacacauguuuggggguguaaguaccucauggcugugacuuucaguccuccaguccuugagcccccagacccuggugucuguaccccuugcucccucaucuucuauuuuauugcuagcacccuugcuguguucaguauuuaugucccucuaaauugugagcauugugaugucugaauuucuuaaagacuuauuuauguuuaacuuucuuugggguggguggguagguguuuuguuuguaugucugcaggugcaccacauaauucuaugugugccuggugcccucagaguccaggagaggguguuggguugguugccuagagccugaguuacaagugauuauggacugcucugugggugcugggaucugaacuugggucuucugcaagggcaggcagugauuuuaaucacugagacaccucuccaguucccaggacuucucauacaucuucccacccaaugccuggcacagaagaauauuugguauugaaugaauuuaguuuccugugaaggcuuaggcaagucuucccucucuuauggccuccucucagcauucacaaauucaugggccgaaauucuuucugguuccaacauuucauaauucuauuuauucuuaguuuuuaaguauuuggcaacacuagagccauuuucuuucuauuuucaaauaaaaauuuguauagaaccucaaaauauaaaauauaacugcaaaacuggcucuaggguuaagagcaccugggauaaauucccagcauccacauggcagcucacaaccaucuguaacuccaguuccagggaguccagugcccucuucuggccuuccuggguaccuggcaugcacaugaaaauagacaaauauauacaaaaccucuguauacauaaaaauaaaaauuauauuuuuaaaaagaguagagguagaguagaggguaagaaugaaugccagccacugguucccaaguucagagcaguggggcucacucauagcaccuaguuucacaaauauuucccuagauuaagggaaggcuggagccaugacccaguguugaagcuugugcucggcacaaacaagacucaggcuuuaauccccaguguaguagauggguagacagacagacaagaagacagacagauaaaaaaaucagugcauugucauuguguaggauucuguuuguagucacauaugaauuuguuuuuuguuugaaaccagggucucucuguguauuacuggccugccuagaauuugcuauguggaccaggaugguccugaacucaccgagauccaccugccucccucuccugagugcugggauucaaggccuuugccgcuauugcuggcugucacguaggacuuugaaggaaauaucgacuguuggggaugauacaguguggcaucgggugcaggaugcuaggugagcgguuaucucuuuaggugcuuuuuacuuaguuauaccaaagaagagucaggcuaaguuuuuccuggugagauuucauuagugauucauuugaucaagguuacccaguguacuuaaccauucuuguaguuguauuuuuugucauucuguauacacuggggggucugggagggggcugugcuguggcauguguuuagaggugcuagagaguugguucucucccacugcugccuuguggggcaguaccaugaacucagacggucaggcggucagguguggugguuuacccucuacccgucuggcuagccccucccagugugcuucugucuaguuuuucuuccaugaguacaggugucaugggaccugagcaucuguuugcuguggcauugccagggagaaagaccccuuuccaagguggcucuuuauucagucucaucucugcuccaucccaccgaacuguacccuguugaggugacuagggagcucacagccaugugaagcacuggguugucagugagugaagauacagggugaaugacacugcagcuucuuuccuuguuagcgcacagucacauugaaccccgggguuagcagcugggaggcaggcugagcuaauauuuacccagcucugugaucagaacuguuugagggaugguuuggcuuguuugcauucgaauauccaauaauaaucaagagagacggaaagcucuuguuguuuuuuuuucaaauacauauuuaccauguauuacauuaucuuuuauuaauacagcagcuaaggaaacauucaaaugacauuguccuucgaucguuugauuuacggggcuuccuggaugucagcggcagggacucagcugauaauuuucuuuaagguucucaacacucagagaaacaucauggugcuucuuacccccagccugccccaaagcugcuugcauuuugucggauccuugugccuagggcugugcuguagaaguuggagccuagugguccuauuuccaacagaaguucuugaagugacuguuacuggaagagccgagacauguuguugacggcuacaacugaucaccccagcugauugguucugucuggacguaugagaacugucaugacauuuggaauuacucaaacucaacuuuccaggaugggguaaauuucgaaucuaagguuuaaggauccagcaggcccuugccugccuggcucaaaagcugggauucagaaaacagugucuuuaaaaaaaaaaaaaaaaaaaaaaaaaaagagcacaguugcccuuuguauucccagggcaauugguuucaggacccucugggaaggucagauuuuguagaggcucaagucuccuuugucaaauguagccucaaaucccauauguaacacguaguguuuguauacgcugaauacgugccauccgguauacuuuaaaucagcuauacauuacuuuuucauuaaaauuuuaaaauguauauucugucugcauguuaugucugggcaucacuugugugcagugcccaaguaggccagcagggggcauagaugcuccuaggacuggaguugugaggcuccaugugggugcugagaauugaaccaggguccucuggaagagcagccagugcucuuaacuacugagccaucucuccagaccugagugagaccaugcgugggcuuucuuuaaccacgguccaacucuacagaaaacuugcuucuccaauacagacacugcauuaucguauuucuuaguguuuaacaucaucuaaugugcugaaaggaaacugcuuuuugcuccuaaaauuagacuuugacauugacuuuugccccagaaaaacaggcauuucagaaucaaauaguugcauugaaaguuuaguaguuaaaacucagugucuuguuucccguugcugugagaaagcaccccagcaagaggaacuuguggggaaggcucauuucugcucacaguuugagggugcgcuccaucuuguccaucaugguuggcaguguaggguauggaaggggucagaguggcaggaguuugaagcaggcuggucacaugguauucagauucaggacagagagaagggguaugcagaccagagcucagcccacuuucuccauguucuauagcccagcauccccacgcggggguagucccaagacaccagucuccuaugagcacauuuuguuucaugguuguucauauauuuaaaaacuuaaugacccuuuauguuguggccacugauugaauuacuacccauaaaccacuucauuguucuguaugcccucagcaagcuuacuggacagugacuacaucuccagcuucucaggaccuccauuccauucagccguccugacaacaaaacuuagcacucaccacuggcaggggucagggaauggcuggagacuucuucccagcccuuuucccuuagaccagucauuaauuuaucauucggggcucagacaaucccaacuugagcaaugucccguguguucccacacauuuauuucaucucccuuaaagaucuuccuacauuuuuuuuuaauuuagugacugcagugguuaauccccauugucuauuggaaugguucucucucucucucucucucucucucucucucucucuuuccccacuuguguguaugcacauacaaaugugcauguauucuuuugauauuuacuuauucuuauuuauuuuucauuaguuaauuuauuacuuaaguuauauucgguugcagccccuccccucuacuccuucugguuucacucucucaaaucccucccccauuaccccuuccccuucuccucagaagucacaccacccugggacuucaaauugcaauaggacuaagcacauccccucccgcugaggcccaaccaggcaguccagcuaggggaagagauccaauggcaggcaacagagucagagacagccucugcuccaauuguuagaggauccacaugaagacugagcugcauauauguuacaaguguguagggggccuagguccagccccugcaugcucuuugguuagugauucuacuuauuuuuauuuuaugcauguggguauuuugccugcauguaugucugugcaccaugugcaugcaguaccugcagaggccagaagagggaguuggaucaccuggaguuagaguauagugagccaccaugcagauauuaggagucagccaguacccuuaaccacugagccaucucucuaguccaccauuuauuauuauuauuauuauuauuauuauuauuauuauuaauuuuuauuaucauuagacuuaguugacagcuggguucugugguguuuggaugcuccagggcagggauuuugaacaucguucugcauugggguuauccugaggacuuguuaagauagcuugcucgaaucccagaguuucuguuucacuugauuuggaauggagccugagaaauaucuaccaagguccaggccuuccuagugcugcugaccugagcccugggcugaaagcccugcccaggguuaccuggccugcgguggagcuccugggcaagauuuugagcugucugcucuuuagugcaggugcacguagacagagauuucuggaguguggacugaguuccagagugcuaaauguuacacugcuuagacuguuggaccucuaaagucagauuuuguuuaaggacuauauucauauuacuuuguuucuguagcucuccaaaauagguagggcagugagcuggaugucgggugaugcuugaguggggguggggcacauugcaagccuggcauaucagacaucaguucuaggccuuucguaagaacaaagccgaaaguagagcucguuauugguuaaaucugagcagaguacauuauccucugugucacugucugugaauuaagcaguuuauuuugcccccaggucccuucuaguaguagccugaucuuccgugccggucagcaguucauuaaaaguguuacuauuauuacaauagaaagcagucaaaggagagaaugguuuucuugguaaguuuuacuuggcaguauuauuuauuugucuuuguaguaacugagcuagucuuggaauggauaccugagccaccaggcaggugacagccugucgcugcuccugggcgcacaggugauggugcuaucuacucaaacugcagauacagucagagcaggcacugugcggaaccagggcacugaaaagacggaggaaauacuagaaauacauucuuccucagacuguuucaucugaggugcggaaacagcaccgcggacaucgcggugguggaacugacucugcccaugcaauacggcuucagcucuuuaagggcccuuagcaccauucuccuuaaucccuuuggcuuaccaacguugagaugacacuuagagaagaaaaacacucuucugaacugcacaccuaguagguggccuggcuuugcauugagcccuguccucugggccucggcuuggagcuggccucauugcguaguggaaccuucccuuggcugguccuacucccaauuguguagaccuucagaccccucaagaguuacuuguggacaguagaguguagggcaagcuuuguaugagucgucccuguucuccaaaugccauuuuuuuggcaugaggaauuggcucugucuccaccaucuucuccccaugacuacagccauuuguuuuccaucuuuaggguagggcugggccgagcguucuauggucaaucaaauuaaaggcggcgagaguuucaucugcaauccccaugccugaguccugccuuaaugagcuccuguagggucgaguccugccuuggugcuaagggugcuuucuugauggugagagaguuuaggguucagguggggucaagaagguaccgucuguugaagguccccucugugcugugcuaacaggacuugcauagggacagagcugaugaguugugacgucggguucugaugagaguuagcugaacucugauccuguacauacuucaguguauucagggcuuaagaguauuugccccuaugagcuucagcucuuaaaacuaaauuccagggcauugauuaauggucuguauuuuagccaauacucgucacgggagaggcagaccccacccacaagcuucucccucugggauggagaagagggaugggucuggaaaaugucagagaaaugauaggggcucaguggguaacgugcuagcccuuaagccugaagagccccaggcaagccccaggaagcacagaguggaaggagcgaacugguucucacaaguuguccucugaccuccacgaguacacuguggcguucauacacccacacacauaccccaagcccauauacaaaaugcugcaaaagagagagggguggggugggugagugguggggagagauuuagagagaauaugaaugguggaggagcguuuaaaccagaccugagacagcagaggaugaaaggcccauugcagacugagggcaggagcacuguggagagggccaguguucugcuaccugucugucacagugccuaucacuuaaugguuuucccauggauguuugcugaaugaauaugugaaugggaugcuggggaaagcuuuugcuucuuacauaauaacuaaaguuaucuugcaaugcaucaugguuccaaacagcuuacccccagcuccucccgucagucuguuuuggguuuccuuccuauauuuugaauguacacacacacacacacacacacacacguuccaucuuuccuuuaugcuauggggugucuuccuaccucagagagaucagaaauggagcuguccuauugucuccugagugg

SEQ ID NO: 3820 - RNA, 4614 nt, Mus musculus
agacaucuuuauccuuuggcuuuuuuaauauauuuucccugcagacagauaggcagaugggccaauauagugaaguaugccacacucugaaaguggcaacaugugacaacaugugacaagagcaggaugaaucccaaguuccucauccuccaucccacaggcuccauccauccuccccacguuucuuucucugcuccuguggaguuagucuuccgccuagggaccuggcuuuggcauagcaguugcucccguaugacuagaaucuccgucuucauccgugccuucucgucccuacaaaccagacuggccuucucuagaagaaugccuuugcuuuaugagggaaccaauucauuuacucccgcucagugauguugugucuugcuucccuucuagagcggaaagcagacuuuuguuucgaucaaaagacaaugagaauaaagccaagaaagagugaugcgaucgccacuucuuagguaguguuggccaagacuaguuagaaccugagcugagcuaggcacuggugugguguggugugguguguguguguguguguguguguguguguguguguguguguguguugguguguguguguguuggugugugugggggucaugguguaugugggagugugguguguguguguguguguguguguguguguguguguguguguguguguguacacuuuauggggacagagggucucauguaucccaaacugaccucaaauucaaauucaauacauagccagggcuggccuugaacuucuggucugucagccucugucugccuccccagugcuaggauuauaaauguauaccaucaccagauuuaugcaguucugagaaucuaccuaugcaugcacgcuuagcaagcacuauaccaaacgauaucccugguccccagugcaguuuccaaguuagaguucccaaggcuaagaugaggcauucucgacauagcguucccuacuugaaagaggucgcaggggacaaggccugcaguuagugaagagggcaugauugauaaggcagagguacaccaguaccaauaaaacagagaccgguugugaccagaagauggugggguagggagacaccugaccaguguccaggggagaaguugaugggcagguucccagggcuuaucucagagcaaacuccacuuuucagagaagccccugcauggugggcaaugcuuugcuagcucaagccugcuuagcagacguuggugugguuaaaggcuagagcagaucugcugggguugugugagggaccuucaugguuugaggccauuaccugguggucacaccuuuuuccucugcuuauuuucugugauccauagcaacucuuucuccccagaaaguauuucugagaguucccuguuuccaucgacaaauuuaauuggcaaaguguuuacugggcaucucuagcuucuccgugcuucuuguggacaccaagcugagugacuaucacagagagaggcuuguggcucacagccuaguccacugagugcugucugaguggcagacucagaacuucucaggaaggcccucgggucggaagugauugggguuuuugccacugcggccccauuccucggcuuucuggguagccugcaggguuuccaauccaugguuccugauuccaaaauaauaucgguuuaggaggcccuggaaguauuuccugcuggugcugaaauccgaggaagagagacaggagaugaaucccacacugagacagcugaccucugaagucccuccuccucuccuaccaaagaaugacccagaaauaccagagcaguaaaggcuaaggcacagaaaagagaaaaguauuaguuucuuggucaaggcccucccauggcugguccuuuccauccuguuacaggaugcuuuugggaccccugucuugguuuucaccuuuuccuuguggaggcuuucaccaccaccaccacccugcuuuccaggccucccagacucuggaggcauagacaguaggcgaggccacaggcaggaacagugaaaggcaugaagcaccagaccauuaccugauuauuuuagcagcccagaugcccccagagccccucuguugggccucguaguucccacgagcauagaaguauuggucugcauuuugguaauuagcuucuagguugucccgauaggcucuccacaagucccaagucccuacaaaggaaggaaggguucaaaagugaaccuagugguucauuggagaaccacagugugugugugugugugugugugugugugugugugugugugugugugugaguauguguguguuugugugaguaugugugugugugugugaaagcuuucuguggaucuccacauuuugucccuugacaggauaaucuuuugaaaguggguguuccucccuggggauagguucccuggugaccauaaggagggugcaccuccguggguuggcuuggguuggguugauugacaguuacaguguccugggcugugcccuuauauggauccgugugugcugugcaccaacaagagauggggccgucuugugagagagauaaccacagacaauaacaucccagggguaagauccagggauagcuacgcagucagaggagguggagacuggacauuuaucacaggccccuaagaaagcacagcagaagugugucccccagacgacucuaaauccagccaaguuggcaaagaaggguaaccaccacgggcggcugagcuucggucccuucagcuggggagcuacacacaccuccuaguagauuaaagagaagacaggaugaggugcugcgcaugaagugccuaauagagcgcugcagagguugcaccccuccccaggugcugagggguaacaaaggcauagaccuauguaaccagcccggugacaacugguguccacgcugacacgagcauagagaggcugggacuuuauaagugcaaauuguggacuuguaaaauaguaggccauuggaacacugcuugccggagucuacugacccuuuaaugaggcauaucucccagcccugugauccugcuccuguaugucuauccccggaagaaauggguguuuauccccaacgaacagaaauggacaaucaccaaaacacauuuucaugauguucauuuucgagaaaagaccagaccaacgcagcaugaauaaguaaacguugcugucaaaauacgugacgacgugcaaugcccaauuucuaggaguucugcauccuugcucuugacucuuugucuggaauaggaugggauuucuucaagaaaauauuaucugaaggcaugugcacauuugcuaagcgccugugccucuggagacacacugaguguccacuuacucuuuaagacuggggaauucgcugacucuggaaauccugaucccucuguguuggcaucaaaaaugcaggcuggacauugugaaccaugucugaagaccccucagagggugccaggugaccaguguaggguggaagccacagaaagccagacuccugcccugacucaucuguagcuuuuuaaaggcgucccugugccagacggguauguggcaugugcucagaggaagucaguuaaacauggccgcccuccuccugacuucuuaccuuguacggcuucccugaagaaugaauaccagccaucaccacugacucccaggaacaaagaacagaggacaaugacgguggcaagccucaugaugcugcaggaacagaaagaacagucacaacagaccuacaggcugggagguggugucacacaaccuccauucccagaauuuucaaggcagagacagguggaugaucucuaauucuaagggcagccuggucuauguggcaaguuccagaccacccggggcuacauagugaggccccaucucaaacaaacaaacaaacaaacaaacaaacaaacaaacaaaaacagacucacacuuugacuuguaaagacaaucuaguccugcauuaaccauuuguucaucucugaauuauuacuacaaagauaacagaaacaggcuuuaggaguuucagccagccaaaucacuggauaagaagccuucuacgguguugcuggcuuauagccccuucguaccuagagaagcugucuaaagcugacaauaagucuuuccuaaguguucuaguccacuuagcucagacccccaaagaugcagaaaacucuggccacgagucaguugaucauaugccuuuuuaaugauuuugaggccugggguuucauccccagcaccucaaaaccaagcuuaguagcacaggccuguaaucucaucgcuaggagguagaagcagagguaccaggaguuuaggacccucuauggcuacaaggcuacuuccaggccagugugggcuacauaagacccuaucuccggggggugggguggggaaagaucagaaaacauaauuuuucccaauuagaacuuaccgacucuauaugaaacggaucucaggagugaaucacgagcaagaccucccuggagaagugugacaucgauggauggcccuuucucugguggaaguuucagaggaauugggaccguuaggaccuucucuccauggagugccugcugcuuucucucuccuggcuuuaacauuaaug

SEQ ID NO: 3821 - RNA, 1338 nt, Mus musculus
gggagccgcggccgagaggagggaggaggaggagguggaggaggcgccgggccgcgggauugucaauauuuaaacagagcgcaucaugcgugaguacaagcuaguaguccuugguucaggaggcguggggaagucugcucugacaguucaguuuguucagggaauuuuuguugaaaaauaugacccaacaauagaagauuccuacagaaaacaagucgagguagauugccaacagugcaugcuggagauccuggacacuguaggaacugagcaauuuacagcaaugagggauuuguauaugaaaaauggccaaggguuugcacuaguuuauucaauuacagcucagucuacguuuaaugauuuacaagacuugagagaacagauuuuacggguuaaagacacagaagauguuccaaugauuuugguuggcaauaaaugugacuuggaagaugagcggguaguuggcaaagaacaaggccagaauuuagcaagacagugguguaacugugccuuuuuagagucuucugcaaagucaaagaucaacguuaaugagauauuuuaugaccuggucagacagauaaauagaaaaacaccaguggaaaagaagaagccuaaaaagaaaucauguuugcugcucuagaccugaagucagcagcagcucugagccagauuacagaaaugaagaacuguugccuaauuggaaagugccagcauuccagacuucaaaaacgaaaucugaagaggcuucuccuguuuuauauauuaugugaagaauuuagaucuuauauugguuugcacaaguucccuggagacaaaguugcucuguguauaucucuuggaaagaagacauaguauuucuccuuugcaauagcaguuauaacagaugugaaauaagauacuugacucuaauacaauuauacagaagagcauggaugcauuucaaauguuaaauguacuacuauaaucaaaugauuucauauugacguuuuuaucaugacuccucccugucaagcacuaaaaaauugaaccaucauacuuuauaucuguaaugauauagauuaugaaaucuccucucaaacucauugcagcagauaacuuuuuugagucauugacuucauuuuauauuuaaaauuaugaaaauaucaucugucauuauauucuaauuaaaauugugcaugaugcuuuggaaaaaugggucuuuaauagggaaaaacugggauaacugauuucuauggcuuucaaagcuagaauauauaauauacuaaaccaacucuaauauuguuuuuuguguuuuacugucagauuaaaucacagcuuuuauggaugauuaaauuuaaa

SEQ ID NO: 3822 - RNA, 14632 nt, Mus musculus
gcugcaauuccaagaacugcauguggucauagugugcccuugucagaucuggauuuccugaguaccaauucuaaggagccaacaagcucuaucuaggucucuaccuccccagugcugagaggaguguccuggggacccugugucuuagcaacucagucuuucagcucaaucagcuucuugaguacacuguaguugucuucagccagaagagggcaucggacggcauaggucagccaccagaugauugcuaggaauuggaccucugggagaggagucagugcucuaaaucucuccaguccccacgccaccaacuuaacuuucuuuuuuaaucuugauacaggugucacuacauagcuccagcuguccuggaacuagguaaccaggcucgcugaaaggcaggagauccauccacaugccucugacccugaaaucaaacugaccagcuacccaacuucaucuuaauaaaagagcagagccaucacuguucaagguuuuauuuggcaugacacuugggugguugguuccaucauccauaugcagaucuuacaucucacauaauauugcaaugcacacuacagacacauauaauauauaaaauauccuguacaacauuuaugcacaagauaugcaucauggacguacacacuggagccagguuauacgacuuaacugggaacucgucggccuaggcauguuuggugcagggcagcaaugcagcaggcucacagggguaaucgaagccugcaguuggcagugugucucagagacagugggacugucacacuaaccaggucaccacuacacaaguaccacuuggcagcagggcagagcuguggggagugagauguuuccccacaccaucucaacaccacuguacuaaccacagcucagacgagaaggguguggucugccuagaagcccugcugcagccuggacagugaagugcuaggacacggggaagacuuuagaacugcagcuccuucuggauuccccagagggugucugcgcucuucuucaggcgggccucuuccucaggagucagugucaccuucacaacauccgagauuccauuuugucccaggauacaugggacacugaggaagacauccucauugauuccauagagacccuggacacagaaugacagagauuacaucuauuuuguccauaccuccuaauauuccuugggauuuagaccuuuacaaguauaaagacuucuucuuuuagauagaucuaccugccucuaucacccgaggucugggauucaaaguuuuaccacggcuuggcuuauaaaacaaguugagugucaaugcuauucuauugcagaguuguccagguaugauaauaaugaacagugaagucuggcagugguggcccacgccuuuaaucccagcaccugggaggcagaggcaggcagauuucugaguuugaggcaagucuggucuacagagugaguuccaggacagccagggcuauacagagaaaccugucucgaaaaaaccaaaauaaaccaaaaaaaaagcacugaaauagaaagucaguaagaaagcaagagcuagguuuggcacgugccugaaaccccagcuagaggcaggagagaguucagggcuauccucaacuaccucacaaguucaaggucaggccagcaggcaccauuuaauaccaaagcaaaccaaacuauaaaaaaccccaaacucuaaccaagguacauaauaaaccacacuucucuauuucugcuagacccugguaacugggacagggucucccgccugacucagcguaacucagcuaagguucuuugaguuagacaucuacaauggcaguguccauauaauuccacagcucacugcuguguuccaaaagaaaagcgugagccgaucgaugcauuuacuucaguucagcuagugacgaggccuccgcucgguagauuguaaagauuccuuguaaagucaagaaacaaaucucucagauacaaaaugugucuccacagacccauuaccuuaaucaugguggaaaugggaugcacccgccuaagguucuucauuaugcucucagccaagucugccacagagaggccaauggcccaggauguguaaccuuucagcuugaucaccucguaggcacugugggguaggaaggauggugaaggguugagggaagggagacaagaggaguaagggcuuuacugaacacgcuuuaccauguuauacacucaagacaaaaacgucugaccccugguggacuagaaucucguacauugauaggaguauuacagugucaagacaacugaacccacaauaaaacugguauuucucaaguaucaaauaagaaggggcugaugaaaugauucagggguaagaccaggagugguggcugaaaaugaaucgugucccuaguaugcaugagagucuacuccaucccauacaccucaaaaauaacccauggugacucccaugagugaaaaguccuccguaaggcuagggcacuggaacguugggucccccguuaauaggcgugauuggcggugauuaggaggcauugucuugcuggggcaaaccacucuagggugggcuuuagguuuccaaagaaagccacugaguuagcucucugcuuccugucuguggaugaggucaguacucggcuguggccgaauccacuugcuucuuacugcucaucccucucugcccagccucuguggucucucacccuugggaaccaggagcccaaaacaacgccuuccauaagcuguuuugguccugauguuuuaucacagcaacagaaaagaaaaaaagagcaaaaaaaccccaccaguacaacaucccagaagcuugcacaugacacaacugaaucaagggcguugaaccaggcugggaaacaaaguucaccggcagcauuucuaauacaaagacucugaaccagauuuaaacuguauuagccaaaaaaaaaaaaaaaaaaaagggaacuuggcuaugcuucucuuauuucuggggggcugcagggguggcucagaggugguuaagggcucuucagaggaccucuaagaugacucacaaggaucugaaacuccagugcuagggaauccuuugccuucuucuggauuacuuggagacugcaugcauguggugcagacauaagcgggagaacacccauguggcaguuuucagcuguaagccauuuuccaaggaggagguaccaccuucugcccccaccaagguguuagcauauuacaaagggcagagucuaagaagccacuggcaacaaccuugccugcacuuggugaugcuuucaucuuagccuucuguuuauagugugaagauuaacaaagcuuaagaaaaacaaaauugggguggagagauagauggcucagugguuaagagguccugaguucaauucccagcaaccacaugguggcucacaaccaucuguaaugggaucugaugcccucuuccugugugcaugaagacagcuacaauguauucacauguauaaaauauuaaaaaagaaaaaaaaaagaaagaaaacaaaagcacccaaguggaauugcuguuaaaaucuuaauccuuuagagaugcagauucacaccccaacauuggauggagcucagggacucuuauguuagaguuucugagaaggaucagggacucuuauggaagaguuucugagaaggacugaggcauccaaagaggacagggacuucacuggaagaccaacaggaucaacuaaccugaacccuugggggcuccuagaaacugaacaccaaccaaagagcaagcacaggcuggaucuaggccccccacauaugcagcagaugagcagcuuggucuucaugaucuccuccaacaacuggaguaggggguuucccugagcccguacccugacugucuguggaucccguuccccuaaauggaccacuuugucuggccucaguggaagaggaugugccuaguccugaagugacaugaugggagggaggggaguuagagaaaggggagguggaaugggaggaggaacuugucugagaggguacugggaggaggggaagggaccgguaugggcuguauaaaaauauaucuucagucuuccaugcugucugucaaucaugaggccucaccuguccaccaccugcuugugaaccuccuuccacugcuccuugucugcgucagugcccaguucuggguuaagagacuucagggagacgccggcaacauucacaccacuccacacaggcacuggaaggaaacgggcagcucauacuguuuccacccaacagcacagaauagcgccuaugucccaccugucuccucaccugcaggggaaggucccccacuccucaaugauggucaggaucaccaaaccccaguacauugauaccggccguacauucugaccuaccuuccuaauuugcugaaaccuguaggcuacguacuuucuguuaagucaaaggagauuuccuuggcauaggaccucuaagaacacuguauaaacaaauggagccuucaccugcucccuaacaggguuucccccacccccgaucucccuaaucccagcaggggcaggcauuucaagucaagaguaaacugcugaacgaaacaagugacuaaaguuguccuaagacaacaugcucaaagugcucaacauguccaggggcugaaggcaaggcucgguggacugugugcuagcacacaugagguucccaaguccuuggcaugaagaugaaugaacgagucaauaggcgugaugguggcucacucacgccugaaauccccauccucggaagacaaaggcugggcugguagaaaagaaaugccuggagccuggagaaguggcucaguggccaggagcacggacugcagccacaugguggcucacaaccaucuuuaagggggaucuggugcccucuucuggugugucugaagauagcaacaauguacucacauacauaaaauaaaucuuuuuuuaaaaaaaagaagaaagaaaaaugccuagagccauuuuuaugcuagguuuuuguuuucaaagagcgaagaaacugguauuaaagacuuaccacuggagucgccauguucucccaggacccagccgugacagcucagcgcgugaacccccagccucucucccaucagguaacggaaccgcgcugaauccagauugcaaccacuuccaauuacucgguuuuugggaaagccacugauuuuccaagccacguaggucaagauauccacuacaaaacacagacaagacauuugcaugaugggaaacucaaaacacaugauuuugucccuguugaccauggaucaggagucuauuaacaucuuuacuacauaauucauguccaauuagucaaagcauuauuauuauuuuauuuauuuauuuuuuacuuuuuaauuuuuuuuuuuugagacaggguuucucuguguagcccuggcuguccuggaacucacucuguagaccaggcuggccucgaacucagaaauucaccugccucugccuccugagugcugggaucaaaggcgugcacccccaccaccuggccaaaguauuauuuuuuaaauauauuauaccaauaaaauuacucauaguuacucacuucaagaucaugaguaaaauuccuaaacuuugcaacuacauucagaggcauuuacgcuuuaaaaugagcuguuuuagaaacacaguccauacaaaacugagucuguauacgcacaguguagcuaacgcaccgugccacagcagggcgagcgcaggcuggcugcucaccuggauuggagacgaucagcagcuugcaguguggacuguacuugacaauguugggaaugaugaacuugaagauguucacguuucgcuggaccagguugagccggcucucccccucuugcugacgggcccccgcggugauaaugaccagcuuggaguucgcaguuacacaguagucuagagaaaagagcagaaaugaagguccccucagggaacuuuucuacccaagcaaagauuacugcauaaaccuccaguguagacaguuccaucccaucccggccuccuguacacagcugacggaguccuguuuccguucagacccucgcuuuggugcauaguuuuguuuuguuuuuuuuuuaauuuauuauauguaaguacacuguagcugucuucagacccuccagaagagggcaucagauuucguuauggaugguugugagccaccaugugguugcugggauuugaacucgggaccuucagaagagcagucggcacucuuaaccacugagccaucucgccagccccuggugcauaguuuuagcugcagucucucucagagagggaugccuuucucauacaugaucauuguuaacaggaaggaagcuggugcauuugauuuucauaucaacuccuuauauggcgauuauuuucuacccuaaauuagugucuucucuucccucacccccuugagacagguacuucguccaugcaccaccacacccugcauucuguccauuugcuuucauuacacacuuaauuguugccaagagcccagccacaggacagcugauccagagagcugccuagcaggcaggaggucagacuuucaaccguggguuccuggcucacgccaaugaaguguaaaaggucaagccaagaacaucuacugggcaggcccugggggcaaguccucagcuguuuuauaugugacacagggcagcaagguuggggcugucacucugcagugagagcuugggccuggcggguacacggccccaggauccauccuagccuugaaacacacuugaaacaaauaauguaaauuuggagcuuacucauguccuaauucagagaauuuccauauaugugcaaauuagguuuccacuuaaaauccucugcuagcgaucaaagcuuugauaacguacugagaaccagugcauaaguaagccaagguccuccugucuuugaaagagcuauagagauggagguucaggcccgaggaggaacuuaagucugacagcaagagaaccuggccacaaccaaccuuugcuggagacaauuuuugguguuuuaaggaagaggcugccaugcuggagauccaucaucucgcccuugaguuugucuuccaugacgucaacaagggcaagcucauccgccaaguccuaaaagacaaacgguuuaguuaaaugggaaaauaauucugauucuucucauugcuccccaaaaggccccgugucgugucucuccugcaagcccuccauuggagccgggcaauguuggccaguaccaaggcuucaaauaggccuaggcaggaagcucagaguagaccauugcuuagcaugagaccgugcgguggggggaaggaaggacucaauuaaagaagcaacacuccaagucaggaauaucgaugcaugcccuuaauggcagucaagucuccaagaaggagaaaaacaaacaaacaaacaaacaacuacuuauagacaggagcccugucuuaguuaauaccugcagaauaauaguauucugcaaagcuaggugugauguugcagacguauaaaccaacacccaggaagauuguuccaaguuuaaggcuaguuuggacuacauaugaaucaagaacauugacuuacccugccucaaaguguuuucuaauucagugauaaaguuguaacuaauuaaauuuuagcccuaugauugauaagaaaauuagauccgagauggcuugggggugugugugugaaaucagcuccugcauucgucugcugagcugaauuucaucuccagaacccauaaggcaagcgagaaccaaaaauuuacccucucacaugggugugcucaguuauuuuuccaaaggaaaauuauauaccccaggaaacagugggauuugaauagaaguucaagacaaccuauucaguaggauuuuaauuuuuaaucaauaugcacauauaaauuccaauucaaaaaucacuuuagauuuggguauauaggucaaugguuaccuagcauguuggaggcccuagguucauguaacugagaaaguagaagaaaagguauauacuuugacgcuguuacuuuggugguuuauuuuauuuuauuuuauuuuauuuuuggagacagcccuggcuguccuggaacucacuuuguagaccaggcuggccucgaacucagaaauccaccugccucugccucgcaagugcgaggauuaaaggcgcccggcugucaguuacuuuggauaaucccuuucuuguguaucauuauguugcaaaauguuucacagaugacugagugugugcaaaccuugauaguuuuacauacaaugugacaauguagggauguccucucccccacaccccacccauaggcuugggccaugaaggaucuccacuuaccuucauuaagauacugauggcacaagccaugccaacagcaccaaccccaacaacuguaaucuuguucuggggagccugcucuuccuuaagaagauucacaaucagcugguccuugaggguugccaucuuggacuuugaaucuuuugagaccuaagggguauacaccgugugucauuguaaccugcccaagguauacucaccaagucccuguauuuaaaaaaaaaaaaaaaaaaacgcugacuuugcuaccuuuggacuccuuuuccauuaagugacaaugugacaaagaacagaaguggaaaaccaagaauagccagcgccaggguguggucuggcucucaccaggaaggcucucaccuugaaauggaaaaauaauaccgaggucuccguguacguguagccgccugaggacuuacucaucuugaugaaccccaaaaggggaugguaucuccucuuauaugguuagaaagcugcccucccgcucuucucccaucacccagagcccuacagcaaguagagcgccaaguugcuccaggaaguaccaaaaaucaagagcagagggcgccaauaacggccacaaggugcgaccccaaggcauagcaacgugcuuaagccugcgcacgcgcaagcuuccuuccuaacccccccacccccgcaagaacccaaguuguaugaccagcccagauccagaagacuggcaggcgggggaaggcagugcgcgugcgcaauuucagaaucaggugucauauauauaggucuagcgacugcuggccauggaugagaccucuggcaggcaguucggcgucaaaguuuggcccuuacuagagcccaaagcacaagcgcggugaaguggagcuggcagccaccuuagccuggugccagagugagaucucaaaugccacuaacaggauuagggccuucacccaccagggcggggccucauuacccaggauguggccgcuaagggaaauuucuucaguuccaaaauggggauacaauugcggagggccugaggccuggagcccacucccacccccgcgauggccaccuuucccagcaagcaccaugucuauuuuugaaaucguuccaaagugcaaaaggacuggacaagaucucugggcaagcagccuagggccaucaagcaggaauccggucuccuuacaaccgcugcuauuucuagacagccuugugaggucucugcugacugggggcagggcguggggcucuucccucagagaaucuacuucacgcaaaccucaagucugugcucuauuaggacagggugccucuacuucccaccuacgacccgaugggugucgcaggccucucagcuacagguuuccuccuuccgucuagggugcagaggaaggacugcgacucuucccgcuuccucuccgcacgcagcgcgcuuagcacgauccccagucacaccaggagcgagccucuuaacaaaaugcguuuagggcaagagcgcccuauaaucugcaggaaacaaccacuccaccgagcccacgcaaaggaaaaugcaaaccgcacggcugcuccgaagcacccgccccggacgugccaaggcuuuuucggcccccaugggcucgaguuacgggagcucaaguuucgcaccgcucccucgcccccguucgguggcucccaaccuucaggccagccaccccuuaguccucuuuacacgggucucgccgccccaggcuggguggggccgccugcucaguuccccaaagcacaguagcccacgcgugcccaaaucugaacacccugcaccuccaccccggauagggacccccugugccggcagcguggggcccaaccguaccgcuagugcacgaugggggggcgacuggcgaggagaagcagcguggcccgagcucggcgacaguggcuccagcacgcagagcagcacgcgggcggggccuuaaauggaagcuccgcgcugacgucagagugggagcccagcggacgugcgggaacccacguguaggcugggccgggggcgggcguccagccgggcuaggcgccaccgagaccggggcggcgcgcgcagcacgaugucccugcaagaguggcuccacgugugcugcgacaccccaaagaaaggccaacccgacaugcuccucagccucagaagcaggagcccgaaaugcaucgauccuccgccuccuucaccggaaaacuugugagacucagaaaaaacccuggucacuuucuucauugcuguucccggcgccgggaacaacuccuggcaagcaacaggccuucaguaaauauugugugaaagcacaugccagcaccgugccggucuauccgccauagcagccuaucagaugggccuuucuccugccccacuuccaucucccaaaccauggggggaggggggugcggcucagcuucugauggcuugccagcuuacauccauaucugcccucucccaugccaucccgcaggcauuuguguuuagccuuaccaaggaguaucagggcccuugcuuguuuucacacacccccucugccuuuaaacgucuuucuagaggucucauuaagcugugaggccaguuccuguuccucucccagcucccgaucaaccguaugugaaucuuaagguacuccaccacugauaggaugugaaauggaguuugcaacugcuuugauuuccuuagugaugggaagaacugugacuuucaacccugcucacccaucuccccggaagggauguguucacugcagauuaaggucuauuacagucuugagcaagauuugaacaagcugguugcagggugcuggauaugcagggaucaugugagagggaaugaagcucacagcccccccuuauuuucgcuugucuguaucccuugugaucucuuuuauaacaaacaacaggcuaggaguguggccaggacagggacacuugucuugcauacaccaaggccugagucccucagcagagcgcaaauuuaaaaaaauuaaaaagucaaacaguuggaccuggagagauggcucugccauuaauaucacaaaagcuuguaacuccagauccagagguuccaauacccucuugaccuucauagagucucucucccccuauauauaguuaaaauuauuuuuuuaaaaaagucagaacaagagaaaugaaauuuaacuuuuuaaaagaaaaaagugaaggugaguucuaagagacaccagagcaaguagcaagcaagaggaagaggagagccuuguggauaccucaguguagaguggugagggggaagcacagguggagauguaguaacuacuugugcuuauggucuuagauugggggcagucccaugggacugaacuauuaaccuguggaauacagugcucuaagcagaauguaaacuggguuaucagaugcccaggccagguucaucugcuaggaaauugcuuugugcggaaaacacacguguggaaaccucaugugcacacaagcuccuuugaccccagaaggauucugggaagggauacuguuucuucccuucccuuagacccauauacccacagaauggaaacucccucuuuucaucacccuauacuguggccugugcacccuucagggacccccucacagguaaggaguaggacucuggaccccaugcagaacacagauaggccuccuuccucucagcagcauuugugcagcagcaucacaaggccagcuuccagaaagacccauacuuugcacuuucuugguugcaaagggaaaauucaccccagcuccaggaaaaaugggacaucgguuuagcucacuacaaugguuuuccagaugcugcuggaugcccagggaccacaaacacagcuggaggcauugagggugaggcacagggugcccaagggcagcuuacaacaccucagguccccagggcugugggacaauguucuuauucagugaaggauggggccugccagcuuguuaaauaugucccagcugggagaaaagcaaggcagagagccaagagggggugggguugagagacagguaagacucccaggaaaggccugugaagauaccucaggcagguuccauuccacuacaccaagacgcuuggugaucgccacuccaagcacagccucccuccuccaggcacaucggccauguucugaauccaagauaaguaagacaaaugcuacucgcagagacuaacaguaggugacuucuggguucgucuucauccugacucugggguaggcaagauccuucccauuuuccagaugaaaaaaaacacaggauucagaaagaguacuggcuuugccaaaaccgugcaauuucucaaugauuucagccaggacuuuaaccuggcacugacuggcucaaagccuaucuaucucucuucaagauccuaugcucacaaaacauagggcaaaaaacuacccagggguuucaaggcaguuucaggugcaggagccacauagcggucagugggugucucugaugucuggcugcuucggcugugaugucauccuuuucuccccucacccuggccggacaccaucuugcuucugauuuucaugucugagcaggacccucugccaccugguuuccugagucuucagaugaaagguggcagauggcgggaauucucccccuccacaggcagguaagucaaguccucagaauaaauccaugccauuucuuugugccuccuguauaccagagucuaggcuacucccccacacuccucaaaugcacugucccauuuccagucuuccacucaggccguuccuucuaccugaauaccugcuucucccuugccaccagaccugacauccugagccugcauagucauagucagagauaaagugccaggaacucagaaaugaacaagacagucagcgguggugcaggcucauagauccagcuacucaugagguauagaagcucaugaguuucagaccaaccuguaccagagagagagagagagagaauuacaagccuucaaagaccaacauggagggaacugagagcauccuccucuauagauaaaaugcaagcuagaagccagucuuggugacucacacacuugugaucccagcucuugagagguagaagcaggaagaucagaaguucaaggcuagccuuggauacacagugaguucaaggcuagccuggguuguaggagacuuagucuguaaaacaagcucuaacaaagccaaacauaaaauagugucacgcugccacaaagaaguuaagaauguucagcauucagagagagcaccggcuaaagucacuguuggcauuuagucuaggcuccgccccacaguuaccuggcaauagccaggugugccagacucacuguaagaggagcugcuugcccccuccucucucuugcucucuugcuccugcuccuuacccucuccuccccaucccccucccccccccacguguucauggccggccucuacuccucuucucucucucucucucucucucucucucucucucucugccuuucucuugucucuacuacccucugaacuccccuccccaugcccugaauaaacuauaccgucauguggcuggucccucagugggaagagaugccucaucaugggcccgaagaggcacccccuccccccacaccuuaccacaccucccccaaacauaucucuggccucuccuaucuuuguauaaaacacaacagucaccugagcaaagaaaccucuuuccggaagaggcagcaucagggcuggggcaagaaaaagauuucugcugauggauuaggcguugagaaagcagggcaauggggaugaagcaaugcagagaccacaagaugcaaggugugucugucgggacauccuuagccgacaaugccaggcuaagacaguuaggugugcuuucuucuauucagguuuugguggccggaagucacuaaaguuucuaaagagcacgaaagauggggugaaaacaagaugaccggaacaaggucgugggaaagauggcaccuuguguggugaccauacacagcacacacgcaaggacucgugaggagccacaucugucaucuguaggggacauacauuucccugacgcaacccuccacacccagaagccccucugaacacucacuggcagccugccuguuuucgccuucuccaugacggcaaggccgaugacuuuccugaauugcagggcccaagaugcagagaaucucaucugucuccguccuugaccugcuagggagugcuguguacgagccaaaguagagguuccucucucuccucucucccucccucccuccucucaag

SEQ ID NO: 3823 - RNA, 31316 nt, Mus musculus
cggcuuccugcuucgcaggggcggggcggcggcggcggcgauugucuggcggccuggggcggccccguggcgccuacccucugccuguggggacggaggagcgcgccauggcgguguccgagagucagcugaagaagaugauguccaaggugagcccgcgcccuacggggcggccccgcgggcugggcuaggccgccuucccucugcggagcggcccuucccgccuucgccuccauaaacaaaagcggggucgugccuggcgcggccgcugcugucugcccggcgcugcugacgguccccgccggccggagcccggcccugcucagaaccaguccccgcgcgccucuccccggcccaacccggcacaucccaccggagcucgggaacucuuggugcaauugguucgcugaaguagagcagccagaaaaucgagcuuggcagcccuuccccgcuccagagaacucugcaguugcauuccauuguuugcauuaacugugauuaacgcaguuguuugcuuguuuacuuugaguugaacuuaaaaauucuuacugcuugacugguuguggguuuuuuuuuuuuccucucacuuuuuaaaaggccuuuuggauauuuugcacauuagcuacuuaguacuuaauacugcgcaucggacuccagaaugccuugcuuuuuguaauuuaccaaauuuaauuggaaugaaauuuauguaacguaguugagcccuaacuccuuuagucauugaaguugacuuugaugcucuuaucagagcaauaauagagaucgugggguuaagaaguuucuaguuuacaaggaaacacgaauacgcugggcgugguggcacaggccuuuaauuccagcgcucuguaggcaguugacgacagaucaggacagauugugaguuccagaccagccagggauacacagugagaccgcauuucaaaacauaaaauuuuucuuuucuuuuuuucuucuuuuuuuauucuuuguaaaacuagaucuuuuuuaguaaagucauuucccugaguccuugaagaccaaaccucuugucucuugguugucuaaccauuuaaucuuuuaggcuuccuuuuuuuuuuuuuuuuuuucccuguaguuaucuguaaugacacaggggucugggggaauguacgaggucccgguaaaggucgauauaguacuguuuuaccuucaaaucauuuguuuuucaaagccucaauuaagcuuuuagaagauguagcccauuaacuucaucugauuggggaucucuguccuuaucaagacauucuggcucacccagagagagagacagacaguuuugguguuuuaaccucgcuucagaucauuuuucuccuuugaacaucaucuuaucucccauccuaagcagacuuuuuuagcaccauuuuugguugugauuuuuaccaauuaaguauauuucuacaguuagucuaucguucuuuaugcaaauaacucucuacuuuguucauaccaguaaccuguuuuuuacauacaauguuuuacaauagaagaugagucacuacuaacuggggaggagaaaguggucauaauaaaaguuguuauugaguuugaacuggugccauacauguuuauggguugggaggcaaagggagguauaucucuugaguuugaggccagcuuggucuucauagugagacccugucuccaaaacacaagcugcuauuguuccauaaauuguagggaucugacagugggaucaaccagacuaaaaccuguacuucugagcuugauuacguggaagccacuaucaaagucauggcaauagcauugggaaguugacaacagcuuuggaaaguaaagcgagaagagauggugguggcagugacagugcugaggcuguggcuuucuuuugcaugguaaggggagggcuuugugagaagucuauuugaccagaaaccugagcauagaaggaaaugagcucuggaacagucugggguaaggacaguucuaggaagaaggaaaaacaagcgcagaggcuugaagcagaaguucaccagcaaaaggcugguagcgagacugacugagcuacaggaaguagugcuguuugacauugagcuuuagugaugugagagauuuugaagggccuuguaggccaguguaaggauuuuggaauuugauuggauugugcuaagaaacaauuaaguuuuuguuuuuucaguuauguguauggagccagauauaguggcacacaucuuuaauaacggaucucugugaguuuucaggccggccaggucugcauauugagguccaggcuggccaaggcuacacagugagauucugucaccaaaaacacaccuccauaaaaacaaagagaaauguagggauaugugcacaugagucccauacacacacaggccagggcacuagaucccucuguaugggugugugcacauaagucagguacacacagaggccagggcacuagauccuucuggaucuagaguuauagcuauuugugaacuaucuaacaagcaagagcaguaugugcccuugaccaccaagccaucucuuuagcucuccccugcacccccccuuuuuuuuuucuuugagagucccccuaccuagaccaggcugacuucuaagagagagccaccuuacucugccucuggugagacuaaaggcaugauccauagcacccagccgaguugaaacagggguacccuagaugcucuacuaagacuaagguuuaagaguggaaguagagacaacgcugcugcagcucacuuagaccauaguuacagcuauggagguagaagucagacucuggagguagauguguacaaacauucuuuuuuuuuuaaguguauguauguauguauguauguauguauguauguaugugcauagacacgugggugcccacagaagccagaggagcguuggagcuccuggagcuggaguuauaggcaguucagagucugccacugugagucuugggaacugaauuugcaagaguaacaagugcccucagccacuaagccuucucuucagcccaagauucuggauguauuuugaagguaaugcugagcaagacuuguugugaauagagcaggagaugcucaggacaaccugaaggcuugguaccugaacagcaacuauguauugugcuuuuuccuagauaaaauucucccugugagaagauuuaacuuaccaguuacauucaguaagagguuaauaauaauguaacaagauagaaaaauuauaaaagauagccuaauacuauuucuggcauuacuccucuugaacuugaggcccacugaguaaaguaguuccuugaacacaagcacuaggacagucacucuuaggccagucagucacuagcaggcaggguagccuauauuaguguggauaugcugggcaaagagaugacucacuuccugggcgggacaguaggacugggauuucaucaagaugucaugcuacuuagaaaugcaguuuagcgcaccuuuaaucccagcacugggaggcagaggcagguggaucuuugugaguucaaggcuggccuguucuccgugaguuccaagacagccagggcuacccagagaaacccugucuuggggggucaggggaagaauagugcaauuuaauguauaugaauuguuuauuucuaaaauucccugggguuuuguuuugugacacaaauguuuauuggugaaggagaggggcaucauuccuuccucaugacugccugcacauagcucagcuccuccuuucucucuucucggauauaccuguccauccuccugaugaaguugagugcuuuuguccuuggauaccuugagcagcuccauggcacacuguugacugggugcaaagcugcaaaccucccagcucaugucccacaugaacuuggugugcaugugcuuggugaggcuuccuugcugacguucuuuaucacccuguggucauggcugcucucucuuaaauauuuuagaauugaggcuaaccaugaaucacagaaacugcagagagaaggcacuacuauacaugucugcaguuuauggaagaaguucaggaugaaaguguuuagaaagaugugcauguguguauugaugcacuuacgcuaaggcaaguguuucaaguucagaagucacuaaagucaguucucuccugccacguggguuccagggaucaaacuugggucauaagcuuggucagcaugcucuguuacuuacugaaccaucuugccagcccuauguggaaaucuauaacguggggguuuuauuuaacauauuuaaaaauacaagagagaacacuaaagaagugagauuagaugaagaagagaaaggaguuagucuuguggcucaaaaauaauugauucuagaagagaaagaacaaaaaagaugggaaggaagucaaacuuugagacuuuagaaaaugugggguuugcuuuuuuuaguuuuuuauuaauguucaucguuuugugugugcgagugcgcaugcacaugcauguggugcacacgcacauuugcacaugcagcagugagcauguggaggucaggguauaacuuacaggaguucauucuuccuacaugggaaucuugggaauugaauucagguuuucgggccuuuaccugcuaagccaucuuagcaauccaugaacacauuuuaagagggagaacucaacuuggucaaauaccacuuacaaauaaaaugaagacgguaugguacaccauauagcaggcauugaugacuuugauaagcaauuuuaaugaagggguagguauaaaauauauaugcacccuuucucuugcugaggcaaaaauucuaaaagcugcgcuuaagaccucuuuccccaucacagaaaaucuuacaggcuugccauuuaaacauauccaaaucugaucacaucucacugucuccacguagaauauccaaaacugaaguaggcuggaagaagauuguucuagacauuaaucagugaugcugacagcguagggguuucuucccagugaggaagcauggucaucuguguagugagcuugcuagagauaagggggaagaacauaaauaucucaaacaucauaacuuuuagaucccaaaacuaauucaaaggaucaugugcauuagacgaagagaaugaagugauuggccaauuacugacuauggagccuuugauaggcuagaugaacagguuugcagugaagguuaaaauagagaugaggcugucauuaucagcuaaauacuagguuaaaacgggcuuuccauaugauuaacauaauuuagcaauaaaaaacuguuccauacugaugcuuugcuuucugccuuguuuuuagaaucuguugggauagcugauugcuuuuuauguuuuuguuucccuuguacuaaaggaauugaacauaggccugugggugagcaaagugagcacucuaccucugggucauacacaccuuagcugcugacggcuuuucugcuuuuuaagacaagccaauuaagagcuuugcauggauggggcaucaguguauuaugaucaguuagcuccugccagaugugcuuaaaccaguugcuaauucuaaaguagagaagagagcauuggggugagaaacaauaaugggagugauuuguuucaaaucgacagugagugcuucacugugagaaugaaugaagcaugggaaauauuuuguuaaaagggagaaagaugucaagcagugguggcgcacgccuuuaaucccagccuugggaggcagaggcaggcagauuucugaguucgaggccagccuggucuacagagugaguuccaggacagccagggcuacacagagaaacccugucuugaaaaacugagagacagacaggcaggcaggcagacagcauagaguuugaauagccuguaauuccccagcuucucagggcuugaggcagaagauuauuaguuuuguugccagauuaggcaauaaaagaaaaucccauuagaaacaguuuuuggauggaaacuuuuuuuucuuaaugccuacauguauguccauguaccuaccuuacacgugccugguaccugcagaggccauaagagaguacugaaguuaugggcuguuagaguuacacccacgcaggugcugggaugccauccugggccuucuaguggucuuauccacugagcugcuuugguggguucuuuuaacuugaagaaaugcacuaaaauaguggugagcaucuucaauaagaguucacuuagauuaagaaaggcgagccugagguccccuuaggcuuuaauguuaaugaugaguagaagauucaagaaaacugcagcaaagaaaauagcauuuuaagaaaauacagccugguggugguaguucacacuuuuaaucccagcacuugggagguaggcauguggaucucugugaguuugagaacagccagggcuguacagagaaacccugucucaaacacacgaacgagaaaggaaaaaagaaggaagacgauccaguaaaaugguacacauugguuuuaauuaaacuuguaauuuuugcuuuucaguacaaauauagagaucuaaccguccgucaaacugucaaugucaucgcuauguacaaagaucucaaaccuguauuggauucauaugguaaguuuauaugacaaaaagaucugucccugugguugaguuuguuccuguguauauguaugaauacauuuuucaugguuuccuuugcaguuuguuggauuuccaacugaaggguugaguuuccaccuaacagcugucgggaaacaggagaguauaagucugaaaaaaaauggaucuguugagugcuuccaagucuuaaaaagcaccgcuuugauacaguaguacacggaguuaggcugaggauauuuguucuucuguacuggggcguugggggggggggcgggggggugucagucccagagucucaugcaugcuguacauccagcccauagagagaauuauuuuuuuaauauacuaauuuuuuuaaaagauuuauuucuuuuauguauaugaguacacuguagcugucuucagacacaucagaagagagcaucagaucccauuacagaugguaauacagagccaccaugugguugcuggaauugaacucaggaccucugcaagagcagucagugcucuuaacugcugagccaucucuccagcacccccauaggaggaauuuuaaagauaauuuaguuugucauuuuccaaagccuuucugagagagacagacagacagacugcaugcuguugcaggcaugugcaggucagagaacaaccucccacaggaaucuauucuccuuucauugugucaguuauagacuuauauauugugucaucaggcugaccuuacccagugaaccaucuugccaggccaacagaguugugaagaagguugcuaagagcagcucggggggagguaaaaggcaacauucugugcuuagguuuuaacaguucagauuaaacaaaguaaacacauauccuggaaucaugagccugugaucucagcuacucaagaagcuggaacaggaggauuacuugaacccuagaggucuaggcuagccugggcaauaaauauagucagucagucggucugccugcuuuucucugucucucucugugucugucucccuccccuaacaucucuauaagagaguuucgaguuuguuggggggaggaagggguuguauuuauuuggggguuuauuuuuuuguuugauugauugguuguuuuuuugaggcagugucucucuauagccuugaauguccuagaacucaaucuguagacuggcuggccuugaacucacaaggauccaucugcuucugucucccaagugcuggaauuaaagacgagugccaccacuguccagcuaagacaaauuuuaaaaccaaguuucauugcagcagaauuucuuagcugagaggaauguagugcuggcuugccuagguuccuagcuacggauacucagcuccucccuucccccauagcaucucuaugcucaggaacaucacaggccuacuggggauuaacugucccuuucauuuugcaaaucuuggaaguauuuuuuaguauuggucuuuaguuuuaggugccaauuugucuuuauacugagacaaaauuguaacuuaagaaauaacaucugcggcuggagagaugggucagcgauuaagagcacauacugauguuccaggguaucuggugcccucuucuacccuccaugagugcaugguccacuuauauacaugcaagcagagcgcacaugaacacacaaaguaaaaacaaauacacguugaaagagaaggugucuguauuuaacuguggagacauuucuacuuucaguacugagguuugauaccaccuuggguggagaaugacagugaggaucuguauguagaugaggauggccuugaacuuccaauucccuuauagcuaggacuagagauaugugcaccaugcucaguuuaagugcugagaggaaacccaaggcuucgagcagcuaggcgagcacuccaccaccagcuuggccacagcccaggcugcagucaguggguguuucuaaagugaaaugaugggaaguuagcuuuuaguauggcaucauuuaauagugacuucuuccucuuuuucagugguacuagggaucgagcccagggucuugauucuaaaguguuccaauguacuauacucacaguuugauggagauuuuuuuuaauuuacugauuuauuuauucuuaaauuuguuaaaaacaacuuuauuaggaauauauuuuuugcuuaaucauuagcauccaucucagguauaauggccagaagcuucagagugauuuuaauuguauuuacuuagguuuuuuuugagacaggguuucucuguguaacccaggcuauccuggaacuauagaccaggcuggccucaaacucagagaucugccugucucugccucccagugcugagauaaaaggcuuggggugauuuuuaaaucagcuuaaaaccaugcugcuugcagacuaaaagcuuguuauguggaaaugcagcacucagguccaucuuuacagguaacucaaagcuuuuaaacuaagggagucacugaaggagucuuugauacugaacacuaaguuagccucauuccauaguugccuggugauguguacaaaaauacuugugauuaaguuuuugucuuuuucccuuuuaguuuuuaaugauggcaguuccagggagcuggugaaccucacugguacaaucccagugcguuaucgagguaaauaauauauuuguguguucaugguauguguaucugcaggcaagaacgugcuaccaaggaguuaaaaguacaaaguguacuuucuaauggccuucuugacaacagguuucaacuucaguccuaauuugacuuuauuuggcagcagcaccuuacgguuguuguuuuuaauuucucugucaagauagagcaaugugcaagugccucacaauucggcuggcacuugauguuuccugggcucauggcacuguauuggauccucugugucugcuaguucagccucucauagugauucguaccuuuccaaccaugggaagcugugcugugcaguggugagguagugccuuagggacagaauuagguuugacucucugcugugugaucugaauuaauaaugccuagauugggaacugacaguucauggaagugauacauacaaaggcuugccacugccuggugugcacuaaacagaccauaaggagcaccuguuauuucugguuagcauguugguaaugauacugauuuggaugacuagucccugaagcagucaguucugcuguacucagugauaagcgagugcgcacuuucuuauuugggacgguuauguuuauuauuccuuguggcuaguuaggacaugucuccagagagaggcugggaccaggggccgguacaaccugcaaagguccuucccuagugacauaguccuguaacaggugccagaauaucaccaucagcuuggagcaaguauuuagagcagugguucucaaccuuccuaaagcugcaacccuuuaauacaguuuguuguggugacuccccccccaaaccauaaaguuauccuacuucauaacuaauuugguuacuguuuugaaucauaauauaaacauaugaaaagcagaauaucugugugucaccuccaaaggagucaacccacagguugggaaccaugcuuuagaucaugagccugugggggacaugacacugcaguucugugauugcucuugagauagaaaggagagcagggcacauggaaaggucaccgagaucgugacacuugucagucguuugugccugacaugguccuggagaaaaagcaguuaacggagagcaucuguguugaccugaagcucgauuacuagcuccacgguuguguccucaugugcucugcugagggaugcaggcuguggaagcguacauaaguacugauuucaucuacagggaucccccuuuucucucagccauucuuugugacucauaaaauguggguccaaauuacugugggagauucuugguuuuuuuuuuuuuuuuuaaauagggaauucacaauguugguaauaaaccucaggcuuuguguauuagaguuacauauuguagauguguuuaggggccaagaaagaaaaaucagaagucauuaguaucugauuucuuuaggugaaacaugcuuuugccgaaacuaaucagcaaacauuaagguggacgauccaaaagcguguuguccgcagcgagcagucgucacuuucacuuucuguguggcuuacgugccagagcuccaagaagcaucuugaauuuaaaauagcccuaguggcagucauggugcuguguguugcucucagccuuguguguuacacucgugaaaaauaauagaaguagaguaauugaggcuucuucuucucucuuagguaauauauauaauauuccaauaugccuguggcugcuggacacauacccauauaaccccccuaucuguuuuguuaagccuacuaguucaaugacuauuaaaacaggaaagcauguggaugcaaaugggaaaaucuaccuaccuuaucuacaugacuggaaacauguaaguauuauguggcugugaagugauugcuuguauguucugcucauuagcuucuuucuucaguuuacacucaagcaagauucuaagguagguaaguucagaugguggacuagucacugacugagucuuguuuuuuccuuuguuuauuggugauuuuguuuguuuguuuaggugucuaccucaaauugugcuggccucaaacuuguagugauccauucucccucagcuucccaggaugacagacaugagcuguaauacuguccaacugaaagauucuauuaagacuccauagugcucacucaccacuuuauauacuugaauauaaacuuagacagaguucagagguagacucuuacuuuucaaaacaggggacacugaugggauguguuugggaacucaaaucuuauccuucaaagcauugcuaucaagaguaacaguugggaacuuguguuucugccucuaacaguguaacugccugagcagcauuuaugcuacaaacaaccagaagccuguauuguagugguguucucuagaggagcaaaaucaauacaaugaauguguuacaaaggaaggguugguuuuguuuuuagagauuuauuuuuauuuuuuuguguguguaugaauguuuuaccuaaauguguauacacacuacauguaugccuggugucuguggaagucagaagauggcaucagauccccugcaauuaguguugcaggcaguuguuagcuaccauguauguccugggacugaacucugcaaaguagccugugcuccuaacugcugagccuccucuccagcccagaaagagacuuauuagauugguauauguguuggguugaggagacagugguggucuguacacuggagaggcugaggacucaguggcuucucgggcccauccuguguuaagugccuggaggaaaccucgagauccaguaguugucaguccacauaagaaagccaaaaaaagcugguguccagugucagaggagguagcagcagcagugcuggcagagggcuagauacauagauguacucaccagcuaguggaagaugggcaggacagaacaacacagcacugcacucugaccucuuugagucugggcugagaugggaaggguuugccugcucauggagggucuuccuucuuaguugucaaguuuauaaccagaauuaaccacauuuauuuugagagcgagaccucagagauagaaugaacuuguaagagucuggcuuugagcagacccaauccuuuuuauuguucccuagcucguguuacuggaaggcuugugccugcucuggauuucuucacaagugauaccuaguauguaagauaucaaaagagagagcuauguuuagguaaagaagauucagacauguuucugugcuuucauguaacccauggucccauuugaaaauugacguguucaggaaaauagcugggccagccacaugguuucauguguaagggcacaggcuacacaagccuggugaugugaguuugauuccugaaacucaaguaaggauggaaagagagaacugauuccauaguuauuucugaccucagcacacacccuggcaaaagugcucaugcauacagauaauaaaaagcugagagaguaaagauugucaggguugaaaacuaacaacaguaaugccaaacacuucuauugugcugagaacuaauuauaggugacaugauuucuuggguuucucuccuuuuuagccacggucagaguugcuggagcuuauucaaaucaugauugugauauuuggagaggagccuccaguguucucccggccuacuguuucugcauccuacccaccauacacagcaacagggccaccaaauaguaaguacacugaaaucugacauuaaaacuggcaggaacaaaacaaagccuugcaaaacucuuaaaauaacuucacuuugcuuuuuagcuugucaaguuaguggcguuuugggaaguauucugaggccccacaucugcauguacagguuccuaccaaagacuggccuuugggcuuccaucuguggguagaaaaaucaaaguguggauguucuggauucuagaguggaagagaagaugccaaaucgagcuagaaguuuuaaauuaugcaugccauggaaaagccauauuugaccaccuggaaagcagauguaauuuuaaaagguagccugugguuccagggucaauguuguagagaguuaauuacagucagcuagcccauucccuugagcucuucuggguauacacaauuggacaucuagcucuuggcugcuucucagugguauagccaauuuguaccuugucagaagggugagagcaaguggacaguacugguccaccccugggagagcuccauccuguucuguuuaucugaaugauucuugcugauacuucagaaucauccagauaaguggaaguugguuguacuuguuuugacguuuuuguuuuguacugcuuuuauuguguuuuaaguugucauucugacaaacuucucuuugaaagccuguuaugugagcuuuauuuccuucugccuaaagucauucucuuguuuuuaaucuguuucucaugaagacuaucuugauucuugaguagaaugagagugaguguaaaagaagugacucguucaccccucacccccagcauaagcuugcgaggacucuugcuuccuguauuaaggauggccgugauugcuuugacuggguguguugaguuuaaaguggcaaauguuuccuagacugaucgccccauguguuugacgaguuaacuuauuuaccacuugggacaaagggacccuuucucuauuucuuuccguuucucauugcuuuugagaguauaguguuccagaaagcuagcccacacuaggcauuguugcagucaguucuguccucaccgucgcaucaaguacugaagagcuagcuuaaguaaaucacuaaaaggccauuguacuguccauccauuccaauuaaauaacauguuagauguuagauaguagccaucaucaucaucagguacgacugugaacaauggucuggauuccuccugcaaaccuacuaaguaauagcuaagaaucuuggauacauacuugaauaaauauuuaauaguugagacaucauugcucagaacauuucuuaacucuuucagaguacuuuuuaagugaugagucguguuacaagaaauuguuaaaaacaagugcaauaguguaugcuuguaauuccaaagacuuuggagguuuagccaaaagaauuaugugagccuagaaguucagggucugucuaggcggcauagugagacauuaagucauuaaaaagucagcauuaugagcuuggaaagacaguugagcgguuaagagcaccuguugcucuugcagaggacccauauggcagcuuacaacaaucuaaaucccacuucuagacgaucuaguucccucuucugacccugcagguaccaggggugcauggguagcacauaaguagcugcaggcaagauacucagacauauacaauuaaagccaacaucauauccaaaccucauuuuuaaaauuuauuuuaaugagugugucuauguggguauaugcaaaugagugcaggugccugagagaggcaucagguacccuguaacuggugcuguaagcugugagcugucccgugugggugcuaagaauagaacucagguccucuacaaaagcagugcaugcuuguaacccuuacaccuugugugugcgugucugucugucugucuugcucuguuuugucucuuaacuauggagccaucucuccgggcccugaaaugacacauuuuuaaggaaaggaaaauaauuuaugguuaugagaaaauuacaacucagagauggugcuuuauauauuggagaagccagcauggaagugagugauagugacuacguguguugcuaauauguaacagcagacucacuuuguuuaagagauauuaaaaaaugucaacugugcuuccuacuuagaaagugucuauguguguggaauggaguuauaagauuuggggaguuuuuguuguuuuaguuuuguuuguuuuuuuaaugaaauacugaauuucuucauuguucuuaggaaaaaguauucuagcaucuaccauaaauccuaagaagucuguaaacccugaaguguuaggcugauaaaggcuuccaaaucugcuguugauagcagcccagcguacuucucccacucgcuugugcucugucacuagaagguuauucuugaaagguucugugccuuuuucuucaggcuucaucugucauaccucuacuugaucacucuaccuugaaccuuaaccuuaagaggcuuacucugccucuuagauuuaaaauuagcucuuuuccuggguaaucccauagauagcacucugcuugcccugccagcucccacucugacucuuuagccccccagcuggauuccaagcaacauguggccaaggauuccuucucuucuucuuauccucuucucuucucuucucuucucuucucuucucuucucuuuccuucucucuucuccucucuucucucccuuccccuuuccuugucuaucucuucccaaccccccaccaucaccaccaaauuccuaauuccugucauauaaaagacaauaaaacauuuauuuauugacuuaaguguugauucaccauugaucuaaugagaaaaguugacucugaaggcaagacccuuuccauccaggccaaaguuagccuuuggcaccacugaccuuauaagcuucuaaaaugaaugaggcauucuugaagacuaauugcuuuuaacuuuuuucuccuaauauuuccaagcuuuugaaagucaaucuagaguguggauguaaguuuuguguaggauuucuuaccgugauuuggagucuuaaguucuaaacaagccaacaaaaccagcuaugcaauucagucaaucugguguuaaaugucccaagauuucuuagaugcagaggcggcuacccucuaagaagcagucguagagcaaaugaggucagcauuaccuucuccuguuacaggugaacuuggggcggaaaagcuuaccagcuuggccugucugccagucaguucuuacuaggauuugcaugaguguuauucacacuuaaugaguugagaauuaaaugacuucaaauuacuuauucuuuaaaaaacaaucuaggccagauguugguuuuguuuugagccugagauuggauucuuggugugaaauucugcugugguuugauagugguucauauuacucuauagccuuuauauucaggacuaugcauaugacuuucaaauguuaaaaauuauuuuuagccuccuacaugccaggcaugccaaguggaaucucugcauauccaucuggauacccucccaaccccagguaaugaaaaucuauuaauuacauuuguaaucaaaauaaugcuaacuggggaauuaaauaaauuuaguuagaauucagugagguugguguauugauguuuguuuuuugagauagguauggcugaguagacucacaguccuaguucagccuugguauuauagauauggauauagauauagauagauaugauagaaagagaggagagagagagagguauugguguuuguuuuuugagauagguauaauagauauaguuagacagacauauauguauacagcugggcaugguggcgcacgccuuugaucccagcacuugggaggcagaggcaggcgaauuucugaguucaaggccagccuggucuacauggugaguuccaggacagacagggcuacacagagaaacccugucucgaacccuccccaccccaaaaaacauacauauauauauauauacacacauacacacauaugccuauauucauauuauguagguaugcuauuuuauaccauauuuggcuuauuggugggauuuugagaucaauaugugcccauaauuccaaaggaaguauagguuguccagagaaauucagcuuuguuuuauuuacaagaggagggauuguggguaggcuucguaauaacaguaaucuugauugguuuggggccacuugcuuuuuccuuuuuaagaaguuuauagggcuggagagauggcucaacgguuaaaagcacugacugcucuucucaaaggucccgaguucaaaucccagcaaccacaugguggcucacaaccaucugcaaugagaucugacgcccucuucuggugugucugaagacagcuacaguguacuuauauauaauaauaaauaaaucuuuaaaaaaaaaaaaaagaaguuuauaaagguuagaaaaauggcucauuaauuuaagagcacuuucugcuuuuccaaagggaccugaauuugacuccuagcacccagauuaggaacucuagcuacaaaggauccaacauucucuuuugucuccacuggcacccacacauauacacuuaaaguaaaaauaauagcugagugucagcacuccagaggcagaagcaagugguucuuuauaaauucuagaccagcuaagacuacauaguaagacccugucucaauaaauaaaauaaauacaaauaaaucuuuaaaaagaaaauuuggauuuucuagaauggaaauuuaggacuacuuauuagaauacaugaaugacacaaacuauccaaaacauuuuuuuuuuuuaagauuugcuuucagagugaacauuuaagguuacuaguaggacccagguuguccuuaggaauauucuagcaaguucugccucucugaaaguaaucucauauaaucagagccaagcaagaccauuugaccuuuuacuacuuugguuuucuucugauauaggagcucgcacuuguguuguuuuuaaagauauauuuauuuuaacuuuuauguguaugagugucuuucuuauauguaugucugugcaccacaugcaugccugguuccucacgagcucagaagaggauagugaauccucugaaacuggaguuguggacaguugugugggugcuagaaauagagccuuagucuuaugggagaacaacugagacauuucuccagcuggucuggaacucaccaaagcugggauuauaggugugagcuaccuguugggcucuguuuuguagguugauuugauugaguuuucugagauacagucuugcuauguaguccaaauuggccucauacucuauuuugagacaauccuuguggcuguccuagaguuuucuguauagaccuaugcagcuggccucaaaaucacagacauucucuaccucuccaugcugagugugggagucaaagcugugcaccaccaaaccuggcuuuuuucucuccuuccuucuuuccuucucucuccucuuucuuuuucucuuuuaauguaugugagugguuuuuuugcuuguaugaaucugugcaccacgugcauacuuggcauccacagaggucagaagagggugucaaauucccuuggagcuagaauuaccgauggcuaugagcuagcaugugaugcugggaaccaaaccuggguccuuugcacgagcagcaagcacccuuacccacugagccaucucuccagccucuggccucauacucaaauuugcuucugccuccuucccagauuggaggcacacacugccaugcuugaccuugacagucgauuuucaaacccaauguaauuuccauacacuguuccuugaauaaacacuuucucuaaaacuuuauauucauuaucuggcaauauaauaugucagucuuaacucucucagugggguucucaguaguguugggucaucuuuacauuugguguucuuuucuauagugguuauccuggcuguccuuacccaccugcuggcccauacccugccacaacaagcucacaguacccuucccagccuccugugaccacuguugguaaguauaagcauuuguauuuuucuuuauaagucaaggucuccuguuguaaaacauguauuucauuuuuacauguaaaauuuuagaauauucuauauuggaaagcucuggugaucacugucuuguaauguuaaacuugaugugauuuaacauuaucuaaaugagccauuuagaagucuaaaaauguggcugauaacucacgaacacuuuccuguuugccacacucuuacugguggaucucacauguuuggagucacuagggccuaaggccgcuggaauaguccuaaagacauagccccaaaaguaagguuggguacuacuagcaaauccuagggccuuguggccuaacuguagaucacacccggaguuagcaugaaagggucaguaagauggugucacaccccagggguguuugcuuuuuugagcugucugacccuggaggacuugugcaaaauuggccugcagagggccucccuuuugucacugcaucugccuucuguuuccggcugcuucugcuucugccugaaggguuucucuacuggagcuuaugucuucuaacucacacuggguuaucauuucagccauuuccuuucuugccuucuggacugcugucauuagcacacaaaaacauucccuaaaacagccuuuggaagcgucagcugcgccucccuguuugcacuaccucgucuccucacagcaaacuuccuugugccuauggccuuuccuuguuaucuucacccuucuugccuucccacuaucauuccucuaaaacugcuucugucagagucacagugaccuuuauggguuuaaauccaguggcuggugacugcugucuguuccuuggucugucuguggcaucugacacagugggccucugccagcuugccucucuuuccagggaaccacacuuugucccuuuccuccuauagcucaggugcuuguacucagucuccacaggcuccuucucuuauguuguaaugcccgauuaguucuuggcacuucgauuccucacucuagcgauagagcuuuaaauguccugucucuacccacagcugcuaaacuguguuggucugcaccucuuuccucuccacuugagguuuaauagacaucuuaaacucaacaugacccaaguugaacucagguccuucuacaguuuauccaucuccauugauagcuauuccauaugcuaacucaagucauccuugauuccucuagaauucucuuaucuucagaauguauggaaaugugaccauacccacugccaguauaagucacuguuaucucaucuaaauuacuguaugagaaccucagccccugcauuuguuuuuaacauaagcagccugaaggaucuuacucaaaacaugaguugaugaugucacuccucuacugaaaaccuuguuucccucagaguucaauacaaaggucuuaggcuuagaaggucuuguugauccuccuccucguuguuucuacuaccuuaucgccugcuaguuuuaucucaaagaguuguuuguuggguugguuauuuccuuuguauugucaaacucacucuuaccaaucuguguuacuaucuccucagacaucuggcagguggcagcucucccugcguauuugcugagugcuugagugagugcacucacaggaugaugagaggcugcugucuuuuauguuuuccaaugucaugagaucggauaccagggucucgugucuaugccuuugcucuccagacaggguccgcuucuguugucaucaauaggaucuaauggcauggcuuugauacauuaaaauaugcuugccuugucuguaauauagcuuccuuuaaguaacaaaggauuuguuaauuuugagaccaggucucauuguauaacccuggcuggccugcaauucugauuuauucuguuuucccaagagcugacauuaaaggcgugugcccacauacuuggcccuauacaguauaauuuaaauuauuugaauaagaaaugcugggggucuuuaaucuguaaguuaaaagcaaaaacaaaaaauaacaacaacaacaaaaccccacuaaaucugggccucaagaaauggcucagugguuuaagaacacugguugcuuuuuccagaggucccuuguuugauacccagcccccacauagugggguuuacagcucuuuguaacuucaguuccaaggaaucuaaugcccucuucuggccuccucagguaccaggcacacaagaacaacacaaauaugcaugcagccaaaacacucauacacauaaaauaaaaauaacaucuuuugccaaguauggugguucacaucuuuaaucccagcccuugggaagcagaggcagacaaguaucugugaguucuacaaaacuuguuccaggauauggaggacuuuuacacagagaaacccuaucuugaaaaaaacaaaauaaaauaaaauaaaauaaaauaaaauaaaauaaaauaaaacaaagcuaauaccaucuuuuuaaaaacccacuauuuggguucaggcagcgucagagaaaugggaauugaacaguuaaucaccuuauuucuuagauaaaacugugguauuauccucugaucucauuugugaagacuuaaacauuuguuacauuuguuuguguauguauauucucagcacuagugugcucagaagacaaguuuggggaaucuguucuuuccuucuaccacuggguccagggauugaacucagguuauucgguuauugggccuauuagcuuaccuuuugcccauaaaagucuuguaauucacuucagaacauuaguuuugaagaauuuuauagcuuagaaauuuuccauuuauccucaaaaugagcuuuuguggaaaaugauacauuuaaaguuagauuugacuugagauuugaagaguagccacaucagcuaauacuuaccaugguuuauaaaaacagaucaccugugacccaaugguuucagucaugacugcagagcagcugcucugugguugccugcacaagacuggaccugacaauaacacacuaguagguaguggucuauugaguccuuagccuccugcuaaacuauuggcuauuuuugaaaauugaggauuuugaguaaguggagucuccugugguguguuguugguagcuuucuucacuuugcuuuacugugaucacauaagguuuuugguuuuugguuuuuuguuuuuuugagcuagagccuauugcuuacauaaagcuggcacacugucaaaccugagcccaucuaagagcccucauuagcacccugccaaguaccauacaugaagauucuguguaugcaguuguuuggaagguuugcuccuaugucagaaacugaccuuucauguuguuguuauauaaaaaaguaauccucgugguuugaccuacuuuugagcagauaguuugugauaacucaggcuccaugguugcuguacagugacuagugucuucacuuacccuuggcuuuguuuccagcagguucugccuacugucaguuccagucuaaaaguauuauuugucuuuuuuuuuaaacauguauguauguauguauguauguuccuguguguaugcuuucauauguguauacagauguaugaaggaagacuagagaucggcuugggugucuucaauuuauacucuacuuuuugagaaaagguugagagccaguuuuguggaccagggguuaaggguuaaaacucagaaaagucagggcagagauaaucaaucagugguuaagagcacugguuguucuuccagaggacccaggauucauucucagcacacauguguggcucacaacugucuguaacucaaguuccgggaaaucucacauccucuucuggccucugcagacaaaacaccuauacucauaaaauuuaaaacauagaauaauaaaauauuagaaaagcuaccguuuaucauguuuucugauaggcuaaugauagauucacucacuaugaauaaucauucaauaugaaauggugucuuuuauaggaacuagaggucaguaaguacugucagagagcuuggugaggucauuucauuuaucguauguuaaggugauugcaagacugaccuaauuacuugaugaguuuucuguucccuaacacugggaaaauuaugucuuauuuucuaaggguuaaauuuggugauggauaccaucugacauguuuugagcagauauuaaaguuuuguagagagaauugcguguacuguguggaagcaucaccuacaauaaaaagccaauggccuguuaauugaggcaggaaauaagagguggguguucugauagggagagaggaacucugagauagaguccggcaugggaagaugaccacgaucucugcagggacagaugcaugaaacugaggagucaccauccauguggcacucacagaauagaauaaagggguuaauuaaggaguuagucaggaagcaagcccaaguucauggccuaggcauuuauucauaaagaguuuacucucagauucauuauuugagaauugggggcacugguagaaaagcccauaguuacaaaguuuuugaccuuuuucacuccacaguucugaaaucuacuucugcuugcuuggguaauugucauuguguggggacuugauauaacagauuugcucaguauauaguagauauggagaauaugggauuucucuucagucacuuaacaaauagugugaugucuaaaagcuuagacucuuaaagcaguucuucucucguguuucaguggaaagcagcucacugaauuuuggauuaaaauucagaauguuugggauuuuuuaagauuauuuucauucauaugagggaacagaggcccuugggcuggaggcacagguggcuguggacugccacaucagucccgagaauugaaccuagauuucauguaagggcagugaguuuuccaaaccccugagcugucucuccugccccaucauuucuacuacuucaaaaacccugggauuuuccauuucagauuguuuugauuuuugauauagggguaccauguuggccucgaacucacagacaccugucugcuucccaagugcuuuuuuccuuccuuucuuuuuuccuuucuuccuuucucucucucucucucucucucucucuuucucucucucucucucuuucuuucuuucuuucuuucuuucuggcaggugaaggguaaagacaggguuuuucuguguaguccugucucuccuggaacucacucugaagaccaggcugaccucagacucaagagagauccacuugccucugcuucccaagugccagaauuaaaggccugugccaccacugucuggcucacuuccucuuucuugauagucuaguuuccauaugugagagaaaacgugacguguacguguguguguguguguguguguguguguaauaccuucuauaacacuuuuuucuuaaccuaggcuuauugcauaaccuuauuuaaggcuuuguuuuacuuuuuauguauuauuuuauuuuguauguaccauguauauguagguaccuguggaggccagaagcagacauggaaacuccuggaaaugggcuuagaggugcccaggagccaccugauauggguacugggaaccaaacuugugcaauguggcuaggaugucugccaccaugccuaguucgaaagcuagcagggauccacccagggguaagccaggcaagcacccuuaucggcugcgcuaucauauuagcuacuuuccuaguaacugaacagggggccugacaaagugaauguaagguauaguuaccucauaguuuggggguaguguccaucuugccggggaaaucaggguagugagaauauggggacagauggucacauugcaucugcagccaagcagcucguuauucagccaaggacccuaacccauggagugguggcacucacauuuaggucuucccaccuuagcugaccuaaucuagauuaaccaggagagcuacauccacgguuccguuggaauuagccucccacagacuuuauagaugcuacguaaacuagaguggacagggacuuccuuauguucuaugggcugucuacucucuugcgcagaacuuuuuuaauuugaugcagucccauuugucaggugguauuaacugagcuguugagaucagauucagaaagucacuggguacuccuggaccuuuaagucuuuccucaauaugcuguuaugcuguuggaaauuccagaguuuagagucuuaaagucuuugauucuguuuauuagauuuuuuucagauaagagauagguaccuaauuucggucuucuacauuggaaguuuuggguuuucaugacuuucaucuuuaguaaaaaucacaugguagaauacuugagcuuauuucuggcuucuccacuuuguuccauuauucugcaugccccuggcuuuauaguaugacuugaaaugugugaugccagcauuguauuuaugcucaggaugcugugggcuucuuguggucuuuuguauuucuauauggaccuuauggagaaugcccuugaccuaguuuauaagaacuauauaaauucuaaaacuaaauguguauucuuuagggauuugaauuuaacaucagugugacaugauccauuagaccagauaaggugacuuuaaccaaauguguuggugcgcuuguguauggaaagcucacauaaaaagacccuuaaguuuuguuguucagauaacuucuacaacacggauaaaugaaacggggagugcugcuguuaucaucuggguaccugaucauggggacaacagcauuuugcaucagauaaacauaauagaauuucauauggguuauuguagacuggggucuuuuaaagacaaguauaaacucuauuccuuauguaucuuugucagaaugggcacauaguaagaucaucaucuucgcuggucuucugaucucuuguaggaaguauccccuuuuaggugaugcguguuuuuuuugcuuugugugagucugugugcaccaagagcagauaggagcucagagggcagauggccugaaacugaagguacaggcacucugagcugccauguguaugcugggaacugaacauggagccacuauaagagaaggaaguguucuuaaccauugaaccaucucuccagucccucuuccuuuuugucuuguuuuguuuuggggggcaggcuuuuuuguuuguauuuuauuuauuguuauuaggcugaaugucacaacaucugacaguuuaagauuccacagagaacuccaugcuuuugcuacugaaagacugacgcaccuaaaaacugaaggucuagcgauuccaagccuucugugagcacagucauuuacuuucuacccucccucuuccuuuuuuuuuuuuuugauuuuuugagacaggguuucucuguguagcccuggcuguccuggaacucacucuguggaccaggcuggccucaaacucagaaauccaccugccucugccucccaagugcugggauuaaaggugugcgccaccacugccuggcccccucuuccuuuuuaaaaacuacuuuauuaauuaguacaguguaaguaaccagagauuuuaauauggccuuuaucuugucuggaugacggaauaguuaggcccuauuauugucaucaucaucauuaugguuauuauuauacuuauuuauuuguguguguguguguguguguguguguguguguguguguguguguguguuuaugucacgcgugugcugaugcccaggugcccguggugaccagaagagggugucagauaccauguaacuggaguuacaggauuuugugagcuuccugauuaugggcacuuauaaccacagagcuguuucucccaacuccugaacaguuagucagaaugagucuaugaacggggcuuguggaauacaucucuuugauagcagcugaaaaaaugucuccuacccgucuugaauggugaagucucugucucucucuauuucucugucucuguuugccugacugccugucuccacccccaccccacccccgugugugugugugucuguguguguaugugugugugagagagagagagaaggggugggugagaguuugaugguucucauuuucacuuguugaaucaggaucucucuugguucuacugcuggccuauagacuuccaugcaguucaguugcugccuccuaucucaagacaagaguguuggaugagggcugcugcaucaggcuuuuuacuuggguuccagaaauugaacuaggguuguccgcuuaugguaugugcucaguggucuuaauuaaguuuagcaguuccaagugcgucuucaguucuagcguucuguagaaggauugacacaacucuucaaacuauaaucagcugcuuacagcaaaaggauacagauuauaauuggcuaaguguuugugaggaaguccaaggguucugaauggcgaacaccuaccugagccuucauguccagaguuugugcauuaucuccugcaggucccagcagagauggcacaaucagugaggacacuauccgugcaucucucaucucagcagucagugacaaacugagauggcggaugaaggaggaaauggauggugcccaggcagagcuuaaugccuugaaacgaacagaggaagaucugaaaaaaggccaccagaaacuggaagagauggucacccgcuuagaucaagaaguaguaaguaagccgggcgugguggcacacgccuuuaauccccgcacucgagaagcagaggcaggcggauuucugaguucgaggccagccuggucuacagagugaguuccaggacagccagggcuacacagagaaaccccaucucgaaagaaaaaaaaacaaaaacaaaaaguaguaaugcacugaaaacaucguggguugaauuacagcuaaggcaaaggguucugugcaaaccuugauguuguaaaguaaaaguucagugaacaguaguugucuucagguaugugaacagagcucucuaagcaggauugcuggaauguaccuauaaucucaguucucaggagcugaggcaggucaucaguuagaggaaauacuauagccauaaggucucaagugcagccucauugaucuuccacuggaaagugcuaucuagaauacugcacuucuuccagggugaauugcugccacuucacagggaauaugaauuacagaguucugugaauggcaaacacacuuggaccuugaacuauacacuuaagagagaauuguauuucuaagcauuuaagucaguauuagaagugccuuucagggacauggagagaugguuuagugguuaaguguccagcacccauaucgggguacacacacgcacacacacacacucacacucuaauaaaaauguggcucagcagcuucuugguuuugucauccagagacaucugagggccugagagcuucaaaucaauacagccugugccccuucccucuccaggcuuucucucuguguguguauaaaaugagcaucauaauagccaaccauuucaguuuaagaauguagugccgauguaaugcagagccugcagccaccaccugcaaugcguuguagcucugaaaaucaaauccuucccauagaugggaggaauuucuccuaugggaauuucuuguuucaugauuguccauggggagagacuuuauuuuggacugugucuggcaguccaguuggcaguaccauguaucucuuucacaauuacuuucauuuuggggaauuuucgucauuccuucccacauuccaccaauauauuauuggaaguauuaguccgaugcuccaaauaccgucugagguugaguuguagaugugucauagcaaauaaucguguacaaaucaguauaaaguuaugcauggacuguucuguuuucaggcugaaguugauaaaaacauagaacuuuugaaaaagaaggaugaagaacuaaguucugcucuggagaaaauggaaaaucaaucugaaaauaaugauauugaugaaguuaucauucccacagccccacuguauaaacagauucuaaaucuguaugcagaggaaaaugcuauugaagacacuaucuuuuaccuuggagaagcuuugcggcggggagucauagaccuggauguguuccugaaaguaaguacccuuccuucagcugccagggcuuugggaucugcugcagauucagucacaccaccuacauuugagcuuauugcccacccccauuuuguuuuguuuuuagucccauaauggucuuagaguuggauaauuuuagauuaguuuucccagaucagauaguucuagaaagaaguggguacccuuuuuaaugcagguuaucucuggcuugcuaauaguguacagcccgaagucuuaguaagcuuugcuuauugcccaaggagaauaugguuuuaggaauaauaaccagauacucaguauauuugaccucauuccuggugagaacacucaggugaguggcuaaaccuugugccuuggaucuaauguaagcagugugaguggccgagcguacacuagugaucacaaagaagguucuaccacugccuucuggcuggguggcaaggcauaugaaaagaugaauacggagacaggaaaaguaaacuguucugagacgcugaguaggguuaacguuaguaccguuucuccucagcccuucucuuguuguucucuuaguaaagggacaguuugaaaacuuguaccaagcauguuuuccuggcaucuugguguuucaagauguagguaggugggggcuggagagauggcucagcggguaagagcacugacugcucuucccaagguccugaguucaaaucccagcaaucacaugguggcucacaacuauuuguagugggaucugaugcccucuucugguguguccgaagacagcuacaguguacucauaaauaagauaaaucuuuaaaaaaaaaaaaaggcugggcaugguggcacacgccuuuaaucccagcacucaggaggcagaggcaggcggauuucugaguucgaggccagccuggucuacaaagugagugccaggacagccagggcuacacagagaaacccugucucgaaaaaccaaaaaaaaaaaaaaaaaaaaaaguaggcuugggcuggggcuacaccuccgggaauggcucaucccuaaugugugcaaagcccuggauuccauccucagcacugcaaagguaaagccaggcccugcaauauaguagaguuuuuaaaaguuauaaugugcaauugguuucaaagguugcuguauauauuuaggauugcuagaugcugucuggcaucaugacuggaucaacgcguuucugaaauguuaacauuuuccuccuuccuagcacguccgccuccugucccguaaacaguuccagcuaagggcacuaaugcaaaaggcaaggaagacugcgggccuuagugaccucuacugacaugugcugucagcuggagaccgaccucuccguaaagcauucuuuucuucuucuuuuucucaucaguagaacccacaauaaguuauugcaguuuaucauucaaguguuaaauauuuugaaucaauaauauauuuucuguuuccuuuggguaaaaacuggcuuuuauuaaugcacuuucuacccucuguaagcgucugugcugugcugggacugacugggcuaaauaaaauuuguugcauaauuuuucucuuucuuggacuugagauaagaugcacaaaagaagccuggcuucucauuaauaaacaaggcacaguguucaucuuaaguugcaguucaguauucuguagguuaaagauaaguucccuuuaguguagaaugucaugcagagaaauguauauauuggaggauauguuuauuucauucuagaaccaacugaaccaugguucaaaacuuuuuuaaucaagaauucaauucccgccauuugcauuaggcagcucacaacuguauucuagcuuuggggauccaauauugucuucuggucucuguggccacuacacucauauguacauagacauagauacauacuuuaaaaaaaaaaaaaaacuugggaaaauguaguaagacuguuucaaauaaacaaacacugagcaugcugggugauuuaaaggaaguacucuuugcaaacguauuuuaauuguugaggaaaaaauguguuaaaaugucaggugaucucuaauugauuucuucaaagcuuuccucagauuccaccgucacugccaacucugaccuugugacagccacacuaggugcacaagccauaccuugugcagcaaaaggcaauguccaucucccagcuuggaguucagcauuaccuaauaccuggaauaccugcugcagauagguguuguuaccaagccaagucaucucaaauaaaggaaguuuuccuggugauuuucacaga

SEQ ID NO: 3824 - RNA, 35314 nt, Mus musculus
guccucugcggaaguuugggcccgugcggccuccguucccagcguguuuugaaacaagcccagugacugcggccgaagaacgcgccccugcugaccauggaguucgacugugagggcgugagacggcugcuaggcaaggugcaggcaggucggggggcggacgggaccuagcauucucgucacugcgcgucgccccagcccauuccccccaccccauguccuuuuuuccaagauuguuuugucguuuugacacacccauacauacucuuucccaggcuggccuggaagucgcggcaauccuccugcuucagccucccggugcuggggucacaggcaggcggugccucgccccccuugaaugagucacucccugcuagugucucuaccugcuuugagaaauccggguuaucaccuuguggaagccauucuccgccgugcuuccuccuggagcguuugugacuguacacuguacucuugucucuguaguccucucaucuagcacuguggucacauuguagguacucacaacgagaaccccgcagacgcgagugcaggccuggacagggcuuuacuguggaaagguggauggagguuucuuccacccucaagucucuacccaccccacccccaggcuguaugcucagcauuccugacucccgcccucgagcauacuagggcugucuaguucagagguuaccuuguuuagugauccuggccguucagauugcccuggaagagcccugaaacaugauucugugcugauauucuuggacguagggggugucucuuugucgggacaguuuuuacacuuguaagaguuuuaagagcuccuaaaguugaaaucguguauguaguugauucugaugguuuagcuuacaguuacagguguagguugauugaguugguuguaagacuucucauuugcaaaaagaaaaaagagaaaaagaagccuggugugguggcacacggcuuuaauccaggcacucaggaggcagaaacagguagcucucugugaguugaggccagccugcucuacauaguaaaguucuggacagccagggcuacauaaugagacaaaauacaaaaaaaaaaucuagaccaggcuggccucaaacucaccaagauucuccugccucugccuagcaagggcuugggaucaaaggcauucaucaguacagcugcccugugaagcugagacuguguuccaguccacagcagugcagauagguacgggggaguucugaguuccccacguccucgccagcacuuacuguugucucauuuugauuaugguuuguaucuugauuaugcugcgauuucgccaaacuuuuuuguucauuuccaagguuauuguggcuguucuaagucucacgaguguccauaucaauugguguuuaauggugagguaugugugugcugcagaccaaaaccaggccuucuggauauccuaagcaacugcuuuaucguuuagauacaucuccagcccaguuuucagacuuuuguaacagcugaaguuucacuaagggauuacgccaaaccuuucgggaaaugugaugaucaugacgaucuuagauccacaaacacaggauacuuucccacuuaaaacaguuuuccaagccaggucuucaaucccagcacuugggaggcggaggcaggcaaaucucugugaguucgaggccagucuggucuacgaagugaauucuaggacagccagggcuacacagaggaaccugucuugaaaaaccgaaaaaacaaaacaaacaacaacaacaaaaaaaaaaccuuuccauuuuauuucuuccaacagugguagguuuucaauaucccuucuguaccuuucugaacugauuuccaaguaguuuuauucgauuuccaugauguugauaaacugccuccucucaauuaauccucauggugagccucgggaguggguaggauuuuucuuuguagguaagaaaauaaguugagagaaguuacaugauggcgcccacaaggccacaaagaaagacagggagaggcaguucaccagcuuguagcaaacucuugcuuguauuucuuuccccuguaaaaucuaagauaccagcuggaggcggacaagggaaagucaaguugucucuagugaaggaggcauucagacaaaagggcugacagguuggugagacagcugccaucaagcaggacacccuugagcuuggucccuggaagccugggguuggaaggaagagcugauuccugcgaguguccucugcccuccacaucagcacccacacuuacauaccugcauuaaauuaguaaauuaaaauguaguuaaagacagguggaucuugaaugcucaugagugguucaucauguacugucccacaggcucucgggguguuuggaggcauuuagacuuaacugaucaaggcccagagcuugggguuaagcuugguguuuaauaccuugcuuugguauccaacuuagcaaauugcauggauucucuagauuucuuuuuuuuuuuuuuuuuuuucuuuuucuaucaaguggagcaccuguaaacucuccgugcuccucagaacuaugguuucaaugaugaaaccagaaauccuugaugauggaugccuguguuccuggcaucuagggggcggagacgggaagggaagauggauggccagcuugagguccgccugaacuguaaagugagacccugccucgcauucauaaugagucaaacucuggugacaccuguggugguaaagcgcuugguccuugucccacagcagguauuuagucuuguccguccguagcucugucuucauuccgugcugcucauugcucucauuucaguacaaguucagggaucugacuguggaagagcugaagaaugugagcgugucuuucccgcacuucagauacuccguggacaccuaugguaugaauagugucuucuaguccucgcugcauuauuuggguuauuaauuauuuggccuaaagagcuuccguuuuuauuucucuucuuuuaaucucagaacuugcgauguagcuaagggauggccuugaacuuccgauccucauccugcagcuccugagugcugggauugcaggcaggcacugccacucccugcuuucuuuggugauagacguugaagccagggcuuuguauauacuagccaaguacucuaccaaccgagccccacuccaccgucugugguuuugagacaugauugguuugcauuccuuugcuggucugguagcggucuugagcucaugacuguccuucugccaacgccucucaggggcuggggugacaaguguaggacauuaugccuggcaacuuauaugucucuuaagaaaggaaggugggcaucagauuuggacuugacugucaaaguuuuguguucuuacacuucccuuugcuagucucuacuucugacugacauuuuggaacuuugucuucuaguuuucaaagauacaucccaaaaagaccugcugaauuucaccgguacaauuccugugauguaucaggguaaguacggaagcuaguucuuuggugugcacugcucugaacgugucuuuacauauaccugaggugucugcucgggaccuuacuaggucuggcaggauccuguagacgacaaggaaagccuagauuaauuuuaaguccauguaacaacuugucaaauagugccuguuaggcugguggguugugagaccagaagagagggugagagacagagacuugcucuggggagagagccuugcucucaguaauggagggccaggguccuguguguuccuauugaugccugugccuguccccgcuuuccuucucugugauguggcgcucuaccuguucuguggguaagacugaaucucagccuggucacaugaucgagcaaacacagccagugucgcagugcauuccgagacauuuuagaguuaggugacagguugagauaaugaggauuuacucaaaaggaaaggaauuauaauuauuauuauuauuaagcauuucuuaacuguucccugcuuacuguucagcaauguaaccuuugguauagaagguugcuuaaacaauaucauuugaagaacaccagcaaagcucuguuuucaaaagacuucucugaaguagugcccacaauuccaccauuaaacauuuguucuugcugcguguagaggaggacauuuguaauccuggacucaggaugcugaggcaggagaguugaagagcaaccugaguuacauacuaagacucugucucaaaugaaacaaaaugucauucauuuacagugcagaucuccccagaaagaguaaccgcugcugauacagaaugacugaugcuugcuagcaguucuugggaaguguagcucacaguuaguuuacuuguuacugacuggaaggcacaggaacaaaugaacucaguaggcguuugaaagaguugauacacagagaagagggcuuuaggagaucaaaucacacggggagaaaagucucucagaaagcguucagcaugggacaguaggauuuugaaagaccaggcauuucuguacauuaauuucuaaaccaaggccagccucgcuaauuccugucuccccaccagugguggcauuuauaagaagugugcugaggcuuuucuucugccugugacugaagaugaaagccuuggcuuugaggcagaacucgucugucuuugcuuugcuuuacuucuguccugccaggaucuccuccugucuucuggcugucagaacugcacucaccccacaaguuguuucuuguauucuguacuuugcuuggguggauguuaagaagaaacagagggaaugaggaaagagaagaggggccaggaaguugagucccguaguuccauuuugaggcaagagaauaauucuuauuacuuugcugauuucaauuuuaucauuuuaauaaucacugccuaguagcauuucauuuucuagguauuguaguaucccucacgaagcugaguucaaccccuaaaugugcaaaccgcuagcuaugcuccacgccacaccccagccccaucaguacugugcaguccacugauauucugcuuuucgaacaggcauguaguuaagccaucgacccuuaugccaagucuuccuugaaguagucaugcugguugcaguacucugucuaccccaguacuggaaaucaaacccggggcuccacacauucaugacaggcuauccaacucccugcuucuaccuugagcaguuacuaccucuggaggaaugugaugguauaucuuuguaccuggucacuuuauggucuuuggucucauaauuuuguaaucguaggguuuucuauggccagacccacauuguaaauauuuagguaaaagcuacacagcagauguucuaugaauugcuaauauaaaacuggucgguugccagguuuuaacaugucuauaaugcacuaauggcauccuguuuguauauuagcguggcagcuuuaaagaaauguugucuggacccuguuggguugcaucagucucacaagggauacggccaaagcacuuuacauguuaauaaaauguguaguugcugcugaguauuauugugcuugguggggaggaaggaagaugagaacaguaguagcuuucaguagaaaggcaguuugcauagagaggaaaagaugacggugaagaagagaaccauuuguuuacaucugaccuguuuccaaguggguuugaaaguacaacuuauaguguuugccaugucgugugcauacauggauuucaccccaacaguggaugaaauuagaaugaauauuacuuugaguuuauagaggaaaggauuaggcggaaagaaguuaaguaacgugggugaagucauacagcuaauaguguguagagguagguauccggucccgagcagaauauuuuuaauacaguguaagacacggcgccagaccgugaaacaggaaucaggguuaaagacagaacaguucgaguguuuuuucgcaugucuagacaguuuaguuuucaguuacuuuggauuuagcuuugggccuuacagcaacuaaggcaugaccuacacgaauaaagucagaagagcguguggucggguuccuuccuauccaucccauccauuuuuguugagguggguuaaugaucuaaaacaaaacuucagacaagcuaccugccugacaggaaagccagguggcaggcagacaggaaccagacaccugcccagggcagcacgugaugagcauccacaggcuucgccugacugggaaacuacaaagagcaagucuacacuugaagcccucuagcccaaaaggucccucuucaagcccucugcaccugagggcagccgccuucaugguucuuguugagaacccaaucuaacauaauugcagugcuugcggccaacuaaacccagagccuccucacgucaggcaaauggucugcucagcuagacccauugacuguuauaagccugcuucuuuuucugaaaagaauacugaggacuuccaaaguguaguauuucuaaaagauuaguggcccguuuguguguguguauggcaggagaggggcguauucagacugcccuacccuacuuucacguuggugggggcagggaaggguguuguuuaaaaugcagagcauuugggccuugucccacucuaccuagguuccuggaauccacaugguuuccaguuucuuuaagucauucuaacauacacuaaaauuuaggugucacuaagaaaagaugacuuaccuuccccucuaagcucagugucuguccauucuuauuucuucuucuucuuuuuuuuuuuuuuuuuuuuuuuuuguuuuuuuuuuuuuguuuuuuugagaaaggauuucucuguaguccuggcuguccuggaacucacucuguagaccaggcuggccucgaacucagaaauccgccugccucugccucccgagugcugggauuaaaggcgugcgccaccgcguccggcuccauccuuauuucuaugacugacuuauuuagcagcuaguauuuuaggcacaauaccugguguuggggauauaggggagaaugagagagaaugcacaguagacauuuacacuggaguaggaaagcaggcuggguaagaauaauuuaaaaguggagcagcuacagugucucugcuugagaugugcaagguaaacuacguagaagagauuuggcgucccacacuagugggacagcacagccugugaacuguuucggaauugcucaggugaccacugucuucguuucccagcuaugcuggugcuaugcuaagaaccucuuuccagugcagagagaaugaaaagugggaugguuugcauccauccuuacacacaaacucggcuaccccuuuucuuccuuuuauucaguacuuagcacccuuuuuuauuuugggacagggucuugauguugucuagacugccuucaaacucacagucccuccaccucagcaucauuagguggaaugauagcuuuuccuccaugccuagcugucuguuucucucugcauggugcacccauuguguacgugucaugauuguuuaucuugucucaaauagguaagacauacaacauacccauucgcuucuggauuuuggauucccacccuuuugcuccacccauuugcuucuugaagccaacugcaaacauggaaaucucgguuggaaaacauguggaugccaaaggcagaauauacuugcccuaucuccaaaacuggagccacguaagaucaauuuggauuuucuuuuauucuucugaauauuugucuuugaucuugguaacacaaguaaacauacugcaucuuccuuccccgcacccucccccugcauacacgacauacgugcacacacacacacacacacacacacacacauacaugcacuagugcauacucgcgcacacauacauauuguuugguugucgagucagacucuuaucaugucggccuuuuguguccuggaacuuaccguguagaccaggcuggccucacacucccagagaucuguugcuucugccuccuaaguacugcaccaccaugccucgaugaucuuucaauuacauucuucaugugaucuuuagaaauaguuuguaaucaggcuuucuugagucucugacguuccagaacccugauaagaucagccugcagagcugccuucuccaggucugggagccagcugcuggugucccugguuuuauuaucauuuaguacuugaaggguuauacaaaagcuauuagcaaaguacuggaacucuaguuccuaguuccugucuauuaaugauucucacgcuauauauagauaccuuuuuaacuuugucuaaauugaucguacucuauuuaauauauaaugugccuuguuuaacugauuguaguguguguguguguguagggacaguguaaucuagggcucaaagcaugguaggcagacauucuacugcugagcuuuguccauuagccuuggcuugcucuguagcccaugcggccuucugccuuacucugaaauagcuguuauuccguacuccaggccuugcuaagguuuuuguuuuugcagugcgcaggcuugaaccuugggccuugcucaucccagacaaguacuguacugcucauuacucacucagccuagcauucagcuacuuuuuaucuucuauuuauuuauugcauguguuuguguguguaccuaugugacaugguaugugugcaugcagaggacaacuuguggaaguugguucuuuccauucaucaugugagucccagggaucaagcucagguggucaggcuuggcagcaagcacccuugccuacugagccaucucucagcaagcacccuugccuacugagccaucucucagcaagcacccuugccuacuuagccaucucucagcaaguacccuugccuacugagccaucucucagcaagcacccuugccuacugagccaucucuccagcccuuucuuuguuuuguaagggaauacacaauaaaaguuuuagggguagaggacuccugucuacauuuuguuuuuacaugcuuuagaaaauagaccuaagggcugaaugugaccagccuggguggcagauagaugcuguuuuugucugaagugacuucaaaguaaaacaucucaacccuguauauucugucacaaaguauguuuauccuauucuucuacauuuggaagauguugguuuagcauuuuucuccuuguauuguguagaucuguggagugcuuccaugagaucucuagggaagguacuuacuguauaacacaauuuguuugugcuuuucaguuaagaauauuaagaguuaaagacauuucguauggugguuuaggaaaaugagaagauaacugaagauacuucaccuuugacaaccuggguuuggagaaaagauuaagucauaaauguauaaaguaaaaagacaguguauuuaacuauugcuaccauaaagucuauguaaaccuguuaugaaaaguuaaaaucuaucagacauaaagaaccaugugugguuaacacuuggaauucuaguagcaaggaggcugagguaccacaaguaaagguuugggccagccugggcuacacacagcaaguucucauccugggcuauaaagcacaagaccuuagaaacaaacaguggguccagaauuuacccaaaacaaaaaccuaaaaaauaaaaagcuugcacauguucuuauaugcacaaguguagucuggggccuuuacauguaacaacagugugaguaaacgcacacuacuaagugagcuuuaccauguagaucuuacaauaguacugacggacuuccuucuauuugcauggaguaaagucucucgugauuggcuaauccuguaacgcucugcauaauaaugugcggucaaagggcugcugugcauuuuucacuguacaaugauacagcauacaaaacaugugcuguucuuacauacaaaacauguacuguucuuuuuuuuuuuuuuuaagauuuuuuuuuuaauuauacguaaguacacuguagcugucuucagacacuccagaagagggagucagauuucauuacggaugguugugaaccaccaggcgguugcugggauuugaacuucggaccuucaaaagagcagucgggugcucuuacucacugagccaucucaccagccccaaaacauguacuguucuuacauacaaagcaugugcuguccuugcauacaaaacaugugcuauucuuacauacaaaucaugugcuguccuuucauauaaaacaugugcuguuuuuauuauugguaagggcugcaguguagcuuggugucaaguacuugccuugcaugcacaaggcugugaauuugguucccagcacgagugaagaaagcaagcagcagaaauagugaagaugaggagucuggggagacugagucgguuucugacugugcauugucaaggaucaccuugagugacugacaauguaaaauaaguguucuguaggaaauacgguuagguaacuuuucccuuugcaugcauucuccagcccaaaucugccaucguuggauuaauuaaagaaaugauugccaaguuucaagaggaacuuccucucuauuccauaccgucguccaaugaagcgcaacagguggacuugcuggccuauaucacaaaaaucacggaagguuuguauugucagugagaucaccuaagagucaggacauuagaauuucucacuaagauucuguauucuuugcuacuugaauucaaugcauaagcuuauggauaaguuuuauuauauauauauuccuguuuaauauuccucuauaucaguuauaaggcacuucuauauaguuccaauuaaaguuuguuaaaauguaaaaauguuacucuuauauaaucagauaaaauagcucuuccuuuguucagagccucuuauaaauuaauuauaccaaaauuuuaucauuacauguuucuguaguuuuuugggcuuauucagugaaugggaccagagguuguauaaguuuuagcuucuuauuggguuaaagccaguuacucaugccuagaacauuucaguaggauuuuugugacuauugaggucagaggucaguacugucugucuuccucagcuuuugcuaacauauagcaauuguguauagcaguggguuucaguaugacaucuucacacgguauacaauguaugucuaucauguucauccugcacccuucccuuaagccccuuaacuuagcccuucccucuucuuagcuagcuucuacuuuuaccucucugccccugcucuccagugcguuuccuuaggguuguuuauagggacaugggugaggaucuguuuacagagacacugguaccuuaccaggcuacaccccuaaagaaaacaucuaccuuccuuauaaacaauugacugucuauagguucuuuuuuuuguugguuuuuuguuuguuuuuguuuuguuuuucgagacgggguuucucuguguagcccuggcuguccuggaacucacucuguagaccaggcuggccucgaacucagagauccgccugccucugccucccaagugcugggauuaaaggugugcgccaccacaccaggcgcuagguucuuuuuuuaaauauaccuuuaaaaauuauuauuuuauucuguguguauggguguuuugccugaauguaugucagugccuagugccuauaauggccagaagaggguguuggauuuccggaacugaaguaccaggugggugugaacugcugugugggggcugggaauuaaacucagaugcucuugacuacugagcugucccuuuagcuccuuaaauaaaaagugguuuuuguuugucggguuuuuaugguuuauuuuuuuaugugcauuugguguuugaccugcguggaugucuguauaaggaacuggaguuacgugguuacugggaauugaaccccgucuucuggaagaaagccagugcuccuaaccacuuagccaucucuccagccucaaaugaaaaguuuuaaauguuuauaauacuguccuuaaaaaggagagccucuuaaaauaacauucaauauaacaccccugcuuuucucaggggagggcgcaauguauuaguuugagaaaggcucucggguaacucuggcuggcuuguuuuuuuuuuuuuuagauuuaucuauuuauuuuauguauaugaguacauugucgcucucuuagacacuacagaggagggcauuggaucucauuacagaugguuguaagccaccaugugguugcugggaauugaacucaggaccccuggaaaaucagucacuuaacaaccacugagccgucucuccagucccccagccucaaacacuuauguagcugaagaucaccuugaaguccugaccuuucugccuucaccucccuguuuggggggguuacaggugugcacagaaauguccagcuaccuccucuaugcccacccccaccccuaagaauagguguuacuauggaacccaggcgcugccucaaucuccugacggcuggaguuauaggcgugagccaccgugcuugauuucaggcuccuguccuugccuucauuaguacagcaaauauuaaaaaaaaaaaaaaaaauagaaaugcuggccagccagugguggcacacgccuuuaaucuagugcuucggagggacacagaggcccaugagucuauagccugcucuacagagggagcuccuagguagccaagacuacacagaggaacucugucucaaaacaaaacaaaaaaaucuauagaaucucuaugagagcuuuugaaguucauuuuauuuuauuauuuuuuaaaauuguauuuacuauuuuuuuuuuagauuuauuuauuguuauauguaaguacacuguagcugucuucagacacaccaggagagggugucagaucucauuacagaugguugugagccaccauguuguugcugggauuugaacucaggaacuuuggaagagcagucagugcucuuaaccgcugagccaucucaccagcccuucauuuuauuuuuaagaagaugcuagaaaagcauuuuugcagggagcggggaaugggaaacaaggucacacugugguccagguuagccuugaauuuacaauccuucugccucaacuuguugagugcugggauuauagauguaugcuaccucaccaagcuuauaaaugcuagaaaagacauuuuaauauuauuuuuuaauucucaggauaaucuuuuuauuguaggugucucagacauaaauucaaggggcuggacaaaucaugagaauaaaauacucaauaaaaucacugugguuggaaguggagauuugggaaucgccugcacauuggcaauuucagcaaagguauguagacagaguggcucuacgucuauuuaugcuuucuuucaacuuaacacuuuuuucuuuuuccacuuuucauguauguguguaugcauuuuuuggcaugucuaagcacacauuguguuuaugugugcacaaguaugcuugugcacauagaaaccugaagcaagaagucaagaguuauguucaacugcucuuccacuuucuucacugaggcaggaucugucaaucaaucacagagcuggacaauauggcucacccaccagccagguuacucuggggugcucugucucuggccuccuaggcugcaguuaccagugggcugccaugcucaucugguguuuacacugguuucuggggaugggaacauauagucuagaucuuuaaccacucaaucaagagacaggguuuugcuguggagcccaaccugcccucaaauacucuuccucccucagccucuggagugcugggguuacaaacauuuacagccacacccggcuuucagagccggaacuccagcaucuccuaagauagauagaaaugcauggccuaggcuaagucuucauuuccugcagcccagcugacuugguggcagucaguuuagcugaagccccucuuccagcccuguguuguauugcuucucgacuuguucacagugaguaagggcuugagucuccucgagaguaucuauacaauugugucauuuuucacaggugcuaguacauuuguaggauaccaucuauacaugagaucagcggguuacauaauuuacuaauuuuugaacuguagaaaugaucacauugagcugggcauaaauggcacaguccuuuaaucccagcacucaggaggcagaggcaggcggaucucugaguuccaggacagccauagcuguuacacaaaucaaccaugucucagaaaaaauauuuuuuuaaaaaaggaaggaaggaaggaaggaaggaaggaaggaaggaagaaaggcaggaagggaggaggcggaggagacgagcaacagcaacacugaauuaaaguaaaaacuuaaacucaagaggaacaguagcauaccugccucguacaccuuguccccuuuguuauuuauuccaucaaaagaagcgauaguuugcuccugaguaagcccuguuagguccuggugcacaguagucaagccucaaagacaguagcagucacauaacagcgucgggcuugcguaucucccuuauugcuguuguguuacuuguuguucuuaagcaguucaggaggccuccuuuagccuuucucgugagcuuaguccugaguagcuagccgugucagugaaacgcuguucuuguucuacucuuuccacacagggcauugcagacaagcugcuccucuuagaccucucagacgggaugagccaagggacgauggaccuugauaucuucaaccugccuaauguagagaucagcaaagguuuguuuauccuauuuaaagacagacgguuauaguagucuauaguauucuuuuuuuuuuuuuuuuuuuuuuuuugguuuuucgagacaggguuucucuguauaacccuggcuguccuagaacucacuuuguagaccaggcuggccucgaacucagaaauccgccugccucugccucccaagugcugggauuaaaggcguucgccaccaccgcccagcagucuauaguauucuuguaguugugucuuagauuguuuauuuauuuguggaacugggaauuaggucuguacuggcuaguuuugugucaacuugacacagcuggaguuaucacagagaaaggagcuucaguugaggaaaugccuccaugagauccagcuguaaggcauuuucucaauuagugaucaagggggaaaggccccuuguggaugggaccaucucugggcugguagucuugguucuauaagagagcaggcugagcaagccaggggaagcaagccaguaaggaacaucccuccauggccucugcaucaccuccugcuuccugaccugcuugaguuccaguccugacuuccuugaugaugaacagcaguauggaaguguaagcugaauaaacccuuuccuccccaacuugcuucuuggucaugauguuugugcaggaauagaaacccugacuaagacaagguccuagaauuuuuuuaauuauauuuuuacuuacuuuaguuagggggcacacgugugccauagcauguguguaccugcgagaguugacucucuccuuaugccucuuggguccugggacaucaaacucagguugucuacuuuagggacagaagccuuuauucacuaagcugucucucuagcucagguccuagaauucuaaggcugacaaguaucaugaagguccucuguuccaagggucuauaaccaguuuuaacaaguuacguuagcuguagucaaaugagcaaauagcauucagaaacacgccggcccaaaguguuuucucugauugacacccauccccaaaucagcauuucucugguugcuuccuuucucaggauacagugguucagagcccuggcguuagaguuaggcagauugaguuugcaucuuagccuggccacaucauagucugacauuugcagguuaaguaagaaaaagaaaggaaguucuuuuugcuguuccauccuuugugugugugugagccucaucuugcuguuuccuggcugccccugaacucccgcccggcucaagcagcccuccugcucuccacugcucucccaacugguggugauggugggcgucuccacugaguccaggccuuuuaaaaaagcaucacuucagguuaagagcacugacuggguucaauucccagcauccacaugauggcucacaaccaucuguaaugggaucugacgcccucuucugguagacagcuagcuacaguauacucacauacauaaaauaaaucuucaaaaaaaaaagcaucguuucauaggacauguaacauugcauuaguacagauacauucaucuagauaaagacuauauuuggggaugcagguuuaaaaauauuuuaccaggaaugcaugaguuuaaaaaauaaaccaagggcuggugagauggcucaguggguaagagcacccgacugcucuuccgaaggucaggaguucaaaucccagcaaccacaugguggcucacaaccauccguaacaagaucugacucccucuucuggagugucugaagacagcuacaguguacuuacauauaaucaauaaauaaaucuuuuaaaaaaaaaaaggaaaaaaaaaagccauaauaaaaaauaaaccaagccuggugagauggcucaguggauaagagcaugcuccugcagaggaccugaguuugguucccagcacccauaccgugcaccucacaacugccugucacucuagcuccagggguuccaacagccuuuucuggccuccacagguacccacauacaugacauacauacccagacacauaaaauuguguguguguguguguguguguguuuuaacauagguuucuuuguguagcccuggcuauccuggagcucacucuguagaucaagcugaccucacacagagaucugccucuaccucccaaguauuagaauuaaagcuguacaccauugugccuggauuaaaaauacauuuuaaaaaucaaaauaauaaaaacagauuguugaacaaaauguauuuccuaaaacauggcuaccaguuuauagauaagaccaacuuauacauggcacagugaugugggcaucuuuggucauucccuaggcuuccuauauuccuuggcuguuuuccaaacaauguuuaaagucucacauacuagaauguacagaugguggucagaagaguugacuugccugucuguucuaaaaauagcacgccacagugcaguaaguauucagaugccuggaggagacaauuagcucauuuuccucaucugagaagacuauaguuguuuuaaugguccuuuaauggcuggguagagguuccuuaggggcuggauagucucuugugccugucauucccaguccugaguucuuaagggaccucuuaacucuucagaucccuguaggagagcgucuuuaguauccaacccuagagaaagugaggccauuuaggaccuaaggaaacugguuuuuuuuuccuugugucucaucagcccuugauaacuggugaaguaacugacuaauugaaagaacacacucuuuggaggaaaugugcaguacgugguacugaccaccaagcagggacucagaauuaccugugaggacgaggacauuuuaucauucaaggcagaggaaggaagccagaggaagacucuggcagggcgguugaagacaagguguaguguuuuaaacuaguuauugauuucugcugcucugcccgugcuugucaaccucuccagguaccaguuuuccaaggggggcugauagauuggaaucugaaagcagacugccugggccugaccagccccucugcugaccugccccagucacuucacuucuuugcuccguccuccuccgguucucccacguuguauacggucgcuuucaaagacugcugcagcucccaagcucaguacaggagccaguggcuauuggaucauuuugccucuauuacucauuucccuuucaagcguugugaaccacauagaaaacuuagucuuuguauauuggcacugguucuuucuaauuuccugccuauuuuguucuguaucccaggcuggcccccaacuuggagccauucugcuucgaccucccaagucacagcuguguaccacccugguuggccaugggauacaugcugucaccccuaagcauucugaaugauagcuauauaggaguguguaugccuauagucucuguucauagaauagagaaacguucuagcuauacuggcauuaguuuagacuaucuugaacucagacuguuucuuuuuguucauuagauuugucugccucugcucauuccaagguggugaucuucacagccaacucuuugggcgguucugaauccuaucugcaugcaguacaaaguaauguggacauguucagagcucuuguuccagcucugggacacuauagucaacacgcugucuugcuuguugccucucaaccagguaaaaagcuuuauuuuaaauucaaaugaugguccagaucaucaguauaauugccuuugcugauuuaaaacaaaaacaaaagccaaaucgccgugguguguaaggaauauucaguaagacugcucuuagaaugaccagcacguacaguuacuccuuauagcugauagcacauaguuugcaauucacagcucuucaugagcgggguauuauuucccaguuguuagccauaccuccuuuagugagaaagugguuaaaaccuccaagagaaucauacugugauguuuauguguaagauaucuaaagcucugauauuaugaagaauuuaagaaacauaucacuacuauacuuacaaagacaauuuuuuacuuuuguguguguguacaugaacaugugcacacauacacacuguguguggaggucagagggcagcccuccuuugauguguguuguggguugaacccacauugucagaauugagggcagcuaccuuuacccacugugccgccucacccacacucacuguauagcuuuaacaguuuauaguugguagacuguuucacuuaagagagauguuuccagagacuaggugguuugggcucagucaauguuucaaguauguguuugaaauguuccaaaguuacauguuuccuuuaugacugucagagacauuggucccuuuaaauucuuuuggcauguaaaagauaggggaguuguggcuuuuuuucuuaaggugauguacugcauaguaauauaugagucaguauuuugauuuaagccuaaaacaaaaaaaaauuuuaucaaugaaauggaauuauugggcuggggcuauggcuugguaguagagugcuugccuaacauucaugaggcccaggguucaaaccccugcaggugcaugcacacucaaaagacuagugcuucacugaaacaaaaugauuauuuuccugcuuucuguuggggugcgggauuaucugugcacugaccacucggacaccagucucagauaugaugaaggauuacugaacacuuucagaaugauaaucuggaccacaagaaggaaaaauuguggcuggcaccugucuguccucaggguagacuuuuuauaggaaaaaccaaguucaaaagugcaaaggcaaacagugaagugguagagcauucucagcuaaggagacaaaguaucaucagcucaccuuuaagcugauagguccugagugcguaggaaguaggaaggguggggggggggguggacagguggagaacacgggaacauucucggcuaaggagacaaaguaucaucagcucaccuuuaaacugauagguccugagugcguaggaaggggagggggguggacagguggagaacacggaauugcagaacauugagauaaugguacaagccuuaacucucuggcuucuaaguaagauucuucagugucgguuaaaguaguaacaaugaguacaguuucaccugugaguagcagggaaccuggauacaaaauggcuacaguuaccuuaaaaggagcaagccucaaacacggucuauucccagguuucaccugacuugcucaacuauucuggaacuuauuuguuuucuauccuaacaauuuauguuucaugaaaaaguuauauacaaaacgcuuuagcuugguuaguguuuucaguacacuuuauaaacauacugccagcauggugguacacuuuuguaaguacucuaguacucgggagcagaggaaggaagauugggaguucaaggccagauagagguuuuagcaaggcccugccuuagagaguaugaugcuccagugcauuuaagaccuccaaagacucuguagaagcgcugacguacuucacuagugaugauccuuuccagaugagccaggcuacaagcagguuuuggguuuguuguuuguuuguuugacaggguuucucuguguagcccugacuguccuggaacucacccuguagaccaggcuggccuccaucccucugccucuguguccugagguaugugccaccacugcccagcuaauuuuuuuuacccuuaaauugucacuguguguguaacauuuaguggaaaucaugagcuaugugacguggaagcugagcacauuuccugcgacuagaguggucgggauuggcugcaaucuggauucacagaggcugcaguacauuaucaccaguguuuugaaggugcagacuucaggcaaagaaguguggguuguuggcgaacagggagaaaacaaagguaagugcaucauuauuaauuaugcuacuaacucuaaaguugugacauucagaugugugcugggacuuuacacuuagagcucugugugugugugcgugagcacgagagagagagagagagagagagagagagagagagagagagagagagagagagagagagaaagagagagaaugaaugaaugaauauguugcuagggauuaaacccagggcaucaaguguguuauuaccaacuaaaaacuccagcuccugucauacucauacauuugggguuuggggaggguucuuuuuaguuuuuuaaguuuaaaacaagaccccuuaguccugcugggcagugucaugccgggcagugguggcgcacaccuuuaaucccagcauuugggaggcagaggcagguggaucucuugaguucgagaccagccuggucuacagagugaguuccaggacagcuagggaugcacagagaagccuugucucaaaaaaccaaaaccuaaaaacaaaaaaaaaccaaaaaacaaaaaacccuuagucggguuuucaauuuuuaguugaauuuuggaguuuauauuuaaaagucuuacuuuuccauuuaaacauacaugaagcauugagaacuccccacuguucucucacacccaacucuguuugcuuuuccuaagcucagucccacuuccuaaacacccgccuccuguuuguuuguuuuuucugaaagaauuuucagucuguggacuucuaacaagcugcuugcuaucccuuaucacaaaaccaucacuucagcucccuguauggaaacaaaaacaaaacccuuuucuuaccccagaagaaagccuucuguauuugagaugccuuccuucacuccuuccguguuucacguaagccaggcugguaggugauauguggcagcuugcucucaucagucggcuggcauucauguaacaagaauaugcgucuacacugcauucguugccauugagaugcccauguaccgugacaggugcagaacacagucugcuguguuuuagagcaguuguucucagucugugggucgugacccuuuuggggaucaaaaaguagauagccugcauaucagguacuuacauuacaauucagaacaguagcaaacuuacuguuaggaaguagcaacaaaauaauuuuaugguugcaacaacaugaggaacuguauucaaggaccgcagcauuaggaagguugagaaccaguauuuuagagagaagaaaauaucaaauauaggauacuauuugguuaacuauuauuuugguugcuuacacauuuacauaugcauucaagguggguugaaaucaauaggaaaaagaugauacuguugcuauaguaccccaagugaauuagacgcuggaagaaggaaauaguggugagaacaucccaggaaugggaaacagaaccaggcagaggcauguuguuugcucccaagaggcagggaagccacugggacuagaccagguacuuuugacuugaguucucagcagggaagcaaaaacagaaggaucuaggagaaugcaaaacugggauuacuuaaguccguuguuguaauauuugccauauauguguguauacaccuaauggagcaagcccucaugagugugcgcagucaggagcaccuugagcaccacuggacuugccgggucauccuccugcuuacugucuaggaaagcucagauggcuuuuugcuuugucuuguccugugcuaggauccaacccagggauccuugugcuugcuaggcaaacacuaaccacagagcuccaccucuggcccuaaccuuugugcucucuacuugcuuuacagcaagauacacacacacacacacacacacacacacacacacacacacacacacacacacacacacacacacacacuugcgcucgcgaggcuggguuucauugccuggcccuaaaggcagaaauggaucagagacucccucugcuggcuacauguuagauaccaacuaguaaauuuuugcauaagugacaauauaauaauaaugugguaaaauugauucuuaauaauuaucauccuuaugaaguacuuuucagacagguaucucacuuaaauuuuacaaguacccugugaaaaaagaguuuucuuuguuaaauuuauuuauuuucauuuuaugugcauuggcgguuucccuacaugcauaucuguauaaggauguuggaucuucuggaacuggaguuacagacagcugugagcuucugugugggugcugggaauugaacccagguccuccggaagagcagucagugcucuuaaccacuaagccauucuccagccucauguuucuuuucuguuuguuuuauuuuguuucugcuuugggcuuuugagacaggguuuuucuauguagcccuggcuguucugaaacucacuguauaaaccaggcugaccucaaacucaaagauccaccugccucugccuccuaggugcugggaucagagcacccucugcugagcccuggucuucuaaauguauagaggaagcacagagcaggaugagugaggugcugaggguggucuguccaaugagagcagcucuaaugcuaagaucugcuccuucuuacagucaguggcacagaguaaccaauccauuguccuucuaagauuuacaagacggugauaaauaugaauuaguaaaagggaacaugaaacaguuugaaguaaagugacguuaggucuugaaaacaguuguaagaguagaagugucucgguaaaauccuccucuucaaguucuacagagacaaaugguagucacagccuagggaggagucccagggccaauaagaccuuuaggcucuauuuccugcuuccuuccucagcuucagcugccuggugcugugccaggcguccgucccccacuggccagauggucgcuugcagugguucaugagcucucauugcaucugcugcuuccuuuucacgaccaugcauucacuuagcuaguuccugcuuaccuccagcaagcacucagcacuagguaaguucaugcauguguuguaagcauuagcacacggucguacccccaugucugugcuaucaucaucgccaugcuaguuacauuacaugccuguguuucacaacacaaucaucuccugcagcccggaaugcuuuguccaucuuggauugaacaaaugauccucacaccaccuugguguaaccaaaaaaucaaucacuuauucucuaucaaguuggauuauuggcaggacauuugcuuaagagcuacucuuuuuuuauuauuauuauauauuuucuuuauuuacauuucaaauguuauccccuuuccuaguuuccccucagaaaauccccaucccuuucccccucccccugcuccccaacccaccuggcauuccccuauacuggggcauagagccuucacaggaccaagggccucuccucccauugaugacugacuaggccauccucugcucucuauauagcuagagccacaaguuccaccauguguuuucuuugauuggugguauaguuccaaggagcucuggggguacuaguuaguucauauugauguuccuucuauggggcuucaguccccuucagaagagcuacaauuuuuuaagugugcuauuaaaaucauauauaaagcaaagauuacugcaguaguauuucagcagucugaggguuggaucucagaguguguuaucucuuuuggcacagauuuguuuuauauaauagcaaaaaucaauucuaaaagcaguauuuuuauuuuauuaauuuuuuaucagacaggaucucauauacccaggauaucauuaaacuugcuauauggaugaaaaugaccuuugaacuucugacccucguucccucccccucccccagugcugggauugccggugugugucgccacacucccuuauaauuaugcagugcugagggcugaauccagggcuuauacaugcuaagccagcucugcagacuaagcuauaauccuuguucccaaugggcauuuuuucaugaaaauucuugggccuguuuugaggauuggaacaggagguaaagaugacugagcacacuguugugaaugucuucagcaaggauggcucuacaucaggaacgcaaagugcugggcaguaaacagaagguuaaguaguuaaggcaucccggucuucuuuacucauuacagguagaugugaacgcucuaaauguuuucucuuuuacguaaugacucaaggcuucucuagaggaaagaucugcagggccagaggccugcugcaggggugagagcacuuguugcucuuguagagggcucagguuugcuucucagcaguaugugcugccucacaacugccuggaacuccagguucaggggcuccggugcucuucucucgccucuuugggcacugugugcugcauauacauagauguaggcaacacacucauaaaauaaguaaaucuaaaaaaugaacugaagagauggcucagaggauaagagcacugaccacucuuccagagguccugaguucaauucccagcaacuaaaugauggcucacaaccaucuguaaugggauccaaugcccucuucuggugugcaugaagacagcuacgguguauucaucuaaauaaaagaauaauuaauucuuuaaaaaaaaaacuaaaaaaauuaaguacaaaaaagaaucugagauuccuccuuauccaucuguccuaucuuaacugugcacauaaugacagcagugcucauaauuuucugauuauuuuaucuccuuuaugaaucuuuuuuaugucuaccuugcuauuuuuauucauccuuucaaggucuauaauacuguauuucaguuagcaaaugucccaguuuuuaauuauuguuaauauauuaauaguauaacagaaaccuuaaaugaguaauuuuuuaaagauguauuuauuauaucuauauggguacacuguagugucuucagacacaccagaagaaggcaucagaucccauuacagauguuugugagccaccaugugguugcugggaauugaauggaggacgucuggaagagcagucagugcucuuaaccgcugaaccaucuuuccagccccaguaauucuuauauaaccaaaaaaaaaaaaaaaaaaaaaaaagggcuggugagauggcucaguggguaagagcacccgacugcucuuccgaagguccagaguucaaaucccagcaaccacaugguggcucacaaccaucuguaacgagaucugacacccucuucuggugugucugaagacagcuacaguguacuuacauguaauaaauaaauaaauuuaaaaaaaaaaaaaaaaaaaaaaaaaaaaaaaaaaaagaagccgggcagugguggcaugaccaugggacagcuucaagcuuuuuuauaaugcugggauugaaccuagggcuuugcucauucugggcagaugcuccaccaucacacucaacacucugcugaguacaugucuccaccuccaaaacaaaccacacaaacccacaacccuuucauacaagugaaaaagagcacaaacccagggauuguuauaugaaaaauauaaaugcauagaaaaggcuaaaccauuuucuauuacuuauuuuugcugggauuuuuuuguuuguuuguuuguuuguuuuugagucagggucucacuguauaucacuggcuggccuggaacuauuuuuauagaccaggcuggccuuggacucccgagauccuccugucucugcugccugaguacugggaugaaaggugugcacuaccaugccacgcccaagaaaauuuuaaaguguucuacuuacaaggguuauauaagaauucuuucuuuuuuucgguuuucgagacaggguuucucuguguagccuuggcuguccuggaacuuacuuuguagaccaggcuggccucgaacucagaaauccaccugucucugccucccgagugcugggauuaaaggcgugcaccaccacucccgcuuaagauauuguucuuauguauuuuugcuuugccuacccccaaaacuaacuuauauaaaaaucucuauacagaugaauacuggaaugguuucaaguguugcaauguuaagucacuauuaaaaagggacacaaauauccagugugugggugcuucugaugcagcacugccuuagugaaguuugugcauggcauacgcagaaggaagacuuuaggucccaucauacuuuaaaaacugcagcugguucgugcugagucagauuuuuugauuucuuauaaacaccauggcuagaggauguggguaaucuagaagguguugcuuuucuugcagcuguagaaauuccaucccaaaauagguuacugaguuauucuucaaauuagccagugugcuugcuugccagcagaauagaugucaagugcucauaccaucugaaagccuguugucugcagcccccugaggaaauagcucuuccuacaugaacaguaaggcuaccuuuguauagaccuguugcugaugagugagaacagguaaggagccacaaguagguuuuagggaucgcaguuguaggagauguauguuuaaaagcuuucuuguccccagaaaguacagugucaucagugggaaaguaacuguucuugggagggcuaaaaacuauaaaaagaucaggucccuugaccucaaaaggccaguuguugcaggccuggaacuuguuauauagauuacgcuggccucgaacucaaggagacuugccuuccugccuuugcccccugaugguuaugauuaaaaagcuuaagccaccacucucagccauuugucacaugcuagucuuaagaaaaauaucugacaacauguaacaaugucuuuguuuaauucuagugugcucauggaguggccgagauggaguacugagucccagcucucaggcacagcuauccagcagguaacagugcagaguugaguguauccagcuaagacacaugugcuuccuggcugacagagcagcuguuuacacagcagcaucuugccgggcuucuguaaacaggaccaacuaacaggaagugcagggagcagugcccggcaguccuggacuuccaggagagcuugcaagcucaccuagacaugugaaaagaagaacgguggcuaauuugaguccgugguuugcuuccuuuacaucuaacaucaaguuaguguaaagaggacuucucuuaacuaccuagaaaugaaucuagacuaagcucaccaaacacauuuggagaucagucuaagaggaaaguuuucugugucucgucaaagggccaugcagugcaugggcacugaacguagaggccucuaagguuugccgugcacuugggagucacacucagacuauuuucagaccguuugcucuuucaccaucacagauagcgcccuccucaagucuggcacaauaguaaaguggcgauguuuaaaucuucagcuugugggucucaguacacgugucagguggaaaggagaaggugugagggauugucaggguaaacacugcacuccagguucuccagcuuugcugucguuucugcuguugugguguugcuguuuugaugaugcuagagauuaagcucaggaugugcuaacuaagauguguuuuaccggccgggugugguggcacacggggaggcagaggcaggcggaucucugaguucgaggccagccuggucuacagagugaguuccaggacagccaggacuacacagagaaacccugucucaauaaaccaccaaaaaaaaaaaaaaaaaaauguguuuuaccacugaauuauacucccuauaauuuucaaauggaauaaauuuaaacaguuuuaauuuacauacuuuuuaaaaagauuuauuuauuuauucauucauucauucauuuaagguauauguauacacuguagcugucuucagacacaccagaagaggguauaggaucccauuacagaugguugugagccaccaugugguugcugggauuugaacucaggaccuucggaagagcagucagugcucuuaaccgcugagucuucucuccagacccuaccuuuaaaaaaaauuaaaaguaugccuacuugaauuucaaauaccacagcuauuuauagagaguaaaaagcugagcuaaucccaucuucuagaagcagcauccacauccccacaugcagauaugcuguucaucuguaacagaucacacuaucuguuccauccugcccuuugauuaaccauaaaaucuaagagcuuucuguguuguacauguacaucugccuuucuuuuuuuuuuuuuuuuuaaagauuuauuuauuuauuuauuauauguaaguacauuguagcugucuucagacacuccagaagagggggucagaucuuguuacggaugguugugagccaccaugugguugcugggauuugaacucuggaccuucggaagagcagucgggugcucuaacccacugagccaucucaccagcccccugccuuucuuuuugaggacuuacuuuuauuuaauauguaugaggguuuccuccuauguauguauguguguauguauguguguauguauguauauauaugacgugugucuugcacauguggaggcuagacaagaauguuagaucccuuggaacuugaguuaugggugguuguaagcugcuacgucguugcugggaaccaaaccugcgacuucugugccccugacugcugagccaucucuccucguagacacuauuguaaaauacauucuguaucaagcucaggaaaggucacuguguuuuuauuccuguauuuuagacucugaucauauaaaggcaggacugcuguguugagaggucaaacuuacuccaucuugggacuggccuccaucguauaaaaaaauuuuaaaaagccugagaacuugacuuacagcacaucccaugcugcaccgguguaccaggaaggacccugcagcuuguccuuacuugugcuuacucccuagcaacuucuuagcaacagcuaaucaaagauuaaucugauuguuucagauauacuuucagaccauagucuugcuucagagcacccaccugcuggcuuauagucauucuauuagaugcuugccagacuggacacccccucccucagccccucacuugcugcuauuuccuguuaaaacuuuucaugcugaggguccagggcugauccauccucccuucccuuccugcccugcugugucaggcuuggguuggaggagagcccaagcccaagccuuuaauaaagggacaaauccuaauacuauuacauugaagauggcuccuugguguucuuuaagggcucacgaacacuuccuggcacaacagugucagcaccagcaacuuuggugcaacaugugggaguuuagucuuuuagcacacccauggcaccacccaaaggaagcaaagcagaggaaccuauuaaagccauagccauaaguauuacguaaucagaccacauucccucacacugcgcucuuuccaaccgcaacaugcucuaaaacucaggagcugaagauguaaaacccgacucucugcuauaccacuucagacuggaggaaagugguguuggugauggugaaguaauaaauggccugaacacagcuccuucuucucugugaucuguaaguaaguguauguguguguacgagugggugcuaaaagacagugucagcugcccuggagcuagaguuaguggcagcugugagccucuugacaugggugcugggaacugaacucagccuucuagaaaagcagcacccacuuuuaacuucugagccauggcuucagucccaaccuuauucuuacaagugcuauguaguuuuucuuaaagacugcaaacgugcucauguauacguuugcaaacuugagcuugcugaccacgugugagaaaggguuuucuagaugagggcugcugguuuucccugacacuacuuuauccucugagcagcaacugcaggcuuguguccucauacagucuccagaacuggcugucggucccuuuuauccuuguuaguguugaugcccccgacugauauuuauuauggcuuuucguuccguugcuuuuguuguaagacaguccuggcuagccuggaacucacagagguucauuccccuuugccuuccaagagcugggauuaaaggcaugaugagccaccauacccagcugauacuguuuaauuaagacuuaguuaaauauucaaaauggugagcaucuuuuuaugcugugaggguauuuauguuuucuuugugaacuguggaucucauauuuuaggaaaagcuuaaauaauauauuaucuguaagccuuuuaaauuuuucugaucucugucugucucuuucucugucucuuuuucucucucucucauuaucuagagccauggaacuguugaagguaaaaggucagagaucuuggucuguuggacugucaguggcugaccugguggauacuauuauaaacaauaaaaggaaagugcauucuguaucaaccuuagcaaagguaacugguucucauucaugcauuuuagacuuugacaucuuugauauuaaucauauguaggcagcaggacuggggugucaacaccagcagcuuugguggagaaguagaauuuaagugcugaguugcuucgggaaaucuugauaaucagcuuguccugucacuuccacauaaccuggaggauuucucaaggcuucucauauaaucuauauccuggauggcaucuacuccaagccagcaagucacgccagcaguucuccaccuuuuaccagagccuaacaccccccaaaaaaacacagcuaaaaugagguuggauuuucuugaacuccaggaaggaaauacaacauggaaagaaaauguaaaagaauguauuguguguggcuguccccagaauccaugcagucuuuccacaaggacucuacuguccaccucuggauuagccuucagacugcugaccuuacuacagaaaggcaguuuaccucuaugcaaagaggguaucuuugaccaggcuccucccaucucagauguuuccugaagcuauaacuugaguuuagaaaaaucaguaaacaaaucaaauuuaacuuguaucacuuuguacuagaacuaaaaaaaaacaagaaagaauucuuuuaucuuuaauuuuuuguuuuuuauuauuuuuaauuguguauauggcagugguugcuuguaugagugcaggugcccaugaacucuaaagacugugggauccccaaagcuagaguuauaggcggcugugaacugccucacuugggauccccugaagcuggaguuaugggcggccugacaugggucugggaaagacuguccugaaagagcagcacacucugaacugcucagccaucucuccagcccuauaaguuuaauuuuuuuuguaguaauucagcuuuauuauaaucccaucuuuuucauuucagggauauuaugguuuagauaaugaaguauuuuuaaguuugccaugcauccugggaaccggugggguauccgaagucaucaaaaccaaagcaggagaagacacagugacugggacacuccaggccagugcauccuccauccaugcucuccagcagcagcuggaacugugauuccccagcgcagucacccggagaugggagcuuauuuaauuuugccaacacacaucguuuugagaauuuccacaauuuacucuuuauucuuaaaaacagccuuucuaguagauggcuucuuaauuagcuuuauaauuugaauccuugagaauggaaaaggauuaauuucuuguagguuuuugacauaccuguacuguuguuuaaaccugcaaaagggauaaauauucauuugcauuguauuucauuuuaaauuacauguuguaaacuuaaggcacaucuggcacuuuagagauguucuguaaagauuccuguuggacauuucuucugaguauggugagcugaaggcaggaugggcucaaaaucugugcuagguguccauucagagaaucuuggcuucauggauuaauacugcuuuugcaagaagcaggucauaguaauggagaaguguuuuauuuuccuucuucaaauucacuagcuaucaaacacuagaaaguauuuuaguaugcauuuuaaauugguuaaauggaauuuuuaaauauaugaaaaguaaugugguuuaauuuccacugagauuucuuuucugaaaauuucuauaaccucuuccugggcuaaaagaucuccagucugucuuaaaacuauauuaguagaaaaagagaugugucuuccuguggccguagguaaugaauaacagccacacaguguauuuugagaccaaaauaugaggcuuuccuaaaaaccauuggucuuacaggagagaggccggccggccugcugcuucuccccagaagaaacccuucugacugugccuuggugauuggucaguagcaguauuuccaugugggagacagcaugguuggugacuguugugacgugcagauggcagcaacagcuaacacagcucuuguguagcgagcacuuuguuuguacaaugcccacacuaacuggcugagguagggacuauuuaccuucauuacggaggugaaaaugaacguucgugucuaagaucaagugggcucuaaggagucucacuugccuguauaaucuuuuuuuuaauagguagcaacagggguuguggggaggcuucugugccuaaacgccaagucaucgcaagacacuaaaguugaggguugggauacuaugaaagaauugcuucuauucucauaugaugggagcuucuuucuuuuuuucuuuuuugagacagggucuauuuguagucuugaccaucucggagcuugcuauuguagacaggcuggccuugaacucauagagaacugccugcuucugucucucaaugggauuaaaaguguaggccaucauaucugccuuuuuuuuuuuuuaacaaagauugcugagccucuuccccagagauuccacgaacagcagacaguguuuauguauuuaauccuucagcuaguauuuauuagaaacuucucuaacaaagcacuauuaguaaacaggcccagauuaggacaggcccugccaaugccuacagacuagcagggaauacaguagccaaaugucauguaaguucaagagugcuaagugcugugaaguccagugacaaggaacccagucuagucagagagagaggaacuccgugguuuaugagacagaaagggaacagucucauucucagggugacucguguaauuauaaugacaagugaccuucaguaucccaaacuggagaaaguagaaaaguaauguggugacaaagacucccaccacguuuaacuggaugaaacccuggacauccaggcuagggguauagcucacuguuaagaugcuugccuggcgugcagagcccugggugugguuccagaacacagaacugggguccuugagacgauaagcaugagcucuuuguagauaaucuugguguugcuuuuacuggccuuuuguaugaagugggaaaguaaaguugaaacagucauuucuuagguguuuuucuaguauuuucuaauaggugauaacuaauuaggaacucaguaauuccugauuagagcuucuuugucuucauuugguuuugagacuaaccucaaagucaacucuuagcaaucaucugccuaaucuccugggcauuggcggccaugcccagcaacaagucuuacauuguuuguggggaucuaauccagggucugaugcauguuaggcagguuccuccccaacccugugucuauaaucuaauccuaaaacucucuugaacaauaaaccaacugcagagugcuguaacaaugaacuaccgagaacuauguuauagaaagaaacgucagauauuuauuaaauacucaucauuagccaaggauuuuguuaguuugaccucauccccggguugcaguacagaagccucacacuucuuugaguuaaguagcaauuguacguuccuccucagucagguggugccaucacagccaccuaacuuugauuuaauuauuaacaguuacucuauguggugacuuucauuuuuuuucuaaucauuuauugguuuggaugauguugacuugauuaaccuaaauacuguauuagucuccaaaccaauuggaaauguacaguguuugcauauuucucaugugaagcacaaggacaggaucagaacuccuguucauucacuaaggugaugaccuaccauaugagaagguucaacucuauaucaaguuauaaauccugacuuuuuugucuuguuauauucugaaaugcaggcuuugugaaaacugaaaacuuuguaaaagauuuauuucuucauuuaaaaaaguacugucaauaaaacauugcuuuuccuccuugcuaugugaaaggaaacuuucauuuuucccaaagcacgcggaaucucaagauuuuuuuuuuaauuuuuuuuauuagguauuuuccucguuuacauuuucaaugcuaucccaaaggucccccauauccacccccccaauccccuacccacccauucccccuuuuuggcccugccguuccccuguacuggggcaucuaagauuuuuauugggucuuggauuaaaaugcuuuuugauacuauaaaauauauuuuuuauuuuccaauuuacauuguuuccuuaaauaucaaaaauaaugaaugaaauaaacuuuuauuuuaaaaggac

SEQ ID NO: 3825 - RNA, 18025 nt, Mus musculus
aguugcgcaaauacuugcgagcgcugcggaggcgcugagcgugugugugugaguguguguguguauguguguauacauacacacacauacuucguauucggcggcagcgcgggggcgguacacggcauuagaaggcgccggaagugucggugucgaggggcggcgagagaagggccaccaaggcaagccagucaguagcgcuuaggcucagcgagaggcaagacucgcauccaccgcgucccgaguccccggcccagccgggcuuuucucuucggccagacauggacuucagggaaauccucuugaucgcuuccaaaggacaaggugucaaccacguaccggugaguccccgggguugcuguaggaaacccgggcgucaaguucgugugugguggguggaacuucucggggagcgucugucggccucgggaaagccugaacuacgcacgcccucuucuggaguuuuagcggagguguggguacacgggagcuggggauggaaaagggagcgcuuucuuggggucgcuuucgccagcuccugugcccugaaaaguaggcuuugcggcuuucgguguuuuuaagaguugcgcaaagucgggggggauaagccgcgccugacugaauacuguguagcauuaguagcgccuggcgucgaauaaacuucagccccuaaauugaggaccaguauagucaggaaacucggggacuuuuaagaacuuuaaggacuuguccugauagccuuugggucuuuuagcgggucgaauacggauuuccaggugaacguuuugugauuucuugaaagcguucuccgguucguggccccacccacugaaccaaagaugguaucaccugccaaggagguaucuucuguuggaaagaguucagggcuuugcaggaaauccauagccaacugugaggugaucaugugggcugcgggugugcugguagaccuuuuauuugccguaugucccuuggaucuaucgguucccugugcgaacggauugggcaaagccuuuuucagcuuucauuuccuagugggcuuccagauuuuuagguuccguuugcucaguaaaugugugaguuugauaguauuuucagagguaaauacugaaguggucccacaucugcuuucugggguuauagcuguuuugcauaaacuacucauuucuggaucaccagaagguacccacagaacagcuguaaaccgauauaucgcaaugugauacccgagauuuaaucugugaaguguccaacuuaaaagaaccuucuagagucaaucaguuggaauuugcgaucucacuuggauucugcauuuccuaauuuuguauguugcaguauuuuuuccuaucuugucacuuccugucaaauccagccuauuuuuuaacccuugaguauaucuaccuaaauuaaugaguaaacguaguuauauuuguaugcaugcacacacacacacacacacacacacauauaugucccacccugauaauaaucacucaauaagauucugcuaagccacaucucaucagccuugcagguuuugcugugggcacaagccuuuaugcauuuguacuuuaugcauuuguagauuaucuagucacauuacuguuagauaucauaaucauguuugcauaauuuggucuguauuuuaucuuaaauuuucuugaaucucgagaaaaguuuaaaagaaaaacaaaaaaacaaaaacagauacuagcuuuagugcccaagaauugucuuguggaagaaucagaacccagauuuagaaagccaauaucugguuggguguaauggcucauaccuuuaauaccagcacucacagaggcaggaggaucuugugaguccaaagccagcuuggucuacaccaggacagucagggcuaaggagagagacccugucucaaaaaacuaaaaaaaaagaagggagagagagagagaaugagaaugaaugaauuagagagagagaaugagaaugaaugaauuagagagagaaugagaaugaaugaauuagagagagagagaaugagaaugaaugaauuacuaaaagccaaagcuucugggaaaagggcagacagaucauccuagagcagaaaaauuuuaaaugcgugauacuuagagaguacguguauugguugcuuugugauuguacucugugaagugauuuacauuuauaaaccauccuucccuccccuaaaagagagaguaaacuuagagguuuggcucagugugcauccuuaacuucuuuaucuuuuacacggaaugaaagccauaaaaaagaaaucaauuggaauaaaacaagguaaauaguguuaaauuuaauccaugaucuugcuuaaucugacccaucuauccagcuuaauuuuaucagcucaggauaauuugaacgcugauuaaacacagaguauuaacaaauucccaugucccgugcuuuauauuuaauauacaucaacacagguuguauuacauguguguugcuuucauguugcuguuuccucggugcucugcuguuuauuuccgggcccuaucuccagaucccucacaugcuucugaaaaguagcaaggccccaaggccccucacuuucaugaugugggugggugggugagagagagucacagaaagauccacugaguuuagaugcaugagcauuggggaggcauggccaguuuaccagagacugcaucaccaaagaaaucacguccccucccugagcauccauuacccacuagcucagccaccuuuauucccuaccucaaagaguuccuuuccuauugcugugauaagacgcaaugaccaaggcagcuuauagaagaguuuacugggggcuuugaggguuagauuucaugaccaguaugacaccaggccggcagggauggcccuggcauguaaccaagcgcucacaucucaauccacaagcagagagcuaaugggaacaucaucuuaggaaguccuaaagcccaacaccagugauccaccuccuccaagguaccuucaaaucuugguuccaacuagggaccaacuaugcaaacaugugagccuauggaggcagugucauucaaacuaucacaggucucaugagccccucucccacacaaaguguugagaaugucaauuccaucuuauaugggucuuguacaacuuacagauuccuuuuguuccucuuuaaaacuuuaaauuuauuuuauguguauggguguuuugcuuguaugucugcaccacgugcaugcagugucccagaggccagaagaggcaucagaucccuuccgacuggaaucacagaagguugcaagccucucugugagggcugggaaccgaaucuuagucuuuugcgagagaacuaaguguucuuagccacugagcaccuuggagcgccccugcauugacuuucacccaaguugugaaggcaaauaugcaguuuuccacuuguucuguccuauuguuggagaggucagaguuuggguuggguguuuccagguucuuggccucuuauccaagaguugaaaaggguguguguguguguguguguguguguguguguguguguguguacauuuacuaaagaagcaugauauuugcagcaaagcaguuuaaaggcaauaauacuuaacagcauaagaguaaauauaacucaggccccaggcuacagccuggagaugagcagccugguuuacuauggguacaguucuuuauuuugaucgauggguagauuauauaaucauuuuucuacugugcauguuccucuacaucugauuuuaacccugugcacacccaguuaugcagaagcauacgaugguaaauagaaauucuccuuaaaagguuacaagacgaugcacuuuuuccucacugugcaugcaucuaaaaccauuucaagccuaauuggcccuuagaauugucagacuuggaaauuggaaauacgcuugaguagaaauuguaacuuugauuguuagguugggaaaguauaccauuguuucagagaugggagaguguguaacucauacaaaugggggauugagugguuuugagguugcuaggugcauuguuuagaguggcuauaugugugugcauuguaugugcaaguaaaggaacuaggcuaccaaggacaguuuuccaaggguuugugaauaacucaaaacuaaauaguggucccacuaaauugucuccuauacuuuuuccugacuucauaucagucccuaagacauuuuaauuucuggagcauguuggauucuggauuuuuagacuaaggaugcucauuuuguacuaacauuucccauauugcucuuguuuuuaaauggaacaaucaucuuaauguuuuaguuaaaacaaagguaggauugcaucauguguggaaguauuaggcagagacucuuuuucucaguggaauucugaauacaaaaauaacagcugaucaggaugauguaaccagucauugccaguggccuuucuuuuaaagacaggaucuuguguaaggcuggccucaaacucagagagagcagccagccucugccucccaagugcuaggauuguaaagaacuuguaaagaacgguauggccuaauaacaaagguuuuugcugcaguagcgacuguucucuggaaauuggaucuuggccuucuccuaagggcuaaguaagugcugaugaagacaugccugcuaucugaggcagcugcucucuaguccagagcaguacuugccaaccagugcuuuauggacaaggucuuuaggaacugcugcugcuucuuucuccacagggauucuguugucucucuucccccauaacaccuuagagaaccucuaaauaauggugauagcaauuaacauucauugugcugagccugugccagauccuguuguaaggacuucauguguuaauuaauuuagucacaguaaugagcauaugaaugagauuuuauuuuaggcugaggccuagggaggugaagaaauugcccaaggcugcauagugaguuauaggacugguuauaaugaaacagggggucugacggagcagacugcuucacagcuccugcucuuaacugcggccucuguugagugagaggguguauugaagugagaggauucaccaucuucauaggccucggcccuuccuuaauacagcuuuagccaguaucacuguuggauucuuaugacagucucaauauaaagauggagaagaaauaaaaaaaccaaaccaauagcauauagaaacugguggacaacucugaccaaccaccugaacgggccuaccugaucaugucugagcucugcggcucagcaggauugggccugguugggaugcauggaugggaaaccgguagacagaggauauucgaagacuguucuuaaaagugugggaguaguuacucucccaaggagggaaaggauaauacagggaagaucagcuguagaccugucucugguaaacaugcauggaauuuagggaauucuauuuaagauugaagucugagcugcagaaaaaguguuggaguuagaaaguuaaagugugcaaauauguuuguuuucagcuacaaagcuuauaccuaagcaccaggaaagcccaguuaccccuuuuaaagacaaagacguauucauuuaaagggugacuuuauuagauuuaaaugaaacacaaaggauugaaccucaacacgcuggcaaguucucuaucacugagcugugcccugacucuaaccaaguguuuuauaaauccuuuaaugcuuuguuuugguguuaacacauagccaccgugaacggaugcucugggaguuuucuucucacuguccuuucugacaucccgcugagcuggcuuaaugcagagagcuccugccugccuucguucccucgcuaaugccuugagaagguguugaaaacuugguguguugauuaaaguuaauguauuauuuggcuacucuaaucaauaguuaagugauauaaaaucaccagaagauaucuguuuucuacaacagccucacuucuccucaggagcaguuuggagguggagcaugcugguucugauuaagcauucuugcugagcaagguuuccagacugcaggcugcuucuuaagccgcucgaaacuggauaguuucaaugcaaggaggguuuuuaaauagcuucauguuuucugaacccaugggcuuuagaauuucaaaucuuggcaaacugugauaccauauuaaaugauagaagugcggugauuguggauaguucuucaggguccaggggugaugagacuggcuuugcagggugaagaaacuuguccagcagcuuuucaugaagccuagacaaugaagcagccuugggccuugaaucaggagucagaauugauggguacaucuugaugugcugcugcuauggccgugcauggccaucugaugcaggagacaugccaaaugacguauagagaauacaacgugcucugaccacagacuuuuuuuuuuuaaaacaucauacuguauggugaguugggagaaaucuuacaaaaucuucuaucaaaacauauuuuggucugcuuagagcccuuuuuagaaaggucuauggagcucaguguuaaaaauauauaaucauuaauauauauacauauauauacauauauauauauaaucauauacccaagagaaaucuaaacauacauccaccuaaaauaucacagcagcauuuuuuuaugaagccaaaaaauggaacuaguccagcuggccagcugggaacagauaauauguugugugucuaugcccugcaguaucuaucauucagcuguuuaaagacugagcuccugacagcaacaugagccugaaaaccuuacauucaucaagaggccaauugaaaaaaacuguugugucagucacuagucuccagagaaacacaaguaggaaugauuugaggcaauuauuugugggguuggcaaguccaaaauuuguauggaaggccaggcagccuggaguuaaugcuaucguuuugagguaguuucaucucugcugaccccagaacuguuccaaagucauugaacuaaguaggagaccauggacauuauggaaguuaauuuuaucacuaaaguucuuccaagcagcauaagauaagcaccugguuagguaguuugguucugcagccaacugagcacgcagaguugacuaucaaucacauuguaaguucucauuuccguuagcuguuuaaacaaaugcaucgugauagaauguucacuaacgcuugccagacccaucacucaagaauaagugauucuuuuugaggugguuacuauauucugaaacucugcauauaccaaaagauauuuaacuuguggaaugcugccuaugucuuaguaaacuugaaucaggugucacagucaugguaguauuucuagaucuaaagagaucuagaaauucucaauucaguuuacaaagagauagacuaauuauaggauccaauuguuuccuagccugguugacuagaaaauaauuggugcugucuugggauuucucugucagggaugagucagucgugaacacugccaucaugcgggauuuucagguuggacgaggccugccuucucagccagcugcuuuucuaguugacuaauuuacuuggaacuugagccuguuucaagauacauuguguuugucagcccuguaguaagcagauccuuuggcuuccuuccaaggaugucaugcacaggaugggagaugggggugaugggcugucugucaugcacaggaugggagaugggggugaugggcugucugucaugcacaggaugggagugugugugugugugggggggugaugggcugucugucaugcacaggaugggagagcauggaugugauaggcuggcugucuacauguguuuagagagcauugggguuuauaaacugcuggcauuuuccacaaagaugguuuuacauccagcacagacacagauuccguagauaaacagagcgucugucuuacauacacaaaggguuggaauauagcucaguaguagagugccuggcauuugugaggccuggguuucuucuuaaacugugauuuucuuuuuuuuuaaaaaaccuacuggcccauaaauuauguccaaaauggucccagaccugagacuuagcucuguuugucaugcuucuuuaauagguauuuaagagauugaagucuuucuuucaggguucaaaucauccuuauucguguuucagucacuuucuuuacgcaguuacuuaaaaaccaaaguccacacaaauagcaucugugcccgggcaggauucaugaccuugggaucucggagagcaguguaaaggagcuuguguagcaaauuaauaguuaaugaacuuauaugccgcaguugaagaguccagagagcugugcucuuuccuuagauuccuucccuuccucuuccuuccuuuccucgcuuuguuuucuguguuuucugcaguacuggcuggggauugaacuccuagcugauaaaugucagacaagcacucuuccucugagccucacaucccagccccuagacuauauauuuguaaaguguugcugcuuauagcuuuuauucugcuuuuguuuuuagaaaagguacaguuuggcgguggggccuccaaagaaagacccaaaagugaaagguguccagucggcagcugugcaagcuuuccuuaggcggaaagaagaggagcuuagacaaaaagguaugcgcuuguacugcaucucagccugucugccaccaaauccguguguguguguguguguguguguguguguguguguguguguguguaaacauccugacagcuuaguaguuuggggauguuguaugugugucuggguuaacuuuauagacaaauaugugcgugcauguuuguaaaugugcucauagguugguuauuuggguuguuuuuucuaaccccaucucaccuacccccaaggcuuuguggagcuggccacagugauauucaccugucaucccagguauucaacaggcugagacaagaucauuuauugagcucaggagcuucagaguagcugggacaacgcaucaaggccuuaucucuugaaggaagguggggagacaugaaaaggccugguguaucaaccauuuaacuagccauaauaugucuccaauucuuuaccuugguccuggcauuguuauagauauucauugauucacucuuaacagcuccagucagugcugguguccuauugacaugguauauuuaugagccauuuugugcauuuuaagcaaaagccaagucuuuuaucugcuuagucauaaagagaagcucauaucugacccacuuguguaguaauuacucaguuuuguuagaugacuuccucauuugacacagcucucuagaaaccauaacucagauugagcuuugacuguggaguggcagcacaugagcgcugcuaugcugacacuguugaggugaugugcucuuguuuuauuccuuucagccuuggaagagaaaaaaaggaaagaggaacuagugaaaaagcgaauugagcucaaacaugacaaaaaagcaagagccauggccaagaggacaaaggacaauuuucaugguuacgaugggauuccuguugaggaaaagacaaagaagaagcagcugguggagagccaccugaaccagggaacugaccaggaguaugauguggaggaggaagacuucauagacuacaaucaggcugagcuggaccaggacuaugaggaggagcaagagccacccaaggcugaaagcaaaccaaaggccccccuuaaaagugccccgucacccaugaacuucacugacuuacugaggcuagcugagaagaagcaguuugaaccaguggagaucaagguagugaagaaagcagaagaccggccccugacugcagaggaacugagggagcgagaguuucuugaacgaaagcauaggaaaaagaaaccugaacccgaugccaaacuaccuccacccguguugaaaaaggcgcccucucauaaagacaucauggguacaaagcccagcagaggugcuggggacaggcagcuugcuuccaaaggauugcccuuuccucaagcugagaagaaauucagacccagcacggccagugagaaacaagcagcuuugucuucacccaaaucccugccaggcgagaggaccaagguagggucuggcaguagcacccagcccucacuucgggagggucacaacaggccugucuucaauggggcuggaaagccccgccccagcaccuguucaccaagugucccaaagacuccugcuagcgggacucagaaaucugcuucugagcacaaagccaaaaaaccucuuccuucucauccgagccauuccaagccuggacccacgguucucucacacaacaaaucuaagaguccaggugucagacaaccaggcagcaacucuggcucugcuccugggcagccuaacccagggacagcucgacccacacuuaguucuggcccugugcccaggcgccagaacggcagcuccagcucaggaccugagcagucagccggugggaucagaaagcuggccagcaauucacaucucuccggacgaacacucaacggcacaaaugguccuggacgaccugcaagcagcucaaguggcccugggcgacccaucaguggaucugcugguucugggagaccugugggcaguucuggaggccccgggcagccuguaaacaauccacaugaccuucgacgaccaaugaacagucuuagcucuccugggcgggcagucaguggcccugggagauccauaagugguuccauuccagcuggacgaacugucaauucaggcccuggaagaccagugagcagccuaggcccuggacgagcaguuaguaacccaggccuccccacaaagcccagauguacuguugucucagaaacaauuucuucaaagaauauuauuagucggucaaguaauggacagauaaauggaaugaaaccucuccucucuggcuacagaucugcucaagguaaaguugacccuuaucccaaagaguauauuuaucacuaugccuuuggagaaaguaccuagcuuuauauaaucaggaacccuaugaccacuuucacaagcccuguaaugugcucauuguugauaguggaaaagaggcuuaucuaggacccgcuguucacaccccccaccucuuucucacaugcaguauugugaugugugagagggggugacuggacgcagcuggugguuuguaggauaauguucuacaugaagacuaagccagaugagaggaugauuaagaacuuagagccuuugcugcucugucauucagcagguguuuauugaacaccuccccuguagcagcugcuauuuuagacuguccugaguucuauuccuuuucaugguggugucacuuggcgcuuuaggaaucugccgucuuaaaguugagagucauugacagcugcauguuguaggcauugcaugccgcacgggcccuuguuaaagcacuuguuaggacccauggagaggacaaaaagaaaccuauggcagaauuccucacuuuauagucagacuagcagacuagaaaguugcucucagauacugaucucuuguugaguaccugucuuuugcaaaguuguucuucaguuuuugggauguuugcuucuuguuucguuucguuuguucauuugggguggggguggggggauaggguuuguuuuguuuuguuuuguuuuguuuuguuuuaagacagauagcccauagugaccuggaaucuacuguauagcuguagguggccuuuaauaucuaguccccaccucuaccuccugggugcuggauuaccaguguauaccaacauuacuguguuguccaggacuucagacuguuaacucaaacuuucuagcccagagagcugaaacugugggcgugugcuggucuuugaauuuuuaagugaaaagaaaauuucacuuucuucaaagaaaaauggagaacuacuucugguaugcuuauuugguaaaguuaaaaauaaaugauucugugccaguuuguaacuugacucaguuucagaaauuuuacugaucucuuaaaucccagaagucugcauaauuaagcuagaaaacaugacagggcaccgaggcacgcuaaagugccacagcagcucagucccuuggagacuggagccagcugguguacucugcuuucaggggugccaucuuagugucaauuucucugacuccuagugacaugguucccacaggaacuaauucuccauacaguguucuuacaagucguggcuuuuguucuuagguccucaaaggcuucccuucccuacuggcuacaaaaggccucgagaguaugaagaagaugaugaugaugaauaugacucggaaauggaugauuucaucgaagaugaaggagaaccucaggaagaaauauccaagcacauucgagaaaucuuuggcuaugaccgaaaaaaguaagcugaagauuuaccuaaacaaacccuuauuaucuguaggagagaaacuaacaguagaggcauuaaaugcuuagcuagaaaccuuuggguggugaugguucucgaaagauuuagucuuagagcacgugcugacuaguuuuugucagcuugucacagcuagagagaacuuaaaauugauaagaaaaugcccuuagugagauuggccuuuuggcaagucuguaguacauuuucuugauaguugauuugggagggcccccagcucugugggcagugucacuccaagguugguagaccugggugcuguaagcuggcuggcugagugagcucugaggagcaagccagcgagcagccucugcaucagcugcuacucccaguucuugcccugguuucucuggguaauggacuuuauauacaauaaaaucaaccuuuccuccuaggguugguuuuggucauagcaauagaaacuuuaagauagggcacacgauaguuucuaaugaauucauaguaguuaaugcuuuuguauguaagcugcuuucuuuaaaacaaagauggggagugaagcagguucacgggauagagauagauggcuguggugccagggguaaacugaagcuuuggaagagcuaagugagggucgauguguguaagacagaugaggccuagcacacuuccuaugacaaaguguuuacacgccuuuagaaagcagcccauccgaaagcauccgagauacacagcccaguuggaggaggaagcaguugcucuggagcuagaagcagccaguggagaagcagcacugucugcuagccuugccguuagcuucucugccucaguuuacuguugggaaggucuugucucccgguagucaugagggcuaaugagauuuagauaaguuuucauaaaacgguuucaggauuuaaauuauuagauaaauguagcugguugaggaccucuugucgaguuuggugcuuuugcuaaugcuggguucugaagacuugccuuguagacaccuaaggcuccuuuacuacaaugcccauuucuacccacucugccguucucacucccaaacaaggcaagaggaagccuaacacugaguaguuuaguuguaauuguuagcagguugguuuuguuguaaugagaggcuguagcucuuuaagaaaauugaaucuugcugggcagugguggcacacaccuuucucccagcacuugggaggcagaagcaagaggaucucuugaguucaaugcuagucuggucuacagagaguuuugcaggacagcuagggcuauuacacagagaaacccugucucaaaaaaaaaaaaaagaaaagaaagaaaauugaauguguucauuuuuuaacuuugcuuucuugccagauauaaagaugaaagugacuaugccuuacguuacauggagagcaguuggaaggagcagcagaaggaggaagccaagaggugagcaggagguggcauguuguguagaaacaucucaaagccugcagcugccugggccccaguucuccggacggugcugcugcuggcuggcuauaaaggccgcagacagacucccugccuuucuaagguuuucccauuuguaaaacuagaauauacugcuuuucucacugaagcuugugaggguuaggacaguauguagccacgugcuugcagcgucuccugugugauguguaguaagguuagaagccucccacgucugccaugggcuguuugcuuuucugugcccaucagacuugucuugguguuggaacuuguaauuuugcuaccuuggggaccucaugggagaugagauuagauucccuccaccuccuuauuugacugcccaguugugaguucccaagaguuucuuagguaaggguaacaaaugauuacuuugcuuauaguguuaauaauucccuauuauagaggaauaauuuaccucagucccaucaagauuauggacuauuauuaaugaaugcuuccuggguuuuuauacuuaguguguauguggggggagggucacuucuaccuuuauguggauaucaaggaucaaacucaaaucaugcuuauuuuaaauguuuuugaaaaggauggaaagauugcuccuggguuaaggagaacugcucuccuagagacccggaguuuaguuuccaacacccauaucugguugcccagaaccaccuuuuaccccaccucagcccauggaaucucuucuucucaccuaaauagacaccugcacucauaugcacauacauagacuuuuuuuuuuuaagggggguuguuuauuuagccuuggcuguccuggaacucacucuguagaccaggcuagccuugaacucacaaaaaucugccucccaagugcugggauuaaaggcauucaccaccuuaccuggccucacagucuuauuuuacuuuuuugucauucuuguugugaaaucuuuauucuacauuuuucucucugugagccugucuuaaauuguguauaugaguguguguguguguguguauuaugucccugucacauaggcagacucaucagccaguccacaugaaaguucaguugagaugccaaucuuacuuuuuuuuaaaguuguaauuucauguauguuaacaauauccuuuaaacaaucucuccauaguuuaagacuugguaugcaagaggacuuagaggaaaugaggcgugaagaggaggaacugaaacgucgaaaagccaagaagcugaagcgacacuagcugcugcuacuguagauucuggaagggacacugcaaggaucaccugccuucagacugagcaagccucuucccggauuagauucacacuugggcccgcaagaggaaggaauacauacugucguuugcaggcuaucauuugagugugcaguguuuuuaaauagcccaggguggaaccuauaauggagaugauacgaugcuggccaugugcucugugaaguuagccauucacgggugccggccuugauccugaugagcuaugcacgcuaaugugggaccacucaccaggcagcugaucauuguucuuuugcuacuucaaaaggagaaaaagauugaugugugaguaggguaccacccagaucgcagucugacuuccuuaggaagggccuggcccuucugugaaugcugccagcaauaaagugaccuguccuagucuauguuugaauugaaaacccaggaaagaguaggcuuuauagauauuauauuagucucauccuugugacugacacacaaaauagaaugaauuauauuguauuuagcuuauuuguggguuggaugcuaagcauucuucauugaucuuagguaauaaaacuuuuaaguuaaaauacaaauuuugccagaagaagaauguucuuuuccaguuuuccuuccaagcuuucuguuacguugauuuuacaugaaguagaugagagggcccauacuauuggugauugauuguuguuuguuuguuucauuccuuuuuauaguaaagaaagaugguuauucagauauuagauauuugaaaggguaguuuaaagauuagcaagcaacauguauuuuggccccuucugcuuuauucucccccauuacaaugcuauuugggacccuaaggugccccuguaccucuugauguuaauaguuaacauuucauuuuuagcuuaaauuccuuagaaaauguuaauaaccaaaaagccaaauguuuaguguaucaggaauaccaccuucucuuuguccgcguugcacuuuuauuucuaacuaugcacugugaagagaauguuuccuguuggugugaaaccuucuuacguucuauccugcuuaaagccagaccuacagacagacuuaaugccauuucaaccuggagcccauccaggcugauguauggucuggcuggaaggaagccaugucucaaggacagucagcaacagaaaaugaaauaacaugcuagagacuggaguguggagguuugggagcagccagaauuuggauugugggaugauccacaauguaucuggcuuucuuaaacuguuaagccaugaggggugggaagccagagaggcuauccuacaaagaauucuuacuuuucaacagguccagacuuuaugcauuuguccaugaugucuucauucuuaagcuugaguauuauggguaaucauguuuugccuuccuuugugggaccauuugacccaauccuuaaaacaaacucguuuugaauugaguuucaaacuuugagaaagugcaaggauuuaauuuuaaaggguauagaacgcuucuaacucuccauguaggucuuuauacacugguagcagaaagucuauuauuaacuucccuuucccuagcccaccguuaauauaaagggaggaauauuccacuggauaaguauguuuggaacauuguuauugcuaucacuugugugcuuccccgccucugugauuuucauauucauacucuggaaucuguaauugcggucaaaguuacugguggcugaaaguuuacuguacucaauuucagggugcagcuguuugcacagaaaggcgccauugugcuagauuaaaguuucagaacuugguagagugagguuguaaucucucauguaugaaugcauuucuguaacaggcaugcaucaacuuuuacauaaguacucuugugugggccauuaaaaagacacaggaaagauuguaaguccaaaucaugucuuccauuuugcucuucuguauuuccugaccacuuagaaaaaguucacaagccuuugaagaaacagcagcaggcuguuauuguuuucaagguuuacaaauuaagugcuugauuuuuaauguauucucucuaucuacuguuuugauuuucagauuuugacucaauauuugaagaugugccuuuuauugggugauguuaauucucgaauguaguaauguuguuucacaauuguaauguuacauguucacgggugugacauucucuaacaaauuauucgauaagaaagucauuuucauggaacucauggcucugauugcacagucccuugcuaaagcaaagggcacucuuuuaaggcuacuucagaacuggucuuuguauuuucucuaagcgauggauguagucauguccauuuagaggcaggguaccacaugucacaggcagcccugagugugugccaugagaaaguucaaagacugugacaaagucuacaggaacucaaaauuucauuuuuguaaugguaacccccaagauuuucuccaagaaauaaauuauuuuguauuuuauaacuuaaaagcagcuaguaguacauuucugagauacagcaggagaccaaaacauuuuucgaaagagaauaaauauauaaagagagacugguuguuuuauuuucggugugcugauuagacuauuuauuuugugagugaaugugaugaaauacauauucagguguuuagcgugauuacgaguggaauauagauuucucuggcauuauuaaauccaugaugucuuuuacauaauggacaaaucaaauaugaaagaaggacacuuugacauagcuuagcuuguuuccuggugcuguugaccugcagaagaguuuacuuuugcauauacaggugaauguuuugcaauuuauguauacaagaaauuguaggcauuaaaauauuuuauugauauuuuu

SEQ ID NO: 3826 - RNA, 931 nt, Mus musculus
cuaguuauucacgucuacuuuauugagucgaaaugaccaaauucaagauaacgcaaaagaaagucaggcuagacucccaaugaaugcacuauauucugcagugcgucagagucaaguucugcuuggcaugugacgaaggucuucgcucuuucccuagguuuuuaaaagaacaucaggugccuccaggagauaacuggcgucccagggacaggauucuugugcgcaugcguagcuucggggcuccagcgaaacgaaaccgagaucccuugcuccagaccugucgcaccagcuguuggaauaccgucauuuggaaucuguacauccacgcgugacaccuacagagcccagcucuagaagggggucgggucucucuucuucuccaccccccccccucccaccccacccuccccggaucucacacugaaacccucucucgccgcgaagauccucgggcugaccgcucuccccgcccccuuuagccacaccccuaaacugccauuuugcgucugauuggcuaguaaaagccucagucccacccauuugagccaacgccaacggccacguacccguuuuccgugucuuaucuccgaaagcggaaguugcgcaaauacuugcgagcgcugcggaggcgcugagcgugugugugugaguguguguguguauguguguauacauacacacacauacuucguauucggcggcagcgcgggggcgguacacggcauuagaaggcgccggaagugucggugucgaggggcggcgagagaagggccaccaaggcaagccagucaguagcgcuuaggcucagcgagaggcaagacucgcauccaccgcgucccgaguccccggcccagccgggcuuuucucuucggccagacauggacuucagggaaauccucuugaucgcuuccaaaggacaaggugucaacca

SEQ ID NO: 3827 - RNA, 4486 nt, Mus musculus
cauuggcugggucuguggugacgucgucggguucacagacaguacucugagcgcccagcgcgcgggagguauugugcuucaccccagcuuuguucggucgucugcucaccuggcucugggugcguccugguggugcaacccggagcgggugccagcagccgcagccgcagccgccgccgccauggugucuccggucacuguggugagugcgcgagcgcgcgagcccgcggccaagccccccgggccugggacgaggcagcggcaagccgggccgccgaggggggcggaggaaggugcuguccccuccggggaagcggcugcugucacgguuuuuagcuccucacucuuguagcgucccuccuacgcgcgccccucgucugcccgcgggagggaggaaaacauugugcacgugacucggaagcgugacuguugauccaugagugucuggagcgggucugcaggucuuggccuggaacuggaugcugcaggcccuaggguucugugugguggacccucagggaagcauucgagagggugcaggggggugccgacuuccugggaaugccccaaguuucucuuaauauuguaggugcaggaggugacgccucugucuuaguaacgcuguucaggcgauaggugaagguggaccucucucuguugaccugaccuccuuuccagacuuucucaacuccagccuuugaguugucucuucacacuucuaaggcuggcuucucugacugucaugauuucaccacuuacugccaguuucuucuaggaaauaugggucuggggaguagggggagggggagcaaaggugauguuucugaaggcugacagguggagcugggcaugcaaaggugauguuucugaaggcugacagguggagcugggcaucccucccccccccccccccccccguuuccucccuuuggccuugcccucacucugacuaucccugauaagggaguuuccaugggaagggagugucaacucugcucccaucucuaaccucuggaaaaacaagagcaggcuuguacucuggacccacuauaugucucuucucuacccuuuccuaguugcaucagguaccugguugccaggggaucuaagugucuugucccuucagaguccuguguggaguggcuugcucacacacagucagagcacuuuuguuggaguaugggucuauagggaaccucaacugcuccaauucaugcucagaaacccugaacuugcaggccaggggaaggagcuucgggagaccacagaacaucugcagaaucuccucccccugcucagacucugccugcaguggccuugaguaaaaccuuucuuuagcugcccucccccuaauccagcugagacccagucagcuggccaacuucccccucucaguuccccaucuccucccagccugucugcuggcuccagaucagaagcccuccccaccccccuuccugucucuggugccucaaguugcucuuguucucugggaaagaaauggccaacauccccuuuuccuagccuggaaaccucuggccuuucaaacacuguuucuucucccaacacagaucuaguucucuucccagcaucccuagcaccucucuuuguccuugaugccaccuuuagucugacauagguagaguggaaggucggggcgggggcaggcaggacagaaagcuugugggguggagguacugucaccccuacauuccugacacucaccugguguugccagggcuuuaagcccgaguccuggcucuaaagcuugggucaugaguuggccagucagugcauuucugugguuucccugugaccuuacuccaguuccacacagcugggagcuuaggcugacagggagaggugguaaggggugccuggagaaggggagagcagagagccaggagggaacagggcugggcugcagaaaggaguauccuaaucggcacuguuggcucagugagugacgacucuggccaaguuccaggaccuacaguggaccagagugacuggacaguggagcccuugccuguccugguaaauugagccucagggugauaauggcuuucacauccugcuggcugcuuggagccagacaggcuagguuucucugucagaacucuuuguucucagugguauagggcuggggugugcacugcagccuuggggaaagguguaagauuuuuagaucucacugugggcuuuugugccccuaaccucugaguguuguccuuguucugucuccuccaggugaagagcgaaggacccaaacuggugcccuucuuuaaggcuaccuguguguauuuugugcucuggcugccuucauccagcccaucgugggucagcgcccuuaucaagugccugcccaucuuuugccucuggcuuuuucuucuggcucaugguguucgguuucugcuggcucaccccagugccucccucaucuucgugggacuugucuuuucugcugugggugaugccuuccucaucuggcaggaccacggauacuuugaacauggucaguaguuacaggaauugccuggguggguacuuggggcuggacgaaaaaggguccugguugggguaggaugaggcugcagaagagggaacagggaguuggagaguuucugaggcuggggaccaguucuguaaaggagagugugagagugugaguuuaaaacuauggcuguucuuacccccucuuaggcgcccgggggaaagcugcuggguuauccccaguccccuucucucaagcucucaaguacucuuuagccacaaaccuuccuuuagcagucuuuauccucucgcccuuucaggucuccugauguuugccguggcacacauccucuacgccgcggccuuuggcaugcggccacuggcucugcggacaggccuggugaucggagugcugucaggccugugcuaugcccugcucuacccuggccugucaggugcuuucaccuaccuggugggggucuauguggcccucaucagcuucaugggcuggagagcuauggcagggcugcgguugguuggggcagccuggcgguggacagagcuggcggccggcgguggugcucugcucuucauccucucggaccugaccaucgcucucaacaaguucugcuuccccgugcccuacucccgggcacugaucaugucuaccuacuaugcugcucagaugcucauugcccugucagcugucgagagccgagagccagugggagaagacuacagacugagcaaggccgacugaagggacuggggucugcucaccuuucucuuggggcugggggcccagacuuuggggucaugcaggagcuggaccagcaggcggcuucugggaaaggggcagucuugaagggggguaagcugaaggggcucccaggaaagcugguaguccaggaugacccggagagcucaaagaggcagccucacaucccucaccugagucagagguagacaucuccucaccucaucaggacugucaaagcccuccuggaaggugguggugcuuuuugaccccucucuuuuuauuagaugcaagagugugacucucucuuacgcccaggaccaauggcagugccaggccccuccauucccaccuuuucucuuccaagaugacccacgaaugaggaguccugaaagcuccuuccccaggcucccuaguugggaagacugguugaagguggagccugguuuucuguguccaaccucguuacuucagcagucuuuuaaguggcaauggcugucucuccaugguagaaggacuggguuggucuggaagcuugagggcaccaagguuucagauugguccuuguucucucacaggccagcucaggccucauaccaucacccccagucucuguccccagggcuaggguggaccaugccaaaggaaggggccagucuccaacuauaugucuuuguccuacugucugcaaaagacuuaaaguugcaggccucagagagcuccugaggggugcuuaacccagcucagagcugcccccccaaccccagcacaccaacaaugcuuucuuccagcucugggagugaguucuaaaugacacuuuagggucuuagacccaaagcacagucaaugcaaggggagcgaggaugggguaacuccauccucuacugcccaugugaaaaaauaaaauaaaauaaaaaccuaagggccauuggcuuccugacuugucugccuguguggcacgugccugucccagacaggggguagaggcauggugccagaagcccugcuuguccucacagccugggucagagucaucuuggcucaggcaucuuggcacuaggcuggcucccuggcugugcugacacuuguacuuguuucagugggucuugcuucccugguggugguggugguggugauauguguguguguguguuggcugugugguugugugauuauagucaggagggggaggguggggaugaauagugucuugccauguuucugaauuuguccuug

SEQ ID NO: 3828 - RNA, 2169 nt, Mus musculus
cagaagguguagcccugagaggaagugcaagagucacaagucgaguguucgcagaugccagggaaauggagcaaguugagguggguaagagggguuaaauaugucacagcagacagggacuuuaagaacagcaacagaagaaauauugaugggugaaacuaacauuuguccucaguagugagaguaagaauaaggacuuuagcaaacugacaucccugucuucuaaacaccauuugcuacccaguugcacuuggucauuguuauagccugaugggauuguuuuccaggacuuuuuaauauggacuggggacuaggaauaugucacaauugguagaaagcuugccuacuauccacaaagcccuaggcccaaucuucagcaccacauaagcaagcaugguggugcaugcccguaaacgcagaacuggcguggaggcaggaagaucggaaacucaaggccauccuuggcuaauagugagcucaaacccaaccuggacuacgaaagaccccauugccagagagauagguagauggauggauagauagauagauagauagauagauagauagauagauagauagauaauacagagacagagaaggagagagagaaagacagacaggcugugaguugacagaguuaaaaugcucagauuuuuuuaaaaaaugauggcaacuaguuaagaacagaaucuuuguuucccaucuugcccucugaccugggacacugugcaugguaaagaauuguucuccugaaaagcccuaagcuccaauuuucaccuaaauguccccuuacuuuaugaccucacaaaagacacuuuucucucauuuagacgagacauuguuucucgucuaaaauaugaaaagggggaggggagaaugaggagggaagaggggggaggaaaagggaaggaagaagaggaggaggaagacggaaggaaugaaccuaucagauuucuuuagaugcucucuggguuucugagucuguacagaaggaaauuagcaagacaucauggaauaaucaugaucuccagggaccaagugucugggugacaccugcauccgacacacacucuggucccacuggaacuucaaacuuguccacagggaacacaaaugucuacccucccugccagccucuucccaccucuaacccaacugcccaaguuuucaaaacuccacucucauccaaccacaaacccugucuauucuauuuccuuuuaaucuuuuagcucuguucacuucuuuccacacuuuccucccagucuagacauccaugaacuucacccacauugcaacagccucucucucucucucucucucucucucucucuuucucucucucucucucccuuuccuucucccucucugucucccccuccccucccccucacccucuuccucuccuucucuuuguucuuagcucucauugguccauccuucauagcacagccaaaguuuccuccauaaaacacagguguccagcuuaaaacccuguggugaucggagacaugguccaugggaaagaacgcgucugugcuguaaacuuguccaaagcuaucacuagggauguaaacuuguccaaagcuaucacuggggaggucuugggccuuugagagaaucaacaagcgaugcugcagauguauugcuaauggaagcacaguuaaacagccccugacugcuuguguuuauucccacagauugaggucgcucucauaauugguuggagaagccucuuucagccaugggcaugggcgaaagcagagauuuauaacauaccaaagcaccgagaagggacugcugaguucuccacugcaaagcagaaaucuauaucacucacuccaaagcccagaaauauuucagaagaggagaggaagggcuguaagagcuggagaguggaaaggacuuuuauaaaaugcugucaccugaguaucacacagcuguuacaauuaugaacaccagggacgacagugacaccugcagaagacaugcacacaaaagagagaugaguguggggacauggcuaagaagaagggacugagcaggggugggaggaggagucagacggaugacaacagacaaugugaucaauguagaauguacacauacaggaaacucaaaaucuuaagccuguguuugcccuugugguaaaauccaaacugcuuguauuac

SEQ ID NO: 3829 - RNA, 3702 nt, Mus musculus
ggcagugcucacuccaaagccaccucugagguccgggcagaggcucuucaucacagcucugcuuuguuucuugacaucuccaccauguuuucaggugucucaggaguguccugcagugcacucuggagaaccauuuugagggucuggugcuucaaccgaugccugaaugagcccacaaagaaguaaaugaugggguuggcacagcuguuaauagcagucaggacaacugaugucagauaaagacuaaauucaaauacacuaaaaacauucuuuuuuuuuuuuuuuuuuuuuuuuuuuuuuucuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauauauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguucgcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccaagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuuccucuuuuccaauuuguauccccuugauguccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccucacuaaaaacauucuuaaucuuggauaacaggaaccaguagaagccacagggcaacccgcagaggagaaaaaccaaaagggucagcgugauggucacguauaaucugguaagcuucauccguccagcgccacagaacaaccuggccagcagagccaggcuggacacacagaggacuacaaacaaaaacaucagguaugcgguaguaaggaaguucauugcuagacacccauagucaucuucauauuugguauccaagaagccgcagaaauaccuauacagaaugcagagcaauagagacaggacccagaucauagcacacaugacaguugauguguguucugggcgguggcagcgauaccagauggggcacaugacagacaggcagcgcucaaugcugauggcacugagcauguucaggccugcgauguagagaagcacccugaagguguaaaggcaguugauaaagauacuguugggggaggaaaaugugagaauaugcucuguggaagcuaugauguggcagaggaggaagaggaagucagccagggccaaguuuaggauguagauugagaaggcguuccugcgcaagcggaagagcaggagccagaacacaauggcguuuccugucagcccgacuaguccgaggaugacgaucaucaaguuuguuaucagaauccugaugcugauacuucuaugcaugguuucgugcacuggauuuguuguugugagugccguugccgagguugagguguucagggccc

SEQ ID NO: 3830 - RNA, 992 nt, Mus musculus
cagcagcaccagugcaggguuucuggcccuaaacaucucagccuccacaauggcacucacaacaacaaauccaauggacgaaaccaucccuggaaguaccagcaucaagauucugaucccaaacuugaugaucaucaucuuuggacuggucgggcugacaggaaacgccauuguguucuggcuccugggcuuccacuugcgcaggaaugccuucucagucuacauccuaaacuuggcccuggcugacuuccucuuccuccucugucgcaucauagcuuccacgcagaaacuucucacguucuccucacccaacauuaccuuucucauuugccuuuacaccuucagggugauucucuacaucgcaggccugagcaugcucacugccaucagcauugagcgcugccugucuguccugugccccaucugguaucgcugccaccgcccagaacacacaucaacugucaugugugcugcaaucuggguccugucccuguugaucugcauucugaauagguauuucugcgguuucuuagauaccaaauauguaaaugacuauggguguauggcaucaaauuucuuuaaugcugcauaccugauguuuuuguuuguaguccucuguguguccagccuggcucugcuggccagguuguucuguggcacugggcggaugaagcuuaccagauuguacgugaccaucaugcugaccauuuugguuuuucuccucugcggguugcccuguggcuuauacugguuccuguuauucuggauuaagaaugguuuugcuguauuugauuuuaacuuuuaucuagcaucaacuguccugagugcuauuaauagcucugccaaccccaucauuuacuucuucgugggcucauucaggcaucgguugaagcaccagacccucaaaaugguucuccagagugcacugcaggauacuccugagacagcugaaaacaugguggagaugucaagaagcaaagcagagccgugau

SEQ ID NO: 3831 - RNA, 992 nt, Mus musculus
aucauggcucugcuuugcuuuuugacaucuccacuauguuuucaggugucucaggaauguccugcagugcacucuggauaaccauuuugagggucuggugcugcaaucgaugccugaaggagcccacgaagaaguaaaugaugggguuggcacagcuguuaagagcagucaggacacuugaugccauaaaaagacuaaaaucaaauacaauaaaaacauucuuaaucuuggauaacaggaaccaguagaugccacagggcaacccgcagaggagaaaaaccaaaauggucagcaugauggucacguacaaucugguaaguuucauacgcccagcgccacagaacaaccuggccagcagagccaggcuggauagacagaggaccacaaacaaaaacaucagguaugcagcaguaaagaaguuugaugccauacauccauagucauuuacauauuugguaucuaagaaaacgcagaaauacuuauucagaaugcugaucaacagggacaggacccagaucauagcacacgugacaguugauguguguucugggcaguggcagcgauaccagauggggcacaguacagacagacaccguucagugccgauggcgcugaguaugcucaggccugcaauguagagaaccagcaugacgcugaagaagcacuugcgaaagauaauguuaggguaggaaaccuugagaagaaacagaguggaagcuaugaugugacagaggaggaagaggaagucagccagagccaaguuuaggauguagacugagaaggcauucuugcgcaagcggaagcccaggagccagaacacaauggcauuuccugucaucccaaccaguccgaagaugaugaucaucaagugugggaucagggugcugaugucaauacuuccagggaugguuucguccauuagauuuguugucgacggugccauugaugaggcagagguguuuagggccagaaacccugcaccggugcugcug

SEQ ID NO: 3832 - RNA, 1505 nt, Mus musculus
guuggaccacugaggcauccaaagucaguaagcugagaggagaguggacaguggucaagugcagcagggcagugcucaauccaaagccaccucugagguccagguagaggcucuucaucacggcucugcuuugcuucuugacaucuccaccauguuuucaggugucucaggaguguccugcaaugcacucuggagaaccauuuugagggucuugugcuucaaccgaugccugaaggagcccacaaagaaguaaaugaugggguuggcacagcuguuaacagaaguuaggacaagugaugucugaaaaaguauauaaucuaguacacugaaaucacgguuaauccagggcaccagaaaccagaagaagcccaggggcaacccacagagaagaaaaaccaaaacggucagcaugauggucacgaauaaucugguaaauuucgucuucccagcaccacagaacaaccuggccagcagagccaggguggacagacagaggacuauaaacaaaaacaucggguauguucugauaaagaaguucguugccagacacacagagucaauuacauauuugggaccaaagaaaugacagaaauauccauucagaaugcagaucaacaggggcaggaaccagaucacagcacacaggacaguugauguguguucugggcggcggcaccgauaccagauggggcacaggacagacaggcagcgcucagugcugauggcacugagcaugcucaggccugugauguagagaacugucaugaugaugucaaagcaaugguucaaaauauuguuggguaggugaaccuugagaagaagcauuguggaauuuaugaugugacagagaaggaagaggaagucagccagggccaaguuuaggauguagacuaagaaggcauuccugugcaaguggaagcccaggagccaaaacaaaaugacauuuccugucagcccgaccaguccgaagaugaugaucaucaaguuugggaucagggucucgaugucaauacuuccagggaugguuucguucauuggauuuguuguugugggugccauugccgaggcugagguguuuagggccagaaacccugcacugguguugcugggaacacaaagaagaaaugaggccuucacuaugaacacaacuuuuaauuucuuuuuuuuguuguuguuguuuuugugaguuuuuuguuguuuguucaaaauguuuuguauuggauauuuucuauauuuaaauuuaaaauguuauccccuuuccugcuuccccccuuccuggaaacccccaucucauccucccucccccugcuucugugaggguguugcucaacccacacacccacuuccaccucucugcccucgauucccuuacacuggggcaucaauagaaccuucauagguucaaggaccucuuccaucaaugcaugauauggccauccucugcaacauaugcaucuggagccauguguacucuuuuguugauggcuuagucccuaggaguucag

SEQ ID NO: 3833 - RNA, 1505 nt, Mus musculus
cugaacuccuagggacuaagccaucaacaaaagaguacacauggcuccagaugcauauguugcagaggauggccauaucaugcauugauggaagagguccuugaaccuaugaagguucuauugaugccccaguguaagggaaucgagggcagagagguggaaguggguguguggguugagcaacacccucacagaagcagggggagggaggaugagauggggguuuccaggaaggggggaagcaggaaaggggauaacauuuuaaauuuaaauauagaaaauauccaauacaaaacauuuugaacaaacaacaaaaaacucacaaaaacaacaacaacaaaaaaaagaaauuaaaaguuguguucauagugaaggccucauuucuucuuuguguucccagcaacaccagugcaggguuucuggcccuaaacaccucagccucggcaauggcacccacaacaacaaauccaaugaacgaaaccaucccuggaaguauugacaucgagacccugaucccaaacuugaugaucaucaucuucggacuggucgggcugacaggaaaugucauuuuguuuuggcuccugggcuuccacuugcacaggaaugccuucuuagucuacauccuaaacuuggcccuggcugacuuccucuuccuucucugucacaucauaaauuccacaaugcuucuucucaagguucaccuacccaacaauauuuugaaccauugcuuugacaucaucaugacaguucucuacaucacaggccugagcaugcucagugccaucagcacugagcgcugccugucuguccugugccccaucugguaucggugccgccgcccagaacacacaucaacuguccugugugcugugaucugguuccugccccuguugaucugcauucugaauggauauuucugucauuucuuuggucccaaauauguaauugacucugugugucuggcaacgaacuucuuuaucagaacauacccgauguuuuuguuuauaguccucugucuguccacccuggcucugcuggccagguuguucuguggugcugggaagacgaaauuuaccagauuauucgugaccaucaugcugaccguuuugguuuuucuucucuguggguugccccugggcuucuucugguuucuggugcccuggauuaaccgugauuucaguguacuagauuauauacuuuuucagacaucacuuguccuaacuucuguuaacagcugugccaaccccaucauuuacuucuuugugggcuccuucaggcaucgguugaagcacaagacccucaaaaugguucuccagagugcauugcaggacacuccugagacaccugaaaacaugguggagaugucaagaagcaaagcagagccgugaugaagagccucuaccuggaccucagagguggcuuuggauugagcacugcccugcugcacuugaccacuguccacucuccucucagcuuacugacuuuggaugccucagugguccaac

SEQ ID NO: 3834 - RNA, 38440 nt, Mus musculus
aggagggcggagcgcgagccggaagugggcgagaggcggcugaggcgugcuuggagagccgcggccgccacuuugcgcuggagccgcggccgagcgggcgcgggucgugauggagggcccgggccugggcucgcaggugagcgcggcuggacgugggcggcgguggggacguaagccgcggccaggugaggcgguuccgcgaggacagcaggaucugggccuuggccacacuaagaaagaugcugcuuguccuuugcgguggccgcagagcgaggccgggcccuccugucgccuccauucggcggcugggcgucacgcaccggugccuaagucggcuggaaccuguaaggugucaggugacacaccucagauagcacagccagccuuagaccuuagccuggagucugagagauucuguugagaaauuaucagcccuagcgccuaggcugccgccuucucuccaccuugucuuagcucuuguugcuacccacauccuuccuacuccuugaaagcaucaaggcuguggaggcaggaggaagggcgcuccgugguaccaucugcaaaauccccaaggauucuauucugagaagggcuagauuagucccagaggacagaggaggccaaaggggaagcuauaaaagccaagagaacuaagaauuugucccuuuugauugugacuacucuaaagacuuauaacuggcauugaauagauuacaacuuaauauuuucaggcuucuucaauccuagcaaauguuuagcgugugcuacaugcauuuaugugcaccuuuuuaucccagcuucaaaguuuuuaagcaaaagaaauccccaucuacaggagaguaaacugacacagucucuaauucaaguuaugcuagaaguagauugauuuuuuuuuuucaagcaguuugagguugucacauugcuuggacucuuuaaaaaaaaaaaaauuccccaaucccaagaguguucuucauagcucucuauuuuucuucuucaaccaguuugguguagguuuaaguggaaaauaacaugcugagguguuuuuauugggaguucuugcauuuuaaaagaaaugaaaaaugaugugcagggagccugaauuacuaugaaagaacauagacucuuuacaugaaacagucucucauuauuuuucucaggcucaaacgucaguaagaguaggccucauuucuuaauuacugucacucauuaauaaaagccugugagagcuuagcuuuacuccuccaugcuaagagggaaauaacccagcucagguuccaugacaucagaagggagaggaugauuuuagagguugagguugguggggcaagauagacuguuguuaaugauaguugccauggcugcuuucuucaguuauaacgugaagagcuagcuuacccuucuuagaaaucucccagucuuggucuucacuacucacuugugagcuagguaagaguaauuauuucuaauuuuaaaagugagaacggacacucaagacaaucuagucacacgcuagagagcagcugaguggcaaagccgagauuccauucauccauccaguaaauguguuguaaaugugucccggaaauugggcucuauucuucaugaacaaaacagacaaagcaucccuguuguugaauuugcuucuuagugccgauaggucuuuuuguuuuguuuuguuuuguuuuguuuuguuuugcuuugucagaauuuuccuagccugccuggaucucaguuaugcuuaauaccucaccuuuuacaguuuuuguuugcucaagaaacucccagguacaccgggcugcaggccauauuacuuccuuguuuuaucaggagugcucugucugaagucacuccugaguauugauguggcuuauuccuccacuucuauaauaucuucagacaaaucucaccacaguguagcauuuugaugcccuuauacuuaaaaaugcaggccuuucuuauugucaucacuaacgauaucacucccuggccccccuccuggguucauauuucuccccggcauuuaauaucaugcaauaagcuguugauccugaugaugcgcuugcucucuccucugcugagcauaaguaccaugaagguagugauuuguaucagaugcauuaaucauugcuuugugucaagcauuaaaaaaaaaaaaaaaaaagaaucuaacacuaguguucacccacuagugaauuuagaaacuuaacucugauacuucuguuaauauugugacaaaguuuaaugguuuucugucacaccucccuugccagaguuuuccagaucauguuuuuccuuuagaauccacuguaucuucaugaacgcuuacuauuuuaaaaauaauuugauugcaucauaauuacuguauagcuuaaagaugcucuguugagcaugcucaaaagcaugauggcauggaaaacagccauuguuaacucauggaucggugcuucagaaaucugaagacugguucagguugguuugucucccuguuccauugugucuagagccucagcaggaaagacucauaagcuaguuguaagucgcuagcuaggacugguauuaucuaggaguguuuuuccucgaagaucuggcaguugaugcugacucucaacagauaaccuggucuucugcacagcaugguagcuggauuccaaaagaaaugugucuuaagagacaggaagaggaagcugccaguuucuaaagccuaggcuuacaaauggacacagccauguuucuacaauauuuuauuagugaagcaguucacagagcuuagagucaagagaaagugacauagaccuucaccucuugaucuugaaaauaagaaaaacuggggacugauauaaaaacugccacugauguaacuuuaugcuucaauuauaauguucaauuuugacccuuuucuucccuguggagaaguauuuagcuuauauaugucuuuccuuuuuuucuccuucuccccaacaacccauguauuuuagaaaaaaacaaaacaaaacaaaacaugguauccuggucccuugaauauuuguuaacuggaaucuuagguggaccagagaaaaccaaauggaucagaaucauagacuauguagaaccaguuuucuuccaucugaauaguucauauuuacuaugauacagagaauccuaaaaaguucuuacuuuccuuuuaauguagcuaaguaccuguuaguuuugacuuuauaugauucuguguuugcuuauucagcagauagaucugaacaaaucuauucaaaagagcauuauggcucucguucugggugagaugaagggauagaagcacaccucucucucccauugaauguagauaugaagucuggcagacuuuaaaacaucuccugaaggacccuggaaaaguaaaugggaaaucauauuaaagacaaccagaaaucaagcuccacaaacccagcagauaauuuaccuuugucaccucugguuugccccucuuacagauuugagccccagaagaggacauuccuguagacagaacuccaugagcaauguaauucacucaagaagcaagaaagggaucuuuuggcagcaugagugcuagaacuuuccucaguagcuacaauaauugagauuucauggguaauuccuggaauugagcacaaggccaaaaggcacagaugaaaaauagcggguggacauguuagcacaugacuguuagcccagcucuuaggaagcugaagcaggaagaucacaaguuagaggcuagaugugagacccuggaucaaaaagagaggguggcaaaggcuugaacagaaacgucauagaagauuagcacauauagauauaagcacaacuaguguucauuucaaaugguguucagccucauuugcccuuagggauauguaaauuaagacccuuaugaaauauaccguacaucuguugugcuaacaguugacuaaauugauggauagugcucuuuuaaagucucuuucaaguucccagauuguuuuugguuguuuuuguuuuuguuuugucuauccuguguuauauugugucuucucauacuacaauaagugaaagaaguguuguaaucccuauaauugugaacugauuucuuuuuucaguucugucuguuuuuuacuucaugaauuuaaacauuugacuucuguauacauccaguguuaaaucuucuuauauaauuagcucuauaguaucaagaagucuccuuuacuccucaaaauauuguugacacugcuuugucauaucuuccaauaaccacugcguuccucaugcuuaauguuuguauauaucugugugcauuuauauguuucaguugagcuuuucauagacagucugcguuuuucuaaccuuguagaguuuaucuguacaugcuuguauaggauacguucuuuuaauuuuuuuauuuagaauauaugccaacaaugucuuuuuguuuuuaggaaacauugcaaacuuuaaggaucccaaaucuuaagcuucagcccuuauacacacacacuucuucccugcuuagcuuauuucucucuugaaaucuguucucaccuugagccaccucaaccuguuacauguauauucucugccuucucauuuauacagagaagccccugaggcucuagcagcuuuuuuuuuuuuuuuuuuuuuuuggauuggcuauuuuauuuauuuacauuucaaauguuuuccccuucccaguucuccccuuucggaaacucccuaccccagacuccaccccacccuaccccacccccgccucuuugagggugcucacccacccacccacucuuguccucccacccuggcauucccuuacacuggggcaucgaacacccucaggcccaagggucucuucucucacugauguccaacuaggccauccucugccacauguauggcuagcaccaugggucacuccauguguauucuuugguuggugguccaguccccaggagcuccaggaggucuggccuuuucaguuccuucuccaacucuuccaucugggacccucaagcucagucuaaugguuggcugcaagcuuccaccucuguauuugucagggcucuggcagugccucucuggagacagccauaucagacuucuaucagcaagcacuuuccagcauccacaauaacuuacagguuuggugucuagcagcccuuuuaauauuauagcccagcauuguuacaaaguugccuaaaagaaucaccaacaaucucaauguguuaaguaaguuuacuguguccuguuggucauauucagccacaucauaugugucuuuaaguauaugaggcuaguggccacagguuggacauauugaaaauauuuucucaaagagguucacuccucugacuuuuuuuuuuuuaauugaaaaaaguauuucacacacuguguucugaucauggcuuucuuuccuugucucaaucccucccagaucaauucagucuccucaccuacccaguuccaugcccuuucauucauucaugugugcucccucucccucugcacccccccuucucucaaaaacaaacuuuaaguuucuuaaguucucauuucuuggauacuuuccuguuauucauaguuaaaauaguuuauuucagguguuuuauccaguuuucuaggucuucuuuaaaauaggauagucaguggugagaccuaauccugguuauuguauuguacacuaaaguagaaggcccuaccuuauuuuauaaauagcugagaaaagaacuugcacucagguauuuaagugcugccaucuaagacaaacuagaagucccauaaagcaacagcaagcagaguuugaugauaccaacaguuugugaggaugagagccaugaaaguuuccaggcccugcucuggaaagcuuaauugauguggccauuuuaagaugugcuuagcauaccuuaaaugccagacaguuaaacugauuacauauuauuaagaauuguuuaugcaugaauacucaagaaacauauacaaaagugugcacagaaguacuguuaguagucccaagcuaggaagauccaaguaaguggccacauaaauaaguugauggugggccacauaaauaaguuaugauaauguugggucauuuuacaucaaccuggucacuucuauacuggcuguugcugcaugacaaaugaccauacagaguucuuguuuauuagcucaguguuucugcuugucagaaauccaaacacagcuugccuagauccuuugcucagggucucacaagcuggugucauggcuaagauguguucccuuauguaacuuagauuucuuucucaagcuugugugguuaguaaugcaguuaaacucucugcgguugcuugauacacauuuucauuuucuugaugucugucacuuucacuucuagaagcuacucucaguccuugccaccuggguuuuuugcggucccuuuuguuucauagcagccugcuuuugcaaaaccaauaggagcugcugcuaagacagucuuauucacccugucguagacuacauuguuccaccaccuuugucauauuccuugccucugggauuuccaucuucaaagggaaaggaaauugcaagagcuugaucauuaggaagugagaagacuuuuuagggugugcagccacgacucugaaaacaagauccugguaaugcuccuucagugucaguauccaugacccucuacuacugcagcuaccaaggcacaugugugccuugucagaugaccuguuuuaugacauuuauaauuuggauuuuucucauuuuaagcaucuuugaagguaaaaucuucauuaagacacuccuguaagggauuaaagcaauuugauuuguuaacauagguauuguuaaugguauaaaaugcuucauuacaugauugaaugaugauauuaauucuucuacaugcuuuaucaacugcucuuacucuucagugcaggaaucacagccauggcucccacguuccaggauuugggcgacacggcaucuguguacaugaaaacaaagaacuugcaaaagcaaaagaaauucuuccucuuauagaggacucgaguaacugugacauugucaaagcuacacagugagucuacuggaugcucugucuuauccuuagagucucuuuacuuaugauaauggguaugcaguugauagcacucuaugggcacuuuauauccaaacagcuccauaccagugccaaaugcauuugccauuacagcaucagaguacuuagugugguauaccuugacuguucauguaucgggcacuuccauuaaguuuucagcagaacuuaucuucuuuaucuuugaagccccaggccuuuugcauaguuuugucaaauaaaauuugcugccugguaaaauguuuacugaacaaaugaaugauuugaaacaagauuaaaacuagucucuaauuugaauuuaaaguguguuacaaccuaauacagaaguggaaugggaaauagcagcucacauuuauggauuuaaucauuaauuauuauauauuuccugcauuuuuguuugcuggcaccacagaacagguggguagaaguauauucuaauaggucuguuucuugugcugaaaauagaaaugaauuuaaaauuuuucuacuuacugugaccauuauguggauauccacguugucagugaugccagggccaucuucauggagccuguucaguucagggaccaucucaccucuugcuuuugagcauauuuugaaauauguuguuuaucagacaugacuaaguaguaauuuauauuuuagaaaucaaguauagacauuauaaugcccauuuaauguaagucacacucauuaaucaacauaaacgaauuaggauugccugucuaucuugguaucauuccuguuaaaacccuguuuggcuuuaacacuaacuaauguucauguucaauguucauauauugacaguuaccggaauggguuauucugauuuccaauuuauauaaaguuaguuuaaagacccugggucuacugcuuugggugaauauuauuugauaguuuguauugcucugaagaugagaguauucuuaaggggaauguuggcuuuaaucagaaugggaacauuguaaugucucugucaucagguaagcucuguugugccgaaugcuagccgucauccgccuucacagggaagcgcaguaagaacucaucuuugaugguccuuugauggucuuagaccuucucaaguguuuguggagauauuuuuagaccauugguucucaaccuucaaaugcugcaacccuuuaauacaauuacucauguucuagugacccuagccauaaaauuauuuucauugcuauuucauaacuguaauuuugcuacuguuaugaguugucauauaaaugucuguguuuucugaugguccuaagugaccccugcugugggccuguguacuggaggcuuucagggguucagacgaaggggggagaaugcgagcagggagggggaauuggaggaauugccuccacugccucugcugcugcagcugccuccaccuccgcugcugccaucgcuucuguugcuccaggaugcuacacugguagaucugcgcugagucuggccgggcugagccagccagaggcugacuagccagcgagggguacggggaagcuucuaguggagcuucugguggcauuuuugggagagcaggucucuucccuggcagugguguugcagcucuuaugacaaaggcucucagacaacggaguaggucucacacaccuuuauuucuucuagagaggauccuuauauacaguuuuggggugggucagggucuaacaaaaggugcuuccuauuggcuuggucugagaacuugaggauaucuuaucuacaugugggagagcuuagagugcugcccuuaugugucugacagccacaaaccuggugguuguggggggcuguggcuacggguuuacaggguccugguucugggagcaggcaaagcuccuaccaaccuuccagggucccgcgggcuucaaaccuuagcucaaccuuaccaggcuuccucucacagcccaucaccccacacccuguaaaaguuguuuaaccuccaaaggggucacgacccacauguugaugcuuuagauagguauuuggaaaggagacagaaccagagagacaacauuauaugcaaccaauaauguguucucuuauguuucucaaauaaaaggaauagucuuucccaguaaaauguccaaagugaccuuuaaaagauggauaguccagcuaugacaaugugccauuaucagaagcuuccguguauuguuuggacauacaaauguuuaucaggcaaaauauuugcauuuaauugugaaaaagugagaucauuuuugccaguugauuugaguuuugaccucugaggagcaaguugcaauuuucagguccuucuaaauagaaauaaguuucagagaaacugcuaaaaauguauguuguaguuaguuucuguuaaaauguauguugguaauauaugauuuuuaaaauuaugaaagcauuuaaaagaauaacucagcagaaucaauaucuucuagacucuccuuuucuguuccuuuuguccaucucacacuuaauguucucauauguauucacaguuaucaccuccauuauggucucugaauucuauucuuaugcugaucuaagcugcuucuucccuauugccacuaacguaaucuuucuuaaaacucaaauucucagcacuuuuccuucucuaaugacuuucuugguuucccacugaacugaaggugaacucagucucauccaccuuguguggucuugcccuuaccauucccucuccauugcauuacacucaccauugcuguguuguuucuuuugcucugaacaucuauguaguguuucacagcucagguuuuguaccuacuauucuuccuguccagaauguccuccuuucuuaaauuacagcaugugugccauguuucaguucuccaggaaggccuccugccuggcucaacauccuggcuauuucuuguugaauuuaucgcauuccaaguuugcuuuuaggguuucaccuacauuguaagguaguugcuuaggugugguuugcuucagagauaagauuguagucaggagccaacaccguauguuuuuagacaaaugaaauuacugaaggagagcaggugugaggaucaaggcuuaagacaguuguuucggcuccaugugagugaauccaucaguuaguacauugagcuugcuuuaguuuggcuuugcacuauguuccuuuugugcauuagaauuagaccaugucuaagaauuuuuccauuguggaacucagcauucacauguuguccuccucccucucagaggagaaggggaaagaggaauugggggaggagaggggcugugaauacugggacguauauugggauguaaagugaaugaaugaauaaaugaauaaauaaauaaacaaaugggaaaaaacaacauaaaaaggcaaaaauaaaaacagaaauacugcaccuaaacuuguacuguacauucauagaauuuuaaaucugucauuauuacuuauauaauacaauauggcaguuauuuacauggcaucuguauuguagaaguaaccuauaugacauaagguaugugggaagauaaugacaccuuauuuuauaagggauuugaacagaugcauagauguugggaucuggaaggauuccaggguacaggacuccaaggauaccacggggaaccugcuuaguauuuccauguugacuagaaaguuguuugcacucaaauuaaaaaauaauaauaauaaaaaucaugguaaauggaagaaauuuugacauauaaaauuauuauaauauacuaauugugcuuuucuuuuuuuuuuauuuaagauauggaauuuuugaacgauguaaagagcugguagaagcaggauaugaugucagacaaccagacagagaaaaugugucucuucuucacugggcugccauuaacaacaggcuggaacuuguaaaguaagaugggaugugugugugugugugugugugugugugugugugugugugcacgcaucugugcacauguagugaucuuuaugauuccagaacucucuuuuguuuuuguauggguuaggcaacuauuaaaacuuggaauuugccacacaucaguuaccaugguaucggagcaggccagucauaaaucggacccaucauaaagauaaaggauagugaaagaggauguguuuaaaacaaaagaauaagauugcuuucucaagauagaaguugcaucuuagucuagaagaagcaaugaaauauuuuggguuauaacaucaggcggaguagauauguagagaauuagacuuugaaaaaaguuaaauguggaauauaauuugcaaugagcauauaaugguuuauguaguucuucugauuuaguguguacaaugcugguggguaguaaggguuugaauguauauguuucaaaucaggacuauauguguaaaauuuuuaaggcuuaaaaaaauuaaaauuuaguaguuuaaaaucuuauaacacaucauaccaacagacaaacuuuuguguauucuuuagauaaugugauacaugaagcacaucuuugaaguaaggaaauaaacuuuucuaaacuagagaagaaaguuauuuucauuacauaauaaguucacuauacacaguaccucauauucuuuguucccaaaauggaacauucauaauuucuaauuuuucuaaaaugauuuuaaauccacuuuuuacuauuuuaagaauucauucccauaugcuacgucuaauuaugaaaugguaaaaaugauaaaaucucaccuuucucuuuccacuuugaagcuacuuaagagugcuauagucauuagaauguucaggaaaguuuccauguguugggcuuguaggugauaggggaacacuaacuauagcaaaaauaauuaugacuauaguauuaaguguuucaccagagauuugucagaugcugucauacauccuuuugagacuuccauagaucugggcccuucaggagaauuaguauaauuucuguuuuauaauauagugugaagaaaauuggguugguagaguauuugccuaucagacaacggagcccuggguuggaucccagugccaaauaaaaacugggucugguggugcacaccugcauucccagcacucaggaaguggagacaggaggaucagaaguuaguuuaaggccaucuuuggcugccuagugaguuugaggccagccugggauacaugagacuuuaucuugugagggagggaaaggauagaagaaagccuuuucuuucucaaugugaaucuuaaauuucaugucucauuuucauugcuuuuaacagguuuuauauuuccaaaggugcugugauagaucaguuggguggugaccuaaauucaacuccucuucacugggccauccgguaagaugccuuuggaaguuuugacauacguggcuaguggcagcaugucauaaccccagcugcaggcaggggaauggguguuauuuuggguuuuuguuuucuuucguucugggggggggggggggguguuuuuuguucuuguuuuuguuuuugaaaauaaagugaggcuuugggguuucuaaaagaguuguuuuaguguuugaucuuaugcuccagugugauuaucagacucaaauguguuggaauuucuguuuuaaaacuggaaugaauaucucuauuugguuuguauaaaugaauacaguaguucaacuauaaagucaaucuucaaccuuagcuacucauuuggaaacucaguguagugccauuuuaaggagauugaaucccucaaucucuuuaaaguauaucucugucucuuaagaucaaauggguaaaguccuuugaaguugaugcaggauaaucuugaguaggcuggcuuaacauggcauuuaugguaucuucuucuuugcugugaggugcacugauccucugaagcugaaggucuaaaucugucugccuaacccacccugcuugcugagguuguaacucaagugaaauuaauuguuacugcaaggcagagagcugacucuuguuuccaucggcaagaguuuugaagaaccuaagcuucacucuuguccuucaagauacugaugguaguguccaugaaaaugaguuauguuuggagauauauauauauauauauauauauauauauauauauauauauauauauauauacauacauacauauauacacacauacauacacacacauauauguguguguguggcucuauaugguuauuaauaaugugguuuauaaauauauauggcuccuaucuuaauauuuuuacaauguauccauagucuuaauauuauacuauaauauuucuggcucaugaucauguuuuaguuucaaaaccaugggugaagccggcaggauuuuaagguuuucauuguucucauuagucauugcuauuacaugcuauagcagcauaagguuuaauuuagauugugagguuaucaaguuuaucauuugccccaagcauggucauguaauucugaguuguacuacuuaaguaaaagacauuuguggcucacaaaauggcucagugguuaagaguacuugcugcucuugcagaagagcagcauucuguucucgaacccacugugaagugcuucacaacucccugcacgcaacuucugcuccagggaagcagagacccucuucuggccuccucuggcaugcacacauaugggcacauauacacgccuauacauaaauaaaaauaguuauuuuuuuuuagugaguagaaguuacuuguacaacgucaaguuacguaaaauaccuuucuacuagaagacguuauuuuguccagccagaaucccucaugccuuagagggauucuguaguuucuuccuagguauuauuugguucucugcaugaauucugcuucuacagaauaaagcacauuggaaauuuuccuguucgcagacaagggcauuugccuauggucauauuauugcuccagcacggugcagaccccacucugauugauggagagggauucagcagcauccaucuggcgguccuguuucagcacaugcccaucauagcguaucucaucucaaagggacagguauguguugucaugcaccuuauauucuggguaguguaauuugaagauauugggaggguuauuggcccuggucuaccgucaguuuuaaauuggaguuaauggcuauccagauacucggaacuaaccuuaguaagccaaccuagcucuugaacacuggauuuuuuuuuuuuuuuuuuuuuugcuucaucagagggagaaagacagguuauuuuagcucagcaucacuuaaugguucugaaacuuauaaaccuguaauaguuuuucuuacgauaccaguaauuuucaggguuuuuucaauugaccucagagccuguauuuuccuucugcuugaguggagaaaugguugucaggucacuauuaacccaucguuugcuuucauuauuauuugagcucaaaugggaggccaauuugaaugugagcaucucauuuauuguucucugaguaauucgacgaaaaugauguucuucggagcauggauuaaauuauaggcugucaccagugggaguucugcugucagcugugcuugcuggagugugcucugacagcagggugguuuguguguuagcagucuugucuggaaugaguguggaaacauguuugcacaaaugccauuggauugauuauuuucccucuauaagcacuuucucucagacagcgcagugaaguggaauaauuauaaccucuugggcuucaguuuuuaaaacguacgagaaaggagacccuugugcugcuucccgaguucucuuucuccgggccaugagaacccucaguaacuuacguucuuucacaugaucggagcacaguuguaccucacacuugccgugucuguaaaaggacuauauccuugucagcauaugcuucccuuuuuccuucucuuccaguaaauauaaaaggaguuuugauuuuuuuuucuuucuuguugaacuauuugaagcagugacucugaagauagguaauccacuguuacuaguggauguuagugugagcccaugcagcaggauuuaagccagauggcuucaagagcucucauuuucaguggagauugucaacuacccuccauuuuucuuucacauuauacaacacuuuauauucauauucucccuuuaaaauauuuuguagcauucuauggauuuucacccuguuaaaaaaagcacuuuuuuuaacuuaaguaauauuaaaaccauuuaacaguuacagagaugaagguguuaaggaaguauuuaucuacuaagaaaugcaacuuuuuauacuguguucacaguucugcuaauugauuccuuuuugacuagagugugaauaugacagaugucaauggacagacgccgcucaugcuaucggcuuacaaaguaauugggugaguguuacuggaucccgucagucugcuucuugguuccuaugagcuuucuguaaauacauuugcaaguccuuuggucugugagaugcuggagauuuuccacguggccgugaggagguauacuuagaauacaccauugaguacauuuucucuugguagcuuugacggaaaaguuugaaaguuuacugaguucauauuccuuagcauauacucauuaagugacugauuccucuuuuguaccugaagaaguggcaaauuuaaauguucucauaaucacagaucucuaugguaaaccuacuucucuaauggcagugaauuugagguucucugcuguugcugacugcucugaagacacugaugaagcugguacauaaugggagucuauuauaggaugaggucagauacauaccugcuuaagugagacaugcuuaguguuuaguuguacagcacuuaauauuggcuaagguuaaguagacagguuuuuuuaaaauauuaaucacuaaauaaaacagcaacaugaagaaauuuuucuuaucuccuguauuacuaucuaaauugcaucauggauacaguaagcugccauuuuuaaggaccaucuuucuuguuucuuugaucuuuccugucaauaacuagacuagaacucugaagagaucccuuaguucuucagagcacuugcugguuaacgauacacuaaucuuaaauuuucucuuugcaauuucuucuuguaucuucauccuuacuaaugccuugugauauuguuacuguuuugacacaggccagaaccaacuggauuucuuuuaaaguucaaucccucucucaguguuguugauaaaacacaucagaacacuccucuucacugggcaguugcagcaggaaaugucagugcaguugauaagcuuuuggaagcugguucuagccuggacauccgaaaugcuaagguaugacccgguauucuuuucuucaauucuuuguaucuucaauuaaaagauggguauuuaauauacugguagcuagguacuagaagauaaauauuaacaauaauaacuacucuuagaauaaacauguugagucuaugauucuggugaaaaaguguuuuaaaccuguaauauauuuuaaaaauauguuauuuauuauaauuuacuuuauuuuuuuagggagaaacaccucuugauauggcucuacaaaguaaaaaccagcucauuagucacaugcuaagaacagaggccaagaugagagccaacaaacaguuucggcuuuggcgauggcugcacaaaugcgagguauugugugugaagaaguuguuagccuuugucuuuagggcagcagagaaggcuagagauuaaacuuugugcugcagaggaucugcucauagcaucuuuccuaugcaucacacugcccaaaguaagaaauagggcauuucacugguuguucaacguuaauuucucagguagauggcgcuaaacuauauguuaccugguggauauuugcaaauugacuuaaggaaugaauugaaguauagaauagguuugauuguuagagugguaccuacuugagaacaguucagcaucucauagacguuugcaaugugagguaucaaaacuggccuucugcccugccagccucugacugagccuccucaucugcuuagguagcucuuccuuccuaccuuucugucaugguugugcugucagucaucccauuuauccaugcugguguccuagcuggucuuacgucacuaugucucuggaaccugaccucaucacuucacaaaugccauguuagucccgccccauuagucuucauguagauuuauuuuccuauugaaaaaucacauuuuuuaaaacuuugcaauuccucacuauaguguuccaaauuuaaagugagcuaaacaguugaaaagaaaaguuuaggaacuuuagcuuucucuccuaaauggcuaagaaaacuaagcuacaguugugugaauauaauucacauugacaaaauggauauuugguugauuaaugcuuuuguuuucaaauacaauagugucuuuucaaguaauauuaauaguuauacuuucagaauaauucugauuagcaguugcaagauuuuuacauaaaaauucacaagugcuguacuuaauugucaguugugguaaaguagggaggggacuccccaacuucuucgaauucaguaugccaagauucuguccuagaccuucuuuucuaccuaugaguuaguucccuaagaggcgacugcaucuugccaucccccagauuucucucuucagcauagaccaucuagauugcuaaacucagucaccuauucaacucagccaaucccugucugguagacacugcaguauagcacaucaggaaguauccuguaggcaccugcagauggcgaaauagaaccagaacgccuguucucuuccuucccaccuucacucaucuucgcaucucaagaggagcacuccaaaugucugcucugucuacuccauauucacagugcugugguucugguugcuccugcaaaggcauauaaaugaaagcauuuauagauagaauuugacacacacacacacacacacacacacacacacacacacacacccaucuccaaugccauguuaguacaacagaugaguacuugaaaauguaagucauauuuaccucaaauucccagauaucuucccauucuucugaguaaaagcuaaauccugacagcugccugcugucuuaguuaggguuucuauugcuguaauaaaacaccauagccaaaagcaacuugaggugggggagguuuauuguuguaacuuacaccucacaauccuuccucaaaagaagucugggcaggaaaucaggguaggaaaguggagguagggacugaugcagaguccgugugggagugcugcuuuuaucccuugucccccuuaccugcucagcuuccuuuccugugacauacuggaccuccugccuagguuggguaccucccacaguggucugggcccucccacaucaaucauccauucuaaaaaugccccaccugccaauuuagugagggcuuuuucucaauuucgguucagucuucccaaauaaccaaguugugucaaguugaccuagaacuagcuagcacaccugcuaagcuccacauguuccagcuuuuuauguccuguaacauuucugcuugucuucucaacuggaauuucagcuucaugaaagaaagccuuucaguucauuaucucccguggguagaauagcaccucacacaguaaauaaauagugugguucguguagaagacuguuaaauauccaagauuuacaguuauuucucuguucugaaacuauuuugugauuauauuauagauucuaaauuuauuuuuacaucaguaaguuagaacuggaaacaauuugaagacuugaugccauuugaaauuaucuccuuccagauguaugaguaaaaguggaggaaaauaaggcaaagagcacuuuuccuccuugcuauuucaaaaaccuaacuugcuuuauagagacuuauacacaaagcaccaaaaugcuuguagagcccaguaccacuacccauggccuguuggcucuggguuucauuccuuuaacauugucaaagcaagcugaagcacuagcgaccuagagaaauauuuuagucuuugacccccugagucccaagaccccuccuuuguucccugcuucucugaaaccuuucccagauuuucagccuggcuuucccaucauucuuucuuaguuacauuugggaauccuuuguucuuaauuuugacugcuuguguuguuggagauccugcuucuuucugccuucauaaucuugaggaagguccucaucuacugcuuucccaccucugugcagauuacucucaagacuugcaaaacacuaggcccauugugcaggcugccuccuggaucugcccuggguguccauagccauucacagguccacauguuccaaaccaugcucagccccuucagaacuauuucucugguauucuuagugaggggucauacuagcuggggcucaaggugcaguuacuauaacccuacaguuuagucuggauuguauugauuuugguagucccuuuaguugcuuuauucauggugauguagaauacuaacuaaaagaaaauauuuuuauuaccacuuuccuuuuaagaaugccauuuuugagggaaauaacaaugcaaaauauuaagcaaaauuuguaagauugucucuacuauauaaaucaaucauuuuuuaaauuugacagcaauaugaagaaaauuuauuaguuccauuaaguuguacuguacuuacaaaguaguucuuguacugaacuagcuauuguuaugaguacaaucaaaaguucuaaaacucuaauuucucaauagcucuuccugcugcugauacucucuaugaucacccugugggcuguuggauacauccuggacuucaauucagauucuuggcuuuuaaaaggaugucuucuaguagcauuguuuuuucugacaucuuuguuuccaagguguguauauuaguauuucaaagcugauuauugcauucccaauguaacuaucuacuucuguucucuaucagcuggaauuucaaauugacauuaagcauaaauauuacugaaccaugugacagcauccucagggugguagggagaaaggguuugguggcauagcuuugggcugaaagccaauuguucaauucaguagugugguugaacugacaauugauggaaaguaaauaaugugggccacauauuauaucauucaguuugucagcaaugaagagaguucucuaaccauuuuauaucuugaagcauuugcccacuuuuuuacaauuuucuuccucgucuaucucuaaauucauuuuacacuaguuauuuuucuauuugacuguuuuucgguaaagcggccugauuauaaugaggggagguaaugacacuguaaauacauuguaguuuucuuuaaagcuaacacacagagaaaugugcaugauuauacugaugaaucauacgaccuggauccagguuuagccuuuauacauaccagucugaucucagacaagcuguucuuucucucugugccucaguuucuucaucuguaagugaguauaauugcaauaauagccaguucauggcuaauacguguaaaugcuuagaacaguaucugguguguggucuguacuuguaaucaauccucucauauugcagucucuucccugccuuauugacaaggugucagccccgcaugagugugggugucauccuugagucccuugcauccuugguuuuccccuuaccuucgcucccaacauuuauccugccaagccuccuaccuggucuccugccuucauuccuauaguguacccacauagcacucaggcagaucaauuccuacaucauauucuuguuaagcuucuugauccagacugcuaugugacaccugucacaaauagcaagcucuuauagauugggaauucauugaaccauuuaauuagaccaagugcccuccuuuucccuauaaaaucuuaguucagacauggaguuugcacagacagacuccauuuuuuccuauuguagcauguaccuggugccaaguugagguccuugguucuucuuagauaugcuuuuaucuuaauuauggcuaugguccucaugcauuuuuuuucuuugaacuaaacaauuuaaaugcuccugucauagguacuaguuaccaaccuuugccuuccuuuccacucuuuuuuaaaauccaccacuagccauuucugauggcaauuuuaagauauaucuggguagacacuauggcagaugccaacaagagccugcugacaggagccugacauagcugucuccugaggggcucugccagugccuuacaaauacagaaguggaugcucacagucauccauuggacagagcacaaguccccaaugaaggagcuagagaauguacccaaggagcugaaggggucugaagccccauagaagaaacaucaaagaacuaaccaguaccuccagagcuccuaaaccaccaaucaaaaaaacacaugguggaacuuguggcucuaccuguauauguagcagaggauggccuagucggucaucagugggaggagaaacccuagguccugugaaaguuaaaugccccaauauaggggaaugccagguccaggaaugggaguggguggguuggggagcagggcgagggggggagggauaggggauuuucggaggggaaacuaggaaaggggauaacauuugaaauguaaauaaagaaaauaucuaauuaaaaaaaaagauguaucuggguaaaauguauuuguuuauaaggugacuauauugaguuugauauggaaggcauuucuguguuuuacuuuugaaacuauaguacugaccuuuugaacaguuacgcaauccucaggcugcuuguuguagcaguaagguuguuaguguguggugacuacuguccuuuuagcuguuguguauuuucauguccuuucugcuucugacaccagcucagagucagagugcuaagguucuguacaccugcuguuucacaaacaguucuugacaaaaacuugcuuacaagugaaggugaauuucuauuuacauuuguauauuuugguauauuuaaaaauuauaugaaaaauaugauuugucacaauagaaauauaaacuauucguugaaaauauauuguuucuacgaaugaaauaguuauuaguaacuuagaggaacuggaauguguacuuuuggaagguuauuguacaguuuucucaugugcaagaauaaacugacagucaggggagaaagcugcugcugguguaacugucauuguuauuggagaauuagaagaauuaacaugaaucauaccagugccuuacuucacuaacaugcucuacccuuuucuuuacagguuuuugguuggcuauaagaaccuuguguacuuaccgacagucuuucugcuaaguuccauuuuuuggauauuuaugacuugguucaucuuauucuuuccugauauccuuuaagcuuagaugaaaugcauaucuuguuuuacuuucaaaaaucauuaaugccaacugggcaugguggcacauaccuuuaaucccagcacucaggaggcagaggcaggcagauauccgggaguucuaagccagccuggacuacaaaucgaguccaggauagccagggaugguuacacugagaaacccuaucuccaaaaaccaaaacacaacaaaauauuauauccauuuguaacagcauacacauguccagucuucaucgcuuuccagacuuccuucuuuguccuugcuaugaagcuguuguaacacugcuuugcuuauaugacaagaagaaaugugauggggaagaaguaugcuucuuagcuuauugccuuacuuucuauguucugcgucucuuucugauaaugguauuucugaaaagaagaggguguuuaucgaggaaauacauaagagagauauaaggaucuuucccauaggaacgaagaggauggcauaugaguuuucagagugcacacaucuauagccauugugccuguuuuugcuuuaauacuguuuaacuguuuaauuaauuccaaccuuuguuucuaauauggcuuauuuuccuuuaaccuaaaugaaagcauaaguaguauagauaucacugggcuuaaaagaaaauaucucuaaccuuuguccuguaauuacugauuuggugguuguuuuaaugaacaccagcuuucuuauuaccacugaaggcuaccacaguuccuaucagaucauuuauaggugacucaguuuucauagaagcuaggacaggggacauuguauugaaaagggaugauugguauuuuuaugucacugaacaauuuuugaaauuauagguaaguauaagcaacuucaguuauucuagauuuuauacaucagauuauuuugauuuugcagaaucaaaaauuaacaagacauaaaaucccaucauuuauuaaccucauuugcagaaauucucacuugacuguaaacuaggaagugcuugguacuuaaguuagaaaaauugauuuucauagcuagauagaaucuuaagugucaggaggaacucccaugcuagagugaaggcaugcaagccaguagauggcacagcucacucaaggcuaguguuacaugcugcuagaacugcccugugggucagcugcuguuuugccuguaaagacauagcccaaauauuuagacuugccuuucucaggcugccaauuaggauugguccugggcuucugucccauagccagugaucucuuaugggaaaagggugaagaacacucuggaagcauguugucuugguucuaaauuucaggaccuuuuucuuauuucguuguugcagaugagaucucacuuuguggugcuggcuacccuggaacuuacuguuuuggccaagcuggccccaaauucacugagauucagauaacucuccugaguguuagaauuacaggcauguacuacugcucccaguguaaaggcuggcuuuccuuccugucagggauuugaacccaaggcucucacaagauaggcagggauaaucacuaacaaagaugaccuuuucuuuauguuaaugugccauugggcaaguuacuuaacgucaccaagucuguuuuucugucagggggcaauaguaccaaacucuugaggaagcugcaagaauuacuaugcuaugauguauaaagagcuguauacaguccucacuacauaauuggcauuuauaaauaauacuuuguguuuuagggacaacucagugauuguuuucuuagguucuuucaugugugcaguaaguaauguauuuggauuuuaugagaaggacuggaugaaagaaaugagccuuaguaaugacuacaauuaagauuugguaagaaaugaugagccacugagugcuuccuuuaugguccuggcuauacuuaagucuaagugcuagauagguagguguaaagcccuauaugauuucagagucagcuauagauaagacuuaguuuuuaggucaaauagcaaauaaucugaggagcuugcugugcugauauacagaccugugauuccagcacuugggagaugagguaggagaauggaaagcuugaggcugaccugggcuccacagugaguucaaguccagcacaaacuccuaggucucacuuacaccagaaaaggagcaaaagagggaagagaguuggugugacucaugacugagcuuucaagaaagcuguccuacucugauuuaguaguaguacaggaauguguguguccacacagagcagcucacacuagccuagaauucccucuguaccccaaguuggcuucaacucaaaaaccuccugccuuagccuuccagguguugacauucagcucaaaguucaguuuccaacuuugaguaguaagaauugagcaucuguuuuauggccucugaaguuaguagaagguagcucaguaacgccuuguaaggcaauacuuacugugcugggccaauaguauuuacauuggguaaagucaggcuuacuacugucucauugacuuauuacugcacacucauuucuucucuggagcaaaaugguacuuuguaacuuuaaaaaguaccacuuuaaaaacauuuuaaaguggacaguuuuuaauccuuauaaucuuuuucagaauuaauauacucauauuaacagcuuuucccaaauaggauauaauguucaaagagggcaguggguuuauuuuuguuuguuuguuuguuuuuuaugaauuaguauuuucuuuuacuuacucacuuuacaucccacucacuuccccucccagccacccccucccacauucuuucccuccaucccucuuccccuucucgcugcauggguauccccuacccaggcacaucaaggccaucuuccuucuauucuuccauaaaaguccccaagcuccauccacuguuuggcuguggauaucugcaucugucuuuaagucagcugcugcguggagccucucagaggacauccuugcuagacuccuuucugcaagcauaauagacauuauaucuaaacccuagauaggaaacagaagaaggaggacugccaguguuucacaccauggugcaaguuugguaccugugaggaaaaggucagaagaauuugcuaucuuaauagaaaagguucagaaauacagacaugaccauaaugguauggucucauuuuccccagcauggucugcuuuauccccaccucacuuuacucguugucuuaaaacacaccccagccccugcauuucuuauagauaggauacauucuggguugaaaguuuuguggauggguugauuucccuaucgcuccguuggaguuccugccuggguacaggcagugaccuuuccaguuuccauauccccagugcugugaaucacagcuaaagucacccccauugauucuuggguaccucccauaucccaggucucugucucuuccuggagaugcccccuaccuccucggcccugucaauugcagauuucuauucauuuucgucgccaucuggccaucaggaggacaguuucuaauuuagaacaguuacaagggcagauuacuaaagucuaggaagaaacucauguaagcauuuaucuacuuuacagggaaagugcauugaaaucucagacccaagugcauuucuuugaauugucuugugagaaagagcaaagaauguguuucuggauggucugaggaaagccacaguuacaccugaagaacuuauauuuggaaggcuuagaugguuuuuuuuuuuuuuucaguuuucagaaugguugcugguuuucuuuaguauuuaaaaugggcuucaacaaugaugaagcacuaguuacugacuaaccaggagcagacucuguaggaucagaacauggaagagggacgcuuugggugguguguguacauagggaagucaggggugggaugcaggagagagagguucauggggacaaugguaacauuugcuugcuucacacaugaugcuuuucucaguagagaucggcuguguuccuuaacauggcuuuaacauacagcagguagcccuuuguauuuugcuuuuauuuucagcaucauggccuuucucuauuuuuucuacaagacuugggcaacugauccaggcuucacuaaggcuucggaggaagagaggaaaguggugagucuucuucuguuguguuuuucugagagaugcagccaugcuggccuuuggcacagcugcaucuauagugucugcuacuuaauagguacaacauaaaaugugggcagauuagaucaucaaaaugagauuucuacacaguuacacuuugucauuuguauacaagucuuuuuagaaacaccuauuuucuguaaaaagugaucccucaucaaucuuuacuagacuugaguuuuauuagacuugucagaucucccucuucauuacaauuuuagucuugaaugccugccugcauguccaagugaugagaauguaccuuaucagguuccugcuuccuaauagcugaggcgguaccuuuuccuccucaugugugaaauugccagagacauggccucuuugcaucuguuucuggaguuuagaaguuagggagaaccuugucuuccaccaccaaaggccuguccuggaaggccgagcgagcgagcgaggccugugcuugcggcuuuccguuugggugcuuauccuucaugagucgggugugugugugucugugucugugucuguguuucuuucuuugccccagcaagcuguaacugccauuugugagaaggugguaaagggguauggaagaauaaucuuuagcagucagacuucuuggccacugccuaaaagaacaccuugaaaaguuacauuauuucaagaauggagugacuggguugagaguauuccacauugcuauuccggcuacuuccgaagcuggagguggcauaaaagcugugcaaauggcacauaacuguggauagcacugcccaguuaaaugcacccuaaggccagguguuugucuuucagaauaucgucacccuagcagagacuggcucucuggacuucagaacauuuugcacaucaugucuugugagucucucuuguuaauacuuuguuuuucauaguaagggcaaauucuuaguagcauugguuacauaagcauuuauucaauccucauggcaugugaaugcacuuuccuuuuuaccugguucuaauuuuguauuucugucagaccaguuuuccacuaugagcaugugaaagaacauguauacucacgaagcucuguggcuaaucucuguaacuuauccauagugcuuuucauuugccuuuccugacaagaaguggaugucagaauucacugcaagucagaagcaccuuagcaucuuaaagcuacauagcugaaaccuccuacuuugcaguugaguugaggcuuagaagggagugggugauuagaagaaccugaaguggaacugugauuuccauuuucuuauuucagugcucaugcugaauguggcacugccugaguuuuccuuagccaguaugaacagucucugaauucagagcucucuuagugaggcucauuccugucacguacagaaaugccuauuaguaaggccuuccagagcuucgcagugacugaaucaucuauuugggauuauuugugcccaucuucuaugacguaagauuaaaguuuugcuaugaucuguugcugccaagaccauuuuugcuuaggccucucuuaauugcccucagauaaggaagccuuuaagaucacuccauugccacgugugcaacuccuguguggcucgcuuugaucagcacugcuuuuggacuggacgcugcauagguaagagacuuaacuuuuuacuuaaccucuguggugaaguuaagcacguguaguuaugaauguggugcagaaagaaauagaaacccguccaaggucuccauucuguagcucuucaagaaucuuuacaauaaagacuugggaaguaacuaacauuguuaaugacaguuauugucaguuguguaguaucuuggagauuaugaaauauuuucauguguggucucugacuugaucguuaggacacaccugugagguuguuauuacugucugcauuucagagcaaagcuguaaaugauugagaucaucuuugucauauuaguucuccacgccaaaugucacacucucuccuuaggugugacuugacugucuuacuucucuuuccaccugccuccuuaagugagccaagguuaaucugugauugucuucacuaaggguuugcuuuugucccccuggggaaccugagguggcagaucagggagauuccugugauacagucggaugaucucuuuucuucuggggauggggucccaaucuuucggucauaaagauuaaaugauugauacucuaccaguuaaauugaaugacagcagggaaaccgucauaaggggcccaacuacuauguguuuaucaaauuauauuugacaguguuucugucuccauaguccuauuugguugacacagaccuaugaagugagagaggucuggucucuucuugcuauuacaagugagacugugggaucagagaaaccaaguggccuugccacaguaacacaacuaguaaucauaaaccagggauacuugucacagugugucuugaugguacugaauauuccugcuucugaggaaaaugagacucaaauggugguaacugaagaucauuuauguuuuuagcagcaaaaggcucccacauucaccaccaagugccugacauacuguaggaaggggcucgguugcccaucaccccuuccuucugcagccuuucuguaggcuguggguccuccucugcuguuuuuaguguccaccaaggaugguguggacuugcugcuccucacacuugcuguuucuguucccuuucaaguuagucuuugauguuccugaacgcauuccaugggaagagaccagaugugauuucgccugcuaccucccacuaacaguggaggccagaccaaagcugguucugccgaauucacuuugcucuaugcaaacugucuuuuucuaggcuaguagggaauauuaguuaacauggacaucugacuaucagagcugucugcuuuaguaguauucaaaagcaaagcaagccuuauuucuguuuacauagaaauuuuuucacagaaaaguaauauugucuagggauucacaggaaaaaaaaaugucaaauguuuucuuucuuucugacucagguuuuggcaaccaucaucauuacaucuucuucuugcuuucccuuuccaugguaugugacuggaucauauauggaucuuucgucuguaaguauaaauguuucuuauaagcuuaugcacccauacccaguucuuuuccuugugagcccuugucugucacauucuggccaguauguaaacuauaccucuagugaaagaaugaaauggaggccuuuaagccucacacuaagaaacuguaagaaguauaauaagagguaacucugcaguacuuagaaagaauaccuggauaaaucuaaguggucaaauagaaauugauuaugucaaguauaggcuuacccuccugugaagagaaacagcugccgggguacaaagcacuuuaccuuagugaguaaagaagagagaaaaagaaggugcugguggugggcagguggaaggauaguggucauaguacauuaaagagcaaagcucugagaguugagaguguaagccauuugagaagaaucaaaucaaaaccaagaaaccaggggaaagcugccacgguggagcaguugggaagaaaauauuggcucacuuguucuccaguccaggaacagaaauuagccuucaguagcauuuaauaaaggugccuagguauuacacuggggugacuggugaaggacaggguuucaacuaaagucuaaaggauuggugaacucuuaagaaguguguaacuacacucuucacacccugaaguggguguccuagaacuuuagugcuggcauuuauuuaucuaaguauuuagaacuucaggcuuuuaaguauuuauguauuuugaagacugagaauacuuagucguggacuugacuucugaucuuucacaucugguuuccccucugguuguagccccucaugucuuagguuauugcugggagcugaaguccucagaaacacaauguuuucuuuuugucucuaccucccaaaccuuagcucuauuguccucucaugcugucucuuccuuguuuaaauguaggcaugggggggggaguuuuuuuuuuguugucuuuuaucuauuuuuuguuugcagggugggggugaggugggagggagauaauuugcaggacucaguucucuccuuccaccauguaagcuucagggaccagacucgggucaucaggcuuggcaucaacagccuuaauuaacaggccggucaccagcacuaagacagcucacuguacacuguucccugacuucccugucuauaagcagccacaguuacagauucuauuuuguuuggguuuucuuacuuggagguugcuuuguacucagauauagucauagugcaggcuuuagccacugccagacccuuuuccuccugacauguuggguguucauucucuagggaaugcuuuauggaacauaaccauggccggcucagacaggucuaauacagucaaaagugagcuuaguccuuguccaaauccauagcaguccugagcaguuuguuuguuuguuuuucaagacaugguuucucuguauagcccuggcuguccuggaacucacucuguagaccaggcuggccucaaacucagaaauuagccugcuucugccucccaagugcuggaauuaaaggugugugccaccaucgcccggcuaguccugagcauuuuuaaccaccuuagauugauugucuuauaagcacaaaaacauucaaaaucuuaaguuucucugacagcugccuucuuagacuugaccaugaagccuguucguggaagccuucuaaguuggcccauggaccagcuggucucuuggacuugacaagccaaaaggagccagacuucgcaccacccuugcuucuccucacuaaaaauaaucuuguucuuuggugucgagguccagcauaagaccaugcugauaaggacagcagcaauuuuccaucacauucaaucuucccaaguugguuuuuuuauuacagacauuuauuuucuucccuucuuuguuuucucuuucuggcuuugaccaguuuucauacaauauuuugugaggaguuacauugauucacacuucuauagcccagcugagcaugcuuugucacuaaugaagguacuaagucauuucucauuucuccagacaguaaacaggaguuugugccccguugcucuuaacgaggccucauugccaccccuccuccuuugucuaccguucauguuguugucacuagagucgugcuguacaccuccucacuguuagcuguuucugucucagcacagccucuagucacuucgucuuuuguaaggccuuuuuuuuaaaguagaaagagguaaaucagaaagucagcauccuacaaguuacaggaagaaagguauuagaucauaucaagagagggcgugugagugucagaacuaccugaagaugagaaugacugguguggaauaagaauucugucaugaaaggaggugaauuuggauggaagggaaaugggggagaauugagaggggaaaccauaauaaaguucuauuaugugagaaaaaaaaucucuuuucaguaaagggggugggugucgaguucccugucauuagccauugacuaccugggaaggcuguauuagcauggauuaaauuguuauuguuaccuugcauaagauaauguagaugaccacuugcagccauaucuuugauacuaauugugaagucacuguugguggugcuguuaccuaagggggggggggggggaaccaggaggaagcaguagaaauccauaagcuaaaagaagcuagcuauuuuccccauucaacagcuguuucuuccaccugcuguggaaauuauauucuugcuuuuucuuucucccaucagguacauaggaugccucuuccuuuacuacacuaaugaggagcucuaaaauguaucauuugcuuuaauguguugcccugauuguuacucagcucuuggggugcuuuaggcauauauucauaaaagaugguucgaauuuaaaaaggagaaauagauauucaagacuaaaauggacagucuugggcucguuuucuuccugucccaggagaugcucgugcugccuuggggggaugucugaaacugcguaaagauugucagagaaucaucaaagaacaaaucugcagaucucacuucagaauugaucuacucuuuauguacagucacagagcccaggagccccgugaccuugaagaucuguuuccuuguuucugccgcuucuuaccuguuuuccccuugcagcugcucucaguucauaggucacucuuaauuggcauguagauuuccuggaggagaaagugagcauuaguguuugaaucuugcucucuauccuugugcuagacuaaucugucuugugaagcccuuuauccuggccuuucuuucuaagaggauuauggcugguagcagagguacaccaagccucgcucuccaucagagguuguguccugaaggcauuuggauuguguauuauguguugugcccacagcagucccuguucaucugaacauucaguguauauauuuaguccauaaugucccuuaaagagcauagcuuagaugucaucaucugcaauugucaagcccuuaaaauuuucuggccaauguauuuuacgcugagugugcuaagugaagauuuuucugggcccccugguagggugccaucacagccucacgaccacucaggcccguucucauugccaggagcugagcuggcauuuagaaagcaaacuucugaguuggauuucugcuuuuguuuugguuguuuuguuuuacuuuugaggcucguguaugcuaaggauacuuucuacccugaacucucuccccaucccuaagggcgaauuuagaucuauguuauuguugcucccuaaauagaacuauauaauuuuaaucuucuuggaggauauuuuuugccauuguuaauaauucuuucuuuuuuuccccauguggauuuacagacuggucaaaucauugugccacaacauucaaggaagauggacuauggaccuaccucaaucagauaguggccuguucucccuggguucuguauaucuucaugcuagcagcuuuccacuucucauggucaacauuuuuauuaauaaaucaacucuuucagguauuucucaaauggcucugaaugucauuuucagagacuaauaguuguguagaaagacuugacuuuaaaaucugaagaccagcguccaguuccaccuccaaggcucccucugugagucuagcaugccguuucccacucuucauuauuaguuuccuugucuguaagaugaggacaguauuguccauccguucucaccagcagcuuaaagguuagaauaauaaauugcugagacuguccccacuuacaaauggacuaaucuggccuuuuaguuuuaugguacagaaaagugaauugaguugcucagagucacccagcaaguggagacuugguccuucuaacagucccauucaggggucuugucuucuuaugugugaaaacaugauauaaacuguaaaguauuagacaaacgcaaggcaguuacuguccuucaauucuucugauucuauuaccuuauauaccacuuagguagaugcaagagaggggaagauaaaagacaggucacuaaccaguggacaaagugaacacaguugaaaaaguucauacacagggcaauaacagccucaguuuucugcggagcuuccuccccugcccugugucccguuacuaugggcugucucuguggaaugggcaacagugaucauuuuagcaaguuauuaauacugggguuuagacuauuauucaucagaagcagagcagaucccacugggggaauaaugguaagcgugagaggacaagagaaggacggcgagaagacucuggggaaaggaacugacccugacgaagacagcugcucagguagugagcgagagucagugucacagggagugcucacacaguugauacuaucauuuauaagaacacuuuccaggacauuuacacaucauucacucuugagauagggaacaaaccauaguaguagcucuauuuuauggacaagaaaacaucaucuaacaaaggucuugcuuuaugaguucagacauccuuaauagcuaaggugugcauggagucacaacaccugaaaugcaagcucucuagagguuaaagcaugauaauaagaaguucaaggccaguuugggcugcauagcaaaaccugucuguacugaggaagaaaaguggacuaaagguuucagauaauuuucacaaacaagaauugcacaauuguuuauuuaaggaacaaagcaauccaguucuuugaaaacuuugauuuccugaauauugugauuuaagauacuuuuaucugcauuauagcaaacugagcuugcaucgccuccugauccucagcgugcgucuuagacauuuaucucagauccuuaacacaguaugaggaggguggcuaauaacuccguuauacaaauuggauauugauacuugggguguuccaagguuuagauuagcuaacccugugaacuacuguggucuauaaugauuccagaguuucuuaauuaccuuaguccuuacccuucaaaguuaugacuuuaggcguuguccccuuuggugcauuagccuuuuuaaagaacagcucagaacucaaaauugugcuaauugcacugauacuaccugacccuauuucgguuguucaacaaauguguguucuucuguugaaaucuaaauauggccauaagacaugacaagaauuagugaaaagauauuuuuauaauuccaaguuaaugugcagagcuuucuugaguguuaauaaaauccagacaauaagucuagccauauuuacaugguaaaauacaggguaagguugugacucuuuguccucagugugaucuuuugcuggaagucugagggugagaauacuaaacaguugccaccaucuuauaaugcgcuuucaagaauaguagagccaugauguuauaauucuuaauccauguuguaauucuuauaauuccaucuuuuucagauugcauuucugggccuaaccucccaugagagaaucagccucuuaaagcaaagcaggcacaugaaacagacauugucccucaggaaaacaccauacaaguaaguaaauucugaucuggucaccaagucuuuggaagauucccagguacugauuuccugacccagucccauuuucuaaccuaucucauggaauggagcccguuuuuucuuggaagccucaagguuagguuuuaagugauaaggucauaugcccaauggggucaggaauucaguccacuggacucagugcaaauauaaguuacuuugaaguuuugccaagauggggauucuccaguugaaccaagugucacaagguugugucuugcuggcaaggagucagugugagauaguuaagcuggcaugugucugacaagccagccucaggguucucuguagaaagcaucagguagugugcuuugccagaacuuccgcauggccuucuagccccagaaauucuuuuauucucuuuguaaugugcccaccugggucagggaaaagcugcauuuuuagauuuggaguauaucucguuagaacuugagcucuguaaaaccuguucccaguuugaaaauuagagugcuugguaggaacucugcucuugucaugugaaaggacaggcuuugaagcuuaucuccugccaccuacaucagugucuuggaggcugggcguauggcagaggugacggagagcucucgagauugagcacucacuguguaucucaugagcagucugcuucaaagccugcucuuaguguuuggcgguuagacaaaggaaucagacugguuugagauuacaguguggauuuauagcggagagaggagauggcugugcucaggacuggagagugguguaaagcuggugaugcucacuucaaacuggcagucauagucugugucuuggugguuaagcuaaaggggugaauauuugcuuuauugaagucuggaagcaggucagagguggucgugcaugccucuaaucccaacguucuuaaaauacaggcgucucgugauagagguagaagagauguauaucaggcagggucugauagaggagggagggcaggcugaggccuagagaaacguccauggagcagcacaggugaaaguugagccuuauuugcuaaggauaagaacaugagaccaaggaacuaaagaccuuagagucacuuugagacuaaccuccaaauuccuguccaaaucaagaucuuacuucuuugcccacuuguuagcaaauucaguaauauuucuugagcuugacccugugauugccagcaugucuucccacuguuacucagucagcccucuuccugaaaagacguuuuccaguuagguuagucauguagagagagccauucuaacagcagaugguccaggggugcauacacaguuugcuguguguagauuggcuuuagcauaaaagauagaacauaggugagugcauuaaaguuaaguauucccugugcuggaguaagaacuguuucaggaauuugauggagaaaaagugaugccaaagacaauuacaguuggaggcucuaaaagaaugugaauaucagcuagaucuugagaaucagccagagauaagggugagagaguguuccaggcgcaaagcucacaaucaugggagaacagcugacauaggagugggagguuugcaggagucauugaguauggucuugaauacauaaaugaagagguuggauaggcuccucugagcagagagguaucuugaaaggguuaaguuuggaaaguaagaggguguggauguauaaggguucuacgggacaagacagucuucagugugucagguaaacuggaaagaacugggacaggaacaucauccagaagcuugggaaaaggccaccuuccuaguuacagcucuagccuaugugagcucucagauaaaguccggugagaauggaaggaguaagguuaguaauggcagugacugggagcgaggagaagugauggagaaacauauauuggauuuguugaccugcugucagggucucucagugggaauuuggguccacagauggagcuagguuucagcuuuaagguucuggccacucaccucuuaccuucgcagagguccucugagaguguggguuugcagauacucagugaaugcuugugguuuggguggacacuugucaggaucagcgcaagagaugcugagcuguccuuucuucuuuucuucacagccucggauucacacagaaccuggcagauuucuuucaguguggcugcuuuggcuuagugaagcccugcaucauagauuggacaucccaguacaccaugguuuuccacccagccaaagagaaaguccuucgcucuguaugaaaaaaaaagcaccucaaaaugcacucugacuuguuuuuguuuaugcuggugcucuuauugcugaaagugaagugagauauucagcuaccacggucaaaggauaagggauacagucuucagcaagaguggaccuuccgucagacccagaaagauggccuguuacugagcaauuuggcaagcagcuuuuaaaaacauaugaaaauauuuuccccaagaacaugaguuacuuuugaaaaaaaccuaauagucacugauuauggauaaaauaaaguauuuucaaauacuauauuggcuuuuuaaaaauaguacucuuuaaacuuguaauuuuugauaaguuauuugucuuuguuguaucuauaaauauguaaagaauauuuaaauagauguaucuguuuugcuuucacacuuaauaaaaacauuuuuuuauacuugag

SEQ ID NO: 3835 - RNA, 1668 nt, Mus musculus
agagagagagagagagagagauguuuuuuaggcuccuaucggucuccagccaacaaauucacuggacagugaccccacaaguccauucaaccuugcaaauuuguacucuaggacacaccccucagugugccauggcuucagcacacugguguccucuucaccguauggacaucuuugagcucuuuguguuuuauagaaacuuuccuggccccaccgagggugucucuguuaacgaucaggguuuuuaaccucaucuuugauguuccauucuugaacguuugucuuuuuuuuuuuuuuuuuuuuucuuacccuaagagcuuggcccaaaacugcucgcuuucuuuggaauggcacugauuuucuuccucauugaaaggaacaagaauguguccugcuaacugguaacuagaaacauuuccguucccugcuguaagcccagacccagccugccuuugcuacuaguguggaugugagugugucuucuguuguuuuguuuguaauaaaaguuucaaaccacgugucuagccugugaccagggccaaacccugagccuuccagugccccugaaggguagcccuucucagucuugucucccagcaacggccguacacucucauacugugaauuugggagguaggaaaaucgaaccccuccucaacauaguuuucucagucaccuuaggaguacaccgcaccaacauugcuuaaaacuguuuccuuagcaacacccucuccccacucuccacgcccagaugucucucccagcccacccaggaucgcaacagcagccuguguacccauugcugccugacuugguucuguagccccagagugccuccuggcucagccaccuucccgaaacacugggaaguggggcugucugaaaggcacauuuccgacugggucaugauuuuccuuuuaaguugcucgaccuuggacaaaaugacuuuguacccauuuagaacucugucugcaaugcuuccauuuugccuuuuucuauagauaggcuacuuuugaaauccuaugcaaugccgcugcugagguaccagggggagccaaaaguuuucuucccaggaggccaagaauucuacagaaguccuuuuaacuuaagguuggggguggggugggagugugacaagggcaagacucacccagaucuuccucugaccuuggggacauuuuaaauuuuauuguuuaaugcucgacuuuaaaauucugugugcucaaauuccaacccuggcaaaucuacuucaaaagcaaaaacaguccaacuuugcggauaucgaaugggagguuugcuguuuugaccugcuugucucgagccgagcgguuuaugaaacauguucuauaagauguacauuuuuuuuuucauuguaacauagaaauuguaaauauucgaugaaacugcugcauuuugaugacuuuuuucuagccauuuuuaaagagaaaacuaggaauugaguauuuuguguacgguauguuccccaccacaccaccaccaccccuccaucccucuccccccucuauuuaauucucauuugucaucagguuuuuggguuugagaacaauccgcuggagaucugccccaugucauagagaauaaagcugaugauuguaccagucuuaaauuauucaugauccaauaaacuuaaugcuuauuuauucauac

SEQ ID NO: 3836 - RNA, 1668 nt, Mus musculus
guaugaauaaauaagcauuaaguuuauuggaucaugaauaauuuaagacugguacaaucaucagcuuuauucucuaugacauggggcagaucuccagcggauuguucucaaacccaaaaaccugaugacaaaugagaauuaaauagaggggggagagggauggagggguggugguggugugguggggaacauaccguacacaaaauacucaauuccuaguuuucucuuuaaaaauggcuagaaaaaagucaucaaaaugcagcaguuucaucgaauauuuacaauuucuauguuacaaugaaaaaaaaaauguacaucuuauagaacauguuucauaaaccgcucggcucgagacaagcaggucaaaacagcaaaccucccauucgauauccgcaaaguuggacuguuuuugcuuuugaaguagauuugccaggguuggaauuugagcacacagaauuuuaaagucgagcauuaaacaauaaaauuuaaaauguccccaaggucagaggaagaucugggugagucuugcccuugucacacucccaccccacccccaaccuuaaguuaaaaggacuucuguagaauucuuggccuccugggaagaaaacuuuuggcucccccugguaccucagcagcggcauugcauaggauuucaaaaguagccuaucuauagaaaaaggcaaaauggaagcauugcagacagaguucuaaauggguacaaagucauuuuguccaaggucgagcaacuuaaaaggaaaaucaugacccagucggaaaugugccuuucagacagccccacuucccaguguuucgggaagguggcugagccaggaggcacucuggggcuacagaaccaagucaggcagcaauggguacacaggcugcuguugcgauccugggugggcugggagagacaucugggcguggagaguggggagaggguguugcuaaggaaacaguuuuaagcaauguuggugcgguguacuccuaaggugacugagaaaacuauguugaggagggguucgauuuuccuaccucccaaauucacaguaugagaguguacggccguugcugggagacaagacugagaagggcuacccuucaggggcacuggaaggcucaggguuuggcccuggucacaggcuagacacgugguuugaaacuuuuauuacaaacaaaacaacagaagacacacucacauccacacuaguagcaaaggcaggcugggucugggcuuacagcagggaacggaaauguuucuaguuaccaguuagcaggacacauucuuguuccuuucaaugaggaagaaaaucagugccauuccaaagaaagcgagcaguuuugggccaagcucuuaggguaagaaaaaaaaaaaaaaaaaaaaagacaaacguucaagaauggaacaucaaagaugagguuaaaaacccugaucguuaacagagacacccucgguggggccaggaaaguuucuauaaaacacaaagagcucaaagauguccauacggugaagaggacaccagugugcugaagccauggcacacugagggguguguccuagaguacaaauuugcaagguugaauggacuuguggggucacuguccagugaauuuguuggcuggagaccgauaggagccuaaaaaacaucucucucucucucucucucu

SEQ ID NO: 3837 - RNA, 5353 nt, Mus musculus
acucauucuacuuuuuauuuggcauuuguccauuugauacauauauacauauauaaaaagucuguacaugguaaaaaauacaaaauaagcauuuccuuauaaauuaugaaguuacacagcuaccuuuuagacuuuaaagaccauugcagagaaaaauaaugagagggacacagccagcccuucauuauggucauucacaauaaccucaguauaaaacauccauacaaaauauagauacacaguagagcacaucucagguaagcugcccagacugcaaagcugggugaaacgugucggagagucagacaaguccacaccccagugccaggagcuggcacucugaaaaggcucccguuggaguagcagaaggacaucaagcagagcacuggauacacaugucuacagagagaaaucgcuuccucccgccaaaggagcaucaagaaaugaaaagcuugcuugauagugcuuuccccuuagacagggagacggugcccuuauucucuuucagaaucuccugugcuuucuacucucaaggugaaaagacaggauggcugacugauacccccugcagaaagguggccauccaggaaguuaggggucagaggcuugguguuugacaggaccuggcucacaguaagcacuggcaguggaacuagggacaccccucuacacacacccugcacgcggugucuaaaauaaauuugcaauaaauagaugcaauguugcucuuguagaaaagacccacgcucccgugggaaggguuguuuagagguggcagcacggcgcaaggaaaugucucugggacaacaggaagggugaugccaccccugagaagguggugggucuguugugagaagaggcaggauccaggauccugaacagagguggccacgugggcguucccucuccaguuuccaauugcaacagccccagagccgcuggaggggcuccuaggacaccgugauuuccucauccuccucgcccuccucauccucaucagaaucagagaagucugacgguuuacccgggcugcucgagugcgccggcgaggcaggcaguggcccuuccagcaaaugucgcgggucugcgggcgcgugguaggccaggcgggcacccggauugucuuccuccucauccccaggucccuucuggccuacaucacuaaggucuggauggggguuuaguuuugugggaagggucugcucucggcagcccccgcuagacaggagcucgcgcucuuuggaguuccgccauuucaugcgucgauucuggaaccagauuuucaccugugagggaagaaccagaaacaaguuagugucugcucacaaugaggggguggugguggugguggugguggugguggugguggugguggugguuggggcaacccuuagaagccaggcuuggggaacauguaggaaggcgcugcccucaaggugauuucuguguuguuccccaccagccuuguaagcccucuuaacucuugcuccucuggucuaucuaccugccagcccauucauauuggaucgaauucaugcuucauucacucguccccauagccaugacccacccauccaucuauccaauucauguguccauccgccuaccccauacacacacacacacacacacacacacacacacacacacacacacacacguacguacguauccauguacacauccuccaccugcauacacaccuacccaugcauaugcaucuaucuauuuauccauauagcuauccauguacccuuacguccauccauccucucauucggcacuugacucagcugggcaggugggggaguaagauagaagggugggguggggugggguggaaaaggaggcugcucuggggaaaccucaaauaacuuggccuggguuuccccagcugcuccgccagccuaagaggcaccagagagcccuugcaauugauuggcaggggcuagcauggcgugugaggguggggcgguggaggccgcucgcaccugcgaguccuucaagccaagcuuggaggccagcuuuuuccggucuggcuugcugauguacuucugcuucuggaacgucuucuccagggcuuuccgcugcacgucagagaacacggcucugcgcagcaugccccggcgaggcuugccgcgagcagccagcggccaggagaaggucccagggauaggcacgacgcuggaggaagcugcggggugagggaaguagagaaugagccggguguccugcagagccgagcauccgccucucccaagcuguuuucacuagcguucucccuccuuuuucccccucgagucccuucaucucuuuaaaacacuccuuuuucuccccguagagaauagacggagaaccuacaaccugucugagugaaaggcgcuuuccgcacaaauaacuuucgcuuucaaccgugcaaacccggauuaggaaaaaacccacgaaaacagcagccacaauugccuuuugcuuacccgcccccccacuuccauucaauggucuuacagaaacaguccgcaccaaacagcuuaaauagcaacagaauaaaauaaauuacagaaaugaaaauaaucccacagagaccacucagcacaccuccacuuucccccccccccaagacccacggacacgcaaucaccuuggugcugucaguaccuuuuaagacaaggcacuuugcugguuuggcagacagaaaaaagucuguuuuggcuuaaaaaaaauccagucauucaucguuuuaaaaacuacauaugauuuuucugccucccccacaacguaaagaaaucagcgugaauacaaggaaaguggcgucuaauuagcacauugaccgcuucccacugggaauuggcgcuaugaaaagggggagaguuucgcuuuaagggagagaaaaagaaaaacaaaaagaaacagagacgcuaacgaagcgugaaugguaauuguguaguaaugaacuaaccgcaaaaggcuauggacaagcagcgagagccauauauuaccgggacaaaagagguuuacacucaggcuaaacacaacugcaggcggagacgauugggagagcggugauggcagaggcuucucuacccccaaucuuucacauuaaauggacacgaaaagcuauuuauaaagcucggguuguuuuuguuagaccauugagacccgggagaaaggagcaaauuccauugucggcaaaagccugaauggugguggaagagaguuucuucucucaaaaaaaaaaaaaaaaaaaaaaaaaaaaaagcgucgcuaguuucuuuugcugauguugggagugcuguccuggucuugcccugcccccacccacugcacuuuggcucuggucccuucuugucuagggggcuucccugcuuuuuaaagcagcuuuaaaguguucgaggcaaugcuugaacacucguaguucucagcaugaaaacucuugagggugcuucuucgccuguagacuaggacccauagcgggauucugucaacuguuuccuuuuuacagaaagagcccaccggcaugauauaggguugggaaaucaaauuggcaagauaagguuggggucgcgggaggaucuagacuuccuacccuuagguaacccccaagcaucgcacacaagagggcaccccaugcggucuuguggagggaaaaaaaagcagcccugaaugaauguuaacaggaaauuagcugcggcugguagguguuuuucggcggcguggaggggcgagggccggucugcguguggcugccggaggagcuggccaauuggucacggugcugagaccuuuguggcgaaugguggccaagugcaccaacucugugggaaacggcggcaugaagggaugccaacagcuccucgccgggaagggaaccgccucaaauguggaccaugacaauucuugcuaauuuguagagcagggaauuggugcauagugucaagcagucacugcuugugcuaaaugggguaucaaauuggcgcgacggauucgugaauguuguacgccucgcaaccucugaaccagagcguaaccccgagggguggacggagaaauacgacuucgggguagggagcgaccggccgggacuggaacgggcuguccagcccggagcgggaaaaacacgaaagagaccuaccugggaaauaggaggaucugauaaaggguuggaacgagccuucgaaguauggaaaggcgaacgucuugggaggagggcucugcagcaaagcgggcgaaguuucugguagggcgagggaagagagagagagagagagagagagagagagagagagagagaaugaauuugaucauguguuugaauacuguguggagcaucgcguacacgaucuaauucacacugcagcagguaucagaggcaucuuuuagaacguauucacuaaguaaaauaaauuugcgcagcgucgucucauuugugcccccauuucaucaccauuccagagacuuaggaaaauagggagggguggggugggcuauugcagaucuauccauaauaguacaaaccaacacaauaaacguacuuguuggguuuaaagcaaaaagucucuuuccuagucuugagggcgggaacgcaggcaccaaagcgcgugcgcugagacgcccgacuaaggaacugcacucacuggcccggggcucaaguucauuuugaggauacucguaaggccugagacuuuucuuccccuuaaaaccucaguaccaucguuucauaaucaguaaccuggcccuugaggucugaguuccugcguggaaaugugcacuaacaagcgcggaggaacaaguuugugaaggauugaguggcugucaggccgcggaacgcacgucgagggcacggcuguaucuuaccucuucuaggcgccgaggaaaggauggcauucaccccaaacuucagaaacgugggcucgcuggcaggggagagggcggucuguggagaacugccucgccggcucccggacccaggagagcccaggucugagguccccgagucggcgagggcugcaggggccucuugacuggggggugacaggcuggcagcggguaugcugcgggacagguaggugggaggccggcugaugcggaucaaaucuucuacuaggaaacuagaguggccggaaaaugcggauugaagggacuggggcaguguuaaggugggcgugggucgcaggaggcuaggguaucccgcgggaggcgcaaggaggccggggaacaucaugguuagagcgggucuggcaguagcucccuuucccugggccggagggcaagcgccuggcuucccgccccucccccgaugcccucuuuggcucaguauccugguaaccguccuacuugggcgucugcgagucuucug

SEQ ID NO: 3838 - RNA, 5353 nt, Mus musculus
cagaagacucgcagacgcccaaguaggacgguuaccaggauacugagccaaagagggcaucgggggaggggcgggaagccaggcgcuugcccuccggcccagggaaagggagcuacugccagacccgcucuaaccaugauguuccccggccuccuugcgccucccgcgggauacccuagccuccugcgacccacgcccaccuuaacacugccccagucccuucaauccgcauuuuccggccacucuaguuuccuaguagaagauuugauccgcaucagccggccucccaccuaccugucccgcagcauacccgcugccagccugucaccccccagucaagaggccccugcagcccucgccgacucggggaccucagaccugggcucuccuggguccgggagccggcgaggcaguucuccacagaccgcccucuccccugccagcgagcccacguuucugaaguuuggggugaaugccauccuuuccucggcgccuagaagagguaagauacagccgugcccucgacgugcguuccgcggccugacagccacucaauccuucacaaacuuguuccuccgcgcuuguuagugcacauuuccacgcaggaacucagaccucaagggccagguuacugauuaugaaacgaugguacugagguuuuaaggggaagaaaagucucaggccuuacgaguauccucaaaaugaacuugagccccgggccagugagugcaguuccuuagucgggcgucucagcgcacgcgcuuuggugccugcguucccgcccucaagacuaggaaagagacuuuuugcuuuaaacccaacaaguacguuuauuguguugguuuguacuauuauggauagaucugcaauagcccaccccaccccucccuauuuuccuaagucucuggaauggugaugaaaugggggcacaaaugagacgacgcugcgcaaauuuauuuuacuuagugaauacguucuaaaagaugccucugauaccugcugcagugugaauuagaucguguacgcgaugcuccacacaguauucaaacacaugaucaaauucauucucucucucucucucucucucucucucucucucucucucuucccucgcccuaccagaaacuucgcccgcuuugcugcagagcccuccucccaagacguucgccuuuccauacuucgaaggcucguuccaacccuuuaucagauccuccuauuucccagguaggucucuuucguguuuuucccgcuccgggcuggacagcccguuccagucccggccggucgcucccuaccccgaagucguauuucuccguccaccccucgggguuacgcucugguucagagguugcgaggcguacaacauucacgaauccgucgcgccaauuugauaccccauuuagcacaagcagugacugcuugacacuaugcaccaauucccugcucuacaaauuagcaagaauugucaugguccacauuugaggcgguucccuucccggcgaggagcuguuggcaucccuucaugccgccguuucccacagaguuggugcacuuggccaccauucgccacaaaggucucagcaccgugaccaauuggccagcuccuccggcagccacacgcagaccggcccucgccccuccacgccgccgaaaaacaccuaccagccgcagcuaauuuccuguuaacauucauucagggcugcuuuuuuuucccuccacaagaccgcauggggugcccucuugugugcgaugcuuggggguuaccuaaggguaggaagucuagauccucccgcgaccccaaccuuaucuugccaauuugauuucccaacccuauaucaugccggugggcucuuucuguaaaaaggaaacaguugacagaaucccgcuauggguccuagucuacaggcgaagaagcacccucaagaguuuucaugcugagaacuacgaguguucaagcauugccucgaacacuuuaaagcugcuuuaaaaagcagggaagcccccuagacaagaagggaccagagccaaagugcagugggugggggcagggcaagaccaggacagcacucccaacaucagcaaaagaaacuagcgacgcuuuuuuuuuuuuuuuuuuuuuuuuuuuuuugagagaagaaacucucuuccaccaccauucaggcuuuugccgacaauggaauuugcuccuuucucccgggucucaauggucuaacaaaaacaacccgagcuuuauaaauagcuuuucguguccauuuaaugugaaagauuggggguagagaagccucugccaucaccgcucucccaaucgucuccgccugcaguuguguuuagccugaguguaaaccucuuuugucccgguaauauauggcucucgcugcuuguccauagccuuuugcgguuaguucauuacuacacaauuaccauucacgcuucguuagcgucucuguuucuuuuuguuuuucuuuuucucucccuuaaagcgaaacucucccccuuuucauagcgccaauucccagugggaagcggucaaugugcuaauuagacgccacuuuccuuguauucacgcugauuucuuuacguugugggggaggcagaaaaaucauauguaguuuuuaaaacgaugaaugacuggauuuuuuuuaagccaaaacagacuuuuuucugucugccaaaccagcaaagugccuugucuuaaaagguacugacagcaccaaggugauugcguguccgugggucuugggggggggggaaaguggaggugugcugaguggucucugugggauuauuuucauuucuguaauuuauuuuauucuguugcuauuuaagcuguuuggugcggacuguuucuguaagaccauugaauggaagugggggggcggguaagcaaaaggcaauuguggcugcuguuuucguggguuuuuuccuaauccggguuugcacgguugaaagcgaaaguuauuugugcggaaagcgccuuucacucagacagguuguagguucuccgucuauucucuacggggagaaaaaggaguguuuuaaagagaugaagggacucgagggggaaaaaggagggagaacgcuagugaaaacagcuugggagaggcggaugcucggcucugcaggacacccggcucauucucuacuucccucaccccgcagcuuccuccagcgucgugccuaucccugggaccuucuccuggccgcuggcugcucgcggcaagccucgccggggcaugcugcgcagagccguguucucugacgugcagcggaaagcccuggagaagacguuccagaagcagaaguacaucagcaagccagaccggaaaaagcuggccuccaagcuuggcuugaaggacucgcaggugcgagcggccuccaccgccccacccucacacgccaugcuagccccugccaaucaauugcaagggcucucuggugccucuuaggcuggcggagcagcuggggaaacccaggccaaguuauuugagguuuccccagagcagccuccuuuuccaccccaccccaccccacccuucuaucuuacucccccaccugcccagcugagucaagugccgaaugagaggauggauggacguaaggguacauggauagcuauauggauaaauagauagaugcauaugcauggguagguguguaugcagguggaggauguguacauggauacguacguacguguguguguguguguguguguguguguguguguguguguguguguguaugggguaggcggauggacacaugaauuggauagauggaugggugggucauggcuauggggacgagugaaugaagcaugaauucgauccaauaugaaugggcuggcagguagauagaccagaggagcaagaguuaagagggcuuacaaggcugguggggaacaacacagaaaucaccuugagggcagcgccuuccuacauguuccccaagccuggcuucuaaggguugccccaaccaccaccaccaccaccaccaccaccaccaccaccaccaccacccccucauugugagcagacacuaacuuguuucugguucuucccucacaggugaaaaucugguuccagaaucgacgcaugaaauggcggaacuccaaagagcgcgagcuccugucuagcgggggcugccgagagcagacccuucccacaaaacuaaacccccauccagaccuuagugauguaggccagaagggaccuggggaugaggaggaagacaauccgggugcccgccuggccuaccacgcgcccgcagacccgcgacauuugcuggaagggccacugccugccucgccggcgcacucgagcagcccggguaaaccgucagacuucucugauucugaugaggaugaggagggcgaggaggaugaggaaaucacgguguccuaggagccccuccagcggcucuggggcuguugcaauuggaaacuggagagggaacgcccacguggccaccucuguucaggauccuggauccugccucuucucacaacagacccaccaccuucucagggguggcaucacccuuccuguugucccagagacauuuccuugcgccgugcugccaccucuaaacaacccuucccacgggagcgugggucuuuucuacaagagcaacauugcaucuauuuauugcaaauuuauuuuagacaccgcgugcaggguguguguagaggggugucccuaguuccacugccagugcuuacugugagccagguccugucaaacaccaagccucugaccccuaacuuccuggauggccaccuuucugcaggggguaucagucagccauccugucuuuucaccuugagaguagaaagcacaggagauucugaaagagaauaagggcaccgucucccugucuaaggggaaagcacuaucaagcaagcuuuucauuucuugaugcuccuuuggcgggaggaagcgauuucucucuguagacauguguauccagugcucugcuugauguccuucugcuacuccaacgggagccuuuucagagugccagcuccuggcacugggguguggacuugucugacucuccgacacguuucacccagcuuugcagucugggcagcuuaccugagaugugcucuacuguguaucuauauuuuguauggauguuuuauacugagguuauugugaaugaccauaaugaagggcuggcugugucccucucauuauuuuucucugcaauggucuuuaaagucuaaaagguagcuguguaacuucauaauuuauaaggaaaugcuuauuuuguauuuuuuaccauguacagacuuuuuauauauguauauauguaucaaauggacaaaugccaaauaaaaaguagaaugagu

SEQ ID NO: 3839 - RNA, 2535 nt, Mus musculus
caaaauuaaacuauaaaaauuaccuaaacuaugagacaaccaaaaccaacagaagagccauauaucuucagcuacaagaaacauucccauggagagauagauucaagucagacuggaugcuuugacuuccagucacacuggugacauuguacuugauugauagcaccuuugugcagggcugcaugcugggcucaguguuugcugauugauuucugccagcuccaucuaugugaaggagcaccaugguccugaacugcacugcacuuuccacuagggaugcugcugugugggucaccagcugaaaaauagucaccaaagucuacaugaugagccuuuaguacagcuggaguucuggcugagcagagggcuuucagaaagacauugguagguguaacuauccccauuuuaccuggcauauggcuucuuguagaggaaaagaaaucccuccugcugauuugguucaguucucauguuuauagcguaaaggagucggcucagaugguagagcuauacaaagcagccacuugcaaauaacuuacgaaguaauuugcuuauaguaguuccacauuucauauaaaauucauccuauacugccugccaaaauuaucacauuugucauuuaaaauucuaaagauuauggguaugcuuucuuccuuuuuauuuuuagucuaaaauugaagccagagaagcauuuuauaaugggaauuccauguguccuagcagagauguuuucuauuccuguuagacuuggaaaaccuucccagcauugcagcagacuccggaucccuccucagcaucucugucacagugggacugggcaaggacccucagacacuacugucuuucugaggacuucagggauaucucuugucguucacaacucauaguaaucucuagauuuuucaaaguucaaaaggagcucaaauccagaggaagagccaaaaugaggagcuugcucucccaccugagucaucuguguguuacccgucuguuauccagaaguacucaguccuagcaaacugaagcauauacuucauguagaagagaaauuuuaaauuauaaauccuaguaccuuuuucuuaaaagauuuuuaaaauuuacuuaacauguaugagugcucuaucugcaugugcacuuucaugucagaagauggcaucaggucacacuauagaugguuaugagccaccaugugguugcuggggauggagcucaggagccaucccuccagcccccuuguauucuucauugccuugcaguuuuaaauuaucuauaaauuaccagcucuguucaucaccacccccuacuuagcuacuuguagugcuuacauaaugcucugcaaucccagaccauuauauauuacaauucugacuaagcuauauauauacacauauccuaaaucaucucaaugacagugaacuuacuagauuuccauuuuacugcuauuaaaauaacacauagcucuuuucaaacuucucaaucuguuuacucuuuagaugucaaucaaaaccauuuacauuuaugaguggauacuuguauauauuguaaaaaggcuaaaucaagcagaugagcucacauacuaauucaggugacgaaaguacuuacaauuaaucacugaguaguguucaaacucauagugcauccuguuagcuauagccagcauuggggguuugagcucuguuaucucccugggagguuacgccuuuugauacccuuuccugucuccuaacaucacuaucuccuacccagcaguguacuauuuccaggaaaucauccuuuuaugguccacauuccacgagguuugugacaauucuccuucugugcggcuuaauucauuuaacaacgucuagugcugugcuugucuuguaggaaagcauuucggucucuuaaagggccaauuaauauuuaauugcauaugcauacauggaccuaucuuuauuuuucagucuauucauguguauaugugagcuuuguauuuaauucauuuacagcuucuucuuuaauuaaucuaaacuuuuguguuuagaggaacaaaggagauccgguuuuaucaccaucacuuguaaauuacugaagcuuuccacacugcuuuauguuauuguuuguuuguuugaggcaggauauuguguagcccaggauggccucaaacucacuauguaguggguaaugauacugaccuccuaguccuucugcuuugggaauuagaggccagacaugggccgccgcaccugcucaugcuguacacuuuucauccuaacauccuggaaagauuuauagacuuuauucuauuugaucuauuguuuuaguaaagucacuuuuuaacuuucuauauccuuuuaauguaauuugaucucugguaaucuuccaagguuuaucuaugacaucagucuuauucacuugguuuuggggaauuacaucuuugugauuuuaacuuucuugggaaaauuguaucucuuuuuacuuuaaaggcuuuuuauaauuauuuauaauguuaugauuuauaauuacaucauuucuugauaaauuguucucaaguau

SEQ ID NO: 3840 - RNA, 37532 nt, Mus musculus
cgagaacagucgccacuuagcagagauccugauagguacgccgcggcaauggcccggccuaagucguccgggagccggauggacagacagcuggagcaugaugugugcgagcucguccggcagguuacggggcugcaggacgaggcggaccccaacuuccagcuggcccuggacuucgucugguccaacuucaggugugggaucgcggcuacgagcugaagucgcgcgggcgggcggguccgggucgggagugcggccuccggcaccccugcgucugcugcagcugcugugccuugguuuccccuuaggugcccuugcgagaaacccgcaguugcagcggcacauuccuagagagcuguugacucugcucacccgcacgcaguacggugcacaucaaaagucauuugauggcugggaaagugaauuuuuagcgccaaauucugaucacauccuguuagguuuuuuggggguuuuuuguuuuguuuuguuuuuuguuugucucaccaaccccccucuucucuugcucggaccacuuacaaguuuccccgcuucuguguccucccuuugcauugcauaaaacaaauucaaguucuacuauugagcaacacauagcaugucuaguagaagucacccuaaacagugaacaguuugucagacugugauccugauucuaagcgcaggacgugagugucugccuaguucgugagacuacagaccucucagguugaugggaagcaagccaacgauccaaaaccacaagugcaauuucuaguuauaaccuauagaaagaacaaggauucaaagaagucagguaacucgaaaagcagauguaccacaaguauuuuuucuaguggcagauaggagggaggggauagucauuuuagaguugggaagagacauagaugcugcauaguauaacagaaguacuaaaagcauaccuauaacacucugucaccagugucacccguagaaaacauguggcagucaccuuguguuacaguugcuuuauuuccacauguuguucguuguuacauuaaugacagccuuuggucccacugcuaaauuuuagguuuuguuguugaugauguuauguguaugauuugacucuguguacacgugugcaugugugugccuggugcccaaggcagcugauccccuggaacugggauuauaaacagccugugggugcugugaauagaaccuggggacccugagcaauggcgugggcucuuaacccccgaggcaucucuccagacccuuucaaagcuuucuaaauauuugauaauuguacaugaauauguuugcuuuucuuuguauuucauuuuguacauuuagcagaauuauucagaggacaaauguuaagauuucacugggcuucucucuuacauuaaaaagacaaagaaaauccagucacaaugauguaugccuauaauuacaucagaauuuugcacuaaaaaguauacccacuuggguggcucaggcaggaggauugcugugaguugaaggcuauccuuagcuuccuagugagcucagagccacauagcaagaucuagcaaaaacccuaggaaaauauguuauacugaacauaacugugggacauauaaaaagacaaaggagccagaggacagguugucaggggugucagacauaugcagggacauggagagcugugacucaaguauacuuagcuaccugacaguaaauacugccaugugacacugacauuaaaaacuguauuuuaucuuuaccagauuucaucguuucuuggaugucaacagucacaaaguagaaaaaacaauagaaggguauguugauucucugucuauauguauucauugaugcguucucaaaagcuauuuagguacuaauugauuuuuuuuuuaacauuuuagaauuuaugaaaaauucaccauucauucugaucucaacaaagcugcuaguuggaagagauuaacuaaggaguuccuaaaugcaucucuucccagcacagagaaaauaaagguaagccuucagccgugagcucuccaguuguagucacucuuguugcuguugcugcucuuugucguuccgagacaggguucugugacgcucugacuguccuggaacccaccuuguagaccaggcuggccucaaacucagagaucccaccugccucugcuuccagaauguugugguuauaggcgugggccaccacugcucacugccgggcuuuugcagucacucugugcaguauaauuaucaucacuguguuaucucuucaugaacgcucuauuuaguaguauccccugacuggagcagggccucagagagaaugggguagcuguggccucagguuugguaggacauaagcagugugcucuuguuugcugucucacuuggaauuuacuacgguuacagaaaucagcacuauuuggcuaccuugaauuucucagauagcagccguaucccaaaugugcuuuuauauuaugucaggggcuccaaggccacccuuagguacagugauuugcuacaagaauucuuagcacuagugucuucuuagucuagcaucaucauuucuaucguuuauuaccauuaacucaucuagauuccagucaggaaagagaugacuagagcagaaagcagaaacgaagcgcaugcaugauaggcuaugccuuuaggguucuguaagugucaucaaggagguucucucacucaacaccaaagcugccuaaugauguacuucucaaaaggcuaagugaugccuggugaaaauuaaauggagauuacuucauuuguugugugcucugaggguuuguauuaugugcacaugugcucuacuuuguugguggugguguuuauuggguccuuugagaauuucauacagugaguuuuggccauauucacugcuacuccaacuccucgucaucccuccauacacacccaauuuguguccuuucuuauucuaaugcauaaaauuuucauuugugcugccucuguagucaugaguauguggccuuguacaccugcccuguuguggacagagaacaguuucugucuccaaaacuacaaaucuuccacaugaugagcuguaccacucucgggcacacagccaaaggacucgauauucugccauugagguuccugcucauccuagucuuuguuacucucacaauagccaggaagugaaaacagccuacuauccuacagcugaugaauggauaaugcaaauguaguguauuuauauaguggaauauuauucagcccucaagaagaaugacauuagaaaauucacgagcaaauagagcuagagaucaucaagacccagcagaaaaaagaucgcaugcuuucucucauuugugaauguuagcauugaaucuuguaccuguugucuuaguguaaggaaacagagaaccggaggguugcaaguucaaggccaucuacauaccaaggcauaccaucaacauaccuaaaacaaagcauuuccuggcuacauugacugaaguuccagauuuccuaaagaaaagcccauaauucuucaaaaauaccaauuuuuuuuuaaaaaaaaaaauaggacaguaugauucuagaugugagcuuucccuauuauuaaccaguuaaaaauccuaagaacuguuaacuagcaguuggcuggcaagccguccaugaaaacaagccuucuuggagaauguucaaagcuucggcuacuuggaucuccauuaacuuuuucugcauagcuaacauuacaguuuagacaucagugcuaugaacaaggaaagacucagaaauuugggucauagaaaggcuaacaugcaaaaauaguacuuuucauuagauagauuugauugguuuaugagagucauaacaaagaucuguugaaacuugaaaugucuuggcagugugguuucuagugaaagaaaaucaaaagacuuuuagguuuauuuaaaaaaaaaaauacugacccccuccauaagauaaaugcaaacuuaacaccaacagggcuggagaaauaacucaacaguuaggagcaacuacugcuuauccagaggaccugguucaguuccagcaccacgcacaaaugccugccuguaaguccaguuccaagggagcagcacucuucuggucuaagagagugcugcaugcauuugcugcauauacacacauggaagcaaaguacccauacacauaaaauaacaaguaaaucuuuacaacaaaggccaagagcaucuuugacuucucugagugcagcaaacagguacacuuguacuccgugcaauuauagaugugcaguauuugugcugaauguaaaugugauucuuauagagguuauagucaaauaggcaaacuguuagauauguuuaaucuucaggaugcauauugccacuggaaaauaacaucacuuagccauaaugucauguucuagagaauuauauuacaguuccuauagaaauaaaaucuuuaacccagucaaaugucuuacacuuguuagaacuagggaaccaaaccucaugugacuuagacuccuuuuauguaaacguuugaguuauggaagaaguuuagagaauacaauuuaccuuaugauaacucauguuuccuaaaaugagcagguguguaaacaaguguuguguagcucuuucauuacucagucuggcuucagaagcacuuaccaaccuccggcugauucgccugucucucuuuuuauuuuaaagacagaugcacauuauuccauacugucacuccuucugugucugucugauucuccuucaaacagcaauuauguggaaacaccgagagagaaagaaguggguauguuaccagauacaaauuuauuuuauuacguauacucaucgggauuuuuauuaaaagcuaaaaaucacagccaaggcuauacagagaaagaaauuauuucuuuugcuuaggaugaacgcaaaauuucauuuaaaauauaagcucuggcuuuuugaguucagacuuuuauuuuacaaagagaaaacucaacacuugaaggugaaguaauucaaaugguuaagacuguuucauguagcccaggcuggcuucacacuauguaggugaggaugaccuugaacuaccuuaaggucgaggauuacaagugugagccacuuugcccagcuguccuucagcuccauacaugcuaggucgacaucagcuacuuccuagucccgagugucucaauauuuucaaauuuaguuccuugaauguauuuuuaauuuuauguggguuuucuuuuuacuuguaguuuuauggguuuuagcguuguugagguuuuuuuuuucucccagauauuuaugauaaaacugagguuccuuuguuaaauuguagaaaagaaggaugauuuugacugggggaaguaccugauggaaggugaagaaauuggccuugguccaaauauugauacgccgguaaguggcuuuuguuuugcugauguaaauauaaguacuugcccacguggcagcaauaguucuagugcagccuucugccauagcacaugcuauuuaacaggaaaucucuucacuaagccagugagucuggcuccucugcaugcugagaagacgcuccugcagguuguccucugaucuacacaugugagccaugaugagcauacacacucuaaguaaaaugcaaaauauuaacauuuuagcgauguggauuauggaagguuuauuaauauucugggcuaagucaguguaugucaacauuauuuacauauuuaauaauagauuauaauuauuugguguuguuuuaaacagaaguaaaaggagaaaauuuucaaauuacaauauccuuucccaaaauaauuauuuuuaaguaggucagugcaauaaauguacuaagugauuaauuauauuuaguuccuauuguacuuuuagucaaggaaauugaaaagcauguguuauucucagucacugcuucaaagcaguaacacgugugggauucuuuugaaauucauucguggcucuugcugcuuucauucacagacauuugaacucacauauugaccacaaaaaguaaaucuggcugaguugaaacuagaaacaaauuagcuuucacuagcucuucaugacucauagaaacuucugucugcacucugcccuuccucgucaccucagucuuuaucuacacuacucccaugcuuguagacaucauagacuaagaucuucaguuuuguguguguguggggggcugguuucaagacaggguuucucuguauugcccuggcuguccuggaacucacuuuguagaccaggcuggccuugaacuaagaaacccgccugccucugccucccaagugcugggauuaaaggcgugcaccaccacgcccggcaggccugugauuuuuaucaccucaaaucagacuaucaccauuaugaaaacuuaugagaugaaggcggcuuuugcuucucuucagaaauguucuacauuuuuaagccuaagucacuccaauuguuacagucucaaguguaagaucuuuuuucuccuuaaaucagaauuggucugaagacagugaugaugaagaugcacagcagcccuugagcagagaagacucugggauacagguagacaggaccccauuagaagagcaagaccacaacagaaaaggggggccucaagucugcugggaagguauuauacaugguucagugcuggugauuucucacaggaggucucgggugacaggcugaugacugauggcauugaugacacuaucgcugagcucugacauuuccaguacagugcuucucagcacuccuaaugcugcagcccuuucaggaaguuccucaggccuuggugacccacagccaugacacuguuuccuuguuacuucagaacuguaauuugcuacuguugugaaccauaauagaaguaccugcuguucaaaguaucuucuguuacccacagguugagagccacugugcuaauugaucuugagugugcaccuaagaaguagcucuauaacucuuaucccucugucagcucaaaaaggaaacauagcacuaauagucuaauaguuuuaguacuauuuuauuuguaguggggcugcuauguuacuguuuauaccauguacaagccuggugcccacagagguagaagagggcaucaaauccccuagaacugcaguuacagaugguugugagccaccauuuauauggcgcacacuugggcucucuucaagaacauccaguguuguuaaccauuaagccaucccuccagcccuagaauguaguuuuucaguaguaguucugauaacuugguccuaaaugcauucuuuguuguuauaaaaggguuaaccuuucugaaguuaguaaaggaagaaaguuuacuguaaaguuuguuuuuuacuugaaugcuuaucuuuucaucugucagugagcaacuaggauugguagaaauuuuagaaaauacuagauuaagauaaagaaauccuauuauacauauuuuguccacuguuauuucugaaugccagucuuaauaccccuuuccuguuuuaaacaacuguucuaauuuauuugcugucuauaugucagucauuguucugcauugcaaacauuuagccuauugguauguuaaauuacauaacuggcauuuauauguaaaucuuguuugcuuaccuuuccuuagaucugcuaagaucuguccauauuagcgugggaacgucucuuccuuaguucuuaaacugucugaaguuugcaguuuguauuuccaacacacuuucccuugaugauaggccccaaguuaccucuucuccccaaguucccagcuccaucugcucuugugugagaauucggcuuugauauuaaguuccugccuccauaaucuccuaaguauucaauuaggucuagggaauugucuguuugcacuuagcugacaacuuguuuuuuaaagacuucacauaguuguugacuugauucuucuguguauuccuugauaauugccaucauuuacuuguuccaguggaguuuggguuguuucuagacagggucucuuugagucccuucucuucccucugacucccgagugcugugauuauagaaguguaccaucaugccccacgucauuugguuuuguaucuauugccuucucugcuacauuucuuugcugauguuaguucucaaguuaaacauuuugcagauagcuuuaaucaucuugcuuaaaucaaaaauaaucucuguuccucauauuuuucaaucaaaccagugaauuuuagccacugaagaaguggcugagcacuuaagagagcaugcugcucucccaggaccagggaucgguucucagcuuccaggugagcugcucagaaccgccuguaauccaacuccaugggauccagcauccucuucuaacuucuccgcgcacugcaggcauacgcauacauucacacacucgcaaacuguuacauaaagaaacauuuaaaaucuuuaaacaaaacaauuuuucagguggucaauguuuggucuugaaauuuuugcuuaaaaccaacauuuuccuguauuuuugugagggcuuguuuuauuauuguugcauuuggggaggauuuauuuuccuuuuuuuuaggguauuaaaauaauuguaucuuuuaccccuuuucuuucuccaagcccucucaaaugccuccuccuuuuguucucuuuuaaauucauggcuuuuuuguuaucucauacuugaauacaaacuacuuagacuaaaugcuaauuuguauguauguuuucagggcugaccauuuacauuugguauuggaccaccaauugguguguucuguccugaggaaggcucccccguccccaagcucuccgcauuccuugguggcuuguaguucuuuguguaggguugagaucucaugaacuuucucagaugcacauuaacuugucuguuguuguugaccuuguucagguuauguucaggcagccauguuggugagacuuucugaggggauuuacugacauuccuaggaugcagaaccgcaaagcaaacucccuguuuuucuacagucuuucugcuuccucuucugcaguggucucugagccuuagaugcaggagucuugaagaugcaucaguugggaccgggcucuacaaaucugcauuuugguuggaugucuuuuucuauaguugucuucauccguugcaaagagaguuuuccuuaaugagagaugaagacuacacuuuccugacuagacucuggauaggaucacauuugaaucauuagaugucuccagagucugcuuuuuauauaccaugagacuaaagacuagcaacaucauuguuugaugguuuuaucuugauuaugcaucagguucuccuuuguacuuuauuacagaucuucugccacuuuaguguuugucuacccagggacagacuugguguuuuguagcuugugguuuucugucuuaauguagagaauacauauucuauccuucacugcuuuucaaaauugccuuaucucuuugugaaccuguacucuauggacauuuuagaagcagugagacaaauaauuccagcuggauuuuuaguuaggguuuuagaaaauguauagauuuaacuuggggaagcugacaauaccuccauuuuucucuaaucaucuuauauucuguuagacuuuucuuggaaguaaacauacucugccacugagccaccccauccucuuaagauuugugaggucuuuauuggccauguucucuuuuauauucucaaguauucaucuagugcuuucugugucucuuagcaauuuuuuuguuuuguuuuuugcuuuuuguuuuuguuuuuguuuuuuugagacaggguuucucuguguagcccuggcuguccuggaacucacucuguagacuaggcuggccucgaacucagaaauccaccugccucugccucccaagugcugggauuaaaggccugugccacaaugcccggcccgccuguuagcauuuuuuauuguuguggaucuugagcaauuuguuuuacuuugauuacguagguauagaagaacacuguugguuucugugguuugucuguguuggacauucuuggugaaucuuccuuguaaauuugguaguuuguuggguuuuugggggcuuuuuaauuugugggcaguaacaguuuuauccccuccuaauucuuuuggguuuucaagacaaggguucucuguguagucuuggcuacccuagaacuaacuagacuagacuuggcguaaacucagagaucugcuucugccucucgagugcuggcauuaaaggcaugcacugcaccaccugguccuucuaauucuuaaaccuucuaucuuugugacaacaugaguaaaucuagaucagccuucucacagacuacacuguggccaugggagagcccucauagacagaguuucaucccuagggagcuacacuuuuggucaggaggaggugaaaguaccuagucacuguaaaaauugauugauauguauuccacuuuuuguggcagaugagccagauagccggagcuggcuggaacagcauguaguucaucaguacuggacaaccaggcgcuuccgaauuccacacagugcacaucugcacuccaauuuagcugcugucugguaagcuaaacuucuuguuuaauauaaugacagaacaaacuuugaugguuaaaaauacaacuuugauuugugauuuaaaucaagucuggaauuguaaacuuguuaguuuuaaacaaguguaguggaauguaugcaagagugcacauaacaucauggugguaaugaauugaaggucucagacacauuagacagcacuguuuugcugaccuaagucuuaccucccuugaguaauuucuaauuaauuuuaauaucaugaaauuacuaacgguacuauguuuaucuucauuuuaaguagauugguguaugcuagccuguaucuaauuuccauuugagugcacuuacuauaaaauuacacuaauuuuuuuaaaaaaauugcauaguuuuaagcaguugauugaaugacaaaacacaauuguaauugcucugaacaugcuucacuaaaaagauuccagugaaucugaaaaacgaauauagagugaacuuaaggcauuuauuguguuuauuuguucauugcugaguauaaaguugcauauagucauugagacgaguaauuuuacuuaaaacuuuucuguugaccuuugauguuugcucuuuaauagggaucaacaccuguacagcagugacccucuguacgugccagaugacaggguggugguuacugagacacaggucauucgggagacccugugguaagaugcaucagccugggaggcuguacuagugacaaguaaaauuguuuucuucuguguuuaaggcauagacucaagauguucauucuacuuggaggcuagcaacaggccuuagggaugaauuucagacuuuagguuucacugugaagcauguguaauuuugauaaauucuuucccguuuuaaauaauuugggaucgaguuagaccaucauuuuugaauaucugaauuuaaagcaagguuugcuguugacucuuucacuugaaaugugucugugagaguugucuaugcuuguacccaacacugugagucuacugcagccucugaugaggucuagaugguacuaauauucgaucaagauucuuacaguuuuaaacaugcagggguaucuuuguaucuuaaggaauuuagcggcugugucuuucugugugugugucugucugugugucucggggcgggggugguggggugauugaacuuauaaaugauggugagauaaauaucuugagucuuaauccugugaaguuugacacucuucccauuuucgugcaauugacccauuuugccccccaauucugaauuuucaaaauaaaauucucaacuauacuuuaaugauuauuuuaguagacuucaagcauauugaucuugaucuuuuuuuauuucauuucagguuacuuucaggggugaaaaagauguuuauauuucaguugauagaugggaagguaacugugagaaacaauauuauuguaacucacuugacacauguaaguaucuguuguugcuuaaaaauuaaauuuaaaauuaagcagucuuuuaaaugguggugauaugccuuuagggcauuuuacauuaucaaauuuauugaauaaauuuuaaagcucuacaaagcaaaauuaaguugugcuuacugggcuuagccaauucuuaaauauuugugacauuuaauuuuuauuuaauuuuuuuucuuauauucuauaucgagaaagcuggauacuguaaugauuuuuuuuucuguacuuuauguguguuuuuaaaaaguauaagccguaauucuguaguguguaugaacugauuguucacuguuucuuuuaaauaugaacuaaacucauuauguuccuuugucauguaucacacaguuucuuuacaauugaaccuguguagaaggcagcuuugaauacuuacacuugacuuguguuauagagcuguuuacgaucugugcuggaacaaauagcagcguauggccagguuguguuucggcuccaggaguucauugaugaagucauggggcacagcucugaaagucuaccaccgggaaauggccccauaccuaagaagcaaccugacgcucccuuuagaaccuaccaggccuucaugugggcccucuacaaauacuucauuaacuucaaggaagagcuuacagacauugagaaguguguuaucaguagugguaggucaucuucuucuuuuuuauuaauucauaaagccaccuaacucacuuggaauauuuuuaaaguuauucaguuauugauaaaacauuuaaaaauuacauggcaaauaaguaauucuuauaaauauauucauuuuuaaagugauuuuaggccuggagagauagcacaacagauaaagacacuugccacccagccuuacagccugaguuuaaucugcaggacuagcauaauagaggggaaaaccaguucuuucaaguuuuccucuaccuccacaugugcacuguggcacacacacaucuaccuccccccggccccaauacacacaugcaugugcgcgcgcacacacaaauacguaaaugaaauaaaaauguuaaauaauuuugaagcuaccuuacauuuuauuuuuaagacauuugucucuaaaaacccaaaauuacugaagagcuuacagugaucauuuuucuuguuccaguuccccugccagacaggcagcuucugcacaugcuuuuagagagagcucccucguucccuucuacagaaaacuguuuguucauaccacaccccaguucuccgugcuggacacugggacugcgcccacucuacgguuggcaggaccugcagugguuaccucuuagacauugcagcaguuacacacaugcacaguggagcugauacaucaaagacuuuauguaauaacaugugacuuuugcuagauuuuucuuuauuucucuacaagaaaauauagggaaguuuauacucuugccggcagggucuuguuauauauuacuaaacuuuuguucuuuacaaauaugacagguguaaaauguucaacgaguaugugguuuuuuuuuguuuuuccaccuguaauuuucuguuuuguuaauuaauuuuguuuaauuaaggacagaguagcacaaagagugcccauguuugcuugucuccauaauuauaacauagagucagcuaggagacugccaugucacugcggcgcauuagccggacuacagguccagcagugggggcggcauagcgcccuugcagucugccacuuuagcacauguauagaacuguacagugccuugauguucaggguaaggagcugugucagugccaucugagaacuugguugagccaccucuuuguagcuuuaccguguguagcuuuaguuuauguucuuuacaugaaguucagugcccuuuguaauaacauuaaagaccauuugucuuucuuuucugauuuaugucuucccauauacauuauuuuugucugaguuaccuuuuucucucugacuuauggaaauuccuucuuuaaggaagauaugauauuaaagauaaugguauuaagauaugauauuaaggggcuggagagauugcucagaguuuaagagcauuggcugcucuuccagaggucuugaguucaauucccagcaacugcaugguggcucauaaccaucuaugagaucuggugcccucuucugaucuacaggcauccauacaggcaaaccacugcauacauaauaaauaaaucuuuaaaaaacaagagaagauauuaaaacuuaccacccuccaucuggcugugccuuuccauaugucaaagaaaaggcauuauuagcaucaguauuauauguuggucacagaugucuuuucuugcuauucaguuugauuuguugauacuuaacagauacaaccauaacacuugcaauaguggugaacaaguuggcaccucgauuggcgcagcuaaagguccuggacaaaguguuuaguacuggaguggcagaaguuccaccugauacucgcaaugucguccgggcaucucaccugcuuaacacccuguacaaggccauucuugaauaugacaauguuggcgaagccucugaacaaacaguauguuggacuuuugggugaacuaaagugcaugaugaaaagauagaaccuguauaauuccuuguuaaaugauguuuaacucaugguaugucaggcaguuguucaaaguuccacagcuuccaaauguauggcuggcuuaccagcuuuaauuaccagaagagccaggaggaugaagcaaaaggaaagcaagaagugaaaaauaccuaugugacuuauacagauaaucauuuuaaaaaacaaaacaagacuuuacauaaaacacagccaggaaugguggugcacaccuuuaaccccuguacucaggaggcaguaguaggcaggucucuuggguugaaggccagccuggucuguaugagaaaguauagcccauguagaaagggcuacauagugagacccuuuuuaaaaaggaaagagaucacaagucuaugaccuggagugucuaaaguggucacaguguguaacagacuuguacgagcuaggggugggacauuuucaguauaaauguauuuaaugcucugaacuuacauauuaaguggcuaagauaguugugaacaugugaagucagaggcugagggaagagggcaugagucugagguguugcuaggcugcaugggaagaccuaucaaacacaagagacuaggcugaauuguguuagaagaacaaauccaguuagaggcugcuugguaagguacugcuuuguuccaguggcuggugggacucuugucuucuuuccauuuaaauguugaaguucagaacauagacggauuugacuuuuuucauuuaugcaguauuuauccuauuaguagccaaaggagaauaaaauaauucucucauucuuucuugcuuauuugggaguagaggugggaacgcaugugccacagcaugccuguggaggucggaggacuugaagaacuugguaggaucaaagucagguuaucagguuaacaggcuuggcagcacuaucuccacuaagccaaguagccagccccauuuucucauucuugguugacaucuuacaaugguacuguguagccagugcagccauaugccucugccuuggcugugucagguucaaaaucugaucuucauucaaggagaugucuuaguuugcauuugcuuucaguugcugauaaauacauugaccaaaagcaacuagaggaaaaaggggauuauuuggcuuaaacuuaaacacuugaacuuacaaguccaucauugagggaaacuaaaguaggaauuuaaggcaggaaccuaacggcacgaacugaaacagacagcauggaggaaugcugcuugaugucuuauucuuuguagcuugcucagcuuacuuuauuaaacaaccuaaggccacaugccuagggugacaccacccagagggacuggaaccuuccacaucaaucauuagucaagaaaaugucccacagacuugcuuaugggcaaucugauggaagccucuucuuaagugagguucccucuuccugaugacccuagcugugucaacuugacaaaagccaaccagcacaguugaccccuuaucuauuugacacacaaguaugucaguauuaagccauaaccucggcuuucuuguuuaucucuaagaucuuauccuaacaacacaaaagaguauaacuucaaaaauucagucucuuuaaaacauaaagugucucuaaaauccacaaucuaacuaucaaguccuccuguaugcgcaaaauaaguuacaucuuacucugagagggaggaaucagggcacccgcauaguaugagcaaagcaaaaucaaacucuuuuuuuuauuuaauuuuauuuguaauucauuuuuuacacuucauauuccauucccugccccuccccauccaccugcuucacaucccacaccuccuccccaccccaccugaucucuaaacucccuggggccuccaggcucugaggguuaggugcuucaucucugaaugaacacagaccuggaaguccucuacuguauguguguuaggggccucauaucagcuggugauugcugucuguuuggugguccaguguuugagagaucucggggguccagauuaauugagacugcugguccuccuacagggucgcccuccucuucaccuucuuucagccuucccuaauucaguaacaggggucagcugcuucuguccauugguuggguacaacuaucugccucugacucuuucagcugcuuguuggggcuuucggagggcaaucaugauagaucccuuuuugugagcauuucauagcuucaguaauagugucagaccuugggaccauccuugaacuggaucccucuuugggccugucucugaaacucuuaauaguauaaucugggauccaguuacaauuuugggggcuccaaagagcuuaggcaucucugccucuuggguuuugccauuuaaagcacauagcucaccuuauaaguucaggugagcuucaguucacagauguuacugugcuuagcaguuauccccguguucuggagucucuaaugcaggaguuccuacagguugcacuuuccccaguagccuccuggcuucccuauagggagucugguucugccaaaaagugucaagccuccaccucucuccaugacccagucaaauccugggucuccacugcaacugagacuacucuuaccaauggccccuccuugcuucuuaugguacaagccucagcuacucuccauuuuguccucaugccuuuaaaaccaguaccacaggagagacacuuacacaugaccaaguuugucaaaagccagaucuauauccagguauacugaggaaggcaagauguggcaucagcaauuggggucggugcugauaguaacuggcuccugcaccccugcaugccacccgcuccccaaccccaccccaaauccugaaggggauuuauaguacuaccacuaauagugcugaccauagcaaaacuuaaguaucgggccaggcuucucguccauucuuaacucuuaguggccagugagaaagaacaggauagagagaaagucgugcauauucucucucucucucucucucucucucucucucucucucucucucucucucucuguguguguguguguguguguguguguguuguacccaacuacucgugaauuuuacaaguguacacaugcauacaugcaaacacauuuacauacauacauacauacauacauacauacauacauacauauagcagaaucccaacaaccacacuuuuuuuuuucuuuucuuuuccgagaugguuucucuguguagcccuggcuguccuggaacucacucuguauaccaggcuggucucgaacucagaaauccgcaugccucugccucccaagagcugggauuaaaggugugcaccaccaugccuggcauccaacaaccacacuuuuuuuuuucuaucucucagcauuuuuauaacuucuuagacaaaaguucuuuuuaaaaaauuaccucacagagagaauguuacacaaaagggaguuacagaaggguguugauaauaaguugaaagcaguguuuauuucuacaggcucaucguaauccaaaacaguuucacauggccuugcuuuaucguagugcaaacguguagccucauccuugggccugaccuagaaugaauauuuuccugcgucacaaauuugccccaggccuguuugucuucuuggugcacuucauaaaagcacauuuuacucacuaugcagccuuugcuuacugccuuaugaggaagaggcccuuucuagucucgauucuaccuuuauuacaucucuuuggcagaacaaaaccauguccuuaaacuuucuuccuaaaauuauuugaaucaaaucaggaauucuagaaagucauuaauagaucuauacagcauuauuauaugaaacacaucuugauuauugaucugcaggaaaucugcccaauagggugagcugcucauuaggcuguguuauaauggcaggagccgucucaccagccccccucagugacuuucauagcaaaguuccaaaguccuugcacagucuuccccaaaacagcgcagucagguggcgcacacccauagucugcucucugguacacaaaacagcgcagucaggucaugcacacccauagucugcucucugguacaguuccugccuuagaucgcuuucucuugcugugaaaacagcagcauugaaggacacuuggagggaaaggucugacuuauacauccauguuauauaguucaucauccaaggaguccagggcagaaagucaaggcaggagcagagcagagcagagcagaggcaggagcuccucauggcucgcucagguuucuuuuuacaacacaggaccaacugccuaagaaugguacuaccaccauuaauaggcugggccuccacaucagucauuaauccagaaaauaccccacagcaucgccugcaggccagucugaggaacacauuuucucagcugagguccccucuuuccagaugacucuagcuugugucgagcuaacaaaaaacaaaucagugcaggagggcucucguacaaaugaagaauguuauauuuaucccuauuuagacggauuuccaaguaaggaucuggcaguuuacauuuugagaauugcagcuucuucguuucaaaauguauaggcguuuuuaaagguguuucgaaauguuuaagcuagcucuuaaccuaguaagaggagcgcugaagacuaaccagacaaggucucguccuuaggucucccuccuguucucucucuggguggaaacagugaggcccuaccuacagacgguagaugaauggaucguccauggacaccuaugggacggcgcaagggaguuuaucauacagaggugaggcuuugcauagaguucaggggauucugaaugcaggcauuuacuugccaccacaucagaccagaaucuuaguucuuaguaaguuguacauguaacugagaagguggguugcugaagcacgggcauguccuacucuuucuuuauaaggagaugucaggucccaaccagcuaaaaauauccuugagggcuggagagauggcuaaacgguuaagagcacugacuguucuuccuuccagagguccugaauucaguucccagcaaccacaugguggcucugaacuaccuauaaugggauccaaugcucucuucuggugugucugaagacagcgacaguguacucauguacauaaaaaaaucuuuaaagauauccuugaguuuuauagcaguucacaucuuuucauaacaauuuauauuuuugaaugguacuuaaaugcuuccuaugagauaaaccaagaugacaaccacuguuauaaccuacucccauuauaaguuaccaguaagauaugacaauaguauagaauaugacuuugugacauuuauuucuuaaaauaagugacauauuuucuucuuaauauaauauuuaauaaagcaaauaaaggaaaauguuaauccauuuacaacaauuucccacuaguuaauugacuuuucugaacaaaauccuaagcuggaauggaaaacuauuucuacuuuuuuuuuuuaagauuuauuuauuuauuuuauguauaugaguacacacuguauggauaguuguuagccuucaucugguuguugggaauugacuuuaggacuucugcucacucccgucaguccugcucaacccuaauugcucugguaaauccugcuugcucuggcccaaagauuuauuuaguauuguaaauaaguacacuauagcuucagaugcaccagaagaggccgucagaucucauuacgggugguugugagccaccaugugguugcugggauuuaaacucuggaccuuuggaagagcaguuggugcucuuacccucugagcuaucucaccagcccccuauuucuacuuuucuaaagggaacuaaaguaguucauauucaguuuaacuuuauucaggaaaauauuucauuuaaauuuuaauucaauugcgaguacuuacuuuguacauuaagcugaaugaagauagauaaaaacuauuccauauugaagaucacuuuacuagcacuucauauugcuaugguauagaaugucugaacaacucaucuaaacuaaaagcuaguauacuauuguuuuaaaggaaaagaaauuaacaccuaaaguucuuuugaaucuccuuaggaauaaaaacguuccaguaaaucacagagacuucugguaugcaacguacacacucuauagcguaucugagaagacagagaaugaagacaaagugagugacagugccagugccagcucuggcagugaccaggggcccucgagcagacagcacaccaugguguccuuccugaagccuguccugaagcagaucauaauggcuggcaagucaaugcagcugcugaagaaccucaacugugcagagggcccugcgugccaggcagcagccagagguagcagccugcuucuucucugcaugacuucucuggccugccuuaucuuuuccauucacucuugucauccucaaauacagaguggccacagcuguuugugucaguaggaauuaucacugugcuuuuuguuuguuugcuugguuugguuuuuugagacagcaucucucuacauagccauaguccuaaagcucacuguguaggcaaacuauaaugggccaguguugauagugucuuuuccagugagacugacuccuguaagucuuccugugaucuuauacaguaugguaguaacuuaacuuuaaguacacugcuucaaagaguauucuguucacaacagaauuagccuuuagaccaugagagauuaucgaaaauguuccguuuaacugagaaucaaaaaugguuuugauguacuauaaagauaaaacaucugaguucgaggccagccuggucuacagaaugaguuccaggacagcuggggcuacacagagaaacccugucucgaggaaaacaaaaaacaaacaaacaaaaaaaaaaacaaaagaaaaaaagauaaaacaaaaacagagauaggucuuuguagauaauaaaaaacuuaucaagcucuauaaagauaaaauucauucuuaaacauuuuuauuuacacaugcacacaugugggcgagugucugugugucuguauuuucuauaucuauguauagguaugccuaugaaggccagagagggcacuggagagcauuggacuucuuucccuuuuuaaaaaaaugauuuauuuauuuauuuuauguauaugaguguucugucugcauguacaccugcaugucagaagaaggcaucggaucucauuacagaugguugugagccaccacgugguugcugggaauugaacucaggaccucuggaagagcuuccagugcucuuaaccucugagccaucucuccagcucagcauuugauuucucaaagcuggaguuagcaugcaguugugggccacuugaagugggugccaaaaaccaaauuaagguucucugcagagacagguugcuuucuuagcugcugagucaucuccucuccaccccaaccucgucauccuuuuuaaaauauauuaugucucugugaguauaugccacagguaagggugaagauggagaugagacgcaggcauuagauccucugcagcugaaguuaacaggcaguugugagcuuucuaaugugggcugggaaccgaacucugauccucuggaagaacacuucgaugcuucucucuccagccucugaaacuuacugaaacuuguuuggggaacagaauucauccuguauauuuguauuucagaugcagaaagaaaaagcuuauauacccucuuucuggaaucuauacaguuacgucuucaacauggagaagauucugcuccacacauuguuaaugaagaucaaacaaccaaagagaaccuuauaaagaugcaguccauugcugaaaggcaccuugagcuagaugauauucaugacccacuguuggccaucaacuuugcaaggugauaacauacacacuacauuucagugacugaacuggcaauaucuacgcaaugcuuuguaguuguuucugccagguagaccuuucccuccuuaaaaacaaaacccuucuucuuucuaacagaugacuacaacaagauguuguguucaccuauguccagugcauaguuuugcucuuguuaacaaaagcaaacagaggugacucagcugacaucucucuuguacccuagcaaccccuaggaacaguguugcucaccuagaauauagguccaaauaagcucuguacugccucccucuguauuuauuacauguguuuggggccuagaauucugugaggaacuuaacuccaguggaauaaaccauucauuaauacccuucaccguguauagcacuaaugacggacuaauuccaacacacugacucuaaugcagcagugaucuagaaaggauguacugaggaaaagguuucuucuuucuguaaugauugaucaucugaagcgaaagguaaaaaugggagucuagguuuugcuuuauuagaauugugucucauaaaaaugaagacucacucccauuuuaauauugaagguuguauuuggagcagagcgacuuucacgagaaguuugcugguggugacauaugcguggauagaucaucagagucugugaccugccagacuuuugaauuaacacugaggucuugccucuauccucacauugauaagcaguaucuacauugcugugggaaucucaugcaaaccuuaaagagagauuucagguaaauuaauaaauaaacaaauaagaagaaagaaaagggcaaguuaacucuggaaguaauaaguuguuaauaaccaguggauucuuuuccccuccuuuuccuuuuuuuuuucuuucauucuuuuuugauugugucuauucuguaagacaauuuuugaugucuauauuccaagcaaacuuuaauuagaaaauggauacguauuuguugacaaucuucuuuugaaaagaagaauagccaggcagugguggcgcacaccuuucauccuagcacuugggaggagaggcagguggauuucugaguucaagaacagccagggcugcacagagaaacccugucuugaaaaacaaacaaacaaaaaaaaaaagaucaguuaauagucaagauuuaaguauauugugacuuuaauuauuugaagaucugugucaaaagaguuaccaaaagaaagaaacgcucagaacaugcacagugugcucucagaagaacaauauaagguacuugauaauagauaaccaguuccaacuccgacugauuuguauccacacauaggcucuguaaaguugguagaguuaagagugcuaguuugcuuucgauugcuaugauaaaacacugaccagaagcagcuuggaaagaaaggauauauuuugcuuacagcucacauuucauccuugauggaaaugaaaggaggaaccuggaggcaagagcugaagcagaaagcagagagaaacacuucuuuggcuugcucccuugacuugcucagccuacuuucuuaucuaacccaggaccaccaucccagacagaaauggcaugguguacagugggcuggguccuccuuaucaauuaugaaucaaaaaaaaaauauccucgcagacuugccuacaggucagucugauggaggguuuuccuaacugaggcuuccuauuccaggaugacccaaggugugucaaguugagaagaacuaaccagcauauuagguuaaauacagagcuuaauaaguaggauauuuaauacgguagaaucugucuuuuccuuaaugcucagcagaagacugaaaugaaauauuccauguaguaacuaagucaauauuuauaugguggaauuuuaauuaauuuuguuucauuuuugugauugucaaaguuuugagaagagugacuauuucuaauguuagugacuguuuuacacacaucugucugacaagugacuguuggugucuaacccggguuuugcuagagucccacaggacaggcauaagauguguucccuuacuugucgugucucucgcuuucaaggcugguggaguacuugcaggccaugaggaauuuuuucuugauggaagguggagacaccauguaugacuucuauacuucaauuuuugauaaaauaagagaaaaggaaaccuggcagaaugugucuuuucuuaaugugcagcuccaagaagcaguaggacagcgcuauccugaagacaguuuacgguaacauaaaccaagaagucauuuauggguuuuuacauaugauuauugucacuuuuuguccucaugcccaaaauaccuacuugaagcuacuuaaaggugggugcauuuuggcucacagacugaaagacuuguguauguccuagcagggaggaugaguucagcagagcagauaacaccugucagagggaauagaguaauucacuaggaaguaggauaggaaacagcuccaggaauaccacagucccgagggcaccucaggaaacugcuuaguccagcuuagcccaccuccugcauuuucagaaccucccaaaacagcgcuaguguucaaagcaugcauauacagaagacaguacacacucagaccacacauauucacaguaaccauacaaauuauuuugcaaauuagaaaaugaaagcugagccaggcagugguagugcacaccuuugaugccagcacugggaggcagaggcagguggaccucugaguuggagaccagccucuucuacagagugaguuccaggacagccagggcuauacagagaaacccugucucaaaaauagaaaagaaaaaauaaauaaaaaucaaagcugagauaagaugguauauucuuguggugccagguuauuuaaggucugaggcaaggaagucaucugagccugggaauucggggccagccuuuaucuccagacgaaacacaaaggaaaggcuaagagaugguucugcggauaaggaacuugccauauaagcauggggacauaguuuggauccuuagcacccauaugaaaaaaggcauauuggcaugacaguccaucuguaaucccagcacuuuggaggaaucagauggugggcaugugucugguacaagcugucuuagcaaaacucacguucagugagcgcccugccucaaucaggugaaaaguacucaccucugaccuauacacagacacgaacacauugcacacaccacacacauguaccuccuacgccccaaaaccgagagacgaggaagggguaaguuaggucagcagcugguguguaagugguggcagcaggucagcaccagccagcuuguugagugugauggcgucuaugaugauucuuguguucaguuccuauucaccaguauuacuaacuuuuaucagcccugccuccuugaaggcauccauugccucccuggcggaccagguucuccuccugacucagccuuacuuucuuccaccacaagggaugauacccaucgcucauacccaggccgcuuugugugccucagaccagacagaaaaggaacuuuucccuuucaggcuucauuuuucccagccuccuaucuuacacacuaccaggccaugcucucucuucugcugcauucacaugguuuuccuuccccagugcuguucuuccucaccccaggccuccuucaguggugugcucuuccacucacgaccugccagucaguuugucuacugguagugcaccuuguguuuugugugccggaaagcagcucuucagaucugcucuggaggcagaauagauucuaucaucugcauaguaagcacuuaagugaauguuggggcuggagagauggcucagcgguuaagagcacugacugcucuuccgaagguccugaguucaaaucccagcaaccacauggugacucucaaccauccguagugagaucugaugcccucuucuggagugucugaagacagcuacagugugcuuacauauaauaauaaauaaaaucuuuuuuuaaaaaaaaaagugaauguugauguaagaaacugcuagaaacuaaaaucgcuucaucuagucccugugcuguggcaaugaguuggcuaguucaugcuacucauacacugcucuuaccucuuccuuccuuggaugccuuacuuuaccucuuccauaguuugcacccagguuaucaacuguagcaagcucacuaucaggaccugcagaucacaugagaaaaaggacaacagucgcuagcacauggauauuucccuguucuguuuugcuuccuuucuugggaaaggaguccauaacuagagcaguacacagcaucugcaacaggagcagaccccacuguacaaagccuauggaggcacagcggagcaguucuaguccuugcccauagugccaaaaucuaaaguuuagucuuucuaaccuggcuuugaccagaauuaaguucccagccuauucucaaaguuuguuuuuuaauucucauucccuucuaacauugucaaguauuuuuaauaacaaaacucauauuuuaaauuggauguuggggcacacacaacuguaaucccagcacuacaaagguagagucauagaaaucucaagauaaaaaccaaucuacaauaccuagugagagacuaucucagaaacuagauauguuggcacagccauugggaggccgaggcagggaggucaccuugagucccaggucaucugcacaucaagaccuugucucaaaaaaacaaaauugcugguugaggauagcuuaugucugauucuaacacucagauggcugaggaaggagggucgccaucuauuugaagcaagccuggacuguacagugaggcccugucucaaaaguugggguagggaugagggggaucaaaacaacugcuacucauuucuaaaagcaagucccuguucugaggcauaugccagaaacuguaaguuaguuagcaugcuuguauuauguggaauguugcagggugggugggaugguuguaugguccuguuauugucacgaccucgcucacaguagcuaaguguuguaccacuaagggacacucccugaccaugaacccuucuauaagaauguuuuuauaugaacauagauuuaucacaaacuaaaauggaaacuucuuuauuuaguuuaucuauaucuuuugaaaauguugauacaacuaagaagaaacuacccguucauaucuuagauggucuuacccuaagcuacaagguaagcacuaaccuuuuuuuuuuuuaaauaaaaauuguuuuuuuaguaaaauuaagguauguaaguaauacuguauuuugguuuuucuguuuuguuuugauuugauuucuguaggucccauggccuguggacauuguuauaaguguagaaugucaaaaaauuuauaaucagguguuccuucuccuauugcaaauaaaaugggcaaaauacagccuggauguucuacuauuuggugguaagacuugauuucaauaaauucacuaauuugauuuugguccuggaaaguuuuuguauagguugccuuagucagggcuuuauugcuauaaaaagacaccgugaccacauucaacucacauuuggggcuagcuuacaguuucagagguuuacaucuugauccaaaggcagcagaaaaagacucugucucacuggccagacuugagcuuaugagaccaaaagcccaccccagugacacacuuccuccaacaaggccacaccuccuaauagugccacuuccuauggccaagcauuaacacaugaauccauggggccauuccuauucaaaccagcccauagguuuucauuauuuuuuauauguaaacaagcaucaaacuggcacagauguaugacagcaguguuaacaauccccaacuaugccaggcagugguggcgcacgccuuuaaucucagcuugggaggcagaggcaagcugauuuuugaguuugaggccagccugaucuacagagugaguuccaggacagccagggcuacacagagaaaccaugucuugaaaaaucaaaaaaaaaaaaaaaaaaaaaaaaagcgauccccaacuacaagaaugaaguugggggggggggggagcggugcuugggagauggcucagcgguuaagagcacugacuucuucuagagguccugaauucaauucccaguaaccacaugguggcucacaaccaucuguaaugaguuccuaugcccucuucuggugugucugaagacaguuacaguguauucauauauguaaaauaaauaaaucuuuauauuaaaauccccuuauaauucuuuuuuuaaaaaugaagcuugaggcuagagggauagcucagcagugaggaguacugccugaucuuccagaagauccauuuugggcagcucacaacuacuucugauaccagguccaaaauaucagaccacccuguucaggccucugcaaugcacagugcacacaaaaacacagacgucacacagcaucuacucucacauacacaaaaauacucauagggcugaucuucaauguuuuaggaauugacucuaaauauucuuaugucaugcaaaaaguuuagugaaggucugaccgggauuuuucuaacucaguagugaugacaaucuauuuauuauuuaucugucuucccugugucuccccagugcuaggauuaacagaugugugucauuauaacugguuuauucagugcugggaaguuaacccagagccucaaguaugcuaagcaacuacuagagcaacagagcuacagcuugguauaaccugguauuuaucuucccaaggcauggaaaugcccguguuagguucccagccacgcugcugcccugucgcuuucaaucaguucccugugugcucauuuuguccuuucacucaucuguagaacuggguaaugcugcugaaagaucccaagcaaaggaagacauuccacgugaucaggacacacccucccaguuuggaccaccaaaagagucauuaagacagcagauucaucgcauguuucucuuaagagugaagcucaugcacuuugugaauaguuuacacaacuacaucaugaccaggguugguaucugcccauccgucuucucuguucuuuugucuuguguaagugguaguucagagacaacauuuaucauguauuuauagcuauacaagagucacagaacacuuugagauuauggaaaaaaagauaaauaauuuaaaaaagaauagcaugucagugagagauaauauagucucucucucccaaaguccuuagcucuucaguuaaaggugggaguucaugagucucucugguagaaucacaacaggcuugaucuuagggagguacccacagcugcugugugcuuccugaaugcagugguucugucaguuccauuagacacuguuuggcucugcccucccugaucaccuggucucauagucuuuacccguccucuucugugauggugccugccuuagugggggguuggagggcuauaauguaaaugccccauuugugucugagccuucacacaaacagcauuguguccagagacuauucuuaucuacauccauaagaacgggcacagcaaagcuccuguuuuagaaugaucuuuagaacuugcccagcagcccacuuaauuucaucacuggugaucgcugucucuggaaagcggcaucaauauuuaauaauagcccaaauccuugguaagggugauauagaaggcagagguucagcugaauuauauacguuuuuaaaagaaggaguuggcuaaggagacaacucggugaucaagguguuuacugcagacacaugaggacugaugugcagcucuccagaacacagaagaagcccagcagauguggugguaaccugcuugcaauuccagcccagggaggcaaagagaccugccucaguaaauaaagugaagacuaaugucgaccuuuggccuccauacaugugcacaugcauacucacuacacacaaguccauguggaaacucuucuccugacgaucagucccagaugcaguucucagauagggcauuagagggccaaucauugaguacagagcauuagaguaccggagucaacauauugugccccaaggcuugucggcucuaaacucgucuuggugggcugcagugacuuuaaacccagugugagacaguggcugaguuuugcugaauaccugaugacaaugccagcagccuucacagagccagcuuaaagcacuuaauugugugaaggaaggaauaagugggagcuucaugucuuuacuuuucuauuuaaaguaaaguuagguuucucuuggagaaagaccaauacuguguuguguaaacuuaccaaauucuuuggaauuguuuguauuguaaaaauggcacuuagguuaggacaaacguuuuuauauuugucaguguuuuuuggguugguuuguuguugaacucccuuuccuuuaggaaaccuguucuaagggaagguauucauuuuguguucagaauggcugcccggaggcugguucugccauugucuagggcucagaaaaauaagcuuuuaaggaaagguauuagggguuguacauauacuauauagcucagugguagaaauauuuguucaacaauguaugaagccuguaguuacuaauaacugaguuugaguuuggauacccagaacccacauacaaauccacaugugaggcugguagugcacgccuuuaauuccagcacucuagaggcagaggcaggcagaucucuugugaguucaaggccagccuggucuauaaagugaguucuaggacagccagaacuacacagagaaacccugucuuaaaaaucaacgugugguugcacagaccuagggaaggaggcagaaacaagaggauccuaggacaagcuggucaugugaccugcacaaauaaaugggugcuaauguagcuucuugucuuuuuucuucucauucaagauucuucacaguacagggcuggaguuucagcaucaaguugaggaagccaaagauuuagaucaguugauuaaaauucacuacagguauuugucaaccauccaugaucgaugucugcugagagaaaagguauguaaaauaccaucucagguauaacaguggggaaagacgguaucuaggcauguagcaaugucuucccacugugaaauguugaauucuaaaacuauugucaugcacaaucuuauuuuuaggaaaaacuagguuagaugggguuauaaaugugugccccacuaccagcaauuacauuuaagaaaaauagaaguauauagaacugguaacuuaagucuucaguuagacaaugaaaguguaccaauucauuaugaauauguggaacugaauaguuuugcaaccauuggaacuucugccucccgugcacugaugaaucuaaaugucauuuaagaaugaaaaucugccauccuggaaugcagauuuacaucccaugugggcuugguucagagccucacaccuuccuuauacauaaagauagucauuggaauguugugcucuugcugugauuuaaguuaggcaaaaguauuggugucauuguuauauagauacaaagcccaucauauuuuaucucaaacauugaucuuuaggucagcuucgugaaagaagccaucaugaaaguguugaacuuggcgcucauguuugcagaagguuggcaggcaggccuaggggcuuggcaguaaguaugugcuaugugauaaccuguauugugaccauuucugacuagcuucauuugaggagucuuuccacccccaaucugagaaugguucacauaagacugugacuaggaauuuagaaguaguucaguggcuuaccuacucugcauaagaccuggaguucaagccuauguuccagcaguacauagaauuuagugacacuagaaagcaucaggaaagucaguuuccuuaucagcacaagcaauuuaaaaaacuaaggucuuuucguuaaaauaagcaaacaucugggcuggagagauggcucagcaauuaagagcacuggcugcccuucccgagguccugaguucaauucccagcaaccacaugauggcucacaaccaucucauaaugaaaucugaugcccccuucugguaugcagguacacaugcaguuauacauuaaauaaauaaaacuuaaaaaaaauaagccaacauucuuagauuaucugcauggcucaauuucuuauuguacacacguucaagcauggagaaguuuaaagggcagcaugacacguccgugugacucaccucagcaguuucugaggaggaccaguucuggaccgugagccccaccgcuucacacuugcugaaacauuuuaaaguaaaugauggguaucaugcuggguuacuuuccaaauuucuauguuuguaagcucuaaaagaugauguauauguuauuuuuucacuugugucauuuagaauggcaaacuacuuaaagucaauaaacagaaaagagccagucuacaggaacaucuccaguuuuuuuguuguuguuguuguuuguuuguguuugugucugugcuaggguuugaacucaggaccuuacucacgugugcuauguaaaugcuuuacugggcuacacuaccagccuggcuaucuucuuaugucaauuugaauauauaguucaaugcuuagccucugucuccuuuauaaaauauaugcagugauaauuugcugaaauggagcuucaugucuuguggcuuaggguuuucuugugugcuuguaugaggaguauauucacacaaauuugugaggaugcaugucucuuugcacauggaggccagaagaguugucuggguaucuucucuguuauccuccauagacuccucugagacagacucuuucccugagccugggacuuacuuuucucagccagaguggaaggcaguaaagcccagcaagccugcugucuccuccuccucaaacuguggcugcaggccuaugagaggccauuuguagacgcugggguccaaacucuagaccucagggcugcacacaaacacucuuaagcacugagcaccucuccaacccuugcgcagcauuuauagcagucgguauuuaguccaugcuaaucacgaggggagugcaccuuagugcugcugccauucagagccuagacuggagcccugugacggggagggcguuccuaagggaaggccuaaaaacacuagugucggcuggggaggugacucagcacacgcaagccugacagccuggauucaagccucaaaacccacagaaagguggagaaagaacucauuuuguaaagcuaucugcugccaucaucacgcagauagcacacacauaaacacacauuacucacagacaugcaaauacaaagaaaaaaagcagacuaggaguguagcucuguggugaagcacuugccuaggaucgcccauguccugccugaguucuguuccccacaacagaaagcaagaaaauagacaccuuccugacuauauguccucucaaaguuuacaaaacuacuuuaaucuguaacacuuaccuagaugaggggucacuauuccagaugcuguacugaauucauuucaguaaaguuuucauuucuacaacaaauugucagcaaaaagcagggaggaggacguuaagcauuucagagcugguauggggacauaaauaaauguuugccuauuuagaaaggggaggcuguaaggucaugaguuaaaggcucugugcacaguaauauuuaugaaagguuuguguucuaugaaauuugcuucuaaguaaguacugugguaagguugaggaggguuuguuggcuuuagguagauaacugccagagaggguugaugagcugcgcgcgcgcacacacacgcacacacacacgcacacacauacgcucaccccagaaaggaaacuaugacaucaaaguaauaaauacaccagagucaaacuugguaaggccaugagugcacacagguuauugaaaggaguauggaugauaggucacuuagaagaccaagaauaaccaaaauauaucagcuaugccagcaaaagggucccaaggauugggugacgauucaucagagcaucgccccauuccaggaucccucugcaggaccugccgccagcuugacagucucgucccugucccuccugggcagggucuccuccgcuagcacuuacuaccuucuguaaagguggggaagggacaucaagaagcuuucuaguuuccaccucccaccaugggauuuuauuuacuucaugaguuccuagcacuccccucucucugugagcuguguguguguuggggggagagggggugauaccaagaaaugugucaauuuggaggaaaccccuguacaacaugaacauauuaugaaguguuuuccugugucuguuuuggaucugauuucaaggccggccuggucuacagagcgaguuucaggacaaccagggcuacauagagaaacuuuugucuuacgaggggaaagaaagguaggcuaugagucuagcuagcuacuugggagccuaagcacauuaauuuccuaucaguucuagccaauaugagacucugucuaugaaaaauaauacaaauuaauguaaagcacuguuuccuaguuuaugaucauuaguuagccuguaggauuuuagaaauuauuccaaugagaauuuuauagccuaccuauuacuaguuccuuaauauaaauugaaauuugcuuucuuucuuagaauggaaucuauagagaagauggaaucugacuuuaaaaacugccacauguuucugguaaccaucuuaaauaaagcuguguguagaggaucuuuuccccacugugaguacauccucuuucauugucacugccuuccaauuucauuguaccuaacucugugugccaauauuuguuacuaaucacauggugaauugagcuuuuuccauuucaaaacugggaaauacuuagugaugauuugaauugguucggcagaauuaugaugggauggguaaauagcguaugguaucacuaaaacuaaagaucuccuuaaucaugugccuuuuauuccaguggauuucuaaagcugagauguagcagcuuggagaguugaucucucacucuugacuaucauaugaauccuuuguaacuauuccuuucuaaaugacauuuucuagcaaaauucaaagcuucuaaaacugccucucauuacaaaaaaaauguggauuuuuacaguucagaacauagggugugaaggagauaagaaauuugugaagugaauuaugaaggaguuuuuaguaugcugagauagacuaagugaugucucuggccaucccuccuuuuuuugguaaggaaaguauauauaaugucaagccaggagaugguggucauucacgccuuuaaucccagcacucaggagggagaggcaggcagaucucuguaaguuugaaaccagccuggucuacagagagaguuccaggacagccaggacuucacggagaaagucugucucaaaaaacuaauaauaauaacaauuaguauucaucucuucuccauuuguguacuuucugacuguuagacacuuaggcagaggcaggcggauuucugaguucgaggccagccuggucuacaaagugaguuccaggacagccagggcuacacagagaaacccuguuucaaaaaacuuaaaaaaaaaaaaaaaaagaaugaccaaauaugagaaaguauugcagucugucuguuuaagcaacauuaaguaacauuggugcaucugucuauguuuacaccgggccaggguuauagaagcagaugccaucucuagguuagaauaugguacugaacugugagcuaacccagauuuacaccguguagaauaaauacuguguucaauggaaggcuuuuuuuaagauuaaaagaucugagagcaagggcgugguggcacacaccuuuaaucccagcacucgggaggcagaggcaggguggauuucugaguucaaggacagccagggcuacacagacaaacccugccuugaaaaaacaaaaauaaauaaagaucugagauaaaaaugucaucaacuuuuucuauuuacauuaacaaauauucucuuuuuuuauauauuaaaauacugauacuuuaauuuuuaaauauacaacuuuaaauacuuuuaaguuuuaaauucacugcagucuuauucgaguauuuaaacauauuuagaacuaauuuuuaaccucuuuuuuuuuuuuuucuucccacaguggaaucucuugcacugucgcucauggcuggcauggagcaaaguuaaauaucucuaauuuaacaaguaccuuagacuucagcaucauccauguacauauucacuguuugcagcugagaaauaagaaucuguuuauuuuuauuuauuuuuauuguuaaaccugucuagacaaauggauuguagguauuuuucugaagauuauuaucgaguauguagaguuauguauauaauauuguauauauaauuguaaaauauauaggaguuguauaaaaguagacuacuaauauuucuuuucuucuaaaagauugacuuauuuuaauguauaugaguauuuugccugcuuguauauauguacauaccuggugcucagaagcaauaaaagaacaucagauacccuguaaguuuuacauuuccucuuaccuaaaaauugucuuagauuucacuauccuggauguauuuuuaugugcauagaaaaucccaaaagaaaaauaacaaccaauaucaauauauaaacuguacuuuacuuaaggccagcuguuauauaucgauuuuuggcauuuauuagcuaaccaguaauaucucaaauaaaaguauguauaucaucccauuuuucuaccuauuucauguguauuucuuagugggcacuguaugauaacagauggaugaugguguaagcagaucaauaugguaaagauauagcagaacuuuggccagcugggucaaacggauaacccucauucagccauaacacaauauauauucuuaagcauauauaauacauucgcugagauagucugucuacucugugcaugaaauauaccuaaccuguuguuuaauu

SEQ ID NO: 3841 - RNA, 92265 nt, Mus musculus
cacucucguggugcauagacacacaagcaagccaaacauucauacacauaaugaauuccuuuuuuuuaaauuuuuuuuaaaguaucuuuaguaaaacuuccagcucuaugcuggcuaguccuggaauucuuuccucauuuggccuuagcuucaacagaggucccccaaaucagggaaaacucuugaggcuggugagcauggcaguguggcgcugagucuucauccucucccagccggcuugacggguggagcccaccaagcaaaucccggcuuccuuugcugcggugaccugagcagcaagcggcaggcggggcuacgguacgggagacuuggggagacuugggggccgaccgggcuggccuagaggagccggacccaaggcagccagcgggaggagggaggagcgccgggaggaagaggccgagccgagcagcgccgccccggaggaaggggaggaggccggguguuuccuggugcauucccgacccgcccaagugacucauugggguaggaaagcucccggggcccgcccuggacaaccgaaggcggcgcagaccagguaagggcggucgccuggccucgggguccuugcuccacuguaguccgguggggcgagccugcagacggccucggcgcagccuccgggaccgcacggccucccgggauugccuccugggcucucgagucucccggucucugcacggcagcuccggagcccgggacucccggcccagcucggcggcuccagggcucccuccccggaaucacauuccagaaucccccggccacgggcuucccagugcagauucccuguucccuccgcgcugcacaacuugcacuccgguggcccggcucccgcgucccggacccccgcguccccgaacccccgccccgacucacccuggauacuaggaucccagaucucgcgcuuccggcacgagguuuagcuccaaagaggaagagacaacguuaauauuuaguauuuuacuauugaaaaguaaggagcgacgaauaguuuauguugcacuaaaguggcaaaacaaccccgaguccaccaugguucugccuucagaggaaaggaaggagaguguggucuagggaagccguccucagauucuuggagagaggcauuuugggcuuuguuaaggaaacgggauuguucaggagcaguagugcgccgccgcacauucguaacgaauuuuguacuuuaagccuaaagcaucugcguaauuuguaacauuucgugagugugagaaaagaaggaagagauaugcaacuggggaucggugagggcgaggcagagggaagcaucgggcaauccguguguugcaugggggagcccagagauuucucuugguugucggcuaacagaucgcuuaguugagucguguuugaagcaccgcugguacugggguacuccuacagguacugauacugagaucagcgcuugccaagguggggguauugauccuagacccuggccaaguucacuggcuggaaguugaagcacgcgagaccggugguauaccugaauaccagccuuccccuaguucugaguauguuagugguucuuauuaaaaagccuacaagcacauagccugaaagaauuaauucaguuuuuaaauacauguaaguuacugcagacaugcauuguaagaauucaguaggaauguugcggggaauacuucucuuucccucuuccccuaacagcaucuucccuguaaccuugauaaaaugcugcaguugaaaagucucucuaagaaaauacauccucuaaguauuuguguauuugaggaaguauguauuaagguuuuuuuaaagaauaaacacuguauguguguguuugugguauguguguuuuuagaugugggugcacaggugugugaauguguuuguaugugcauguagaggcccgaggcugauuuggcguuuuccaccuuauucuuugauacaaggucucucagcugaacuuagaguucacugauuggacuagucuugcucgccaguuuguuucggagguccccugucuccgccuuggaagcaaugggacuugagggagguugccaugcccauugucguuuauguggguucugagaucugaaauccuguacggcuauccacugagccaucucccuggcacuuaagcguguuuuuaacuuuacauauaguaauauucaugcuuuggaguguugacugccacuguaauuaagaugccaaacugguuccuaucaccucaagauuuucuuuccugugucccuuguagugaggucuuucauaccaucaacucuuggcaacugcugaucuuuucauagugcuauuuugcuuucuccagaaaguccuguggcaaucuuggagucugcauuuaagaugguucuauguucucaguaauaaguauggggguguuggggaggggguggcuauauuuaaggccguccaagguguuuuaccagccaaacaccauuaaagugaaaaauuaaugauuuuauauauauauauauauauauauauauauauauauaauauuauuugguuacaaaaacacuagucaaauaugucuguaagaaguaaagucagugcuuugaaaaguagagccuugggaaggugggguggcaugcagggaguauaggugcauacaguggguauagguggcacacagugagcauagguggcacacagcagguauaggugacacacaguagguauaggugacagacaggucugacaacuugaguuacaacccacaguggaaggaaaggacuaacuccugaaaauuguccucugacguccacaaggacacagugauuugugccgaaauacuuacucucucucccuaugaacacacuccauacacaaauaauaaauaaguguuuuuuuuuaaaaaauguaguucuggauacaaccuggaagacuaaaacguucuuucuucucucuuucccuuuaucuuaccauuucaaaaaaaagcaaauuuaaauauguauuugacaagugugugguuguuguggccugcaugaguuugugugcaucacauucaucagaagucuguagagacuagaagacgccauuggaucucuuggaccaggagauauaggcuauugugagcuuccaugugggugcugggaacucagcauagguucuccugaaaagcuccuaauugaagagccaucuuuaccccuccugaguuuugagacaggguuucauuccauggcccagacagccuugaauucauggugccucuacauuagccuuuuuguguguagggaggggaaggggcuugagguugggucucccgaaguccuggugggcuugaaccccugauucuccugccuccaccuucugagugcuaagacuggagguguggauaccaccaccuuuccugucuaucucagcuccuugagugcugacauuacagaaauaagauacaaccuagccugaaauaguacuuuuaaaggugagaaaauuuacaaacaccaccucaacaauuuuuuaaauaguucagaaguauauacaacuguauguguacugaagcauucugccccgacuuuagccucuuuuguuugaaucggaguuucuguaacaccgauugcauuccaaguguuauauauuuucacuuauugaugcucagcuggaauuccuuaaauguuucuauuuacagagaguucaauaauucuuguuuuguuuuuuuuguuguuguuguuuuguuuuuugguuuuucgagacaggguuucucuguguagcccuggcuggccuugaacucagaaaucugccugccucugccucccgaaugcugggaucaaaggcgugcgccaccacacccggcugaguucaauaauucuuucuauugauuguauaauacagucauguguugcucaaacuauagugauauaugcuaaaguauaucugcacaauucuaucccugcaucagaguuuaauuagacaaaugaaaauagguacagauguuaauuacaucauacaguucuaggagugcugugauaacugaccaaaacauugauaggcaguguacaacugucgucuuuaguguggguguguuauaauguauuugaucggucuucuggguauuuuucugacacgaguguccgugcaccacaugugcaccuggugccagaagaugacauuaaaugcccuggacuggaguuguagaugauaaugagcugccaugaggguguuuggaauugaaccaggguccucugcagcaaguguucuuaaccaccgagccaucucuucagcgccugauauugugcuuuaacauuuaucaacacuccaguugaucuugugucaguauccuugaguacaugcucaaggacaucacucugaaggugacucaccguuguauuggugugaagagacgcuugggcaaaggcaacucuuauaaaggaaaacauugaauugagggcuugcuuacaagugucagagauuuuaguucauucucauggcaggaguauugugguaggcauggcacuggagcaguagcugagagcuacauccugauccagagagauggagagggggagggagagagaggagagaggccuggcauaggcuuuugaaaucucaaaagccccugugacacauuuccuccagcaauguggcacuuccuaauccuucaaauacagcacuucucagccuguacauugagguuccuuuggggacugaacgagccuuucacaaagguugccuaagaccauuggaaauauuuccauugugauucuuuuuuuuuuuugguuuuuugagacaggguuucucuguauagcccuggcuauccuggaacucacucuguagaccaggcuggccucgaacucagaaauccgccugccucugccuccaagugcugggacuaaaggcuugcgacaccacgcccaguucuccauugugauucuuaacaguagcaaaaauuacagcugggggucagcccagcaugaggaacuuuauuaaaggguggcagcauuaggaagguugagaaccacuguucuaauccuucucaaguacugccacugucagacgagggagcucaaauagaugagccucuggggaccauuccaguucaaaccaccagggaagggaaauugugcucacguucuuaagacaucccauguuucgugcaucuuuguaagccagugcucccuuucuggcaaaggugcagauugugaauagucuccguucugugggccuuguuuaugugcuguagcauuagagccucguggaaaaugaguggguguggcugucugccagggaaauucuuuauguaaaaagacaacguccuguaguuugcugacuucucaguucacguauuauuugcccaguccuugaaauagaugcagcuguuauuuaccacacuuggugggugggugaagcauggacagaugaaauaguccaagauuagauggaaagccagguguugaguucaaucauuagguccuuaaauuugccaguuuaaaaaaauuagaagaaaagguacaaaauacuguccucuaaauguuggacccucagucaucuguugaaucaguauuacagcaggguaccuuccuggcuuuagcuaaccucucaguccccaucacccucagugucugucucaaacaagguuuuugaucuguuucacuuaguagcaacugcuagggauaaauuaggguuccauucuucuagaauauauacagguuauaaaaaaagaguuauuagauugguuuacgauuuaggagccagauaguucaguaauaauuguuugcaugcuauuuucuuuuauaauguuuuacaucgugcaacuuuguugagaauucuuuuaauaacugcuuuacacaagcaaggauuuuucuccuugucaccuguagcugcauguguugacuggguuguaagguaccuguaugcuugaaacuguuaugucacagugcuggauugugauugacuuucauagugccuucucauuccuacccugccaaggcccuggcuagucugguaucauuaugcaguccaggauggucucagacacacagucaucuucuugccuucugaaugauggggugcccagcaagugccacaaugucuggcuauguuucuuuuaguaauaauuuuuuuuauuuucaaguuccuuuuucuguaucaggcuagucauugccauuauuuuuggguuuugcuuuucauuuuguaucuuugcauucuucugacagggucuuacuauguaaucuuggcuggccuggcacuuacuauguagaccagucuggcuuugaacucauggagauccacuugcuucuuuucuucugccuccugaguccgagauuaaaggcuuuuugcaccaugcuuguuugguguaucuuuuuccauucuuuuguuucacuuccuuagugucuuuaaaauguguuucucauggcuccuuugaauuuuuuaaaaccauuuugaauaucucugccuuucaauuugaauaccuugucuauuuacauguaaugaaaauuagguauuauuaugauuuuuuuaagcuauuuuacuauuuguucuguuuaucuggagaacugauggcuaccaguagccuuuguaacacagguuacaaaguaucuaauggaaggcuuccagaauacuuuaaacacaacauuuguaucuguaauauuuuuaaaagauuuucauuaacagcuucugagcagauggucccaaagaaaccauguuguccuucagcuucugggaagguggcagggagcagggggugggugagcccugcagaaacuaauaguucuuccucguugcuccccagccaauguuaauaugcuugcuucuucaagccuggcagugacggcagaaaugguggacauugaacuucggcucccaaagguuuuaguuaugaaugaaacagauggacaaugauagcuauaaugacccugaauccacaaugccugugguuuguauucacaccacauccauucuccuggccaaacuugucaaguucuuuacuuuguauuccccaagcucaugcagggauuuuguuccacagagaagaaaaacugauagucagaaagcagugguuuccacuccugaaugugguugcuuguaaccuuguccuggcuaacacagcuggcaagaauaucggauuucuucuucaagccacucaaugaaagaagacuuuuguuugaagaauugucagugggaacacaaguuaaggcacagguccacacugaauccccuuaauauuuggggacucuugacucagguaaaaccaguucuuugccaaaauaucgagacuggccagcaugaagcagauguuguaauuuauuaaaagauuuauuauuauuauuauuauuauuauuauuauuauuauuauuaaguacacuguagcugucuucagacccaccuaaagaggauaccagaucucauuauggaugguugugagccaccaugugguugcugggauuugaacucaggaccuuuggaagagcagucaaaccacuuaaccacugagccaucucuucagcccaaaagaaaauuuuuacauggauguuuagugcaagaguuaagagagacaugcuuaguugccuuuacaauagccacacgacauacagagaguuaggauaucuguacuguaaacaaaauuaauagucuuuuuuuuuuuuuuuuuuuuuuuuuuuggugugauucccaggcaauauccaggacaggagugaggcuuuacugugcugguugguuugucaacuugacuaaccuggagggagccaccugagaaauggaguuacagugagagagugucuggaucaagcagcaggcaggucuauagaggaugacaucaacugccaauugaugcuggaagaccuagccuauuaugaguggcaccauucccuaugcaggaaagacguagacagagaaaucugacggagagcaagugagcaaggguccaugcguuuauucugucucugugcuugacuguccaugugaagcuuuccguucuucacuugaucccccugaagcaauggacuguaagcuggaauuguaagccagauaagcauuuucuucccugaguuguuuuuugccauuguguuuguccuagcaagaugaauggauuuagaaccucuguugaaggucauacacauuaagcccgguuagcugcuauucuaacauaaaggaagccuugucucuauuuccauaaccuucacagcaaaugugcauugggcuggaauucuugaauuucagcuggugacucuggagugagggucucuguucuuaugcacccguauguaauucaaccugccuuucuguccugccucagaaucacauacccggagccuuggcgcugcagcagcacuaagcugcaccccagccuagagcucuucuauucuaaagcauguucuuuuguuuaccacccacaaaccaugcagcagccucuacagaagcagggagccgaaagccacuucuccucuuggcuccccggggucagcugccuucagagaucuuugacugugcuugaaucucagaggcugucggaauucagcuuuguuuccgucccacgcaccagacucagaaggauuuuguacagacccauuugccuguuauuguuugcucugauugcaggagucggggccgggggugguaaucagcguuauaacuagaguucuccagaaaaacagaauaaaugggguauacacgugggccgggggaggcagacagaaacacugagauccacuuuagggaguugcuucacacagcuguggagacuggcagggccagauucugcaaagcagucuaagcuggaacugcacagaauacuuaaaugcugcgugcaaccugaaaccaaagaccacacagaagcaaaaugcccucuuucuugagggcugucagcauucuuuuuuucuuaagaccuuuagcucauuggaugagauccaucuaaguugggguagucugcuuugcuuaaaguugacugacuuuaauauuuaucucauuuaaagauuaucaucauagcuaugucuagacuagaauuugacuuugaccauaaacuuccuagauaguugucacaggggugagucuugguauuuuaauaacauguuuuagagaacugccgucuccaacagagaucaggucaguguuccuuuuguggggauacacuuaaguugcuugucuucuggaaucuagcugagaagaaacuguaccucuuauacauacaagcuaugagaagcugugaacccccacuucccugccccacuuuuuuugcuguacacaucuucccuagucauccccucuuccucuucuguagcucauguguccugucguugcucucagcaacccggucacuucuuuucuacugucuccugggcccauuucuaguucucucgguucuccucacacuuauucuuccccccacacaaacacuccccccauucuagcacccccaagacacgguuucucuaugcagccuuggcauuccuggaacuugcuuuguaaacuaggcuggccucaaacucaaugauguaccugccucuuccucccaagugcuggcguuaaagaugugcuugugccaccauagccugggcacacguauagccuuuagaagcuaggauauccguacgugagagaucaugugguauuuguguuucugagccuggguuaccuaacuuaaucuaaggauuuucaguuguucauaguaaccgugguugucugcccaaagccugcccaaggguaagccagccaaucagccuauacucguaccugaggaguuguggaugguuaguggauucugggggaaagucauuugcuguaagguauguugaucacguuccaguggaugaccccacccccaagagcauguggggagcugaggcucaagacuguguguuauuuaaaaaacaaacaaacaaaacaagaaagcuagaggcagggcaaggaggugagggugaaaccuaguggguggguuggaagugaauguaauaaaaaccccuuauaugaaauucucaaggaacaagaaaggaauuugcagcuccacuuugcugcagauuuugcaauuuuauuuuuuaauggcugaauaagauuccaauguguauauguggccuguuuuuguuaucuuuuacucugagaaugggugauaucugggcuaauucuuuucccuggguguuuugaaaagaggugcaguaaggauggaugugcaagugucucuuguaguaaacagaauaggguagugccucuaacgguuggguauugccaucagcuguaaacacggguuguuucacuacauccucaauggcacuuguccuuuuucagguuucaugaguuuuuaauuaugggauguacaccugacuauaggugccuagagaggccagaagaagguauuggauccccuggagcugcaacugguggugguugucaguugcccgacauggguguuugagaaucgaacuuggcucuuuugaaggagcaguguguguguuuauccacugagucaucucuggaacuccucaucuuuuuuaacuugaugguaaucuuucugacuggggugagauggaauuucaaaguagcuuuaauaagcauuuuuuuugauggcugaagauacuuaauuguuuuaaaaguauuuaucaaucauuuauacuuccuuggagaacugucauuguuuuauuuguccauuuaacagguagaaguuuuguguguguuuuaauuuuuacaguugugcucguuaguuucuguuaccuugacuaucaggcuugaacauaucggcggagagggagucucuguugaggaauugucucugugguauuggccugugggcuugucuaugggacguuuucuugagcauugacuaaugaggagggcccuguccacugaggggccauccaugggcauucaaaaaaccaggcugaguaagucacagggaacaaaucaguaaguggaauucccccacagucucugcauuaguuccugucuccaaauuccugacuuugcuagugauugacugguaccuggaacuuagauaaacccuuuccuccuagguuuauuuagucauggugucuaucacagcauuagaaagcauacuaggacaacacauauauucuagaauauauaaauacacacacacacacacacacaucucaucaucaauuuauugaacuuagauccaaauuuuacuuuuaaauuaauucucuggaauuacucauugccuuaacacugucugacaugagaggguuuuuuggcuucugagagugacaucaauaguuugcugaguuguagacuauuagaaaccacuuccuccccagacccaggcuggcacucuuugguaaauuuagaaaugaaagaggaaauuccagaguggaaggcugacacauuuggcaugguaaaagcauuagaccucgcaauaccuccucaguucacucuccagccccccaagaaaacagaaguuacguuuccgaaaaagcaagcaaaauggaaaagcaaguagcuugaccuggaaacaaguuugcuacaguucugccaaaguugucaugucagaaguguagugagugacuucaugaaugggagaagaagaggauucagagcaaagcagcagccagcccacaccagcaagccauugaaaagggauggggcugcaggucacaaacuggcuacuguauaggaaugugcccagucauagaggcaguaagagaaaugcagauuaaagaacaguuauuacaggcaguaauaaaaauaagcaggguucuaguugcuuuuuugacaguguuauuaauuccuuggauaaauacucaguaguggaauuguuggaucuugugguagacauauuuuuaauuuuuugaggaacuguguacuguuccauagugacuggaccagcucagugucaucuaaggauucucaugucucuacauccucaccagcauuuuuuuuuuaaagauuuauuuauuuauuacauguaaguacacuguagcugucuucagacacaccagaagagggagucagaucuuguuacggaugguugugagccaccaugugguugcugggauuugaacucuggaccuucagaagagcagucaggugcucuuacccacugagccaucucuccagcccagcauuuuucuuuuuaauaauggucauucccuugggaaguggggaucccucauugugguuuugcuucauaucugcuuggugauuagugaugcucuucauauaacuccuuuugagaaacacccauuugucuuuugucuaaauguccuuugaccaucucagaauggaaugaguugcuuuucuguuguuaaauugccugagucccuuagagucuuuuuucaccccuugucagguacacaauuugcagugauuucuuucauuagaugccguuccacuuacugaacuguaaguaugaccuaugacuuucuugccugaugaucccagugagaguacaccugcccuggauucaccuucgcuuuaaaguuagucaugugaccuaagaauccuuccuaugcuaugucgaaaauggccugaaaauacaggacccagcugaggcuuucccaugaagugucucuuccuuaggcgcucucugugggcagguauuuuaauggugauggucacaugaacuuugugaaugauggguucucuucguuuauccugcugauagauggcuaaguaccugcaagcaguucuugggaaagccagcagggagccagcugggugauuagaauuaugauucaccuaaaacccaaacaacuacagcaauaucaacaaaaccuucuuccucuagguccccuccuuuugggucauuguuggggagaggugcacugugguaguuguagcuuuagcaucucugggacagucucuugugagacucugugcccugugaggucuguggagucucuugguccuuggaagagggagauguugaagcuaauggacauuuucaacccaaauagccuucggguaggaaccuugguagguauuugggaauugaguguggaauagaugggccuuuuauugggucacagacagguuauugaugaucuuaggaaauccuggguggaagcuggcccaaggaccacagagggcugaugcuucuugcggcugugccuagagagaagaggcuggcugcgggugggaaaaggcuguacuguccaauagaacuguacccuuucuggguaagaggaaggaagagucaaaaagggcauguacugguagugugauugccagggacagacuuuacuagcuugcuuucuagucuugugaauaaaauaacauaacuaaaagcaaucugaggagaaaggggguuuauauggcuuucgcauccugucacagucuaucacugagggcagucagggcaggaauauggaggcaggaacugaagcaaaagccagggaggaaugcuauaacuaagcuuguuucccauggcuugugcagccugcuuucuuuuauuuuacuuuugaggcagauauaguccuggcuguccuggaaaucacuaaguauagcaggcuggucuugaacucacagagauccacuugcuuucuuauaccacucaggaccgccugcccaggagugauaccacaaucaaugggauguacccucccacaucaaucauuaaucaagaggcaaucugauggaagcaucuucucaauugaggucccucuucauagaugacccuagcuaugucaaguugacaaaaagcuuacuagaacaugaaucaagugguugcuauguacccaaaccuguaguuugcugcucuaggggagcugugaggguagcaagggagaaguggggacuggggaguauugauugugugaggauggcauucuuagcuguaugcuugcuaaaaaaaauaggagcuugcugauagauccaucgccuguuagugacaggcaacaggcaguuccuucuugaagaaaacaucacuucuggcuguagggaugagcacuggggaugcuuggugauguucucaggguggugccugguaugugaguguauaccugcucuucugaguggaccagauacaccauaguucugucugagcauucaggcugacacaggcuguuuccuguguuuaggcugagucaagguuguggaggugguccaugggugaaagggaacccugugaacucaugcugaccucgaagcugcucagugggcggcuggagcaaucuacucagugccucaaggcucagcuucugcuuucuguaaaugaagacuacccaacagucuauucuggacacugccagccccuaugucuuggguaucaucguucuccuaagcacaagagaacaccagugggggaacaguucuaaugaucuaauaagaagcccaccccauccccacaagggagacccaugccagucauccagcauggucaaauuggucagccacuggaauuuugcuaguguuuucuuucugagagauauacugggagcaauggaaacuacugcagggacugugugugugugugugugugugugugugugagagagagagagagagagagagagagagagagagagagagagagacugccugucugucugucugugccugucugucuuuaacuugcucuauagacgaggcuacucucagccuuccaugugcuggaauuaaaggcauuuaccaccaucaccuggcucuuucucuuuuuuaaaauguacuuuuucauauaaauccuuggcaucaguccaaguauggcucaguggauaaaagugcaugcuuuguaagccacaugagaucccuggauguuaaagccagguaagagguaagugggguggggcuguuauauguaaucccaucauuccuauuuggagaugggaggcaagauggagauggauacuggacaaucagcuggaaacuagucagccagccaaugugguguuagcagugcagagacagaaauaagagagacagcgucagcaaaguggaaggugagaauggacucuggaaaguuguuuucugauuucugcauugucuugcacaugcacauggacacacaugcacacacacugaaugaaugaaugaaugaaugaaugaaugaaugaaauagacaaacagaaauuuguacuuguugcuauggugagacauaccagaauuccacggaacaugacuuggacaacacagcugugggcagagaaagcuauuggagaugcaagcuggagagugacaugaucagaagucugcauuacacaauuaaaauaaaaagaaagaauggcagcuuggagcgaccccgacuucuuagugcgcaggggcagugucaugaagccuagugaacaagucugggguggggaggggcaaagagaccacugugucaugggaguggcucuaguggcugccaacugagcaugagggcuaaugugugugauauguggacagguacaauuucauugccucaucccuguaaugcaagccagacugauuuauuuguuguuggaguuguucuuugaacuucugaguugcugcuuuugaaauugacauuuggaacuuuuggguacuauaagugaauuucuucuuuaguagcacuaggucuguuguuuugguucuuagaauuuuguuuauuuuuauuuuaugcauaugaguauugucugcauguguauaugugcagugccugcugaagccagaggagguuaucagauccccuagggcugaaguuauagccaucgugaguucucaugugggugcuaggaacugaaccuggguccucugcaagagcagcaagugccguuaacccauggagcuguuucuccaguuccuuugcuugcuugcuugcuugcuugcuugcuugcuugcuugcuugcuugcuugccugauugcuugccugccugccugccugccugccugccugccugccugccugccugccugccugcuugcuugcuugcuuauucauuuguuguuuguauccauccuguagcccuggcugaccuggaacuugaucuuagaucugcuugccucugccuccugaguucuaggauuaaagaugugcaccuccacauuugaccuaaugguuuuuaguuauaagcaucuuacccacguugucauagcaguuacauauaugauaaaaguggcugcagauuaagccuugcuuaaucuuaguucaguguuuagcugugcuaaacaugggagaaaaaggaacaauucaauuaggcaggcuuuagaagugauuucuuauuaguuugaacaguuugaaaguggauguuuccgucuuucugagaagggcuuucauuugcauauagaagaggaagaaaaugggacaccuugcauauauuaacaggaacaugucaucauuuaucuuucuguuugugcuauaguuaggcaagcacacuucuuccuuuuuguuuuauaaauuacuauacaaagcacuagguuucaucguggcauucaaacacaauuugguuuuguugaucuuccucccaguuccuucuaccccagucucucugcauggguucccaaguagucuccuuucuguuucuguccccugugucuuauuggccucccugcuuccuuagaaacaccucuuucccccuccuguggucuccuucuaguuuuacaaccuuuccuuauuuuuagaccaacauuugugcauggccuuuuuaaaaagugaaauuuuuuguuuuauguguaugguuguuuugcccgaauauauauguaaguacaucacaauaaguguagugccugugaaggccacaagaccugacauugauccucaaugacugucuggucacccuuaaaauauucucuguggcuguuucucuugauuggagcccguguccccuggcacugcuguccggugaguguauaccuagacucacuguuuucuuuuguccuuccuagucuccuagcauugugccagcaaacaggucgaaccucagucugguguucugauuucuacuccuuugugcagcuuugugcaggaacuucuguuuuguuuuuaauuuuugagacagugucuugcuaaguuuguaauaccccaaauuaaccuauaacauccugggaugcuggcauuuguaguucuuggaaaauaacaaagccucaugggaaaguaugaugucuuacgguuuugucuguaaaagccccuacaacacaugucuucgggccaacucagcugggaauuccagguaguggcccugaccaaagucuuaucuuguucaguauuuaauaaagcuugcuucaauuuuggcucaaaaugguggaacugguuuuucuccagcgaaucucaggauuaacaaauuaccugggccggucuugaaauuacucuguagcucagacagagcuugaacuuguuauccacugcuuuauaguccaguaguuuggauuauaggcuugugccacaagcuuuugugagccugaaguuuccaaggacagcuugucuaaacaugagagcaucuguucuuggcuaucuuccugaaauugcccagagacagggaaaauuaucaagucauaaucgguuuuguaaagaaacaauaguuuaauuauucaucauucuuuguuucaaaaugugguuaacugucugauugucuaacuauaguuuugcaaaagccauuucacuuuuuccuuggguacugacuguagcaucuacaggacucaguggggccagaauggggaaggguggggcucuuaguuuugggcugcuggcaacuccuauggaucugucugcuguuccagccucacacugccucuuuccugagccuuaggccuggaccaguuuuguuugcuaacccuggccuugacuccagaagucuaguugcucaucacuggauagaggacacacaagaucccugcccuaugugugugugugugugugugugugugugugugugugugugugugugugugugugugugguguguuuguugcuuggagccuagggcucucaguugagcugggggccuuugagcaccauucugcuuaucuuaucaguauauugggaugaccccaccaugggaguggccaugagaaggacuuacugaggaacauuuauggaaggagugagucaucagugagugacauguagagggaaggaagaugcucagcagcccugccacaccuccaacaugaugaacacuuacuucucuuucugugggcacacugagacacucagccuccucucuauaugguacccuggugcugcuugcucuuaccuggugccuugugaugcucacccgguggucccuugaucagacagugaaauaaacaaaccugcggugugcagcuccaagcucagacugggucucucacugagcaaaugcugagcacuugcucgaugcaaauuaccagcuaaccucccuccugagccuugaagauacuuggugacuagcuugggaaaucacuugaaaagauauuuuaggacacucaauaacaaaaaugaguugacgacuuauuaaaaugccagauccaauacgguauuucaauuaguuuuuguaacuuaggaaguguaggauuuggagacaaaugugaacguugagccgcugccaggagaacagagucagagaagaaaagcauccuugauacugcuuacucagcuaaaccacaaaaggguuuguuaugugugggucagugcagggccugaggaggcuacagcacccagagcuuggacacguggagcacuaggcuuuauaggccaagcuugagaagguaguuguuagcuacagaacagaccucggagucuacauuaagcauguauuguuuuccuaacuaucaaaaugccagugcgcucuuucucccuuucuuucuuccuuucuuucuuucuuucuuccuuccuuccuuccuuccuuccuuccuuccucccucccucccucccucccucccucccucccucccucccucccucccucccucccucucucucucucucucucucucuuucuuucuuucuuucuuucuuucuuucuuuccuaaucuuacaacccaagggcauuuggcccccuaccugggugauuuucuaugugugugugugaggcccguuacacaaaauaccacagauuagugggaacuuaugugcucacaguucuggaggcuagaaguucaaggucaagguuauaggagggcugguuuuaucuagcacuguccuaacguggccucuucuagucucucugcucacccaugaugugcuguucucaccagacccgagggguggacaucuguguguaugauuaugucauuaaacggucaauggcuuauugguagcaccaacaggaauaagaguuauuccaaauaugugauuuaaauuuuacugugcgauauucauauuaugguaucuaugcuggccaguuuuaagucaucugaaaggagaaaacuucaacagagaaauugccucuguaagaucaagcuauaagcaagccuguggaacauuuuauuaauggccuguuggaucauagcaaaaaggaaucucacccugugagcaauuuucagacuucaguuuauagaaccccccuuuaauuaaggaguagucagguuccucugaggaagaaauuugauaaaauaccuuuaaaguucauucaacgcucuccauuccuucccuagagggaccuacagcuucuuguacaaggguaacuacacuguggaauggaaacaaucagacuucuccaggucuguuagauccugguucugaauugaugcugaguccaggaaauccuaagaaacacuguggcccuccuguugaaauggaggccagaugauuaauagaguuuuggcugacgucugacucacaaucgguccagugggucucugaacucaucuuguaguuauuucuaguccuagaauguauaauuguaauagauacauuuagaaguuggaagaauucucacauugguucccuggccuguggagugagggcuauuaugguuggaacggcuaaauggaagccuuuagaacugccucugccagggaaaauagugaauaaaaaacaguaucguaucccuggaggaagagaagaaauuaguggcaccauuaaggaccugaaaguugugcuuggguguguguagagggguuucuaccacaucucccuuuaacuauccuacuggccagugcagaaggcagauguaucauggagaaugacaguugaauauugaaaacucaaucaaguugugacuccgauugaagcugcuguaccagaugugguguccuuauuaagcagacuaacacaucugguacaugauauccagcuauugaucuagcaaaugcccuuuucucaguaccuguccauaaggaccaccagaagcaauuugcuuucaguuggcaaggccagcaguauaccuuuacaguuuuaacuuaaggauauauuaaauccccagcccugugucuuaaguuagcuaaaagggaucuugaucaucagucucugccacaaaauaucacauugguacaccauauuguugacauuuucugauuggaccacaugagcaggagguagcaacaaccacuuuggacuuguugguaacauguaugugcaucgaaggaugggaaauagauccaaccaaaauucuauggccuucuauaucagugaaacuuaggagucuaguggggugagacauuaagagauaguccuuuuaagauaaagaauaaguuauuguaccuggccccuccuaccaccaaaaaagaagcacaauauuuaguuggccuguuuggguuuuagagacagaacauuugucacuuaggucuguuacucuggcccauauaccacacgacuuaaaaagcugcuaguuuuguguggggccuggaacaggagaaggcucuucagcagguccaggcugcugugcaggcugcucuaccacuuggaccauaugauucagcagaccugaugguacuugggaugccaguggcagauagagaaugcuuuuuagagccuuuggcagacuccuacaggugaaucacagaagagacauuuggaauuuuggaacaagacucccaucaucaucugcagacaauuauucucccaugagagacaucucuugcccugcuauugagccuuaguggaaacugaacauuugacagugggucaucaugagcuggguauuaaucucacccaccaaguuauugcacagcagcaaucuguuaucagacagaagugguauauacaugauugggcuugaucagguccugaaggcacaaacaauuuaugugaagaaguuucccaaauggcuaugguuucuauugccauuacugccaugcugucuucugccaaguauguaccuguagcuucauggggugugcucuaugacugguucaugaggaagagaagacuaggguaugguuuacugaaagugggguauacaugauccaccccaaaguagacaggugucuacuuacauuacaaccccuuucugccacaacacaucaaaggaugcucauauaugcauuucaggaugccccgaaauauagcagcaaagggaaaucuucacagugggcagaacuucaggguaguacauauugucaugcauuuuguuuggaaggaaaaauggccaaauaaugcgaguguuuacugguucauggguuguagccaguggauugcuacauggauagagacuugagaagagugugauuggaaaguugguaagaaagacaucugggaagaaguauguggauaaaucucuccauaugggugaaggauauaaagauacuugugucccaugcucaucaaaaggugacuucaggagaggaggaguucaguaaucaaguaggauaggaugaccuguacuguggacagucaucuucuuuccccagugauccccaucauugcccagugggcccauaaacaaaguggccuaacaacauggcugacauugaccuggcuagugccaagagugcuagucugcggagugccagaucugccaacagcagagcucaacacugagccucagauaugguaccauuucguugggugaccagccagugaccuaguggcagguugacuacauuggaccacuuccaccauuaaauagacaaugcuuugucuugccuugaguagauacuuauuauguuaucgauuugccucuccugugugaugcuucuuccaaaacuuccaucuguggacucacagaaugccucguccacagucaggauauuccgcacagauuugcuucugaccaugaaacuuaauacacugccagagaagugugacaguaggcccacagucauggaauccacuggucuuaucauguucuccaccaucccgaagcagccggucugauagaugggaugaccuuuuguagcuacaguuauagcaccaauuagguggcagcauccugaagggcugaaacaggguuccccagaaggcaguauaugcuuugaaucagcaccgaauauaugguacaguuucucccaaagccaagauccacagggauggacaaaggaguaauucuacucacugucaucccuaguuacucauuaggaagauuuuugcuuucuuuuucauaaucuuaaauucugcuggccuagacauuuugguuccagagcaggaaaugcuccugcuaggacccugaacaaacauucuguugagcuggaauggucuucucauguccuuaagccgacagguuuaagaaaggaauaacaguguuagguggggugauugaucgauuaccgaggggaaauuggauuguuucuccacaauggagauaagaaagcacaugucuguagugcaggagauuccuugggaccacgguucuaaacccaugaccccuuugggacucaaacagccuuuccacagggaucaguuaagaucacuggcaaacacagacauuuacauuaugauucaucacgggagcaaaauuacaguuaugagguagcaacaaguaauuuuauguuugggagucaccauagcaugaggaacuauaugcaagcaucccagcauuagggagguugagaacccacuacuuuaggaugucucuugguacuaccauguccugugauuaaagucaguaggcaacuacaacaaccuaauucaggcagaaugacccuucaggauugaacauauggguuuuccucuagaaaagagccaugauccgcugagauacuugcugaggaaggaggcuauacaaguaguagagcaagguaguuauaaauaccaguaaaggucacaugaccaguuacagagacaaggauuauaacugacaugaauguugguuuuuguuaagaaugugauuguacaguuauuuguguuuucuuuccucgauuucuuuaucauguaauguaacaucaguuaagagacuaucagugguuaucacaucuaaguuugugauacuaaaaaaaugucccucaagggacauugccaccuauucuaaauuucuaaaguguuugccauuguacaugggaucguuauaucauguuaaguaaaauuaugacuuagguauuguuuucauuuagagauuaaccaugacaugagauaugauucugugucaaguugacaagggguggacuuguaauggcugaucuugguugucagcuugaccaccucuggaauuaacuaaaacccaagcagcugggcacuuuuuuucuuaaagauuuauuuaguuuaguuuaugugugugguauuuugccugcaugcacugcagugugcaccacaugcaugccugcugcagugaaucaccaggcaacuggaaguacagacaggugugagcagccaugugggguacugggaauugagucccuguccucuagaggaacagccagugcucuuaagugcugcaccaucucuccagccagagggauuauuuucuuagugaaaucauuuaaagugggaagacccacuguuuaucuuugguuugagguuggaggauccaccuuuaauaugggccacaccuucugcugucagccgggcauggcacaugccuuuaaucccagcacucgggaggcagaggcaggcggauuucugaguucaggcccagccuggucuacagagugaguuccaggacagccaggacuacacagagaaauccuaccucaggaaaaaaaagaaaaaagaaaaaaagaaaagaaaagaaaagaacauaaaagaaggaagcuggcccccuuucaaaaggaaaugagagacauuuuauuagaauuagaggaaaguaaacaggucaagcaaaauggaggucucagcagcuucuagaaggaggcagacuguguugagaggaagagagaaaccuaugcauucuaacguucaagaucgcagaccagcucagcagugcuggagaccugagauugcauacacgguggguggggguggucggcugggaggauggcucauuuggagagcaugggagugcucugaguaguuguagagcagacuggcuuagaacuuuggccaguguucguagaguucugcuucaggcaggcuuagcagugagggacuguaaacauuaaagaugaauacuucuagcuuaguaaguacauaugccauugauagggggaaaaaccauuuuguuuaaaaaagaaagcaaaaucuagccacacuuugcugggaggagacagcuuuuccuugucacgauuugccgggaggagauggcuuuccuuggugggccuccaccuuuucaaauggcauuuucaguuuugagagggacagcuguggugccuuuuacaugccauuucaaauucuaaggaggaggaguucugauauuucccccuuccuugaaacuaguguguuaccagggaaacaagcugcuccuacuagcugaccugcugucaguuuggagauguuuauuuuccuaguuuucuucccaauucuguccauuuugcuguggaauuugaagguuuuggguucgaugcagacagagcuaaggccauucugccaucagagcauggcuccuuuuaugguguaaggccaugguuucccuacaguaaccuacuuucucugaaggcccaaacccacuggcuuccauuugacuaguucuuaccuguuggcuccuuucucuucugcuuucacuaacagauccaucuauccaucuuuaauccuuuuagaucauuuagaguuaauguaauuauugauguuuggauuuggcacgguucuucguuagauauauguguuauucuuucuuucuuucuuucuuucuuucuuucuuucuuucuuucuuucuuucuuccuuucuuccuuucuuccuuucuuccuuucuuccuuucuuccuuucuuccuuucucucuuucuucucuuuucuggcuuugugucauugguuuguuugguuuggugcucagaauugagugcaaggcuuuaagcacacuaagcagucuaucacggagcuacacugucagcccucuuuccaccuucuuuuagaauuugagcauuuuguaguuuucuauuugaauuuaucccacauugugucuauuuaauaguaauuuccaguuaaaccuaagacuuugugcauucaagaagaacaaucuaccacugagcuaaaucuugagcccaguaguuacuuuucagcacuguguagcucuuugcuaguggguguuauaaagauuacagaguacaugccuauuaacuuucccuaauccuuagggcuagagaacguggagaucuuaccaccauguaggguugcuuuucucuggugaauugaguucccuuuugugccuuuguacucuggguaaaauaauugaaaaacagacuuagaagguugcuugagaaccauuuuauucgaguuuuugaaaacaaaacaaaacaaaaacccaacagggcagguaagcuguaaaucuuggcaguucccagggagaagggagcugggaaaacccaugccuugaguuaggagcaacaaugcaugucucuaaacagccguuaaggaaaacaugcguaggguuucggcugguguucaaagaagagggagacaggaggaaggggaaaaguuacagcucaaaagaugggcacccucagcagagaucugcaggcagugacccugaaggaggggcuucuggguuaucuaaguacuuuaauucauuaaagaaaugguugcuuuucccaugugcuugguuagcauggugaauuagcuaaucagguaaucuguccagguaauugaaugucuaguuggauugucugucugucugucugucuauuugauggauaccccguucccaguguuccuccgcuccucccccccccccauccccucugacaagguggaagccccauuaccacuuucccuccaacccccgggacaucaagucucuacagggcuaggcacauccucucucacugaggccggacaaggcuuuuaucucucuccacauagugcuggcuggccuugaccccaggaauccaccugccucugccuccugaguguugggauuaaagaugugugcugccaugcccagcaguuggaguaacuuuuaaacauuuuuuuccacaacauaacauuuuuauuaauuauuuaggaauuucauacaaugcauccauccuuuucccucuggccugccugugugcuuaagcucauguggagaauugucaaguuuucuacauuuuaucuuucaguucuaagaaucuccacuguccacagacauacaugccaacaaaacacucauacaccuacauucaaauaaaaaauaaaauuacagccagguagugguggcacaugccuuuaaucccagcacuugagaggcagaggcaggcggauuuuugaguucgaggccagccuggucuacaaagugaguuccaggaaagccagggcuacacagagaaacucugucucgaaaaaacaaaccaaaacaaaacaaaaauaaaauuacaaaaaaaucuccacugaguucucguuucuuugguuuggcugcuuguuguucacccugaacuucuccauuugguuacugggacuuuucacaguugaugcuuugaagucagagguaggagcugugacuuccugcuguugauuguauaaucacaucauguauauuaaugaaaacgcaauuacaucaauuuccuccuuucuucccgccagccugccucggguaaccccucucgcucucucgcucuuuccauguuccccauuccucucaaauucauaaccucuuuuucuugauugucacuguuacauacuggcauauauauucauaauauauaaacauagccugaugagucuguguguauaugguuucagggcugauugcuuaggguuagauaaccaguuagaaggcuuacccccgaggagaggcuaauccuccuucuuuuccuaugggugcgaccucuaaaagagcacagaguccucguccucacagauagcacuagagaaaccaggaauguuacacucacaaaggcuuacagggauuuauaccugcuuuccacccagaaggcugggacuggauguuguuaauagccuggugaacuucgcuauucuauagagcuaggccucacuugaaucccuccagacucgugagcauuauuucucccucauuagaaccaacucuuaagaaaggguuacuuuacauggccucugcagaagaguuuacuauucuuauuacaaagcuuuccuaccuagacagcuguccugagcauuguuucucagucaguagaacaugcauaugacauacuuuacaagggaguuucaauguagucaugccuuaagcuuuguuguaauaauuaucagaaggaaacuuguuuucaaaguuguacugugcuuaaauaugucaaaauuaaaccacuggagggucaccucugccagcuauaacauuugcagggaacccccucagggacccuuugagauuuuaccucugugguaaauggugaauaaaauggccugaauggguauauagagggugguauuauuaguagguguggccuuguuggaggaagugcguuauuagucacggacuuugagguuucaggagcucaagccaggcuuuaugguucaauaguuuuccugcugccugccaaucuggauguagaacucucagcuccuucuccaacaccaugucugccugugcacugcagugcuucccaccauggugauaguaggcuaaaccucuggaacuguaagccagucucaauuaaaugguuugcguguaagagaggcuguggucauggggucucuucacagcaauaaaacccuaagacaaccccuuucugccuuagcauguuuauugauacugccauuguucgagucuuguuuaugcaaccauuuguaaaauacuguuucacagcagauauccuggcguuuuggcucuuagaccccaacaugugaccugaacuguagauguguaggauaugugauguaaauauagccaucagggguggguucuccaagagcuguucaucucugcauuguguccgguugugcuuuccuguaauuccccaagagcuguucaucucugcauuguguccgguugugcuuuccuguaauggccuccauuugcucuaaaaagaagcuucuuuggugagggaugauacugcauuuguuuuggauauaaugaugagauuuauaaugcaguuaggaauuauucuggacugguaaaguggaaguagcagauuuucuucugagauccauggccucaguagccccaggaaguugccuaggaggucuuuaugugcuggguaacacauaaaguggaaacuggacauuguggauguuaugcuaugagacuuuggucuuaccauaaccacuggaggguguugcugcuuuuacguuuauuaagcaaacagccuguguucucugggcuguagcucccauuucaguacugcuucugcuaugccacuuagaccugucuuccgcuguguguuucaguggcuauaugagaccuuucuuguggcuuuauaaguacaugcagucuuagaucaauacuugugcuguuugaggucagucuggauuuuuuuaaaaaaauguuuauuuauuuauuuauuuauuuuaugugcaugaguacacuguagcuauuuucagacaccccagaagagggcaucagaucccauuagcgauggcugugagccaaucauucagucuguaauuugaugaacaguucugaggacucucuguuccucaccacacugacugaggacuugcugggucucuggaaccucccuuuucaguuuccgucuuagacuguaacucugcuccuucagaggacacaagggcagcaugccgaggccugugggucuuuaacguccgcacugccauuuuguggagacuuggauccuuugugcuacuuccaucuuagaacacaaccuguccuguggcuccaccuguggacagagcccaggucuucauaccuccccuccaggagaguggacuaucuuuguaccccaccaccuauccugcuagggccagaacacuuucagugggagggagggucugugcuucuucugcguuuuguagcuggcauagaagacuuguguuauaccugcaccucucugcauuucuguccuagccuugguguuuaugacuuucucucuaacagccacuucccuaguucaccuuggacauaacuucucuaguagcaugucugugauuccagccugccugauucuagcuguacugcugguggccaagggcaaugcucucacgccugucccuuauauauuuggaauaaccaugcaguagaugcugcccucuugcagccauuugaagguuuaguauagaggguacucugaggggcccuaagcacuagcaacuaggacuggagugccaguauagaaagggugugggaagugacagcaaauguaguauccagaauauucuauaguaaccagguauccuuaguuagggacucuauuugcugugaggagacacuauaaaacucuuauaaaggaaaacacuugauuggugcuggcuuacaauuucaaaggaagggaaacauggcagcaugcaggugcacauggugaugggggagcugagaguucugcaucuugauccauaggcagcagaagcaauugugugcuaucccggguguagcuugugcauaggagaccucaaagucugccugcacuguggcacacuuucucccacaagucacacuuauuucaucaagaccacacccccuaaucgugccacuccuuauaggcuaagcauucaaacacaugucuguggggcccauuccuauucaaaccaccaccccagggugacuaugaaggucaagagagccuucccaauaagccuggaggaaggaaaggcucccaaggauaguccccaggcccuugugcucuggucgucuccagugcccuugaaagaaagggaagagaagcccaugugacccgcugaaagcuuguuguguauuccaggccacaucuuuccucacggguggcucuguacuuuguucuguugcaggauggcugcccaagugacacuagaggacgcacuguccaauguggaccuccuggaggagcugccucugccugaccagcagcccugcaucgagcccccaccguccucgcugcucuaucagguaggucuuggggcagaugugacguagcuggcugcucugaccucucaacgugaccguuuguuuguuuguuuuuuucccauuuuccuucagccaaauuucaacaccaacuuugaagacagaaaugcauuugucacuggcauugcaagauacaucgaacaagcaacuguccacucuagcaugguaauguaucuauuuguuucugaaugucuugcagguguuauauuugaacagcaaacaaacuauauuuccugauagauuagguugagagaaagauaagaaaaugucuuauaguuuuaaggaagucuuugccuuuauuauaaaaacaauggauauucuuuuaaaaaauuuaaucucaagauggguggugguggcacaugccuuuaaucccagggauacccaggcagaggccagcagaucuuauagagugaguuccaggacaccuagggcuacauagagaaacccugucuugaaaaacaaaacaaacaaguaaacaaacaaaaauuucucuggcccagagaaauucuuugccagcauugcaaggguaccucuuuuaguuagcgaucuucuuccgugucuguacuuacauauguuauguauauacucauaugggacuuggguuaucuaaaugaauucuguuguaauuauauauuuugaugguuuuaugaacauuuucaaaucauggcauuuacuagagaaaauaccuuuaauaucuuauaacccauauugcagugucuacaguugacuauuuuucuacaucuacucuguuuccccuuuugugugauaaagaauaccgugaugaacguauuccuauauauuuauaaaaaugaaguuauaaaaagaaaagcagcaguacuuuuaacucaucuuaaaaaccauugccagauuucuagucacaucuuaaagaacaccuaugggauuuuacccuucuuaccaaagcaaaugguauggaaguaauggaaccgaacaucaaaaaguagauuuuaaaaaugaugguagcccucuucuuguggaccgcaucccuaaacuuuuagugcuguaagaagcaggcugucuuuuccuccuguguauccugggcuggcagcucugcuucuggacccugugugaaccaggaagcuugguguggcuggagaagaagcuaugagcauggcgugucuugcccaggcuuucacaccccuagcuucaggucugcauuauagguaguuacuuaggguugaggggggccaagauguaucucuguggcagcucuccucagaaaugacugcacugucacccagaauccuuugcagccugcugaagcugaaggggauguuugcaguaguuaugguggucugucauguacagugugccucuugucaggcuaccgugucucaagaggguagguagggcacuuugugggacuaccggcaguuuccaucucucuuugugcuucuuauucugcuuguacgugauuuguccuguguauuuugcagaacgagaugcuagaggaaggccaagaguaugcugucaugcuguacaccuggaggagcugcucccgggccaucccucaggugccuugaccuuuucugccacaccuguccccaggccuaccaggccgcagcaucuccccccccuuguaugguuguggaaugccugcuucagcgugauaagacucuaacucugaguuucuuucuuugugcucaggugaagugcaacgagcagccgaauagaguugaaauuuaugagaaaaccguggaaguccuugaacccgaggucacaaaacugaugaauuuuauguacuuucagguaaaacguuaaaauaauaagagggguuuaaugcuaaggaguauggacagcguggucugcagcaagaugaccgcaucaggcugaggaggacuaaggccucggcagucuggagugacucguucuuuugcauuucaccucuuguuuagcguggauuuuuauccugcacaaaagcucgcguucaucacuuccaaguccaggauaugucuaguucuucagcuguuuucuugucuuccugcuacccucuguugaccaccuuugacucuucagucgggccacauggaagagacuugcuggugcuuaaaguaguagaaauaccuaaacacuuuuuaacuguagcuuuccuugauuuguuuuguuuuguuuaaucuuaaaguuccccuuuauguucaccucugacagucagcaccaguaugauacauguuguaugggagcauuuugcucauuaacugucuucaguuguuugcuguugcuauaacagaguagcccagugaagcugcuuaaugaagaaaggguuuccuuuugcucaagaguagaguccaucauagcagggggacucaaggcaguaggaacuuuaaccaccgggucacugccauccauaaucaugauacagaguuaagaaugcauacugugucucaacuccuuucucuacuuccacagcccaggaugccagcuagcggauggcaucaccuauaguaggucugucuuugugcccccgucaguguaaugaagguaauccccaggaggcaggcuugcaaacccaucugccaggugaucauagauucagucauuugacaaucagcaguaacgguuaccaucacaguaguuucacugggauaauccgguuaccaucacaguaguuucacugggauaauccgguuaccaucacaguaguuucacugggauaaucagcaaacuucuuuuacuuuaguaaaagaugcaguugcuaaccugcaaaauacagaccaaaauacagguuuuuacagagcaaaggcauggaaauugcucagacaagggacucuaucugagacggagggugauccuagagccucacagagaaaugagggaccguccuguccuugaagcguagucgugaguuugauaagcugcucacuagggcacuucugcauucuuccccuuuguguguucagagaaaugccaucgagcgguucuguggggaagugagacgccugugucaugcugagaggagaaaggacuuuguuucugaagccuacuugaucacccugggcaaauuuaucaacauguuugcuguguuggaugagcugaagaacaugaagugcagugugaagaaugaccacucugcauauaagaggugagcuuagacuugcagcgugcggccggucugcucagagagggccugucuuagcuuuacagguagcaagugcauaucuccuaugugcuaacaucaucauuuuuaaaaagauuuauuucuuuucuuuuuuuguuuucuuuguuugguuuuguuuuuuguuuuuuuuuuuguuuuuuucaagacaggguuucucuguguagcccuggcuguccuggaacucacccuguagaccaagcuggccucgaacucagaaauucacccgccuccuaagugcugggauuaaaggcaugcuccaccaugccuggcuuuguuuauuuucuucuuuauuuuauaugaguacacuguagcuaucuucagacacaccagaagaagacauuggaucccauuacagaugguugugagccaccaugugguugcuaggaauuggacucgggaccucuggaaaaagcaguccgugcuuuuaacugcugagccaucucaccagcccaucaucuuuauugauaggagcuacuuaucagucuugggacugugaauacauggugccaagaauaaggugcaggaguaacuaguaguuuaagggucuuacacaucuugugcggccuggaguuuuuaggugugcuucaaucguuuugggggaaucugggagcuugguucccuugagaugauaagcaucuacaucuaucucuguucacuguguggaagugcuuacccugaggaacauuguuuagaacaugggcuuuucauccaagcauaccaaguugaaguccucagagaagucaucucccuuguuugucccuugggugcugagggacacuagcacuucauugcagacacgaggucgccccaugcccuguuggcaggugucuuagaaucaaucucacugagcauucuagggcuucuggacagcucgcucuuugcgacggcaacuucagcuuccuucuuugaaggcagagcuucuagaaagaggccagcagugguguguuagucagauuuugauguugcugugaugaaacaccugagguucagauuuaggguagguuuucugacuuuaagagguuuaggaugagucuucccgcugcaaaugaucgaucaaguaaauccaucauagcuauaccaagcugcuugaguuuuacuugauuccagacguagucagguuuacaguacgauuagcaaucacguuaccuuuuauauucucauauucauucauauucuuucucuuucauacucauccucucugucucucucucucuuugucucucucucugccccugccccccucacacacacacauacacacacacacacacacacacacacacacacacacucauaaucauuucuuuugugcccagaugauaacuuucaguacauauucugaguagaaugcaaaaguagccccacacaacucuggugagccuugacugaaauagaacgcaguguccucaauuccuuccuuccuugguugucauggcuucuauccuagcaucuacuggagucaauaaggugaauauaggaaaagauagagccuuacuauaucagugagaugauugaacuauauucaaguuuucaaaauauuaauuuuuaggucuuugauuuaauuacuuuaauuagggaguucucauuccgcaguuaucauauguuguucauuguccgauauggcugcuugaguucuacccccaauuuauaucuggugaacagggaggaaagagaacauaaagccguacucuuucuuagaaguaaacauucaacuuccugauacuccuuuucauccuaucucaugggccaccccuugguuaccuggccacagccucugcaagggagaugacacauuaucauuucaggccgaucaugaggcagaaaagaagugaauucauuguggauaugguccuuccuugcggaaccauaaaaguuuaagauucuggguugcccagauagagccuugugggcaguuucuguuacauguaaagauuucucacaguuucuccacacagacguaacaugugccuuugaggauuuuaccgugcaagcccuuuugucugccucacauuguguagcugaauaguuggcaaaucucgggcucugggaaguuccaguacuagugcgcugaaacagcguaacuggggaggggcacuuacuucuuguuagaaauagugguggcggagaggguuucggaaagauccuuaagaauguguuucagggcuuuuuggagucagaauaugcauagacaaguucuucucugacacagacacuaggagucaacacuuugaccuguagauaaagguagacauucaccuaugccuaggagagaccagaguauagauaccuguugaugaaguccauuggccaugaacaauagaguacaaaagcucucugguguauacgauaugucugaguuggcaaaagucuccccuaaagucaaggucagggaugcugcaagaggcugaaaccaaaagcagcuacuucaacacuuauuucugcaaauaacugcaggcagagaagaauagugauuuuuuuuuuuucuccccaagguccccauggggccuccuccacccuccccaauuaauuugcagauauguuuuggaauugccucuuuucuuucuagggcugcucaguuuuuacguaaaauggcagauccacaauccauccaggagucacagaaucuguccauguuccuggccaaccacaacaagauuacacaaguaaggcccgugucucugcacaccauugacauccuguguugcuggugaggcuggagugggcggcagcuaaucucuuuccuuugugcuccagucucugcagcagcagcuugaggucauuucuggcuaugaagagcuccuggcagacaucgugaaucuguguguggauuacuaugagaacaggauguacuugacacccagcgaaaaacacaugcuucucaaaguacguguguagcggagaggguccagccuuccucggggaucaagcauggccguuuguacaaacggcuguacuuagucguucuuuuuuaaccuucuuuuuuaaauucucaugcugucauguauguagacagcaucucuugaguauauacacauucccuuggcuuugcucaccaccucagcacauaguuggcuguugaccuggggcacugccugcugaauuugccugcugcuccgacuugugacacauccuugucaggagagcaccugauggguggucugugauagcagacacgucaugacugugacugugcuggccgaugcagcccucgucauguucccaggacacguugggauugugcagcugccuguucccagauugaauuuaugaguuuacaaagacacugaaagcuaaguuuaguaguaaugcaugggugugucuuggauagugcaguucuacaagagccuuguuacucagguuagacgaaucagugcugcauugguucgaagcagcuagccucuaaacaaaauuacccuuuguaacccaauuucaaugaaggaaaaaaaugcauacggucugggaauaguagguauuaaaccacaauaaaaccuuaaaaaauauacagcuuaacacagucacagucgcugugagcuagguaacuacugaaucugacugugucauuucagagguuaaguauucuugauugugugccugcuuauccuuguucaugauacuccagggacaguauuguuauaauuguagcacuugaguuuaguagaauuaaacuuguggcauuauuaaggaaccgucucaugagucccuugugcaguugccugcaucuacuaccuaagcgcuguccuccgcucagcaggcgcgacaccugagugucuucggaggacgcugaaguaggcacaggagaugguacggacaagggaaaagguuuuauuucagaaggaagcucuuuauuucauagcaccauugagggaagggugauuucugauuucagaguuagcagcucuggcagugugcaucugugugggucgguucacagguccguguguuauuuuugcaggucaugggauuuggccuguaccugauggaugggagugugaguaacaucuacaaacuagaugccaagaaaagaauaaauuuauccaaaaucgacaaguauuucaaggugaguuucaaauguacguaugcaugugucauauguguauauaaaagcauauauaugugugugugugugugucuguguguguguguguguauauauauaagucuauacauggauaaacauuuuugacaaaggcuuuuggcuaguucaaagcauugaugauaaaaguguuuauggguauaugcauugaauuuuugccgugcgaaucugugagugauugugacgcacauggcaugacugaucucucuuuuguaaagguggcugcuguccccuucccgcuccuugccuugcuuuccccuggguugaauaguguagaaauggaaucauacgauuuuucucucuuuugccucuggcugcgugugcccaacccucuguuugugaaaagaauccccaugggagccuguggggagagcuuguagguuugcucauuguuauuuuaucugugcuagaaccauuuuaguagagugauacauaccuggaagauucaggaaggaaaagguuucugccugugugucuucccguaagaccuguaaacacgaagaacaaugaucuaggucacuugcagcguucuccuguguaugugaccagugcaucuuuacugccagucaugguaacuaaauuacagagaaauuagcaucccuucgcuucucucauucuuuugcucuagaaacauuuuacuaggaaauuaccgugcagcucaguaacuguuggcucugaaucuuccaugcaaugauggugucuuuaguuacagaagagccccugcagagauggaguacaggcuugcaugccgcaccaggagaucgggauuucgaagucuagcucuaauaaaaaccuguagauguguaauuuauauuagacucacauaacuuuucucuuaaacuacacauuaacuauuaccuaacauuuuuuacauuucuuuuauuuuuaaguuuuaauacagguauaucuuuucuguccucuguuuucuuuccauugaauauuaacuuuuaaauaaaguagugcuuguaggacaaucgguuacacaauucacucugcucugaauaguuuuucagugccauacgcgaagugagugugcuugaaccauuauccuuucuaaaggguagguuaagucacuggauuguugcucaguuuuauuuuuaguggugugggguggggguggcgguugcauaugguuuagagcauuuguuugaucagucacuuugcaaaucagaaaaggcaauuaucuaaaacaauagcaucuuaaguagguugcucuggccacuuuuuuggcggcgguuguuacagccauuucuaagacccuuggcauuuccuucugugguuuguggagcucugaucagaggaaucugauucuaaccucuucuuuuguuuagccaaugucuggcuaaaccuagaugucuugcccagagcauuuaaaguauauccauaaaaagauccuacagggaaaaccuggguguuccacaagaaugucggaucuuuauaaucuaggcaguugguauuguagguaagcugccaggaggcaacgguccucauaaagcaagcagcauuacuucaguuaagacccaagucuugaagcuccguauaccugggugggaagagaagcuaggggcugccugagcagguuaguaacuguuugaccccgguccaggaagguacugaugcauaggauucagcuaagauccuccauccagggcugggggacggcucagcaggauaaaagcaucuucuguagaagcuuuaugagcgcuguuuggucccagaacccacagaaaaugccagauguggugcugcgcaucuguaauccgcuccucuagcgagaugggaaguggagacaggagaauugucugugagcccagaagccaguuaacggggagaaugcagaacagcucuguggugcuuugaaugagaaauguuccccuuagccucgcuugguccucaauuggugguuggugcuguccagggagauggugcugccuugcuggaaggagucccaggugggcuuugagcguuuaugucuuggcccccacguccagcucgaucuguuuacuuucuucaucugaaugaagaugugcucucucagcauccugcuucagccaucugcugcagugccucccaggccaucacgaagcucucucuggaacuauuaucuaaaacaaaccccuucgguccugguguuuuaucauagcaacagagaaguaacuaagaugagaagaaagagagagaccuagcugcaacaagguagaaggagagaacugauucuggcuucuuucuaugugauugcuguggcaugugcagugauuguauaauaaugcaugaugaugacggugaugaugauauuuuauaaucuacaguccauggcucccaaacaggaaauugagucagcagacacgacugacacaaggcuuguauauugguaauggguaaggucuuccauauaggaagaguagguagacgagggaugugucagcguggagguggaaguugugcucuggagagacacaguggaauuuaccuuccgcucacacgcuguccuuuuuagacaggucucacuuuuccuuacagcuugaugcugcugcugguggugacauuuagcuuuuugauuuuuguuuucaguuguaguuuuuugagaacuuuauauuugagcacugugucuacaucacuuuugcccgcuccuccaacuuuucccuuaucucccuugcaaaaucacaguguccuuaauuauuuauuguaacacucacauacaugugcacgcacccaugcauguucacauguauaaccuacugaguccauuuugcacaaguaucuacaacuuggguuuggaaagccugcuuccauguucagcuguguauaauauuuucgccuucuguucagccauauacaauaaucucaucuccacaauuuuuucauuaauuaauuuauucaccuuaagaucuugaucgcagccucccucccuccucuacucccaguccuacccugaaaccccucuuccccaguuugccucuccccuucucugagguacccauagguaccaaccuccccuagcacaugaggacugagcucauccucucacugaggcggacaaggcaaccccgcuaggggaaagggauccauaggcaggcaacagagucugagucagagacagcuucugcuccaacuguugggagacccacaugauaaccaagcuuugcaucugcuaccuuaguguaaaggagccgagguccagccccugcaugcucuuugguuggugguucagucucugugcacccccaugggccuaggauaguugacucuguaggucuugagguguccuugaccccucuggcucccucaggacuugcccuaagucuuuuucacuagacuccucgagcuccgccucuuguuugcugcggguuucuguaucuguuuccaucagcuacugggugacaguuaugcuggguuucugucugcaagcauagcagaguaucauuagcagugucaggguuggcucccauggaaugacucuuaaguuggacaggucauucguuggccauuaccccaaucucuguuucauuuuuaucccugcauaucugguaggcagggcaaauuuuggguagaauguuuuguaggcucaccaucucauuuagcugccuacaauaaacccgcucccuugauucagagguuuaaaauacaugugcugaguuugugccugggucagaugcaaggccacccaaucccaucuuuucuauacuuguuaggucuaagccaugcaggucacagaauuccagguuuaauuuugacaguuuggcauaaacuaguaauccauccaugacuuuuacuuuuuaauccguaauggaguacagauguuuaaagaauucccuuaauauucugaauuucuuugauguuuguuggaaugcuuccuauucauuugugguucuguuaacuggcauucguucuuccuucucaugaguuggguaaaggacuggugaccuuguuuaucuuacagaaccagcucagagguuuguugguucuuuguauuguuuuccuuguuucuauuucauuaguuucuacuuuuuuuuuuuuuaaauaauucuugcuguguugguuugaguuagguuuuuucccuuggcuuuuccaaaauuuuggauugcaucaugaacuuauugauuuguccucuuuauaauuuaucauuauguuauguguauggauaauuugccugcauguaugucuguguaacguguguuucuuuuguuuguguguauauaugugugggauauguacguguugaaguagguguggcuaaugucagauguuuccuucugugucuuuaacuuacuuuuugagauaggaucucuccccaauccuagaguucauugauuuugccaggcuagcaggccauugggcucuagggguccacgcaugcucugucugcauacagcuucugcauggguucuggggaacggagcucagguacuaaagcuggcaugacaaguauauaacccacaggaucucagccucacugucuucuugucggcugguacuuccuggugugucccugguggguuccuuuguguuaaugcuauuucgucuuuacugcucuguuuuccauugacuuguaauuguuuguauguuguagaguuaagucuuuuauuggauauguguuuuaagaacacgugcaggguaggaggcacagcucacagaaagcauuagaagaugcagaauuguuaaacacguuggcuuuuuauuuucuucaagagaagaaaggaaaugaugcuuuuacaccuggaagagggcggagugaauguugucugacagucuggugaucuuuugcuguucuguggagccagcuuccugaauucugccaaauccugggcauuguuuaggccuuaauccugagccuugucucucagugacuagaacccauccuaaugaaaaaggucccauguacuuugcauccuucaccaguagaaucuauccuuaugcuuacuauaaaccauuccuccuuaagccuugcccugagcucuguuuaucagccagaagaacucauucuuccuguaaaggccacaggugcuuugcuucguuacgaggugcuuuccaugucguugucccuaaagcuuuguuuaugggaauugcacauggagacuuuuuccuaaacuuugaggaucagacacugaaguuuugauccauucuggcugaccaaguccggcuguaccgaguuuucaugcacucauuucuuuaagguugcccugcuuggggugaaaucugcagggaugccuagcaccccaccuggcccugcaauagugcaccccccuuuuuaugucucaguucggccccucagccuuaaaaaggcaguugacaaauaaauccaguuuauauuuaugguguauaaugugaugucuuaauacaugcauccacugugaacuaauugaguucauacuuauuuuucauguagagagcauuuaaacguauucuaguagugaauuucaagcaacgugagaucguuaauguugccagcguuagauccauuccagugcugaaacuaugcccuuagacuccaucuccccuuuuccuuccucucacuccgauucuauguuuccuuuugcugcuggggacugaacccgaggucccacacacgcuaagcauuuggcucugucauugagcugugagagauuuguccucagccccucuguccuucacuuucuuuaugguaucauuugaucaacagaaguucuugauuuuauuguguccuugagagagccaaccuuuucaucccuauacccuuuaaggcgucccaggaaucuucuacuauguuaccuuuguguaguacuguguuuccucuuucaccuagagcuauaagcccucccuggaacuggcuccauguguguguguguguguguguguguguguguguguguguguguguguaggggguaagagcugacauucuguuuuuuuuuuuuucuaguauucaguuuacccugcuuauuuguuacagagacauuuaugucuauugcuccacagccucuccagguuauaaauuagucuguggaucuaaccugggucccugucuuguauucuggcuuucuuccuugaugcacggccacacugccuuaccauucagcuuucuuccagaugugcuuauuuagaagacgaucucuuccaguucuauucuuuaagauaaucuuagauacuauugagauuaggcagcagaggguaccuggguggguccuggccaagguaugcuguaaagaucaugucacaugacagaucuaaugcaggagcuuuauugggggagaggugagaaugaaaggcugucuuggagugggaacaugacagagagauagagacagggcgggggaagagagagagagagaucauugcuauucagauguugagagggaccuuuuaaagguaugcaugcacgugcuuugcaauauauauuuuagaacugguuugcugguuuacagacaagcauuuuccuacugaaauaucuauuuucauuccauaaauaucggugugaccucggaguuuagcuugguaguagaagugcuuauacuugauauguacaugacccuggaauuugauuccuagcaacaacacccaagaauaaacuuaaugaaaacuaucagguccaaaggaaacuccauuucccaaauuccaaaggcagagaagggaaauauggcgacccgugguaccugucagcauacuaaaguucaugcuggccuccaggcucucucuguauuacauguaccuguuccacauuuccauguccugcuggccucuuaguucuucuuuucuccucucccacccuaaacucccuccagcuccugggcuucccuccccccagcuacucauaugccuuauaacccuguuauuuuugguaugcaugagcucuugcugucuuguucucccucucucugcguccucucugcugucacuucucgcucuucucuguucucuccccugcuguucgucccucuuuugcagauagcccucgucauguccagucugcuggccauguucagucuacugcuuucucuuucugcucuggauucuucaagugccucugccuguucuuucucucucucucucucucucucucucucucacacacacacacacacacacacacacauaaucaguuuacacaacaaucaaucaaauaaauaacuauuggccuucuaauacaugaguaucacauuccauucauugagaggcuucucuaggauuuuuuuaaggauagaacuuuugcuuuaacaucuuauacgucuuuuguuuaugaguauguagaucuauuguagacuguuggccuauaaauuuucaccuaaguguuacgaauauacagaaaugcagcuauggcuauagcaacacgguaaguuaagucuuuaaacauauuuuccuguguuguuucuuaaauuguauuuuguucuuuuuaaaguagcuauuuauauauuggaugauuuacaacuguguucaacucaagcuaacagcguuaguuauuuuccuagugauuauuuauuuggugccuagauguacuuugugacauucucuaucucuuucuuaugggaauauagcagcugcaggugguuccacucuuuggagauaugcaaauagaacuggcaagauacaucaagaccagcgcacacuaugaggagaauaagucccgguaggaaaaaauuaagcugaucccuagagcuugcauuagucucuaggcaccuuuaaauaaaaugcauuuaucuaaaguaguuaccuugacauucucacggggcauggaagcaaauaucccauaugguagccccucccaaguguggcuguuuaaguuuaauuaaauucauugauaaaagcacuaaauauuuuaauuucuuuaguaaagcaaaccacaguuugaauguucaguggccaaugauuagcauguugggcagcaaagacuuaaaauauuuuuauuauuauaaagauuuuuaccacacagugcuaguugagaauauaaaaauacuuuucuggauccagagauguggugaaacacgcuuaucaaucaacccuggagaaaagcaggggcuauucauguauauuaacagaguuuacaaaauugucaccugagggcuaaaccaauccaggccuauguuuuuaagggcccuaggacugagacugaucuuauaugguuauuaaugggaaugguuuuuacaaaaaaguuguguguguguguguguguguguguguguguguguauguggagacuuuaccagauguggcagagacacuguggccccagguccugaagcaccuacucugucucuaugcagagaguagucgcagcuaucaagguuccauagcuuacuguuacaacuuacuauaagcauaggaucuuacuguaugaugcgcauagcccauugaauuucucagguguuuuuacugauuuguugggcacucauacccguaaccagccuguacuaaccuacuuagcuaugauuuagacuuuggauuucucccucaggaaaucagcuagccucuccuagugaaagcuaugucguccaugcuucagguuuuauaagccccaggugguuucugucaacuauuccuuuaacaacucuuuggugaacguaaaacuuguugaaugguccuaggcacugugcuggugccucugcucacacagggcucccucuccaugcccagguggaccugcgcguccuccagcagcagcccgcaguacaacaucugugagcagaugauccagauccgugaggaccauaugcguuucaucuccgagcuggcacgcuacagcaauagcgagguacgcaccccacugcaccauccagcccacagagccacuuagacucccgaguguugguuuuauucuuuugcacgcaacuauuuacauuaauuguuuugaaaaaaaacucagauuaaaaaaaaaaacaaaacauuucuuuaaacuggcaaaacaaaauaaauuccccaaacccaaaccuaaauacuuaaaacaaaaacaaaaccccucagaauugaugaaucagugccguuagucuugucugugucugcucagauauauaaaauauauauauauauauauauauauauauauauauauauauauauauauaauacagcuuugcaucaggaaacacugggaggacuggaacugguagaacacuugccuugaauauauaugacuguugaguguaagccucagucuaaaggggguugggaaugagagggaggagggggcaaagggguggggucagaagaggaaaaaaauaaaaaagacaaggaaaaagaaaaacuaaggagaggauggagcaguaggaacuaaaaggagagggaagcuaucgggggaaggaagacaucuucugguccuugggccuugucauauuuagaaagaugucaguccgaaggccucuggguuggcacagggagaacaccucuguggaucuggauuggguccauuaccucugccagguaaagaauugaaagucaggaaaaaugaagcacgucagguagcaucaggggaaaucucagacauaaucagccaguggagagcacuuuuaucaaaaaugagcauccacagcagcaaggcacacagaaagauucccuagaaggcagaggguggacucugaaggguucguggugugcuggaaucggggcagucuucuuccccuauuuaggguugcucacuuuaaauaaagggaagcugacacacccacaacuuuggcuaaaugugucugcucuagccuugaacuuguuggacaggucugcuuguagggccucuacugguacaaaacgccugucuggccuuugucuccccaccaggucuucaucucaaauuaggaaggugaggacaaagcaggacuauuaugaccuuuguuguccaucugugggaccuuuauuggccucucauggaagguuaacuccucguuccuuaguaggugcugucugggaagucugggccuagaguugaguuaggaagagagaucucccagaaaugggucuuuauaauucuuuacuguucuauagucagguugccaugacuguuuuuguuuuuuggacacacauuauuuuaccuauccagcauggcuacuaggcuugugggauaagcaagaggguaguuacagccuuugggaggaucuagucaggagaagcauggaagucacuuauaaucuuagugagcaggcagugagcaggaagugauggcagugggcagccagugauggcagugagcagugagcaggcagugauggcagugagcaugucagugagcaggcagugaugugaaggccacagugcagucauaacuuguauuuaugugagaucaacugugaggaaugcaggucuuagucugguuuugagaaccaguuggcucuccagguuuauagaagaacaguuaacacaaguagacaacacuuuugcuuucuggucauaagcauugcaagauuugaaacacuaguaauggaaccuaaaugacuggaaaagucugcuucuccaaaugucucagguugucugcuguucccaggauauacccuaccuaacuggguagcuccuagugaagaggcaccagaccacuguuccugcugcuaguccagccugggguguacaaaugguuaguuggucccagcuccaugggacuucaggcugugcuuguaaaaugaguuaauaggaaacucuugaacacuaugaacaucuggaggaaucaagagcuccaguuaaaugcauuuuauagcauucauuaccuggcuucuuccuaagaucugugauagguuuuugcccuaccucccucuggguuuuugagacagggcuuuuuuguagcccuggcuguccuagaacucacuuaguagaccaggcuggccucagacucacagaaauccaucugucuuugccuccuuagugcugggauuaaagcugcucccagguggcuugcaccaccaccuuaguucucuuuacaacaagaugguaagguuuuuguuuguggguagccaugaacccucagcccauugaguguugugauuccugcaugcaccaccacacccaucuuuuuauuuuugauccugacuuguggugaaucugaagugguuucugguugugguuuagccgugaauguguuaugucggagcuuacaagaacaugcaugugucuucauucaguguuagaacuuaaugaauaaugauacguuuacaaauugaugguuuuguugaaaguuuuuuuguuuuguuuuuuuuuuuuuccgagacaggguuucucuguguagccauggcuguccaggaacuugcucugaucucucuguagaucaggcuggcuucaaagccacagagauccccuggccuuugccuccugagugcuagaauucauuaaaagcauuuugcuguaacguucuaaaguucuugagagcugaggcaaaaaguuuuuuuuauuuauuuugaucuuaguuugcuaauguugacuuccagauaacacauuacaaaaucacacagucacuguaucucuauauacagguauguauagauguagguuacagaauggcaaccaugaagguaaaggaggcugcagccaaguucauguaauuucaagaaaggaagcuugacuggaggcaagccuaaggcugauagcaaugcaaagggcucaccaugggcucagacagugagcuagaggcaguucugcaguuuguacugcugagucacagguuugagcugagccucaggguugaccagagcuguagaagcaaggaucaggaccauggaggaugcagaacagaggacaggaaagucuagauugaugaagaggcagcaguuccagauggacaaauauauagacaggcagaugaguaggcuguaguaaccauggagaccaagcugggcuaaagcccugggacagcugagcuuucugccuaucucuugacacacauacugaguagucaggugacaggucuaagcaggcuaucccaugguauaguuauguaucuguaggagcauggcucuauagacuuauaugccuaccaaguaucugaguccagaggcaaaugcugcuuguaaaaugaaguuuauuagggcaaggcacaaccugaaaaagcaguuucuagcauugugaugugauuuagaucagaccacagccaguucucaacagguuuggauuuaaguuauccccugacuaauguuguugaacaucuuuucacauauucauugggcgguuauacaucucuuuuauacaaaggucuauucaugggacugagcuuauagcucacacaagaguauccagcaugugugagguccaucuccaacacuguguaguuaaaacaaaauaagaacaaccaaaacugaaagggauuauaggcaugugccaccagugcccaguguucagacucccucccucccucccucucucccucccucccucccucccuccuuucuuucuuucuuucuaucuuuuuuucuuucuuuuuuuucuuucuauaugggacuuugaaauagauuucuagaguagcauuucuggaugcuauaugagcuuuccugggggagaugaaacuacugucuauuccagauagggcacugauggcaaaucaaagaaacaauucucuccaagucuaguuucccgaacuaagaguuuaacugggguacuugcaguaacauggauaguuuucagauaguugcauacaacugaaccgagcagccaugaacugcuuacacacugaggagaggagcaggcccuccagugaccucuccacacagcccuaaugaaugcuaacaggucuccugagagaguucaagaguucuucaggagggcaagccacggcagugagaccggagggaagcugggugggguuucuuacuuaaugccuuugccucuguguccuagguagucacagggucuggccggcaggaagcccagaagacagaugcugaguaccggaagcucuucgaucuggcucugcagggccugcagcuucugucgcaguggagcgcucacgugauggaagugguaggcacagcauucgucacgggugugggcaucggagugacugcagucacuccuaguugcuuacaagugcuuuuacuccagaccuuggcaauauccugugaaggguuucaucuuuucagauagaacuaaagcuauggggguuggaggauagcuugcaguggcaagacuguuuaccagcaaugcuucuuuggccaucaggcucggugacaagugcccuuaccaucucuccagcucccauucuucuccuuuguccagcaucucacccuuuggacuuguaaccauuugcaucuuuaagguuuaauaaaauguuuucgguaacauauaaacauucaacuauaaauugcauacguuuuucccuuuuaaaaaguguguguguguuuuguguuuuuuguguuuuuuuuuuuuuuuuuuuuuuggcuggguuuuuuguuguuguuguuguggugguuuuuuuuuuuuuuuuuuuuuuuuuuuuuuuuuuuugguuuuucgagacaagguuucccuguguagcccuggcuguccuggaacucacucuguagaccaggcuggccucaaacucagaaauccaccugccucugccuccccagugcugggauuaaaggcgugcgccaccaugcccgacuacaugguaaauuaaaaggcaaauuuuuguuuuaaaugcaaacaaguuguaaaguuuuacuuguucagcauacaguaauuuggauauuuuaccuggguuaguucuuaagcuugguuuauaugacugaguguuugcuauuuuuuugaggugggggguggggaggggcgagcgggagggagggagggagggagagagagagagagaaacaaagagagagagguugggauugagauugauucagaaagcaguacagguuuuaaagguucacuucuugguggacucagccgugcuauuauugucuguccaaaaucaaguauuuuguuuucagcauagaauuaaucucucucccucucccucucucucucucucucugacugcauuaguauuccuggaaacuuguacauccaacagacaaguacuccaacaaggacugccccgacaacgcugaggaguacgagcgagccacacgcuacaacuacaccacugaggagaaguuugcccugguggaggugagaaagcucugcuuccuguucucccugccgcugacagugcugccuuccaaaggcaaagggaaagcacgggcagacugucaugugaugccauugcuuguauggugggcagccccugcgucugucagagagaagaguggcugcuagcuucuuagguauguguuggcagccuguccaacgcagguagccagccccucagugagagcuugugaguggagaguagucucucagaagugggaagacagccgauggguugggauuuggucucugccccaugggaggagagccauacgacaggcaggcuugguuguuuccuagucauaauuagucuacuaauucgucgcuggcacuuaccugugaugucuuuggagaaguucaaaaucuucaccuauuuuuaaaauugauuauugaauuguaagaguucuuuaguucccuuucuagguauuauuguuaagcugcgcuuacauuucuuucaccaccucauguugguuauucuguguucucuuucuaguuauuccuagacugaguuaccuagugauuggcuuaggauuguugcuuaugaguuaaugagguagcgcauuagcuuagugaccacugggcagagcuuccucuuuugaagacuuaucaucgucaucaucaucaucaauuauuauuaauuauuaccuacaguaauaauaauaauuauuauuaccuacaguaaugucuaccuuuuuauucugaaucugaucaucuauaucuuacgucuuuuuccuuggccaguccugcuggucaguauuuauuguuuacgaagcaacuuuugucuuuguugaucacucauuggacuucucuguuguuuuauucauuuuuuucuguguuguaaagauauaaacacacacacauaguuccauauuccuucccauauacuuuuagugguacacuuugcuauucuuuuuguaaauucaugauaaugauugcaucacuauuaccuuuaagcuuugcauuucuaauguucauauucagagcuuggcuucaccuuucagccuucuuuugcuucuuugaguccaaauacauaaugccuucauuuuuaugcagguauaguucccaugugcucuuuaguuuauuuuacuuauuuuauguauacggguguugcccauggaggcaagaaguggucacuggacuuggaauuggaguuauagaugguugugagucacuauaugaagguugggaauugaacccagguccucuggaaaagcauccagugcucuuaacugcugagccaugucucuagccucuaucucaugcacuuuuuuuaaaaaguaaaaguuucuucuguuuuaaaaacaaacaguugacuucauuuuuuucuaguauuuuuuccacguuuuaagucaaugucccauuguuguuuaacaaguggaauuuaauaugcaaacucuugcaacuccuuuuccuuuucugauuccuuccauauuugcguuuugaauguuuccucugcauuugaaguccaucacggaugggcaugguggccaggguguccuugagucagguguacucacggugagaagagaugaguucaguugcuggcaggcacagagcacacccgguccucugcucuggggaagguggcaaugggacaagguagcuuuguaguggaaaggagggaaaucagggaaaggucugugcgugagaaagagacccaggcaaugaaggacuguccccugucccuguccagccacugaaagcuguguccuuacaggugauugccaugaucaaaggccugcaggugcugaugggcaggauggagaguguguucaaucacgccaucagacacacgguuuacgcugcgcuucaggacuucucccaggugacccucagggaaccacugcgacaggccaucaagaagaaaaagaacguaauccagaggucagccuuccaagccccccacccccucacagccccaaagcaguggauggagccuagauucagacagauggagugucauauuuucauaaguaggcucaguacauuuauauuuaacuccuaguuauauuuuuuuugaugauuauagcuacauagaauguagugaguuaguuaauauccugaacaacaguagcuaguuuacgacugaaaucaaggaguuuggcaauccaggaacaagagacgauuccagucaccagguagucagggauacgaggccccacauucuucucccccccccccccaccaccaaauauaucaucuuuggcagguuucuuuuagauucuccuacaagucuggcaaaaacgaccuagauaugguaaaacuuaagagaucuugagaguuuuaaaugugagcuuuuuauauaaguugacuuucaaagaaacauguguaaaugaaaccuaccagaauucaggaauuuagagugcugguuuugcuuuauacuugguaugcuuauuaccuaagauaauauuggcuuguagcauaaguaaaauuccauacuguguguacauuguaauucuccaaaagucugagagagagagagagagggagagagagagcucuuacauguauguacauuuacauguguugugugguguuaaggaugagcauggauccuuguacauacuaaacauacuuuacuacuggaucuuauaaacccaaaacucuguaaugacaguauaaugccauaguagacaauugcauccuauauuagauaauuuuauaugcaaaauuauuuaauccaucuggauauauauauauaaacuauccuuuuuagacuugugucuuguccccugaaaaaauuuacuuauauucaaauauucauagccucaaacagauaugaaaucugaaacccuccucgucgcagccuuucacuuuucguuggaggcauauuggauauagaaguccuugcccgugaugaaaagcagaccuguuccacuaggcagagucuauagaaugcauacuguacuuugcauguuauuuaccauguuccccaagagguuccagaguccccaugagaugucucaaguccuuggguggugcuccuuuaauagcgccuguuagcagugggguuauauuucuagugagccaaggcacguguccagucccccugaguugugugauggcuucccauuccucauacaaaaugaugggccacagccagggggagcucugcugacugggugggcuuucgagaguucuauucucucugcccucgcuuggccaccugaccuucucaugaaguuaaaccuugcuuccugacuaauuggugcaaacuacagcugagauaacacuuuuggggauaauaguagcacuaaaggaugcccucugcuuuuguaacuuucauacgaacuacacccuuagcuugucucagccugaaggauuuuugcugugcguugccuguucggugaggagaugcugugauuguagccauccgugucugaugacuuuaugggguuguucaguguccuacaggccaucaggaagacugugugugacugggagacugggcaugagcccuuuaacgacccagcucugcggggagagaaggacccuaagaguggcuuugacaucaaggugccacgccgugcugugggacccuccagcacgcagguucucgucaucuuuauccuagaacugggcuaagggcgggguggggggcagaugaggcagggcugaaauggugguugcuggaucugccaggcacucccguucugccugaggcuuuucuucucuucuccuguacccugcccaacucaauuugaaaccuuaccugagacuguccugugaguauccgguugguucauuuaacugcagaagucauuugacaacaauucuaccucugucuaugaaauauaugccuacauuuuuccuaucuaugcuguuuccuuuuugcuuuuuggagacagggucugauauaaccuaggcuagccuccaguuucugauccuaugaccucugccuccgccucuugagugcugggauuauagcaugcuccuccaugcucagcaccccuuuuguauuuuuaaaggcagggucuuacagccuuggcuggccugguacucacuguacauagcucaggguuagcuucggccucagcgguccucuguuuuagccuccuagcccugcaggcaugugccggcacgucuguguuucccuuucaauguuuaaauguaugacuguaauuuucacgucggaucuauaaaucgagcgcuccuaaaaaaugaacuguugcuuuccuacgucguggucugaagccaccauuucugcuuucucuuccgacgugugucggccuuccucggggugcuucccacugacucacacuugguuuauaugcuccuccgcuuugggaaccugucuuccuuacacgucucucucagaggccucauacucucuaucccuccuguagaaagguacuagcaaagcccauggcugggucucuauggaacccucugaagaucaggaggaaggcuuuuggccauucuuggggucugugugaggcauaucacugcccuccgcucuuccauuccauuugccugucccuguguccccccgacucagaccugugcaucaugugacuaacggcucucucccgcuucuccuucccugucugucuaugucuagcucuaccuggugcgcacuauggcugaguccuugagcucugccgagcugcugaggcagcucaagucucugggcauggaaaggcucuugcaugugguaaacgcguuucugaggcagucguacaccuauccaccucuuuuaaccuuuggugguaagacaucguuuguuuuucuuguugaugcuuauggcacggaggcgagcugcuccucuacacauagcucauccuaagaggcagcgucuuggcuauguggauccccaggcccucuggacagccugucugugucaggcugauugugggcgugggacuuagucaggguguaguggagcaguucuucuucuauagauuuucccauuugaugugacuaauguaccauuuauauuuuuuuccccuacaaauaucuccuuggauaauacagcuuuacauggugagaacuaugcuagagucccucauugcagacaaaagugguuccaagaaaaccuugagaaguagccuugaggggcccaccauauuggacauagaaaaauuucaucgagaaucauucuucuacacucacuugauaaauuucagugguaagagacagugcugagcagaauauccggccuggcaugcucuaacccugcuaacaccacccgggacgcuucugcuuaccucaccauucuccuacccaucucuucacgcacccacauggugccacguccuaaccuuuguggugguggccagacauccuggagaugcccuccccccccagucccuugccauccuuggccucugccauggucucuguaggacauggcccuuaacaggacagggacaguaggguuuugguuggcccugucaugugaacacaaaaucagggucacaaaacagggaaauggaaccucuuaccuggaucaaaguccaggcauugaugcguagaagacacggccccgcuguuccccaccgcccagguagcaaaagugcccugagacacacuagccaccauuuuggugacaccagccacuuugaccuggcacuggugggugcuuucuacccucugugucugccuguggccucauccagcuguucaugucuucugcuuagagcaggaggucaggccuugcgguguugcaggccgugaaguaaauaauaacacuguuguuguuagcucugagaacauacaguaaauccugauaguuuaauuccauuuuuaguuuuguauugguuaaaccauuccugaaugugcacauaauccuaggacugguguuugcccuacauaaagggaaggacggguugaauaucccucaucugaaauguaugggaccagaaaugcuucagaucaugagucuagggggcgggcagcagguagcuaacuauauauaaugacaaauuugggggaugggauccaagucuaaacacacugauauugguucaccucgugcgcauagugugaggauugagcagucauguugcauacccucauuucugucaagugcaguugcugccucgugccgcuacacucgucuccaccuguguccgcauccaagcacacuguugcacacuuccucagaguugugacccugucacugggacacugcauuaccauaccauacucugugugugugcauuuggagcucagcucagcacgugagacaggcuauguaauguuccacuuaggacaucacgugagacgggcugugugauguuccacuuaggacgucacgucgcaccucagcauuuugagauuugggagcaucugagauuucuuucugguuuuccgauuagggauguuaaaccugugguccuauuuccacaucuccuuuucaaaaaguugucgccccuguuccugccaagaagggcuccuaagaucucugauggcagggugacacuagcugcucagaagguguaggguccugaccuauacuuauagcauacccguguucgucuugucccucaugugaaguguccagugaccccuuccugcuugcauccaugcugcauggcugggagcuaagcauagaggagucacaucccgugugcaacaccucuuguuuccucuguauugaaucucuuccugcucaugaacgauaaccuauugucguuugaacccuucaagaaacacugcagcagugcugugaccuuucccagcugugguuccgagaguucuuccuggagcugaccaugggcaggaggauccaguuccccauugagaugucuaugcccuggauucugacugaccacauccuagagaccaaggaggcaucaaugauggagugaguguccucccucugaggccuuggcacacaugcauguaccuucacacauucauucagaauuaaaauagaaaaaaaacaaaaacaaaaacacaaagcaaaacucuuacuacugauauugauaaaacacuuuaaaccacaacauggagaagguaaagucauggacgccuuugucuggguagcuuuuguguguccuucauacaggagcaggcaccugguguucuuuauucuggugguauguuguaaaccuaugucauucaucuuuguacaggaacaccauuuaccaugggaaguaaggaauugguuuuuuuucauaugacaguuaagugguuuucuucauuugacagcuaaauuucuccagaguaggcagcugugagggccacaaguccuuggcuucacuggcugggaagugacugaucucccccucugcagguacguccucuacuccuuggaccuguacaacgacagugcccacuaugcgcucaccaaguucaacaagcaguuucucuaugaugagauugaggcagagguaagggaccagcuuuagcuccuuuuauuaaauaccuugucuuaguuaggguuuuacugcugugaacagauaccaugaccaaggcaagucuuauaaaaaacaacauuuaauuggggcuggcuuacagguucagagguucaguccauuaucaucaaggugggagcauggcaguauccaggcugucauggugcaggcagaacugacaguucuacaucuucauccaaagcugcuaguggaagacugacuuccaggcaccuagggugagaguauuaagcccucauccacacugacacaccuauuccaaccaggucacaccuauuccaacaaggccacaccuccaaauggugccacucccugguccaagaauauacaaaccaucacauaccuuuuacauuuuaacuuauuuuucugaggauucaaauaauuaaacuuuuaaaaacugcacaguaguuuaaauggugacguauacuuuuugguaaaauacacuuuaugguguaaguccuucugacugcuuuucuuuauacauuggacaaugguagaauguacuuuuccaccgaacaguaagcgguucugcaucacuuucuguuucuguuaggugggugcucgauucacuaagccaacccuucuuuuuaagaaaaugacauuggguuuuucaaacuuagagguaguaaaacaguccuuugcugaacuucuuggugcacacuuucuuuucccauugggcggguguauuuuguuguuugagacacuguuucucucuguaguccuggcuguccugguucucccuauguagaucaggcugaccuugaacucaaagaucucucugccucugccucccuuucuuucuggcauuaaaagcauguguuaccauuugcuugguuguucuuccuccuccucuuccuccuccuccucuuccuccucuuccuccuccuccuccucuuuauccucuucuucuuucucucccucccccuucuccuccuuuguccuccuccucuucuucuuuuuucuccuccuccucucccuccuucucuucuuucucucucuuucucucucauauagucaguuuuguugguuucuuuuuuauguuaaaaugcaaauauuuugauguuuauuuuuucaauuaugguguucuaaagaugcaaccacuggauuagacaaagucuuucaugauugauuauaccucuuaaauaccucagaacacacaaggacacugaguuaaugaauacaaugaaugaaugaguacaaaaagaaaaauaaugggguggggcuggggauuuagcucagugguagagagcuugccuagcaagugcaaggcccuggguucaguccucagcucugaaaaaaaaaagagagaagaaaagaaaagaaaagaaaacgaaaacggaagagaagagaaggaaagagaaagaaagaaagaaagaaagaaagaaagaaagaaagaaagagagaaggaaagaaagaaagaaagaaagaaagaaagaaagagagaaggaaagaaagaaagaaagaaagaaagaaagaaagaaagaaagaaagaaagaaaggaaaaggagaagagaaggaaagaaaggaagaaagagaaaauggggcaauucgguuugaucacagaaauuuaagaggaaauuucaggaccuuggucagguucugugauggagcuuaaguacuacuucauuguagaccgaaguucaagguaggaacuugcuaggagaaaaaugcuuauccucugaagacucauucuaagaaauagggcaccgagcauucugugggaacugguuagccaugaagagggcucuauuagucaggacagcaauggaaaccgcuugcuaccuagagagccugagccugcuuuacaaaacaaaagcccauggagugguacuuacagacauaggugugauguaguuucaccaucccuaaauaacccucggggcacugaaaggacucccgguguggcucuuuccuggcaugagaagcuuccacugaacaccagacaugggaugaccuaaagauggaccuucucaaaguagucuuuggaagcuguuggguggcuggaucauaggggauucugguaucccuguuggggccgacuucuccauggguuuccacaaacuggaaugccuuaaccaacugaggguuuccuccagguggcuccuaccaaaaggucauugacacucaggugcuuggugacacuauuaaggucaauaaugaagaggccucugaaugcaaugccagcaccuucagcagugcccugcaaucucaggcuauuugcuuaguuaaauugacaacagcauauucguguggcccaaaccaccauucuuccuuuguguagugauccaccauucuucuuugggcaagauggaaaucugaaacugaaacuacuuaacagucaugaaagucauuggcuuuaucacugacagcaaggauauccauaggaaacaaaugugagauccaaaggcuggaaaacagacagcaaguauuuccgauuacagucuucaagacucagcucuuugaacagcuggggcauggaaugagcaacugaugcuaaaggcaaacucugccugggcagaggcagaccacugugugucugucaagcagguucuucuagaagcaguaggccugaaaacugccaaaguagaaauaccccugggaguagcacucauauucugaacaaccgaggaaagagcaaccuuccugccugccacagccgccaucuucaguauauaaucaguuuauuggcauauucagggcagguugcgcuggauuucacaaggaucauuuucucaaguagaucauguacuuugaacauaguacguagcauaucuucaacuuugaacucauccucuucagcuacauaggugcugugacagaaaugugcuuccuaccgugccuggccuuuucucagugguguucccaucuaauuuucuaugcuggcaugguggucaucccuggucacagcacacuuuauaugcucuguuggacaguaagaucaucucuacuuucuuuucuaauaaggaccucaagccagguagugguguacaugccuuuaaucucagcacaugagaggcagaaggaagcggaucucuugaguucaaggccagccuggucuacagagcaaguuucaagacugccagggccgggugagguggcgcacgccuuuuaucccagcacucaggaggcagaggcaggcggauuucugaguucgaggccagccuggucuacagagugaguuccaggacagccagggcuacacagagaaacccugucucgaaaaaccaaaaaaaaaaaaaaaaaagacugccaggguuacacagagaaaucgagccuugaaaaaccaaaacgagagccccaccuuguguugaagcaggaguuugaagcuaggaauaguggcacauaauuaaugccuguaauccaaggauccaaaaagcugagucuaguggaccuugaguucaauguucacuugugacauauaaugaaucaaagcuugcuuaaaacaacagcaaaauaagcaaggaaaagcagaaacauuuguuuuugaguugugauuugauccugguuucaggaguugagaucuaacauggguuugcuuuuugccaggugaaucuguguuuugaccaauuuguuuauaaacuagcagaccagauauuugcauauuacaagguuauggcaggaagguaagugucucguuugugauucccaugcagaaucuuggauaauuugguuugagauuucuguuaaaaugaacaguguaugacaaauguccugccuuucuucugcaccaguuugcuucuugacaaaagguuacggucagaaugcaaaaaucagggagccacgauccaccuccccccaucuaaccgcuaugagacgcuguugaagcaaaggcacgugcaggugagcugagggacucugcugaaguggggcuuggaaaugauugguuugccuuagagcuagccagauucugacagguauuguugcaugugaaugucauaacaaaguauuaagguguuuugugguuuuccuuccauaaccacuucucucugagaucucaggguugcccaagcuagucuuuuuuuuuuuuuuuuuuuucuuaaaggcuuuucuauugcugcauagagaagaaaacauuuauuuagggcuuaugcuuucagaggguuagauuuuaugaccaucagggcagggaauguggcaguuuugcaugauacuggaguaguagcugagagcccacaucugauggcacagccacuaggcagagguaaaacucuggaaaugacauaggucuuuagaaaccucaccucagagccuuucccccaaugauacacuucuucuaacaaagcuaugcacaguccuucucaaacacuuccaccaacuggggaccaaguauuuaaucuugugaaccuggggcuaucaucauucaaacuaccgcagauuauaauauacuuacaucaauucccucuuccaaguccucuuuccaaagccucccaaauacuugcucuuucaaauucaaguucauuuccuuuuucuuuacucucucuuucucucucuuuaaauauauaauaaauuuuguauuuuucagggcuaaccguuugguacuggauagccaauuuuuguguucuucccugggaagacgauuucuuccguucucagccuuucuuaguuguguaggggucaggccucccucauaagcguuccccuuuucauguuagcuuaucuauuugugucaucccuguucaggucacauuuaggcagccauguugaugagacuuuguggguaugcuucucugacauuuauaggagacacaaucucacugcaaacucucuguucuuuuauaaucauuaugacuacuuuuccacaauccugagccuuagugcaggaauuauguuauagauauaucauuugggacuaagcucuauaacucuguguucugauugguucuguuuuucuguaauggucucuugucuguugcaaagagaaguuuucucucucuuuaaagauucauuuauuuauuuuauguaugaguguucuaucugcauguacguuugcaugccagaagagggcaucagaucacauuauagaugguugugagccaccuuguggucgcugggaauugaacucaggaucucuggaagagcagacaaugcucuuuaaccaccaagguaucucuccagcccugagacauuuucuugacaaggggugagaacugcacuuaccugugagaauuuaguuagggaauauaugaguuuaauaaaaacuggcaguuacagguuuuccucugagauccaugacuucauuaguucuggguaguuggcuagguuuccaguaccuggcauaauuccccuccuguugagugggucuuaaguccaaugaguuagcugcugguuacugccaagguuugugugccacuauuguacccuuaggucuuaugccaugguuuuggucguugugacucauaaguuaauguuaggugagacuuucgggugccuccuccuugggacacuuguauggcaucuucugguucuauggaaguuaguucuuagggaggaaggcuuugagucaaguacuuugggacuugugguugaagugcaugaugucuucagcaauagggacuuagcucccgccucugcuuaggagguuuugggagucgcuuguacaacccugacaaacagcuuuaaagagggcuucuuaugugcccaaggcucagcuuacacuacugggcuucccaccuuagcuugaaauguuagguuuauacuuauacuguguauaagaagguuacauuuuauauuggacaacccuuaacuacaugggugaaauugcagcucucugaacccucauuggcuucuaagaaacagguccagucugggagaguugcuccuucuccaagagccccgcauucagaccuuuacaugaauaaagaucacacgcggagcauuaauaagcacaccacagagauacuugugcaucuauguucacugaagcauuauucaaauagccaagguauagaacuagccugucaacugacgggugaauuaagaaaacaaaagugguaucuauauaaaauagaaauuuauugaccugagaauaagaaugaaaucuacagggaaaaagaagugggaaucaccauauaagcuaaauaaggcagacucaagaagacgaaccaggcaucuuuucucccauauucagaauuuauauuuucuauguguguguaucacuaaaacagcaaauagugauguacuaaauaguaccuugcuccauugcagacucugaauacaguaguaggcccgguaucgucuggcuugaggcucaaugguagaguccagcaucucuguagacuuggcuaccagcuuaaacaucacuuguguguauucaugugagugaaugcacacacauguucucacauacacacacagaauuuuuuguauuuucuuuugauauagaugucuuggguguuuuauguugcugcuuguuuguuuuuguuguuuuuaaaaaucuuuguguuuccuuuuuguaaaaaaaaauauuucuuuauauguuuuuggugagggcuuguggaguguauguggagaucagaggacaucuuucaugagucucuuauuucuuccuauuauuugggucccagagauugaaauaaggaggucaggcuuggcgaucgcgccuuucccuacugaugcgucccaccaggccuugugcuuauucuuucccuugcuaucccuugccuucucucuccucuagcugcucgggagauccauugaucucaaccgucugauuacacagcgcguuucagcagccauguacaaaucucuagaacuggcaauuggacgguuugaaagugaagauuuaacaucaguagucguaaguacuagaacuauuuuuucccuuucuauugauaaguuaaauuaaucguaggucaguucuugaguaggcaauaaaagaugggaacugacugaacaugucaaguaucauaugacugccuagucuuaguauuuguaauuuacauuaacuuaaaagagaaaauaauccugaucuuaaauaaauuacacccacugaggacaaagauaaaaucuacagacuccacuuuagagaagaaugaaaugaagagacugaaaggaagaauuuauauauauuauuauaaaaguuuguguuagaugauuuugucccaacuauaggcuaagcaacuggccuaaguaaugauaauauugcaaaggcuaaguauaguaaauucacuuaucaccuacugauaucucugcuuacaauuacuuuaucaugauauaucuccauuguaagucaaggaauauauauauauauauacacacacacacacacacacacacacagaguauauuacuuggguuugucuauauggaguuuauuacuugggaaaacugacccaaaguguccaacaccaguuggguuauauacaggugggggggacagagcuuaggacuuagauaguacauugacagguguuagguagugauuuguccaaauugccuuugcccaaguaggugguggcuugugggcaguaguggaugugugaaagugaccauagaggagaaaagaccagagcccaguggcuaugacuauagaaggaggagcuuaaguugaguaccaaacucuggccaccuacaaaaguccaauuucaugugguuauggcccacaucuugguggccaccucauugcaaccuuccacugucuguauccccccauguacuaguccuccuaggaacuuuccuggauggcccaccucaucucacauccuugucucuaugauccuguaggagcuagauggacucuuagaaaucaaccguaugacacacaagcuguugagcagguaccucacacuggacagcuuugaugccauguuccgggaagccaaccacaacgugucugcaccuuauggaagaauuacccuccacgucuucugggagcuaaacuaugacuucuugcccaacuacugcuauaauggcucuaccaaccgguaagcauggccuuaguaucacagacauguuuggacacuccaguacaggugcaucuacagcgggugaucuucugccgugacuuuccagacuucccccuuuaacucuaucccuccuuuuuccucugugauuucucauguucuggucucucaggccuuccugcuuucuucuauuuacaaggauagcccugggccaggacuuggccagauggucaucacuuuucauguagaaauagaccacuggugaaagacuggcuguugaggugggagagccaggacugugccagcucacuuaguugugccuguagacaggaucucaugugcguuggaauggcugcuggaacuguacugccuacuuuuagucucccuucguggcaggugauucugcuuccauguuucuaucugaaguguugaggaucaugagaguguaggaaugccuuccuucccacuuaccuucuuccuguuguaucaaugggaauaaagcagucaguuuggugguagaacgguuguuucauauuucauacaccgguuggcagaauggaauuucccugcgaccaguguguucucuuugugugaagauuaccaggaagaggauauucucuuaagaugauaggucuaccacuggucaaguugacuucugagucugaugcaggucauugcuccgaaguuucuccacuuugcaguuaccacuuuucuguuuagauuuuguagguaacucaacugagacuacuuaauagucauacuuuguagguaucuaacccacuaguuucagcaucugugacaaaugcuuauuuguccuuuggugguugaagagugaguuucuaauuccuucauuccuuugcaaauauuaaugagcauuguccaaguuaacauucuuuucuuuguugaugauuauaaguauaaucagggauuccaccuuagaguuugugucuucaguugauuucuguaaucagcaccaugagcaccuaucauuacaaugguguauguguauccccacuguuuuauaaguaccacuuuaucuucuguaccacaagauggaguguguggguaguuggugugcucacugguacuaggaugucacuguuguagagccuuuaggugguaacacuagggaguauuuauaugcucacugcuuuagcuuucuauggcugcuguuaaauggagaaguguuuucuuacaguccaaaacagugugucagcaagcuacacuucccuuuuagacucuggguggaaucucugcuugacucucgcuagcucauguagcaacuguuccugacacuccaugguuuguagcaguaucaugccaggacuugcacuuaccaugaaacuaucuccuucugaaucucuuucucugacccuuauuuucuucuuguaaggacaauggccauauagaucaggggccuuacucucagcuccugaucuuaucaccaaguccaugaguaauggcccuauuucuaccuucugugcuauggaaaaggaguuugaaaauaucuuuuggauggccccauuuuaacuuguaguauuuauguauacuuguauuuuauuccuauacaguuaucuauaucuuaaaacugaguacauucugguaucuccgguugcaauucaguaccaccauauucauuugaaucaucacucuguguuuuugaacuuccuuaaacacggaaaagaucccuucucuuauuauggugacuuguccaguuaauuacacgaaaggcaaaauacuuuaagaauugcugauucugacugcuguaaaacaaacuuucccucuauaguucaguauuuguuuuugguaucuuggcuuuagaugaaaaguauauagguacuaauggguuaaaguuaccuuacaggaagaggagcagagucuauuuauuccuuuucuuuaaauaagaggacaacuggacaaaacacacaggucauuugcucugcauaaaggaaacaagagaaaugucuccuggcuguccuagcuuccugucuagaagcacauucugagcaaaguccagagaaggucagucaggguagagcuugggaauccugcugcaggacgaaacacaguagagcuuggggaagcucagacagcugggauguguagagucaaauguggaagagguggcacucucacaaaagcagcucuugaaaccagcaugagcucuguggugcuagggagcuggagucugaguaauucacagagcucguagcaagauggaucauuugcuguccuuuucagcacuugauagaaucuguaaagucucuugccuuagucuaaauucuaaacuacugccugcuuugccuucccauaaaaguaccauaaacaaaucauuaaacguuuacuugauaugcagauaaacuuugcugcucgcugccucaaaaucaacacucuaaaagaaaacagaacccaauaagaagauauuacaguguccgcacccaaucuggaauuagcccaguaucagaaaaaggugaccuauaaugaagggaaaaaucaggucauaaaacacaggcagagaugacagugccaaguauggucagaagauaagaguguuagccauuuaauuauccguaaagauuuaagaaagucaaacauaacagagauaaugauuuuauagaagagaauggacugaauuaauacuguaaacacagaaucagaagugaaaacuccauuugcuuagcuaaauguuagauucuauuuugcagaaagccacugaauucaaaauuguuacagcgggaaauaucugaugcaaagcugggagggaaaaaauugcugaacaaaaugagaauggccucugugaacuguggcaugaugucacauguccuuauaguuguaauucuaguaagagcuuaucgcuggaguggaaagaauauugaaguuaauaguggcaaauuugcaaguuuagucaaaacaguguagcuguaacugaggaaacucaccgagcuuaucgagucagacguggaagggaacugcuggcucagcucaaaacggggcaaugaagugcugagacuugacuuucaaguuagugugcagcuacagcuguggggguuggugcugaacaauuucccuauucagggauuuugacaaccccgaugaacucuaguacccgagggcauaguauuucacaagacugccgucauuuuaguacuagugauuagugauucagguccugagguccaccauucacugaccagcuggcugaauucaggaaaaaucucugcccagguaguagauuuucaugagauuccuagugguagugacugggcugcuuuccguccuggagauguguuaccuuccuaguacugaagcaucugauauggacaggaagauuugugccagcagaggccaagugguucuuaucacgugaccaggcucacuaaaacaccagcaacugcccucccacaucguccucugcugucacccagccuacauccucacucucuggucacgucauacgguuggucuuucucucaugccagucuuauucugaggguuucucuuuagcguagacccaggugugauccaagaggccaucagugagcauuguguaugccgggugcauccacuacacuucuauugcugugauaaagcaucguggccaaggcagcuuaauaaaaaaagggguugucugggcuuaaacuuucagaggguuaagaguccaucaccuucaugguggaaaagcaugccagcaggcaggcauggcagcuggagcagcaagaugaggacuugcaucuugagauaugaaacagacuuugaaacaucaaagccccaccccaguaccuacccugauggcgccauugacuggggaccaaagguucaaaugccugaggguaugugggacuuuucugauaucaccaugccgcagcguggauacauacuauccuuuugaaagaugacauacagagguuuuugcuuuguuuuguuuuguuuuucccgaauacaaauugagaagauuugcagcccacuguuacuagggucugacaccuaccggucaguaggcgagaaucuggccccuuaaccgcauucucucugugaaacccuuggccuggcagguuccuggccucucggaugcacuugcuuucucugcuaacuauugaaaggugcuuccuuuuuaauuugcuguacuacaaugugaguucaccaagcucacaggcguauauuauccgcaaaccuguguguguguuauuuuacaugugugaacauuuaccugcauguuuguguggguguuacaugugugccuagggcauguaggaucagaagaggacuuuggucccuugaaaccaaaguuccagacgauugugagcuaucagggaacugaacccagccuucugaaagagcagccagugcucuuaacugcugcgccaucucuccagcccuguguuucaacaggaauuugaaaguuuuugcuugaaauuuaaugucguuuucuagaugcagucuugacugaauuggguuaaacauauuuuacuuggcuucuucauaguccaaaacuagugcucuaaguacccaggaugucaccacucauguuguagacuccugucuuccccuguuucugguacaucccaaagccaagaauguguucauuauagguaucaaguacuguauuacauucaagauaguuuugaugcuaguaggccuuugugaacuagaagauguguuuauagguagaaggacaacagagguuccuacucuggcuuggauuuacuauuauuuauggcauuuuagagaauuuauauauauuuaauucugggggguuugauuuacuagaauuuuccuauuugauguuaccaguuaacaaugagaaagauuuacaauacauaauaaaacuuuuggagcuaaagaauuugcuauuaaauuugguuuuccuuauuuucucuuguaugcuuucucccuuagguuuguucggacaguauuaccauuuucucaggaauuucaaagagacaaacagccuaacgcacagccccaguauuugcauggauccaagguagguuguuuucuguuuaugucaccaucgacgucuauugccgugguaagccccugaccacaaucaugaagggaaaguguuuauuucaguucacauuugucguccguccugaagggaaaucagcaagaaacuggaggcaggagcugaaggaaaggacagaaacaugcuuacugacucgcucaucugccuccuuaucgcucccaggucuaccugcucagggguggcacuguccccccuggacuggacccucccacacugaccuuuaaccacagaacaccccacagacuugcuucuuagcugaguuucccuucccagauaacucuaggcuuugucaaguugauaaaaaacugagaaagaaagguauuccuuuuuaguccuugaagaaacuggggugauuuuuaaaaguuaguuguuuuaacuuagcagacaaauacuaguugguuauagcauuuucaugcauaggugucauuauacuuuguucugaugugugcaaaacuuaucuggggcuggcuauaaagagaaaaauucauacacacauacaugugcgcgcgcacaaauucuugauugcuggaugaaaggaauuuagacaagcuccagugacuucacacagaccgacagacagacuauuggauggaugaggaaagcauuaacaagcaggccccaagcauuuuauauacacauagacacacguguugguauauggagcagacuccaacaaacugacuccaacaacuuucuuuucucccuagccuuuuguacccccuaaggcaguuucuguguaagaagaaaaucaucucauagacacuaguuacguauauccuuaacacaaucaccacaaaaacacacucuucaaaaaacagauuaaaagcuaggcaucguggcgcacgccuuuaaucccagcacuugggaggcagaggcagguggauuucugaguuccaggacagccagggcuauacagagaaacccugucucgaaaaaccaaaaaaacaaaaacaaaaacaaauuaaaaucauuauccaaaaagaaauuauaauaggauuauugacuguauucuuuugaaaguuacaccuaacuaaacauuucccaucuaucuuucucuccccaaguugaauguaacucaaagcaauaauucuuuugucaucgaguagcagguuuuuuccuaugcuuagcugacaauuuguauuuaccaagaaacaaaucaucuguucucugcucuuacccucaucauagaauugucuacuuaguccauaacccugucuucucgugguccacuccgaaacuuguggccuuaucccuagauacgagacccaggaacucagagccaaccuugaaugaauguuuccuuggaucguuaguuugucccaagccuguuuuccuggcuguuacauuacaugcuuggaacacaugaaagcucacccuccucguuuucuaccguaugcagcccuuacacuuccacaaggagggagcacuuucuagucuuuauuuuaacucuguuagaucuugcuggaaaaaccacuuagacuuugauucagccaccuuacucacguccaaaaacaacuuaaccauaucaggaauucuauaaaauccuuuccugcuaggaaccuaggaugugagagguggccggcagugugaccaggagcuuggccagugccaggacaccucccugcucuuuccaugcuguuuucaaguguucugcuguagagugcagcugacagcaggaacagguuuuuguguguucaagaccaagauugacucugguuccaaggauccaguguccuuuccuagacuccauaggcaccgggccaaccaguacacauacauauuaaaagcaaucguuauaagguuaucaugacagaugacaaagaccugugucucggguuucuaccgcugugcuggaauacugaccaaaaacagcuuggggagaaagggauucauucagcuuuuacuuucacaucacagucuaccacuuggaaaagucgggacaggaacucaaggcagcaacuaagacauaggccauggaggaguacuguuuacuggcuugcuccccauagcagccugcuuucugacacccaagaccacuagcccaaggcaguaccacucacaaugagcuggggcucuccugcuucaaucacuaauuaagagaaugccuuauaggcuggacuggugaaauggcucggugcuuaugaaccauggcugcucuuccagaggacuugaguucaauucccagcaaccacaugguggcuucugaccauauguggaaggauuugaugccuucgucuggcauggagguguauagccaacagaguacuccuacauucgauaaauacauaaauauauaauaaauacaugggcaaauuguuuuuuaaaaaagaaaaugccucacaggccugucuauuggccaauuauauggaagcacuuucucaacuguggcuacuuauucucagauaacucuaguuucuaccaaacuucaaaaacaaaaaaacugagacagccugcaaauaaacacuuuuauuagaucugagaaauaggaaaaaaaacaauuaaucuggaggacauuuucuuuuuugagucaggauuucauacagcauagacuugccuugaaacgacucuauggaccuugagccauugaucccucugccacagcugcucagaugcaaugacaggcguguaccaccaugccuggcaguggaagauguuccuaacccuuuccuuuccuaucucuucggugcuccuggaugugucuucggugauugccguguccuuggaugccuguggcaucauccagaagcagaccuguagccuagaucggugaaccuagaucaggcuucuccaggcugccgucuguugucuucuggucgagacuuaggcaggagaucuaaaguggaagcuaugaguuuuggacauccucagagucuaaauuuuuuuuaaaauuuuauuuauuauauguaaguacacuguaacugucuucagacaugccagaagaaggcgucacaucuuguuacggaugguugugagccaccaugugguugcugggauuugaacucaggaccuucggaagagcagucagugcucuuaaccacugagccaucucaccagcccccagagucuaaauauuuuaaguagagcauuuacaaccuugcccucucauaaacagagcagccucccuauuccucauugagauuugccuaauccauugaauaacuaaacacccaguugggugaagaagccagggaccauggguguacugagcacuguuuccucuacagccacuggcucaggcaggauuacucugggaguccgcaucgucacuugcaauaugaagucaauccauuucacuaauaguuuucagguuuuguuguuuuucaagcaaugaaccucuuaccaagcaaauaucuuacucagaauccccagccuuuggcauacagugguagacuucaaggaagaccuggagggaggggucgucugaccugaccugauucugcuucuuucaagugugaugugauaugaugaggcuguagggguuggcacugcacaggcagaguguguuccauguagccagucuucuaugagcagcauaggcucagagucuuguuuuagggguccaugacaagucacacaucugagauuuggggcucauagucauuuauguucauggccugcagcagaagaacaaagcaggguccacacagauaaaagacgaaugagauagaggugaauuuuccuucagagucuaaacagguauguguuucugcccagggaggagaagccaucuaaauccacaggacaaaggcuucccuagggcugggagguaggcacauacuaacuauguaaccagcucugucuucuaaaacccgucagagaauaucaguuauuauagaaaauauguuuuccuaggugaucaugcucgucauggguuccagauguagaaaacuuuaucggcuaguaacacaaugacuauuuuaaggaguaagcgccuaggagacgcagagggccuucuucaguugugcuauguccuuucuuguucaccuuccuuguagccuucgugcgguucucguuguaugcguagggcaugcuagacaguaguaaagggaaggaggacagagggaccaaaaguucaaaguggcaaaugcuggcaacaguagacuucgcacaauaucuauaugaagacauacuuagaaauauuguaggugaauauuaaaauggaauuguguuuuuuauuauauuuuuaaaagacuuuauuuuauguaugaguacucugucuacauguacaccuucauuccaaaaagggcaucagauccuauuacggaugguugugagccaccaugugguugcugcgaacagaacuuaggaucucuggaagagcagccaguguucuuaaccgcugagacuucucuucagccccaaaauagaauucuaaaaacuguuuucaguaacccagugggacugaaacagaagagcaggagacaaagaacaagcagaaaaugagaacaauagguuuacaccucacaguaccagcauguaaauguguuaacuguaaacagccuaaauacauucaaaagacagauuggcagaauggauuaaacgaugauugggaccagcauguagauaugugcuuaguguguaugaggucuuagguuugaaucucaggauaaaagcaacaaaaauucuuagcucaauuauauaugcucagcuuagcuugauuucaguuugugauaccagaaaguaaaggagagaagagaaaaagaugugugauacaaguauuggucaaagcaaagcagauguggcuauaguacuacaagauaaacuagacuucagagcaaaggaccuuacuaggaaaauacuugggauaugccaauucagcauguuuauuugccaaugagagcuucuauacagaaacaaaaauuucauuuuuaaaagaagaaaugagacacuccauaugcuacacaagaacuucagcucuucucucagcaacgcguguguugcaacagaacgagaaggaaugaagaacugaaacucaacacuacguggcaucaggaugcgcucuuaaguggccauggccauuuaccaggcuagaccauauccugagcuacaaaguaaacuuaaaacuuaaaucuggccgggcagugguggcgcacgccuuuaaucccagcacucgggaggcagaggcaggcggauuucugaguucgaggccagccugaucuacaaagugaguuccaggacagccagggcuacacagagaaacccugucucaaaaaaaaagaaaaaaagaaaaagaaaaaaaaaacaaaaaauaaaacuuaaaucuggaguugaaaucauagacacugaaaacugaaacuagaaacucauuuuuaaaaguuaagacaggcuguggguguggcuucauggauaagaaaaguacuuccugugcaaacgugaggcucugaguucaaguccccagcacccauguuacagcacaggauuagaguggccauuaccacagugcuguauggggacagaagccaucaggucagagaaguauuaagggaaauuuagaagauacauggaaggaaauaaauccuuuaauuccgcaucucccuguuuuccauaccugguccuuuccacaagguuagugacucuuccugcauggaaaccuuucaucaccuacccaugcuccagucagcucuugaauaucuucugccucccucaggggauggucuccacugucccauuaguuucuccgcauacaguuuacucuuuaaaaagaggaaaaccuccacaucaguaagggcaguguagguuacaagggaaguggcuccuucgcuuaagaugugguacaaauugaacacaucucccaaugccgucugcaugaacgugugagaacgauguugaaaaccguccucuuuucccuaggcuuugaaccuagccuacucaagcauuuauggcagcuaccggaacuuuguggggccuccgcacuuccaagucaucugccggcuacuuggcuaccagggcauugcaguagucauggaagagcugcugaagguugucaagagccuggugaguuuuccuggacuggguuuucccuguagcauggauucacuggguuagauaaacacagccauuugggggucggaggggucuucucuuucugucugggauguguagcagaaacagaaaaaaaaaaaagcuucaacuagcuucagacauuucuccuaacuaaagagaaugguucuggauauaaaaggaugucacuguccuaccucguucucaagagauugaggcaggaauuuugcuuaaacccaggaguugcgggccagccuagagaacaucugaucugucucuuacaaauaacacccccaguuuaccaaaaggaaagauugaaguuauaggacugauuuauaauuuuuuguuguuucugccuguccgagauauagucuuacuauauuuaguguaggcuggccucaggcaucagucaucuugccuuggcuucuagauuugcuaguauuagagaucugcaacaccauaccgggcuuugggaaugguuuauaaccagaauauuauguuuauaauaagagaauguugcuucuucuacuaugcagaagucuuaucaaagaccaccacuguaacccuaagcuugaggggaauuaaaaacaaaguagaagacaaaagaugcuugccacagucuguucucuccaguuuuuuguuuuguuuugugguugucugugauauguagaugcugggaaccaaaugaggguccucugacccaaaugaacaaauguucuuaaucacugagccaucuuucuggcccccaguucuauaaauauauauguucuuguuuuuauuugugaaguauggguuuucauaaagcgcagaucucuaggaaacgcuguauagagguaaauggagaucauacugaccacaggaagcuuacagagccucagguauuuaugguaggcaggaacagccacuauagggauagauaugucagcugugggccguucuucacaaguguuccagugagaaggcuccugacagaugaaagugagcugcacaguuagugaggcaagugguaugugcuuuuguucuggaaacaaaugugaguaaagggcuuagaugcacauguguagccccagagugaggucagaguuguacacaugucaccaucugcacagaaaccuggcuuauguuauuauugcuaugagaaacaccauaacccaaggcaaaacgaggagaaaggggguuuuggggguuuuuuugcugguuuuuggguuuuauuuuauuuuauuuauuuauuuauuuauuuuugccuauacuuccauaaagacgucagaacaggaagugaagcagggcaggaaacuggaggcaaaagcugauacagagaccauggaggugcuauguacuggcuuguuccucuuggcuuacucagccugcuuucccauagaacucagaacacuugcccagggguggccccacccacaauauggugggcccuccaacaucaaucauggguccggaaaauacucuacagguuuugccuauauaccuguagcccugucuuauugaagcauuuucucaguugaggcuuccuacucucagugacucuaguuuguaucacguaaacauaaaauuggccaguacaaagccuuaugguucagguuuuugaaaagggaaaaugaugucauuuauagaccacaguggacuuuuucuuuuaauucauagucagccagucuccccccccuccucccccuccccucccucuguguccccauguauauaaaucucagaucuuuauacuuuuagagcaagcacucuuacccacaagccaccucuguugcucccaccuuguuuuaugaggcagaguauuguacuggaauagaaccaaucaaggcuagacuggaugaccaacaaaccccaaggaaccaccucucugucuuacugguccuaagguuacaaaugugcugcacuguuuuuuuuuuuuuauuauuauuauuuuuauuuauuuauuuuuuaaugcauguuuuggggcuugaaucaucaauccagaaaauaccauacagacuugccuacaggcuaaucuuaauggaagcauugucucaguugcacccaucuuccuaaguaacucuagcuuguuuuacguugacaucaaacuaugcuguaauagcccacuaaguguaaagaaaguuugaaucugaauuuguggccaccugaguacaaccucaguccaucaaagaugugacauugucuugaacuuguagcaaagguuaacagcucugagaagucguagaguuauaacauggguuauauguaaugccuuagcuacuguucugcuguuguaaggauguaccaugaauggccaaggcaguucuuauaaauuaaagcaucuaauugcuuaauuguaggcuugguuacaguuucagaggguuaaguucauuauuaucacagcagggaaugaaacagcacauugggcagacaugguacuagagaacuggcugagaauucgauugucaagcagcaggcagaaacaucaacacuggccuggcauggacuuuugaaacucaaagccuaaugcccagcaacacaccuccuccaauaaggcuacaccuccuaaucuuucuacucuuucucagauauuccaacucacuggugacugagcauucaaauagaugagccuauuagggccauuuucauccaaaccaucacacuuaacuagaauguagaagacuuuagucauuugcccaucugugaucuucgggaccacucacacuuuauggacuauucugccuuaaaauacuugaaaguugggaaagaaaguuacgaaugcagcccucauauggcuaaacacaaaggugacauggucuagccuggaagccauccuaggccugucagaggaaauagaaacuaucuuacaagggcuauugcuucuagagcuguuggcacucuugguguugacagugggucagcauggaaccuacaugggaaugugaacucugcugcuuuauuuccugacuacuucaugucuuagaaagggacuuguauuuuagagugugaauauaguugucucuauagacgcucagaagagggugcucucuuuucacaggugggauuuuauucccgagccaagcugauucuacaaacucggucauaacuguauuuugcucauggacugauuuucagagcacacacuucccagggccauccaugaaagggagggagauagcugacagcccuugucuuuugcagcugcaaggcacaauccugcaguacgugaaaacucugauggaagugaugcccaagaucugccggcuuccgcgacaugaguacggcucuccuggugagcaaagguggcugggguaccccgcaggaguacaaaccucaugagaagggaaucaaguugauaaagaccagauuugaaagaagcccaaaccagaaucugccucuuuagaguagaacaaacaaacacaccuuacaacuggguagcaggcaaguguguaggacuuuggggucauuauuugcaguuaaacaaccgagggacccagcuugucaacuagcaaggaguuugguaaugggguauugaacauauuguugucccagauccugaaaauaaucaccuaccaagaaaagcagggggagcuuaacuaccagguccuaauucccucuucuuggggacaagcauuuaaagcagccacaaggcucuacuuccuauacccucccucuggccucuuacccauuagauagucuuguuggucuguaaagcauucugccucaucuggcucacaggcuguaagaacuucacccauaguccuuggauguguacuucuagaucaaccuacaugacuugcugcaggcugguguaaggcuauccaaauaaauauccauaaugagcucagugucgcuuuaggauuaaccucggcucuacaaaccuuugucacuuaaaagugccaggcaaugauggcgcacgccuuuaaucccagcacuugggaggcagaggcggguggaucucugaguucaacaccagccucgucuauaaaacaagguuuaggacaagcagugcuacacagagaaaccuugucuacagagacagagacagagacagagagacagagacagagaaagagagagagacagagagagagacagagagagagacugagagaaacagagagacagagagagacagagagagugccuuuuauaaacucuuaucugauaguauucucuccaaagauggcaucaguucauuuuuuuaucacuaugaauaaauaccugugaaauacuuucguugcuggaagcauguggcaucuccauaguaguauuagaauagcaggugcuagugcugugccugaaugccugacacuucugcugccacaggcauccuggaguucuuccaccaccagcugaaggacauuguggaguaugcagagcugaaaaccguaugcuuccagaaccugcgggaggugggcaaugcuguucucuucugccugcuuauugagcaaagccuggugaguucucaguucagcccaucuuagcugggccaaaguuuucacugcugaugacaaagaaguuuucuuuuucucuuuuguguuuuccacaccccucuuuaguaaggguaugaggugggcaguauaacuguuuaugguucccuacauuuagaaaacaagaauauaauauuucuucguuuaaagaguguuuuuccaguggaccggaaaaguagcucaaugggacauuaacacuauucuaguaaauucuguggacaauuguuuauuuuauucuaacagggaaaguguaacuuuucugcgccagauauuuauuaucuuuuucacuaugagauccccugccugggaugauuuuuuuuucgacucuguuuuagucuuuagaagaagucugugaccuguugcaugcagcuccuuuccagaauaucuuaccucgaauccauguaaaaggugagucugcaucaucaaccagaguucaccuugcacauaaaggagucauacuuauuacacugugcagccagagaaaaggccaauguucaguuauguuggugccuguugagucucuguggggugugucuaaccugguuagaauucauaaacucaaguauuuauaaugauauccagaacccauuucaaaauaauacagaguucuguaacaagauaauaaaaacaauggccaccaaguugauagaugucauaggagaugaugucauagaugaugucagagaugaugucauaggagaugacgaguaaagagguucacuggacuauuuugcuuuagaucauguuuagaauuuucagugaaauuugaaaaccgaacacacauuuaacucucccauguucccccauucuguaaauaauuacaugaaaaaguuacacuaguccaagcugaaagcagauucuaaaugguuacauuagugaacuuguuagcuugaauuaaaauaagccauuuuaauauauuguauauuuuaacauacuauaauauacucuuuccaaagagacucuccacccauggaguuaacugaaucuuuaaauuucuguuaaaaauuaaacuuuggcaauuuuaaaaucuuacauaaggacagagaauaauaauaaugucuuuuccaauacagagggggagagaguugaugccaaaaugaaaagacuagaauccaaguaugccccacugcaccuugucccacugauugaaaggcuggggaccccacagguaagaugcuaugcuuacuggggucugugugcuggguggaaauucacaucaggccaguggagcagccaggaguuacugugaggucaacacuguuggacgaguugggaggauuagagaguaugcggaaagggcugaacaccuaucuaucuuagaaacaaagauguacucagauguugccuguuguucuacuccacccuuucaugaacaauuguuuuuuguuuguuuguuuuccuuuucuuuuucagacaggguuucuguguagccauggcuguccuugacuugcucuauagaguaggcuggccucaaacucauagugacccaccugccucugccucccaagugcugggauuaacaguguucaucaccauugcaccaagcuuuuuaaauagaguugcuucuuagaagaaauggugacaaaaggcaagguaucaggaugaaguuuaccccugggcagugguggcacacgccuuuaaucccagcacuugggaggcagaggcagauggauuucugaauucagugccagucuggucuacagagugaguuccaagacagucagagcuauauaaaaagaacuugucucacaaaaaaaaaaaaauguauuuaugugugcuuaaguauauuuaugugugccauaugcauucagugcuacacagagaaacccugucucaaaacaaacaaauaaacaaacaaacaaacaacccaaacaaacaaacaaaaagaaugcaaguuagccuagaucuggcauacauaacuguuuggaccauugcuguuuugaaccagaguuucuguuugagguugucuuauagacucuguucaguggcauuacugguuucuagccacgagaugccaguaaauuuuuugugaccacuagaaauaucucuacuuuacucuucuagacagacuucaguauuuuaaucuuuagcauauagauaacugcugauauaaccuguugaugcugcaaaacccuguucugccaacuuagcauuuccuaucuacuacugaguaaguuggcuggugguaguuuguuuuuagcccuuuaguauucuaucauggcuuguaauauuccauguacuuuuugcagcaaauugcaauugcaagagagggggacuugcuaaccaaggagcgucucuguuguggucuguccauguuugaagucauccugacacggauccggaccuuucuggaugaucccaucuggcgugggccccuacccagcaauggugucaugcacguggaugaguguguggaguuucacagacuauggagugccaugcaguuuguuuacugcauuccuguagggacacacgaguuuacaguggaguaagugugugugugcgaggagggggggggggguguucugugacucuuuggaagagugggagaacuggcaaggaaggugguugcugaaaggagugugaagucgguacacaugaugaaacucuuuuacaaaguauacagacauugcacuggccuaaugccacugagcuguggcucccucuuugaugacaaagaaaggauuuagccugaguaucugggaauuauuugaaucuaaagcaacugaaagcaaauuggacauuccuguuuguggguggcagagccaugauguuauucuuugcaggucuguugcuuaugaaacagcaugcuaaagguaccgaaaauuggcauuaucaaaaauuagaaauuuucuuguuuuuuuuuauagucaaaguaaacuuuaaaaaacaauugcauaaaaaucaguucuaaguagauacacauaugugcuugugcacaccuaacacaagcacauauauacaauauauuacaaaaguagaaaugcauuuaaauuuaagaaucugucuuucguucuuucuuauugaagaaauguuuugcucauauaguacauacuccauucaauuuccuucccaaaucuccucccguccagaucuaacccugcucugucucuucuuagaaaacaaaaagauaucuaagggaaauuuuauuuacagaaauaaauaagacaaagcaaaauuaaaccaaucagaauaagacaaaacaacaaauaaagagaaggaaaggaaccaaggaaaugaagcauacagaugcagaggcacaagucucugcauacacaggaacccuguaaaaccacacaacuagaagccauagcacauacaaaggauugagcagggagagagaaaaccuugacaccuuguaagaaagaggaccacuggaaucuccaugacuguguuuccuauugccuguuuacugauaagcauggggccuacucuuaagggugguuuuguggggcuggugagauggcucagcggguaagagcacugacugcucuuccaaagguucaaaaguucaaaucccagcaaccacauugugguucacaaccaccuguaacaagaugugacgccuucuucuggcauguccgaagacaguuacaguguacuuacguauaauaauaaacuccuuuggagaaaaaucaauucuuuauguaaggcagccuuguuggguauauaucuuggguacuuugugucuuucaucuacucuggcuuucacacuuuuuuaaaaauuuuauaagauauuuuauuuacauuucaaauauuaucagcuuccccuccaaaaauccccuauuccccugcuccccagcccacccacucccgcuuccuggcucuggcauuccacuggggcauagaaucuucacaagaccaagggccucucuuccuauugaugaccaaugaggccaucauccucugcuacauaugcagcuaaagccacaugucccaccauguguuuucuuugauugguuguuuagucccaggggagcucugggguacugguuaguucauauuguuccuccuaugagagaaaauuucuugugcucaucuuucucccaucugaggaacuguggacaaaggaacuaauguagccugauuggagacacucauucaagucugccuguuuguucauuguccuuauugcuuggugccucuaggcaguguuuuggagaugggcuccacugggcuggcugcaugaucauuguacuucuuggacagcagcggcgcuuugcuguguuggauuucugcuaucaucuucucaaaguucagaaacaugauggcaaagaugagaucaucaaaaaugugguauguagacaaaaucuaaugcuuaauauccuaacauaaauucaagcauauauaaacauuacucuaaacaaaacauaacccagaaaguuuuaaaaauauuuucuauuuccuuuuucuuuuuaagguaauuagaucuacuuaucuuaacugcauuuucagauuauugacacacuauucuaaucuuuagcuuccaaaccaugugguuuuuaaacuuuuauuaccuuuuugucaucuuauaaaguucuccacaacugaaucacagaaaauauuauguuuucaaauguucucucucuuuuagaacauuauugguaaacucucuucugcuuuccauaugacuuacuucacaauaggcuuaaugacagaaaugccaccauugauuaucucacuguucaacaucuacauagcucagcggauuccccugcuucgucucacaaagcuaaaaggaguguguuuuuccuggaggccuugaaagaugaaugggcugaacuucaguuucuuguaacuguagaaacaagguccauuuccuacugucagcucauuuccucacaugcuuuccacauggcccuucaaaugacagggcaccacccacuuuugccacaucuuuccuguggaaacugcuuagauuauuagacugugucugaucaggcaguccaguucucuugaagucacuaagaagacuauccauaguugcaaagaaauucaauaugggcaugugugaaugguuauucuaguuuccauaccuccuuuauuggcucucuggaauauaaccaaaauauuuuuucugcuaugucucugagguaaccaauucauuuccagguuaaguuaaccagaauuuuuacuuucaaaauucuuaguuuugauuugguucuuaaaaucuuggcagguauauucaaauugucaugucuuguuauuuuauauaacauauauaaaauacaaauuuuauauucugauaauuaaaggcccuggagucagacauuuaagacuggcauucuuguguuugauuuaaaugucuccauuaaagauuugcuaugguucacugucaauuguuaccacccuggguuauuagagcuucucaugaagucuccagcuauaguauggguugucucuucacuccagucuacccuucucacauuucccucuguaugagcagaaccagcaaugcucucaaguucugucucugugaucuuuaucacagcgucuucuccacagaacuguuaaacuggaaauauacaacuuuugcauacuaaacuuuauuauauauauauuaauauauacuauauauuaauauuccagcuucuggcucauagguuuuuucuuugucugcuuuugggauuuggaggaaagggucauccagcaugaccuggaacucaccauguacccaggcuggccuugaacucaaguaaaccuguuucaucuugaguaguagaauacugacauaagccaccucuccuggccaauaggcaacugguaauugaaugaacgucgugucuuuaaguuuuauacuuacaauacuaagguugcaaggugaauuuaaauuggaaauguauucauuguuccaacugggauauuagaaagaugguaggagucaauuuucuauaauuuucucaaguagaauccuugaauuugaaaguacaauaaacauaacggucugaucuaauuguagccauugaagaagaugguggagaggauccgcaaguuccagauucucaacgaugaaaucaucacuauccuggacaaguacuugaaaucuggugauggcgagagcacaccuguggagcauguacgcugcuuccagccacccauccaccagucccuagccaguagcugagggcuaagcucacagcaucccaguaacugauggcauguuugucuuuauguaaacuauauugaaauuuuuaggggcuauuuuccauuaugucugaaccuacuuuugaucugaaagcuuaacuuuauaaaauuuacuuauuuuucuauacuaaaauuguauaugccuuuggaauugggaagucugagaauacgguuacuaguuguugccauuacgguauuaacaaguauuuucaugccgaauauuccagcagcuauuauaaaaugcuaaauucacucauccuguacgagcauaauaccaacuaauuguauuaaaaaaaaauaaaaaaacaaaaaaagaccucuaccaguuucuuuuaaauuuaaugacuagcucuguuuagggauuuuucugauggccuuuuaggaacucuuuucuaagucaccguucccuuugaugccaaaauagugaaauugucuccucuguucaaguaaauccaacagugagucugauuugugagauaugacuuaacaauuagagaaauaaaaauuaauggagucuguuugcguuuguucauuggcauaaacaucccuguacauacccacauuucacaggacguguucaauaggacaagaucaugacaucuuucaaacacaaccagaacuuaacauucaggucugggcagggaugacaugaaagccagugagauguaagacagcaauuguguuguccaugaaggacaugaaaggaacaccagaacugcgaugguaugugcaucuacucuuuaaggccaacagugugggggagggcagggguuuaugugggacaguugacucugcaaaaaggggaccgggccuggcccuaacagcucucagcauaccuucuccauugcugggggaacuaucucacuauaggacuuggacaugugaacaacaacaacccaauuuugcuguacuaucagaagcaucaaaagggagagaaauuaacugaaaaucugguacagcgacgugccacucacaucccagcuacaugggaaacugaggacugaagaucgauggagccgagaguucaaggacagcuuaaggaacauaguaagagcccugucuuaaaaaagagaaaaacaucacugggcugggaaaccccaaaguccaaaagcuuugagcuuuauuuuacacagaaaauaaaacacagguacuauccagcuguacuguaaaccugaguaacauuuuaaacaagccuauuuaucaaaaaguuaccuaaaauauuuuuguugauaugaauagucguaauggcaucuguacugacccuaugaaguguagauuuuaaaaguuaacaacuauauuaccaagugacaggccaaauaaaaugcuugcauacaagauuccguacguauaaaguguuguauguacaacacacauucucaaugaggaaacucuucacccccaagggaaugaacauuggcuuuuuuuuuaugugcaaaauaagacauacaguacauaaaacagacauaaauuauaucugcgaggguaagggggaagccuauucugucugacauuuauaaguuauauaggaaggcuggaacuguagcucaguuuuagaacaauuguguagaauauacuagguccugugacugaaaccaaguauggcccgaaaaggacuuacauagagggagucagaggaaaagaaggcaagaauccuuaagagugccaauaauaaauagaacaaagcuacccccacuccaaaaaaaacuuuuuuuccccccacaaaaccaguacuaagcuacuauacaaccaugggcaggaccaggaaacagcuucagcucuuccugucagugagggauaggauggaggggagugguuuuuuuuuaagcuaguacaugacuuugaagugggcgagucuaaagcuggagaguguuccuuacauuggccuaaccuuuuuguaccugcuuguauuuuuucuauaaacauuuuuucacaguuucuauuuaaaaaaaaaaagcaaacucugaagcaaaauaaaucacuugguucaaagagaccuauuuuacaaacauuuuaaaccuaagcaauuaggaucaaaauaaagauuuuguuccaaccugccauuuuaugcaagcacgaguuucuaaauuuaaggaaacucaaguuucuguugauaaggcagaguuaagggcugaaugacaaucuagcccauucugaaccacacugagagguccaagagcuccauaagaugacacagagauccagucaccauggaaacagcaaguacuaacugauagcacaguggguuuuuccaaaagggggccagcagaugugugcgggaaaccagauguuugggugacaaaucaccaccugagaauuauuuucuuggaaucacacacacauaauuuauaaucaaaaagccuuaguaugaugagguauugauggaauggggaucacaaauguacauuuuaauguucaucaccaauggaaaaaauaaaacauuuuuauaagcuuaaaacuugucauuagugcauuuaaauuucuggagaaugaauaaaaauguaaaauaccuuuacaauaauacaauguuauuagaaauuagccauguacugaggucauauuagugagcuaccauuguuuaacuauaagaaaaguaauuucuugauccaaauuagugaaaacuuaaaaaaagauugucuuuagaggacauuauuugaggauaauuuuuucagauacauucugaugcucaaaacucacuuuauaacagaauuauagguuaacuuuucaaacauguccuuaaaaagauggcagauuuccauuccuacgggaaauauuuucaccaguguguucaauuccacaggguaagucgucuucauuauuauuaagaacuucauacauacuagaaagauugccauucauugccuuuucaucuuuucgaaaagauacuggcagacuugcuagacuaaaacugacaucuuuaaaggcaugcaacaaaaauauccccacaaugauugugaagaagccacucaaagucccaaugacaucaucaacaggcauauccugccauucuuuaaaaagaauagcugaacaagucaaaacugaaguuguaaagaacacauaauauauuggagucacaauggaaguguugaaaauguccagagcccgguuuagguaauuaaucugugugcucacacagaccacaaggcuaaacagaagaauccaggcgagggggugcugcagaacaggcuuuccagccaacaacucuuuuauggcgauacccaaacccuucacacaggagacugaaaaugcuccaaucacagagcagauuguuauauacacaagaauguuugucuguccaugucgaggucccaccacaaagaugaauaucaaggccacaaugaccacaaauguugcaaagaccacaaaaccuagaggaagcaaagaaaagcuauauuagaacaaugcacacacaaaaucaucaggaaagguauacauaacucccaguacugcauccucagauauaucuugccuauaaaacuauuugauggauucauuuugaaguguuaaagacuuuguaaguuacucauuguagcuaacucccauucacaccaaagagacacaagacucuacgaaaauaauucucagguggugacuuuucucuugcuccucuagcaaagucucaccuacacaaauacaucagaaguacauacuggagggcuggaaacagugcagcuggcagagugauuugccuggaaugcgcaaagaaagcccuggauucaauccucaguaccacuuuguaaaaguacacagucuaaaauuaaaauaugcuucauaguacuaaaacaaacaaacaaaaaaaaaaacccaccacuaacauuuuuauuuuuauugguu

SEQ ID NO: 3842 - RNA, 1636 nt, Mus musculus
cagaucccacggguuccucuccuauagugucaucccagcugacuuaagagcuuggaagaucacuauagcucugucaccuucaagguguccucagacagcagaaaaccuuaucuuguugaagagugcuacaauuuuuccagucaccucuuguaacugcgugccaaagaaggacuccaugaaagaugacagaagaagucauugucauagccaagugggacuacacugcccagcaggaccaggagcucgacaucaggaagaacgagcgguuguggcugcuagaugacuccaagacgugguggcgggugaggaaugcggccaacaggacaggcuaugugccuuccaacuauguggagcauaagaacagccugaagaagggcucccuggugaagaaccucaaggacacacuaggccucggaaagacgcgcaggaagccaagugcucgggaugcuuccccaacgccaagcacugaugcggaguacccagccaauggcaguggugcugaccgcaucuaugaccucaacaucccagccuuugucaaguuugccuacuuagcagaacgagaggaugagcugucccuggugaagggcucccgugucacaguuauggagaaaugcagugauggcuggugguguggcagcuucaacgggcagaucggcugguucccccuccaacuacauucuggaggaagcagaugcgaagcugcagcugaggcccccagcuuccugagccuacgucggggcacugcacugagcaaugggcagggugcacgggugcugcacguagugcagacacuguaucccuucagcuuggucacugaggaggagcuuaguuucgagaagggggagaccacggaggugacugagaagccggagaaugacccugaaugguggaaaugcaaaaaugcccgaggccaagugggccuggucccccaaaacuacgugguuguucucagugaugggccugcucuacaccccgcucacagcccccagaucagcuacaccgggccuucagccagugggcgcuuugcuggucgggagugguacuauggcaacgugacacggcaccaggccgagugugcgcucaaugagcggggcgucgagggcgacuuccucauuagggacagcgaguccucgcccagugacuucuccgugucucuuaaagcauccgggagaaacaagcacuucaaggugcagcugguggacagcgucuacugcauugggcagcagcgguuccacagcauggaccagcuuguggagcacuacaagaaggcccccauuuucaccagcgagcacggggagaagcucuacauugucugagcccuacagugaaagcagccauuggcucccucaugcccugcccacugugggccucgcugccaccucugccuccuagagcccagcacuucuggucaccuccacccauguggccuggaucaccucuguggcccagucuguccuucuuuucagcuuuguuggucaaccacggcuaccuaggcccucacaaccaugccccaggccaccaccuucuggugaugagggucagagggagcaaagcuacucacuucuuuccuuuccagccggaaacaaccuguuugaauccuuacacagacacauacacagagagggaaagggggggg

SEQ ID NO: 3843 - RNA, 83025 nt, Mus musculus
cgccuccggacuccgagcccucgcccggcaggguuggcgcgcgcugccugucgggauacucgguccgcccaccuaguccucucguccagugcugcguucgcgagauccguauuucucccaagaugguggcgcuccucuuugggugacuccaggagacgacagggccuuucgucuuugccagcaccucgucgccccuccugcgcucgcucucucgcucgcgcaccgggccacgcagcuguucaccgccucguuacgcuucucuuccgucgaccugucgcugacgguggcgccuccuucugcuucucuucggaguugcucgccgcccucgccccccacuguggacagaucgcgacagcagcgcuucagcgccgacuucaagguugcccaggcgccuggccucucggccucgguuuccugaggagaagcgcgggucccgcaugagacccggcgguggcgccagcgaaagggaacgaggcgguggcgggcggcggcgguggacgagggcgacaaggaccagugaggcggccgcagcugcgagggccgcagcccacgcgcgggggcgaggacaggucagugcugcugcggcugcggccugcccggcgcgcucccucuggucuguaccgccgguccccucgucacccuccggcccgcgcugacaggguaggcgccgggcccucacccgccuccgugagcgagugcuuggggcgcguggucuggaggggccggugccaggacuaggcccugguggcugcggcugcugcagccuuaacugucagugcuggcuggacgcaggagggaggguuuugucacccacggguacccgagugggcccgggguggggcggacgugcagggcgucgagaucgggggccucaucuaagcagagaucggagagccagccguggcuucaggcugcgaaaggcaggccuuuuccuccaaaggggcgcucugguggggaagacauauuuagaugugugcuuaguggguugggguauuggggguggauuggaaggaagacggaugaagcggcaccucaagcccaaggauugcgcucugguuuuauucgugugcugcuucugguaggauucaguaguugaacgugaguuacugauuccucagaaacugcuguguuaauuuucaaugcaaaccuguaagcaguuggccuccuccucuucuccccucccccuuuucaguugagaaaaugaaaaggacguuuuccccauuuugaugcggaggcuuuuuguuggaagaaucagaguugaaugugcuauaauugcguuagccuuaaaaauagaaaguauaauuuuaauaagacuuuaucagcuuuagaagaauccucuaaagacaauuuuacgucaauuuuuuuuaugucuuuugagcaugcuaaaauagaacaguauaaaaucucuuugggauugcguuaaauagcuaguguacuguuggaaauguuaacuaaauaguauaugggauguguuauccaccauuaucuuacuucgugaaggauauucguauaacccaugguuuugggagaagcagcagauuauguuaaaauguuuuggauagggaagugcguuugaaauaaagauggccugaacuuuaagaaauacagcuguuaaaaagcuaaauaucaaagcccuauuggacaagagacacgacgaauguuuuugacacaccucagauuaguuaauacucuuaagauaucuuuuugguaaauuauguaaauuuagaauugaggagagauaaaaggaaaauuuugucuuguuauguaugacagaaauugcuuuaguauuaaauucuccucuuaaauagacugcuuacugcacuuuuaaggaaguggauacugcaucuguauugcugauaagccuaaguaaggaugacuguaaauccauaaauacuuagcuuuacaaaaaagccauguaucagaaucuguaauaaaaaugagaacuucaacaauucgcagucuaucguuuaagaaagauacagcacauaauaaagaugagaugacuuguaguuuuguuuucaaaaucagaauguagguugugaaauaauuugugucaauauuuaccuugcaugguguguugugaagugguauacacauacuucuuuggauguugcucuucauauaacugaggagcuuaacuuugaguuuagaaaauuccuuuuguaugcagguuuuguagguggcuuuuuuaucccugaaauagccaccaucacccuuuuuuuuuuuuuuuuuugagaaagggucuuaugguauaucgcuggaugacgucuaacucuccucuuggcuuugucuccaggguucugcgauuaaaaauguauaccaccaggaccggcuauuuacccuuuuuaugguuuuaaauuagaaaaaugugauuucuaccugagacaaaacucauucuauuugauucguuuuuuuuuuuuuuuuuuuaacauugcauucauuagguaucuauaaugucucugacauguaaauuuuauucaguuguauuucuuaaacauuugugucuucccucaaauaauugcaguaauaauuguuucucucaauuuuuaugaacauuuucuuuuuaauuggccauagcuauuuuuuuuucuguucaagagcuuaagaugaucuuuucaaauguccuuuaaaaaaaccaacaccuuaaaugaaugguuacugguauauuaucauuuauucuaauuagguuuguuuguuauuauugauaauauuacuguuaauggauuuauauuauauuuauaugcagcuauuaaaaacaucaguguucugauuuuugcaacuggagaugaguuuuaagagguggucuuuuaaguacuuucaaauacggaaaaacaauauaaaaauauaaaaauaguccucuaagucuuuugauguucucuucagaaaggcuuaggauaauagaguuuugguuuugacaguuacuuuuucuuacugauaaaaauaaagacaauguuauguuaggcaugaugucucacaucuguaaaccaacaauugagaggcuaaggaaggauuguggcaagccuagacuaagaggcgagaccuugucucaaaaaaguuaucaaucagagaugucauagaauguguaauugaaaacuuuuuucuuuaauuaauuaauuaauuaauauuuuugggaggcaggguuucuuuguguagccauggcuguccuggagcuagcuguauugaccaggcuggccucagacuauguuuccagaauccuuaagucuguuuggccuauuuauaaaauaccaaagacuggucaacaccccccuuccccccaacuccaaaaaauguaucucacagucaaggacacugagaaaucuuaagaucagaacuaauuuucauuguaaauuugaguaguguuaggaggacuaaggacugaaccuagggccucucaaguucuaggaacugcucuaccacuuccuaguccucuguacacacuccagcucagaccuugaaaugggaguccugccgccuuccauaggagcugugauugcaggccaguaucacuaugucucuguaucucugucucuguuuauuaggguuuuuguuuguuuguuuuuguuuguucuuuuuuugauuuuauuauaugagaguccacauugguguggugucuguaggggugagaagagaguguuggaacugcugugacugggauauagacaguuguuaauugccaugugggcucuagaaauugaacccagguccucuggaagagcaacaagugcuuuuaauuuaacuuuugaaucaucucuccagccuucccuauauuucccuccccuuccuuucuuuuuucuuuugucuuuuuccccuccccgcuucccuuucuugugucagugucucucacuagccucugaagcuagguaaauagucgaagcuggccucuaacucaaagauccaccugcuucagcuaagacuaaauggucuuuuaaaauuaggacauugcucucauucaucaauguagguccuccuaaaaauuacacuuguaauuucaucaccuccgauuuuaggcuuuuagugaaguuuuuuuuugggggggugcaaagauucagaucacauagaagaauaugucugaaauaguuaucaguaucagguaguguuucugaggcuccuuugaauugugugagcugacauggguuauaaggguuaaaaaaaaagaaaauaucuaucauuuggaaacugauagguugguuauuuauugcacauaacaccauuuuauuuuuuaaugugauaauucuguuaaguuauggaauuuaauugucugugccccuccaguuuuagggcaguucuguagacuuaauaucccuuaaccccuuagcuacaauuguaaaggauacuguuuguauccuuuuuuguauccuugguauauguguucaugucuuacuugcagcccaucaauauccuuuuacaguacacaugcacaugugguauauauaaaaugaaauagauuuagucuaguaugcuacucagccuguuaggacucauuuauuuggacaaugauuaccauucugauucaauaauaagagucagagauguuuguuuggaagaauagcuacacuuauuuugcaauuagcaauucacuuuuauggaguuauauauuuuuauacuauuaguaaaauauaauccuuauaagauagcacaggauuuaauucuuuuaaauaaaagaugugaaauaaauuguauuaaguagaaauauuauuauuuuucucaauuucuuuuuccaaccaugaaaggcuugaaauacaugacacuuauuccuucuuaauaaagugacuuauuaauguacacaucagauuuccuuuguuuucauuuaauuucaaaauauuaccuauacuuucuugauuucaguugucuauaacaacuaaacuaaugaauaguaauuuggaaagauuauaaguauugggccuaucuauacaugaaaaaaauuuuuuauacugauuuuugaaagagguuucaauauacauuacuuauuacuuuuagguuuuaccugaagccacagaauaaguaaauggcucagaauuucagugguuuaggaaacaaaacaacuuaggauuauugaaauggaauaaagaaugcaauauucauguugucagaaguugcugcuuuccugacaucugucuugagccagagugagcuaaauaggagcaggccauuuaucuuucuaaggccuuguuaaucauauuaaagugguacugccuucuuguuacagaggauuaugcugcucauaugugauacuucuugaacauugauagauacuguauaaagaaaguaacuugcccaggaaauuuguaggagaaaggaugauggaauacgguuauauuguuuucuguuaacauggcuaagccuccuggucuuucugguauguaccucuuuugagagcugggauugcagggguauaucuccuuuacagccgcaauuacaauauaugaauuaguuucagauuugauaacuauuucaauaagcuuagguuguuuuguuuccuaaaccacugaaguucugaagcacuuauuacuucuguggcuucagguaaaaccuagaaauaaguaauguacauuuaacaugaaauuguuagugauaaguuauuugcaaagcugaauuccuugucauuugcucuucuugaccugauuuuuaauuaaaugaauugcaagugaaucaguuauaagaaugaugggaaaggguagccuuuaggggccauaguaccauaguuaagcuuauucuugcaguucaguuguagcaaaucugaggagaagccucacgaagaaauugcauuaggcuuaugaaggagaauccuauguaaaucuugcugaagcuggcauccuuauuugagugaaaccagaguaguaguaguaguaguauauagguacugaacuuuuuauaugagcaggauaaaauuuuccuuacacauaaccuuguguguaaucuguuguuacucuuagcagcagcucaguacauuucagaauuuggucuuucuuaccugucaacaucauuuaagcaguauagcacaacucucauuaauuugacagaaaucagauauuaaaaaaaauccuucaauuuuaguuuuacauagcuggggauagaauacagggccuugcuaccuagcagugagcuacaucacuagguugaaaaaaauacuuugaaaaaaauauguuauggagccuuagaaaucuaguuugaauggugaugggguaugugugugggugugugcguggauggauggugguagcuguggcggcagugguggugguggcggcggagguggcggcggaguaguaguaguugauaaaaaucaugguauguaaccuaggauagacuguaucuggacauguagugcagacugcccuugaauucuuggucuucggcccaagugcugagacacuuuuuaguucuuguuuguuuuauauguuuuuuuaaaagacagaauaucuuguaguccacacuggucucaauuucuuaguaguugaagauaaccucaccuacuuauccuucugauuacacugcuccagugcuggggacuaugggugugaaccaauuuuuuuugugugugugugguguccaaugcauauaucuucaauucagaauguucuucuggacauuuaaagcaagcaguuuggcacacaaauuacauagcuaugacaugaaugaagauacugucaguguuguacuuuucugaacggugguuuuuuguuuuuuuuguuuuuguuuuuguuguuguuguuguuuuugagacaggguuucucuguauagcccuggcuguccuggaacucacucuguagaccagggagaccucaaacucagaaauccgccugccucugcuucccaagugcagggauuaaaggcgugggccaccacugcccgacagaacaguguuuuaaugugauaaaauuuuucuuuuuuuaaaacaaaaaccuauguuuuuuuuauuuguuuguuuuuuugcuuuuuugaauaaaagagauggcuauucacuuaaaacuucuaauggacuuucugauaugaaaaaguagucuuagagauaccauuguggaaccauggccauaauuaauuuaguuuuauaaucugugauauaaaauaaaugcugauaccucuaguuaaauauagaagauaugaacaauauagaagaaauuaaaagaaaccaaccauguaauguaccauuuaguuugaacaaacuuuauauuuuguuauuuccuugaauucuugucuuuucugaaacucauuccuuguuuucauuaguugauaccacucuucucauuauagguuucagcacuuuaccuaguaucagaugugaaucauacugcuauuuuuuuggaaaggaaaagaugaaaugcauagucccucuuucuuuuuuuuucuuuucuuuuucuuuuucuuuuucuuuuucuuuuuuaagaaaaauaaugccuagugcauccuaaggggaaguagaguagccucaauuuauuaguauuucucccuuaagauuucuauuuacuaugccccuuuguguagauauauuugcuaagcguacaauaugcuaaaaauaaagauaauauuugccuuugcuaaauguguuuuuguuugguaacuuaaaauguuguuuuuugaguaccuguuguauaguauguauaauaauagauaaaucuuauuucagauaaagacucauuagagaauauguuuuuguccucacuuuugaagugaccugacucuguaucauguguuacugauagaaaauacauuaagaaaauccaaauccuuaguuucaaagaaaugaaauuucuccgcuuggaaauucugucccauucuccauccucucuguuacuguuucucacugauucuauaacauuguacaggauucuagacuggagaugggaauaagaaguuauguacaaguuuaggaacuuaaaggaggaauauacuuuccucuacagauugggcuauauaauuuuaaaguaagagcucuuaaagcauaguaggagaacugagcuaauuuuagucuuuuaucuguacuuaacaucauguauaauuacuggcugguacauuauguuucaugucacuuuaaaaaugaaagauuguuuuggucugauuuaacuuuguauggaucaucuuucuacugauucugaaauuuucucuuacuccauuuuuuuuuuuuuuuugaguuaaaugaaacacagggaagaggugaacguaaaaacagauauaugcacauaacuuaaccaguugaaauuagaugucuauuccuauacugaagagucugggagaacaguaaauguuuguguacacauuuuguauucuguauccuuugucuucucccuuuuuccaucuuuccucuucucuuuuuucucucuuucuaaccucaugucucccaguucuuuccucucucacuguucucucccuuuuguccuuuuccuuucccuucugcagaugcagguauuuguaaauguuggauugaaugaacuacuuucuagauuguucaggucuggguuaggauaucugcuguaggcucuugaaauauguauguaugguaauacauaauucucuaggcuugagaauuuaaagguaaacagaauuaagcaguacuauaguggccuggacaauuaacaaagaccuucugaaggucuuuuaaaaauugauacuaauucgucuuuuuaguggucaagagauaauagcuuaauuauuuagacaccuauucugcgcuuaaaauuaucauguuauaauaauaguuuuuuuugggggggguucuuggcauuaaacccagggaacauuucuucuaguccuuuaguccuuuauauuuugucuuaaucuuuugaauuauuauuacuauuauuaucauuauguguuguauaauguguauuuggacauaagagugccaugcugugaugcggguggaggucagaggauaguuagguagauuaaggucucucaauuuuuaacuuuaaucccagaguguuuuuuuuuuuuuuuuaaagugucaggcuuauauggcuuuauccuacucauggagauaaucucaagagccauacauuuuuaucuuauuagcauacuuuuaauaaauugggaagauugugucauggaagucuccauagucuuaggguuuuguuuuuagcuuagaaauuguauauucagauuguuucuuauuaaaacauguuauaaaauauuuaaagcacuuaauaguauaucaauaaucuacuuaccuaccauccuggaauauaaaugccaguuuugauuuuuguuuuggaaacuuaaucucuuccuccaaguccuaauacccucucuucuuauccauguaagagauuucuugaaguucuugaauaucuucuguuuuguacuuaaauaugaccuuugccaauaagugagauaucaugcuuaagaauuuauagauguguuucauacauacuugccaucaguuuaugugucuuuauuuuauguguuuuauuuuauguguuuuaucuguuuuugagauguguauguugacacauaucuuuuaugguauuauaguauauggauaacuaaauaguauuguaucccacugcuuaugaauauuuugaauugcuuccuauauugcgcagaucauuuuuauacuuccuuuguaaaagguuuucuuuagggaaaauuaaagggaugaaguuguuagaaaauaggauauauccuuaacuugauuagauacggcaaauuuuauguaaauuugauuugccaacauauacuguaucaccagugaaugaacauuuuuguuucuagcaucucuaaccaguacuuggaauaguuagauuuuaaauaaugauaucaaauggcaucuuuuguguuugcuuuaauucugagugguugguaaaaugauaagaguuuuaugauuuuuuucuacaugcuucaauuuaaugauuuuaauuaauuuuuuuuaagugcuggaguuugaaauccagggccugcuguaugcuaagcaauuuucuguguguuuuauaauuuacagaaaaaaauuuaaaagaaaagaaacucuacaagguuuuuuuuuuuguuucuuuuuuuuuuuugguuuuuuguuuguuuguuuguuuguuuguuuuuuaaauagcugauuaucuguccagucaucaguauaugggcuucuguaugcuuucauuuuggguuguuaugguauuuuguguguguguguguauacacacacacauaaauaauuauauauuauauaauagauauauaauauauaauacauacauauauauggauuuaacuuuuguuguaaauauauagcauucucuugauuauauaucuaggugugaguugucugggaaauauggcaacuauuuaaaacuagaggcauuuuaaaacuuuucucaaaguggcuauauauuuauauuccuuugaaauacuuuuauuaguaauaugugaagguucugauuuuuuucauuguuaguguuauugucauucucaguccuuaacugucauuguucauuuggggugcucuaaaguuuuaagaagaauaguuuuguuuguuuuuuaaauaggcuuuuauagauaaagagaggauggaaauugcagagcacaggaaaacauuucuuguggaauauccugagaagcaaaauuauuaggaccagaaauagagauuucugauauaugauagaguacaauaaccaagggagauugauauuucaggaugucaucauauauggguaauguuuggauuacuggaugugaccauaugacaaggacaucaguuaauauguaaaaaaaaguuugaaauuuauguuaacagaauugagaaggcauagggauuuuuuuuuaauaugagagggauaugaccaaauucuaauuucuaggaggauaguucugucaaauauguaagagagaaaugagguaaaaugacaagacucuguaucacaacaaucuuaguaaccauguggggaaaagaagcaauggauucuuucuuuaaagaugaaauauuacaaaaaagaauuuuaaagcuaauuuuuccggcgugacuuugaguuagacugguuuauaaggaaauggacauggauagucuuuugaaacagauugaaguuucuuagccuugcauuuacauagcuacccaaguuucuuuuuuuuuuuuuuucugugcuguuuuauucuauaaaccuuuuaaaacauuuaguauaaaaauuaaggacauacucucaauguuuugucuagucuggaaggaaggguauacuagcaggguuuggaaacauaguuuuacauauugugauggagcaauuaagcuauaccgaaagcaaguaaaggccacuggagaauuauuagggauaguguuggauuguggggagaucccugagguggaauugguagcagugagugagcaauauauuauauuuggcaggaugauuugaacuuuucugauuugagucauuggaacgagaauccuacuguuaugccacaggauuuacuaguaugugauaaaguuuaucuuuggggagaccauaguguuauaucaguccaucuaucaauuuauuaaucugucuguccauccacccacccauccaucauuuaucagcccauccauuugccuuuccuucuuuccuucucacucaccuaccugccaaccuauuuaccuauaaauaauaugcagauuuauuuauuuuguaguugcuuaauccauaggauuagguuuucuccuuaugacaaaauaagauuaaaagauauuaaaggcugaaaaauauucaagacaaguuauaaaugaacuaugaacacaaauuuaaaaucauaggagagcuuguuuuaagcucuguaauaaguacauuguuauuguuuauuuguaaagaauugugauagacauggagugacuuaguugaguaacagagcccuguuaugugucaggaaagcaucuauauucuuuuuauacauuuucucuaauucaacaacuuagcacucuugagagacugacaggucagaggauuuagccaugguugcuacucuagguuuuauauagcagaaguuuuucauauagagauuaccuggaaguggacuuacuguagauaucugaagggguuugaggaaagggauuguggagcauuacuuuuuguacaugaagaugggaaacauggcuuuccuagucggaaaauauucagcucacagccuacagagcuacccugcuacuuuucuuggcaauaggagugggguaauuugucuuucaauauauuuuuggaucuuuauaaguauuauugaagagaaauuggcuuuuauuuuauaaugaauuugaguaauuuuuuuucugaaagacuauccaguuuauguuaaaagaauugagugagguguuuuauauuuuagguuaaaaaaucucucuaagagccugauuuuagaguucaccagcuccucagaaguuuggcgaaauaugguauguuucuguuuuauuuuuugaaauucauauugcaugaauuauuuuaauauuacggcuaguauaaugacaaaugcguucaauaaauuugggcgccugucaauuuuaaagacucuuacuaggugcugaguauacaaccagguagacugugagggauauaagugggguguuggaagaauuugugaguuuacuguauuaugagacaaaguaauaugaacaagaaggucaaggaaauagacuuggcuguuaggcuguggguaugaaaaaucucuuucauuuauuugcaaacauauuuuauauaaggcacucuuaugauaacccagacuaggguuuuaauucugcuuuaagauaauugagguuuagagagguuauguaacuuguccaagauuucccuauaguaagugaucauggagaguggaaucuuagaaugucuuuggaaacuguucaacugaacauugaaccuaauaaagaggagacuaguggagaguacuugauuuaguaauccuaagaguauauauaguucuuuaaugaauuaguugauuuuauuuaagcuguguuaucuuuguguuuguaaguuagaaguuagauucauuucaguauucacauaauuccacauaagcuguuugaugagaaacuaagggaacuaugccauggaccacauuuauuucaaggauguuauuucucucccuugcuaguucagugaugccucuguucuuaguagaagauaaauaguuaugauagggaaauuugggaaauuggguuauuucuuaacagggguuauaaauccuauuuauugggacccccugauuuuguuuauauauauauauauauauauauauauauauauauauauauauauauauauaauauaaacuugagccaacucuaacaauaauauggguucaaauauugaugcuuuaauaauuccuuugggauucucacuacuuccuguuuuaaguuggguucugauuccgugcuuucagccaucuggcuugucugugcugucaauuugaggguguuaauugugaaggggcuuccucuuccuaaucuuacacucccuuuucuucuuucuuucuuucuuucuuucuuucuuucuuucuuucuuucuuguuuuguuuuguuuuguuuuaagcucauucaaauuuguucuauguuuauagaucagugaaagaggauuuugggggaaaacuggauaaaaccauaacaguauuggcauuuugucaggaguauaguaugauaaggagggcugugaaacgaaucagauuuguuuaaaaucacauaugauaguucagauaugugaauaauaggauauucauucauauuuugcuuuauauuacuuccuagaauugagucuuagugggauugaaaacgaaugcuuucuuauagauccaaaggucuaaaaguuaaugauagauuauacuacuuaaauaauuucugucucucugucucugucucucucucucucucucucuuucaugugugggugcguguguguguguguguguguguguguguguguguguguaaaacuuuaaucaagauuuugccuguuugguagcugauuucucccaucaguuaaagacucuugauacuaaaucaguuucauucuaauuacugccacaauacauagucuaaauuuuugcuuuuuguauguauuuaaauuacaaaacacuguaaagcaaaacuaaaccauagcaaaauucuaauacuuaguggaaauuuagcugauauugguuuuuuggucuuaauuucaacauuauuuacaaaaucuucggcaagucaguuaaucacucugaggcugcuuauuguuauucuucuauuuugaucuuguagagcuaaagucaguggaauguaaggguacaguugauuguuguauuuugugagccauauaguacuacauugaaaaguagggauuauuaucuuuaucagaaaugccugggaccagacuauguuucaaauuuaagaauuuuucagauuuuggcauguuccuauagacuuuacuguuugaacauaccuagucugaaaauucaaaaucggaaauauuccuaaauccagcccuuuuuuauuugcugccaugaugauuuaaaacauucuggauuuuggaguaguuuuggauugagaauauaccucauuuucucaaaugaagagaccauuuaagaaaacaauauacugaagaauaguucauaaagguuuuccugugauaauuauucuucuaauuuuauauugacuacugauuuaaagcuuugaagauaaugacuugaacaaugaauuggguuuaugcuaguguucuaacuaaagguuuguuuaauuuauuagaauuauuaagccuacguucagaucaaguuagcagcuagacuggugugacaaccuguuuuuaaucagugacucaaagcuguuaucacccugaugucaccgaauggccacagcuuguaaaagguaauuuugaauguuauuuuacagucuuagaaaggcugucauuguaagaugaauuaugugcuauaaaaaugacaaaaaugcauagguagcaggaauauugcuaagaauaaaagaccuaagaacggagccauuucuucauuuaaccuccuuucucagauauuuauuauagugcauuucuuacuuacccuucaguucaugaagauaaguaaucaucaaagaccuguuuuucugcauagauuaauaagaaaauaugucuuaaguauuuugaagauuacaguguggacauuuuaagagauauguggaaaauaucuuaaguauuauuuuuaauauuuuauguggcaggaguuucagugcuucuccagaaauguugcaccuuuaguaaaaugaguguacuuuuucuccuagagaguuacaguggaguuaaaagugcaccuuuaccuccuuaaaaggauggauuuacuaggucauguuccaguguucagauuauuuguuuugugauuacauuuucugucuuuaaaguuaauaccuaaaauugauacuuuuaaaagacuuuuuccucaccauuguuacuagguauuuuucagguuucaaauuucauucauuccuuuauuaauauucugguaaacuuuaggauaacuugggucagucuuggguugguaguggauuuuuuauuaacuuuuaguugguucuauauuuugaauuugguaaaauuaggagcauguccugaauucuuauuucaaauguauugucaguaaaaagcagcaagcauuuuaagagcagagaacaguuuuauaacuauuaguagguguuacauauacuuugugguuuguaacaccuacuaauaguuauaaaaauagaguuacuuugaaaguuaacucuaguuuuaggauauauuuuggcaacuuaauuagaauauuauuaaaauugucugcauagacauucagauguacacaaugaucagaaacaugcuuuuguuguauuuauauauuuuucucuugacuaaaguaaaacuguuugaaugggagcagccucugcuauacuaugucuaagagaucaagaagaguauaauuuaagaagaauaauuuguuuggauuaauuuuacucugaucuuucugggguuucuuaaauuuuaguuuggcuaaauggugcuuaauaacuuacucuaauauuugugaauauuaaauagaagucuaguauauuuacaauacuugguuggcauuauguuacuggcauucacauacucuguagcaaucagaaauugcgaaaauagcuguaguuggccauuugacaauauguuuguucuauaguucauuuuagggucuugaaacugcagcaguucuauaauauucucuugagauauaguucuuuuuuucucuuaucuuauauuuucuuauauaauauuuuuucucucaucauucuuaaccuucucuaaauuuuucuuuuccuguacauuuagaacacuuugcuuccuaccuguuuagagacuucuaauuuggcuuccuaauugcuaacagguuuuuguuguuguuuugcaagucagcuuuaucucacagucuuaauaauauaugagauguuggaaagacacauuccaaaaugaguuagcuagugcauggguuaccaucauguuuuaacucuucuagccauuuuauaugagauauaaguuuggaaacaaucuugguaguuucuuaaggcuguagagaucauuauuucugagauauuugcuuguuuucugggggaagaggguggagaauuuuuuauuugauaucacuccuaaucuacauuuuucaauucuuauguaauuuugugauaaacagaaaaauauaaauaaacuacuaagaaaaucuaaacugucugagcuuuuggggucuguuuuuaaucguaucuuuuuuccuuuuucuuuguguguguguuacugacuuggaaucuaaaugaauuacaaugaguauuauuuugaaagucaagcaaagaagugaaauuucuuugacacuaaagaagugaauacauuaauuuuuaagauuuuuuguuguuguuuuuuguuuuuuuaagacagggauuucucucuguguaguccuggaacucacucuguagaccagacuggcuucaaacucagaaauccaaugccucugcccuccaacuucuaggauuaaaggcgugcgccaccauugccuggcuaagauuuuuaaauuuucugugugugaguuuuacuugcagguauguauguguguaccagaugcacaugugcaccugauacucacauaggccagaagagggcaucagugcuggaacuggaguuugugaugguugugagcagcugugugggugcuaagaggcaaaccuugauuucucugggagcaguaagugcucuuaacuagugagccucuucuuuauccccuaacuuaagaaucauugcuuuaaaaaaucuuccauaaccauaagccacaaccagccuuuuauaaacuuuuuguuuaaguugaauaucugaagucagugauaaauuuacaaaucaagucuuuaacuugaaagacuaaagucaguaguaaauucacagauugucuuuguauacaaauuugaaaauuuaaauuauucuuuucuuucuuaaccuauuuugggaauuuaaagcauuagaaauagguauuaaaauaaauuuaccuuagaacauugauugucucacaguaaagauauguaggguaacagauuuuuuucuuuuugggaggcagugucucacuauguagaacagccuguccucaugcuaaauccugguuuagcauucugaugacaggaaguauagcaaaguauugcugugugcaucacuggaauuuguucuuuaaccagauguucagaauagggaaauuggcuuauguuccacccaauaaaaaugggauacucuuuggugcuuuauauguauuucuauauuagcuaauauauuaaaaaauaaagaaaauaaccagcagauauuaaaacuaaaacuagccuacaauuaucuagcaaacauaaugcuccauauacacggugacggcagauagugcuuuuuagggaaaucuaauuuccuuauagaaccacaggaauuaugauuagaauggugcauagcauuuaaauaucuuaaagaucuaugaacacuguuauauuugaguuuaaauugucuacugcagaaauuggcagacauuuuucaagggauuuuuuuuuuuuauaauguuuuagguuuugaaggaaauaguuuuuucugcaaguacuuauccuugcuuuuucugaauacauagacaguguauaaaugaauacaaaucucucaguauaauaucacuucaaaauaaaggugauuauccuacaccuuaguguuugcucagguuacaguuugcaaacacuucauuuaauuucaagacuaugaauaccacaacccaacuuaauagaaaguaacagucuuguuuuuuaauauguguuugacauuguaaauaauuauggcuuauacuaauuugauaucuaaauauaaagauuuuaauuuucuuuuuaaacauugagguuucuaaaauuuguucuuaaauguguugugauaaucugaucuuucuacuuuuuuuuucuuaguuuuaaaucuuuuaaagcacccuuucauuggaauuuaagucuuguuuuccaguuuaucuuccuuacuuauauuucuauaccuuuuuuuuggaaaucacuaauauuugucuuuaauuacauuuuacagaucaccaggagaaucccagucugaggacauugaagcuagccgaauguaaguauaacuucguucagguuauuuugugucucaaguugcccuacacuauuuuauuugaaaauaccuuucaggcuuaaaauaaaaaaagguaaaauugaauuaaaaaaagaaaaagaaggaacaacuuuaaauuguaucuagagauuggaacaugucuacuuauaucuccuaaccaaauacuuccaaaccucugcaaaaaauuagaugucuaaugguaaguagauaauuacauacaugauucugaauuuucaauguuuuuugugcccuuggcaguuguugauaaauaggggaauuagaggaagauucaaacaucuaugugccugcuauuaauuuauaauuccugaaagcaagauuguuuaaauaugaccccuguucuaaauauuaaucaucaggugcuauguuuuggguauaaagaugcuugagacuuauaucucaaugcuucagaaagagcagaaucagauuuuuuaauuauugagauagaauuauacuugguauacagugggaauacagaggaguaccaaauuaugcaaaagaaaucuagugcauaguaggaacauugguauagcugaguaaaacuagguugaauccugaaauguuacuggggauuaagcaguuggauauuugaacaguguucuaggccaagucauugccaagguucugaagcaagacacuugaguguagggaaaaguaggaaauugagaaccuuuucaaaauuugacaaugaggaaugaaaaaugaaaauaggaauaacuagaaggaauuaagcaggggacuguggcaaagacuuggugaauauagcacuugcuauguaaguauuaagaagacuggaguaagaggcaagcuggcugcuagguuagcauaauugacaagcuuugaguauagugaaaacaagccucugacuucuaaacacaccucucuacauguauaaaucuaccuauaccaucuauguuaaugcacacacauaugcauuccugucuuaagaaaugaggaggaaguaaagauagauguguauagcuauguuuaaggugugguugaaaaaguccagguuuuccuuacuagaagcagauuacaucccuuuaaaugcuuaaguacauugugaagucuuaagaaacaacuaugaauuauccuuuaaauuuuugagaccauguaacuucucugauaacuuuaaaacacuuauaaaauguauaaaauuuacucuuuauuguucuaaaguauaugagccagugguauuguaaauauuaauauguuugagcauuugucaucagaacuguuugcauuuugcccuacugaaacuuuguaugcauuaaauagugaccuguuucuuccacuguggcuggcaauuaaauucuacuuuuugucuguggguuuggugcuucuaacuaucucaaguaaguguagucacacaguuuuuguuuuguuuugaugacuggcuuauuuuauauaacacaguguucuugaaguuuauguguagcauauacuagaacuuccuccuuuuuuuuuuuuuuuuuuggcugaauaacacuugcuugcuuguauaugcuauauucugcucauuuguuaauggguuaauucugugcuuuagcaauugugaauaauguugugauuagcaugggucuaaucuuuugucaaauucuuuugguccuauagaauaucaugguaauuguauuuuuaauauuuugagaauauaucaugcuguuuuaaacaauagcuauaccauuuuacuuacauuucuuagaauaaaaguuuuauacauuuuuuuuuuacaacuugacccguauauuaaaauuucuuuggggaacaauagucauccuaauggaugugagguuauauuuuauuguaguuuaguagccaaauaacuuuuguuguuguuguuguuguuuaaaagaaaacucguuuauuuuguauaccuagauagcugcagguauaguagaaacuaaagaacugccuuccccauguaccuuuuuucccccuccccaucgagauaggguuucucuguuuaacccuggcuguccugaaacuggcucuguagaccaauuuggccucaaacucagagacuggccugccccugccuccuaagcgcugagauuaaagugugugccaccacaucuuugcuccccauguacuuuuuuuuucuuuuucuuuuccuuuuucuuuuucuuuuucuuuuucuuuugaaaaagguuuaaugauguuuuguggaacacuauaguuauaauugaguugagauugaguguacugaaaacuuaccaagauaugaaggguuuuaaaaaaacagaccaaauguugaaaguuucaugcacugaauggccugcuuaguuuagaaaccucauagugcuugcaguuagacuguaccaguagucucuaauagauaauauuuuagauugaauauuagcagaauagauaggacaaaccauuaguaguguuucauguauaacacuuuuagcauuagagcauuuuaaguuugcaugcuauuauugauggccagaguugagaauguugugucaucagaagauggaaaaaucaggaauuaagucuuuugucacauaaagcccagaaccuaaugauaucacugaugaaauucacuaaaccuugaagaacuaauacuauaaguuaagucauuacucucauaugaaaacaaaagucuaguacuauaggcuaguaacaaaaguucuucagaaaggaauaaccaacugaauuaaacaauacauaauuauuauucauuauaauuaaguggaauuuauuuuagcccaguauggugguguugcaugccuuuaaucuuuaaucccuugggaggcagagacagucaggaggaaguucuaggacacccaaagcuacaucaagaaacacugucuugaaauccccaaaagaaacaacaucagcuaaaaucaaaacccaagucugccuaacuacaggggccauauugccuuacucucugacucaagcauucuugaggcugcaagguggcucagcuauuaggagcacugaccacucuugcagaauaaaaaaaccaguauguuaaauaggacaaaguuguguccuuaguuaauauccucuuuuaaguaucaccuaauauauuaaaacaggaaaagcuuuuuaauuaguguuuguaaauuuuguuuuaaaaacauaacuacaaaaaauagacuaaugggguuauacaaaacaauagcuuucuacacaagaaaagauauaguuaacagauaaccccccuauggaaugaaugaaagcauucacaugcugaauaguuacuuuaugaaauguguaauucagacagcucauggaagaaguggauaggggaccuaaauaggugcuucugaacaaguaguuccgguaggaagauagcucaguagguaaaaugcuugccuaagaagcauaaggaccugauuugauaacuuucauaacaacauaaaaaugcagugugugguaguguacacauaaaauuccggugcuggggaggaagauccaggaggauccauggggcuaaucugauugguaagcucuaugcuggugaaagaauguggaacuggacuacaguccagaggaugacaaguaaggugguauagaccagacaggggaaaaaaggaguacaaauggcaaagugguuaaaugaguuuuuaaaaauuauuuugauauuauaauauuuuuucuuuuccucuauucuuugcagaaucucaaauauuucaauucuugcucuuuuucuguguugaggaaaaaccuauuuauuuauuuuuguuuuuugagacaaguuuuucucuguguagccugaguguccuggaacuugcucuguagacaaggcugacuucaaacucagauauucuccuguuucugcuuucugagugugagauuaaagguguuguaccaccaugaccagcaucaaauucaugagaaaaaaaauucuuuaccuuucuaaucaucuaagaaaugaaacaacagugagauacuacuuccuaccugcuagaauauaugaauguucauguuggugagguuguaagcaaacagaaaucuuguacacaguuguuuggaauguaaauuagaucgauuauggaaaauaacagguuccuaaaaauugcaaugaccuagcaauuguauuauagaaauauauaguguguuauaagagauaccugcaguuuaauuuugauugcagcauuaauuaaacaaaaugcagaaauaaaccaguguuugucaguggcuaaacaaauaaaaauugacauauaugaugauguaauuuuucgccauuaaaauuuuuuucugaaaucuuaugucggugacaacauggauggaaaugauccuuuauauuuucaaugaaauaaaucagcacaaaaacagguagugcaucaucuuccuguacauagacuguaaaaacauucuaaaaauuguuuguuacuuagaguagaauaaaugauagacauaaaaaaugcaaaaugaauagaauguaguucaggaccaaaauuguagagcauggugacuucuuucuguauauuuucuugaauaucacuaaaagucaacuauuaaguauaugugcaaaagugcuauguuagaauuuauaaacucauuugauguaucacuuuugcauaugauaauauauguaguucuuauuugucaaugaaaauaaaaacuuuggaaaaacagccgugucuucauauauuaaaauuauuauugcaugagugaguguuuuuaacagacgaauaacauuuuaauaauccuacauaugguguuuauuaugcuuaagauaaaggaguuaugguuggaaauaaagagauuguaaaguucucuuauuaagaaauacaaauaauuuuggagacucuuaauacugggauauaacaugcacauugacauugauguccuuuagcccaugaguuuaauagaagaagaaagaaaaccagaagauaucuagguggauuauaugaaaauuucauauuaugaauuugugcauauagaaguauuaagaauuuugauauuuggcuggguauguuugcuugcuccacuucuguacucccgguacuugggagcuuauucagggacagcuucgccuauacaguaaggcaagucaaaguuacaugagaucauggcuuuaaacaaacaaacaaacaaacaaacaaacacaaaaagcagcuaaaagcagggccuaaagaguuggcucaguguccugcuuuccaacuauguggacuagaauuucagaaccuauguaaaaagugaggcaaggccuuucaucccagccuugguggaggggcagaaauggaauggugguugaaauguguucauucagucuagauaauucagcaagugucagguuuagggagagaccacgucuuaaaaaauugugugaggagcauuagaaaauuaugaccgccuuugcuuucuggucuccaaaugcacaugcaugggcaugcaugccuccauguuugugugcacaacacauguauacaccaccccccaaaaaagccagaaaucaauucauccaaaauagaacuguuauuuguaugcuaucaaucccuugaaaucugauagacauuugcaucuuauuuaguaggacuuuauuuuaaaccaaauucuagaaagcauccuuaguuucucuuugugucacauauuggaacuguuugcaaguuauguugcauuuaucuucagaauacauuucagcuucuuuaaaaagcauuuguaguaccauugccaucuuuugauaagggacaucauuguuucucaguacuuuuguuccuaccucuauuuacuaccaacaauucaaugggcuuuucugauuaaaaaaaaguuaagccaucuuuucuauacucaacuuuucaaagguuuccuauuucuuaaacuaugguuagaaauugauacagcccugaacuggcucuuucauuuaugugacauccuguacuagcauuauguucuuaaccugcaacuuuugagguuuuaguucuggaacuuacugacuguucccucuugaguuaaucuacguguuuuucuuuuuuacuuguuucagaauucuuagauaaugccugucauagguaucuuuucugaguaucucuaucaaaauaugauugugucccaucuucucaauucuuacuauuuuccuuucugagauuuaguaucacuucauuucuuuuaaggucucaguagaaugggaaccuaauguucuguuuauauuuaacagucuaacaaaaagaaacuuaggggaguaaaggguuuauuucagcuuacauguuauaggccaucguucaaaguagucagggcaggaacuuuauacuguugcugacucaauuuucagaccuaagcauugcuaacaccacuuacuuacaguccaaaaccaccugccuagggaaugcuauuauccacaguacacuggucccucuuacaucaaucaagaccuuccccuuucccccagucacacccaugggccaguuuaaucuagguagucccucaauugagagucccuuaggucacacuacacauuagacuaucaaauucacaacuaaagcuaccuugaauacguagcaaaauauauaaggaauaguuaguuaaugaguuaaugcuugcuuacuaaguguuagugaaaaaucauuaaauguaugaaaaauauuuagugucucagaaauauauugugguagcaguuuauuucuaaauaacuauuacauauucucagccugugauuaugagggauaauacauaacaucuuaagaauaugccauuugacaaaucacuuugccuuguugauccuugaauguuuuuucagaauuuuuuaugagagcugaacauuuuuaucagggugacuucugguuauaagaucggaugcuuuuaaguuucugugugaaacugaacucuaauuauaggugguucuauuuucaaaaauuuuucuggguuuuuugagcauacucuuggucagauugaaccuuugaagguucuuuaaccuaagauuagccuucuaauauggagaagaaaucugagaaguuuuucaucaaagucaaauaacuagaggaauaccaacuaaaaaaaguaagcaauaacaaaagagaaauuagagauuauugagucuguaauuugguauuuuggaagauacaaggauuaguuauugggucaugcuuucacuauauauaguuaguguggaauaguggagucagugauugcuauuggaccacagaaaugauauggaaacuuugggaaugaacugugauauaacuaaggaccauugguugguuauaaguugaauaucuccugauuacuuuucucgucagauaguuugcauagcauugucaaguuguacagauccuaguuaguagagaucaagcuucaaggugaguuuuugcuuaauuuuuccauuucuuuacugaaguguguuauaucuucaguaguagugucuuacugucaaguucuggagaguaaccaaaaacuauggaaauaaauagccagcauuggaagagagugaucacugggaugucacuggucaacaauucaagagguugaaguuuaauuuuuuuuuuuuuuuacaaaauucuuuuuuccuuuaaaaaaauuugaaaauuucaucuagucucuaaaugaauauaaucacuuccucaacuccuccucuuacagcccucucaacccuuccauuauuuuaagauuauacuuuuucaaacuuuuuuuccuuuauucuccauugagucuaguuuugcauugucaggcuagucuuggaauugggaccugcuguaguguguagucagauuaccagggguucauaagacacuugugguaggaugacaucucuacccccacccccccaugcugggguuuuggcuggcuguagcuuggguguauuaucguaaugacuugucauaaguucauauaugcaucuagucucuugcucuuggaaaagacuguuuccuugaaguuauuuaccaccugugagugaccaucuuuccagcucuuuggggugagauaaaugucugauuugggauugagcacuuaacacuuucuuuuucuugccaugcuuaccaguuuuggaauaggaucaucucuguuacuugccauauguuacggagcaaagcuucucuagugaaagcuaaaauaaugggcuuuucucgggauauagcaauaaucauuaggagucauuuuaauauuaugugcauuuagcagaguaaugguauggguucuacccuagggccuauuaccuuaucuauucacaaguucuuggcuccuuuaauaguauggccuccacuuuauagaguagaccuuuaaugcaaucauauaguggcuaguuacuccuaaaacaccuaugcaauuauuaguaauccuaucuugucaggccacuuuuagccuucaggguucauaacuggaugagauugaggccuuuauucucaagagaguuuauauagcacuugccagcacaguggauuauagccaguugugauaaaguuuuccagugaguaccagcauaaugucuccaugcucugugauucaaggaugugguuggugucuauagcaaucugaucuuaccaucaagaaguuuucacuucgauuucauuacuugaagugucuguuuuuaugucagcaccaugcuguuuuuauuacuaaagcuuuguaguauaacuuaaaaucauagaugaugauacugauagcacuucuuuuacuauucaggauuguuuuucugucauguguauuaugaaauaaauuuuaguguuucuuuuuaugaaaaaucaagcuaugauuuugauggggauuauauugagucuguaaauuguuuuagguagaaugacuauuuuuacaacauucugagcaugggugguuuuuuuucaccuucugguugcuuuuucaacauauuuucuuuaauuuuuuaaaauuuaauuauacaacucuuguacuuccuuaguuugauuuauucaaauaauuuuugagguuauugugacugggaugguuucccuaauuucuuugucuuuuuguuuauuauuuguacaaagaaagacuacugaguuuugugucuucauuuuguauuguuacuuugcugaguguuuaucaacuguaggaguuuucugguagauucuuacaguuugcuacuuacaggauuuuuuuuuaauagaaccauuuuauuguaaauaaagauaauuugacuucuuuccugacuggugauuucuuuaguuccuucacuuacaguauuucucucaucagcacuucaagcauuauauuaaccugaaauaacaagcacaggcccagaaugugcuuguuuuguuccuaauuuuaguaaggaugcucugaggguuuuuuuuuuuuuuucauuuguuauuuaacauguuugccaggaauuucuucuguuuuuccuuuauuauguugagauauccucuguguccuaagguucucaggauuguguuacuugauucaccuacauguuucugcaguucucauucagccauuuguuuauauugucuuugaguuccuuuaacagggauuugcuguuugaagauauuuucuugugcaucauuuaugaugcuuuucucagagaugaauaaacuguggguguuaguuucuagaggagauaauugucucuguguagcccugacucuccuugaacuagcucuguagaccaggaaggcuuugagcucacagagaucaccuguucaguaauguguuauuuaguucccaugguuucuguaauaucuuuugcuguuaauaucuaauuuuauuccauuguauucuauacaaagaaguaugguauuacaguauucauauauuaugacuuuuucagugucuugauagguaguugauuuuuguagaaaauuccauagacugagaagaauguauuaguauauggguggaauguuguacaaauaucuauuacauucauuugacuuaacuccagaguuucuguuuuaauuuuuguccagaugaucugucugcuggagagaguuggguagcgaagucacccacuaucagucacuguugagacugacacgugguuuuagaucuaauagcauuccuccuaugaaauugugcgccucuguguugcuuaugugucuaaaauuguaacauccaccugguagauuuuuccucuaauuuucuuuauuuuguaucuuuggagaagggauuaauuaagaccauuuacaaucagaguucuugaaagauguguguuuuuucuguuuaucauggaaaauuucuauuugucuuugaauuuuuguguaaaguuuuacaaguguaaugcuuuguguuaccaguugugaucuuucaggauccaggcuagcuguuuucagccugagagucauaacugccacagggguugcguaucagauaucccgcauaucagauauuuacauuaugauugauuauaguagcaauaguuacgaaguaccaaugaaauaaucuuuugguugggagucaucacaacaugaggaacuguauuaaagggucacagcacuaggaagguuaaggaucacugauccagacacuucaugcuuuaaagacuuuuguugaauagauauuaauuuugaugagccugcuuuaugagugaugucacuuuuuucuuguauccuuuaguauccuuuagucuguguuuuauuuauuuauuuuuuaacuauaauauguugggaagaauuuauuuacuggccuuuuguauuguguuuuucuaggcuuuuguccacacaucucuacuugcaaauguucauugcaaugaguuauuggucuauuuugaggccucuagguucugccguauuggauccucaaccaggacuccuggauauccuguuguuacccugugucauggagauccugcaguuuuggaugugcagaacuggcaacuucauaaguuccagcagaucauaauuggaguagauguugggguaggcccugggucugugcuugggagguaguugaguuauuuuucucagccgaggucaacucucaagcacuauccugcuuaacuuacccaaugaagcaggaucagcccuugugcucucaauguccuugcauccagcuuaccugcaacaucaccauagccagcuuuucugagcuguuauagucaauuugcaggaccugugcuccugagugauucaaucaguaagggaaagggccaguucuaccugcuguagguagugagagggggguagaagaaggcaucucucccuaccccaugccgucccaccucagauguggggcuaaagcagaucuccaguacauaugcccuuggguuggauuguucuauuuuuaucacagaagaguuuuacaauguugaggaagagggcuaauuuagugcaggauuggaauaucaguuuauuuggcacgugccuuuuuguucuuagacauucuagauacuaauucuguuagauguauaguuuucugcauuaaagauuuucuuccauuauuuugguugucucuucacuacugauuugccuuuuaacuguugcagucucauuugucaguuuuugcuauauucauuucucucucucucucucucucucucucucucucucucucucucucucucucucucucucucugugugugucugucucugucacucugucucucuggguuucuugggaucuuuguaggguuauauagaaaagcccugguuaugucuuucuuuuugcuacaaguguuuaucagaguccuuaaguaaagaaugcuuuuguguacuuacagagauaauuuguucuuuucuuucccauuuguuuuguucugguuuuucuuguuuucucuaugacuucagagugcuacauugaauaauauuauagaaacugaacacccuugucacaugucugauauuagagaaaaaugacuucaguauuuuuuuuuauuuaacauaacaauagucucagguuauuuuauagccuuuuaguauguuugagguguguucuuuucuaagugcucuuaccugguuuggaacucucaaaauaauauuuuuguagaauggcuuuaguaguuuucauucccuguuugguagaacacuuugagguuuuuugccguuuguucuucuauaaagaacugguaauuuuagcaaugaaucuauucuuugcuuuucuuuauugguaggauguacugcuucaguuuuguugcuuucuguaucuuuaguuuuuuuuaauuuccuuuuaauauaauuuuuauagaucauaccuguugaggaauuuauaacuuucuucuagauacuucauucuuuuuaaauguugcuuuucauauuaauuacuaaagaccucauguguuuucaguacuacauuuuauuuuguccucaucuuaaccuugaauuuuauuaauuuggucuugccuuucuuugguuauuugggcuaaggaauuguuauucucuucaaagaaagaacucuguguuuuagaguucaguacauuaauuucuauacuggucuuuauucuuuuuuuuuuccagguauuaguuuguaguuuggguuguucuuauuuuucugagauugugaugugcauuguuaaguuuuuauuugaauucugaccgaauuuucuaaaggaaggagugaaacuucacuguuagagaugccuuucuguaucauaauauauuuuccuuucuugauuuuuuuuuuaacaugacaaaauaaaauacaauaagaugaagcaaaaacuaucaugguagucugccuugguaaacaagaggaaaagagucacaagagcaggcauaagagucagaagccuaauucguucucacaccagggaguaccauacaauacuaaaccuauagcuauuuuacauguguguuugugugcacaugcgugugugccuauguguguguguauuauauguauauacauauuuguaguauaaauauacuacauauauauguaauacacguaauauauguaauacauguaguacauguauguauguauaugcauacauauacaugcauacauacauacauauauaauacacacagacacuuacaaauacauacagacauacauacagacauacauaccugguacagacccacugcuucaguuuaugacauuuccuaugagacuuucguaguugauuuagagggucuuguucugguaucguccauccccucuggcucuuaaaguuuuuccaccuucucuuccaagggcuucccugcucucugcuguaaaguauuugauugagagcucccauuuaaauauucuguccauguaaugucugacuguggucucuccaucucugcaccuguuuccaucugcugccagagaaaaccucuuuugacaguaacuagauuaggcacugauacaauguguauaccauaaucauuuuauugacuuuaaaauuuuuuaagauuuaaaaaaaaaauuuaaaacguaaguaguguuuuuguuuuacccuagguuucugguucuuaguuauccaagcagucuggauauaggcuucuucucauggagugggccuuaagucaaaucagacauugguuggcuacucccacuaguucuuugccccuacugccuuagcauauuuuacaggaaggacagauuguaggucaaagguuuuguggcuggguuggugugcguauaucucuuuugguagcuuguagaguaccuuccuacaccaaagaaguagaguguaggggugaagaguccaugcaggcagcagcuuggcuucuccguguucauuggguaguguggauauuguccuuagcaguagggcucuacuguuaguuuucagguagcaaccuguuguuuugacaacagcuuaggcuguuuggggauuauucuuucuuucuuucuuucuuucuuucuuucuuucuuucuuucuuucuuucuuucuuucuuucuuucuugucgucuucuucuucuucuucuucuucuucuucuucuucuucuucuucuucuucuucuucuucuucuucuucuucuccuccuccuccuccuccuccuccuccuccuccuccuccuccuccuccuccuccuccucuucucuuuucucccucuuccuccuccuccuccuccuucuucuaagauuuauuuauuucauauaaguggguacacuguugcugucuucagacacaccagaagagggcauuggauccuauuacagaugguugugagccaccauaugguugcuggggauugagcuuaggaccucuggaagagcagucaguggucuuaacugcugagccaucuuuccagcccuguuugggaauuucuaugggacccucuucacuuaacugaagugcaacucacuuugguugucuggagacaagagauggccacuuaagauucuauaucuuccauuacuagaccauuuuauuagggucacuuucauacauucaaggacauuuccaaugcacuagguuucuacaccaacauggaaauucuuuccuccccaauuccagcuguuucuaccacacuuucccucaaccccaucucucccuccaccugcucaccuccccacaccugcuuacucucccuaucuacucccaguuggcuguauaaucuauuucacucuucuagggagauccuuguaucccuacuggauccccccucuuuaccuaaccucucuggcucuauagauuguaccuugguuauuauuuacuuaacugcuaauauccuuuuuuuuuauaagugaauacauaccauauuuaucugucugagucugaguuacuucacugaggaugauuuugcuguuuccuaguguguuuucuuuucauuugacuuauuccuuuaaaacacuucuguucugauuccuucaguuacucuuaugauacuuaagauuguauuauauugucuucagguauuuguagcauaccuaguuuuuuuuuugcauuuuaauuuuauucucuuauuauuuguuaaguacaagaaaguaauuuuuacuauuguugacuugccuaauguucaaaaaugugguuuaucucuuagagaguuccaugggcugccaagguuuauucugcagaaggugagauguuuuuuagaugucuugaaauaaguccauuugauguuugguacaguuuagauaaaaucaaucuuccuuccuuccuuccuuccuuccuuccuuccuuccuucuuuccaucagauaaguuauuaauuuggaaaguuaagauuauuacuguauuuuacuguauuuugacuuguuacuuucuauauggauauuguacuuucuggugagagguuggauuuuuuuuuaagauuuauuuauuuauuauauguaaguacacugcagcugucuucagacagaccagaagagggcgucagaucuuguuacagaugguugugagccaccaugugguugcugggauuugaacucgggaccuucggaagagcagucgggugcucuuacccacugagccaucucaccagcccgagagguuggauuuuacaguagucugguagugcuuguuuuuaugaacuuggguacaccaucauuuaaugcauauauacuuauaauuaauuguacaucccucauugguuguuuucuuuuuuuaaauauuuuuuaaaauauuuuuuuagguauuuuccucaauuacauuuuuaauauauuuuuaaagagauuuauuuauuauuauauguaaguacacuguagcugucaucagacacaccagaagagagugucagaucucauuacagaugguugugagccacccugugguugcuggaauuugaacucgggaccuuuggaagagcaguaggugcuuuuaaccgcugagcuaucucuccagcccaguuguuuucuuuuauaguauacagucauauacuuaugucaguaguccaguucuuuuuugauuuccacucacuuuucagucuccuuuuuuuuuuccuuuagcuucuguucaagugaaauacauuucuuauagacaacaaauaauuugauccugcuuuuaauucauuuggcuaaucugucucauaaauggaacgcuaaaaacauuuauauuuuguuguuucuuucauuguucuguuuuucuuucauuaacuuauguagacacaguugcuucuuucuuaauuuuucauauauagaauuacaaaauucauuuuccuugagcuccucuguuuguaucauucugcuauguguaaguuuccuuuaaguguauacuguaguuuaguggucacaaguggccuuauguuaugccuaccuuggaaaguuuuuauauuacauuuaaaagauaacuuuggauauaguaaucauugaaaagauuuuugucuuuaaaaauuucuagugagagguuggauguuacagugaauuuaccuuuguuaguauguugauacuuuuauuuucuuuguaguguuaggauuugagcuacacugugcucaggagcaauucuuucuguccaugauuuauuuggguuuuacacaucuuucuguauagauguucauuucuuucucgauauuuuagaaaauuucugcuguuauuucauugacuuagucucagugcuuuuaaguuccuucugcuccauguauucuuuaguuucauuuugaucauguucuaaaagguuugguuguguuuacuuauuguguuguugugugucugaauacagauuuuucuucaauuccugcuguucugucuuguacuugauuuggucuauuauuuaugguuuccacugagauuuuuaauuauuuuauuuauuuccaucauccucccucccagcaccagucucaauuucuuugcuaaacuucucauugacauguacuucagaauucuuugaacagcauuucaaacaguuggccaucuuuuuauugguuauuaaaugcugaucuucugaaauaacuuuguuccauuuauaauguuuuguuuguuuuuguguucuaauuuguacacuugucaguauggauauguuuuccaguuuuauuuguaauuagccuucuguugaguuuucaauccuuaacacuacucaaaggaggaaagaaaccuccaacacauacaauaaaaccaaacaauuuucagauauagacuuugaauugauugaugccagcauuuauagcaccauugauaauuaaaaauauguuuagaauaauguaaguagucaaaacuuguuuagggucaaauuagaaauagcagcuuaaggaaaaaaaaaaggggaaaggggcaggaaaagaaaagggaagcaaguuuaaaugaaaagaaguagaauacuaagaauaaugggaauggaacaaauggucaauaaguaaagaaagcaaacaaaauagaaagcaaacaaauaaauagaauaguaaguaaauaauagucuuacaaaaaauaaagucuaaaacaauaacaaguaaaaggaaguguauuggaguaauuuauucugcauccccuaauauuccaguccuguuauugaggcuggugcugauuuggaaccagucaaagcucagaugucauagaaaacuaucuucgguuugagauugucaguguuuuugaauaccagugucuuugcuagcugaacuuugcuguacaggaccuagggauuuuuacauuuauuuuuuaaauuuucaccuauuuauuuauguauucauucauucacucauucauuauuuccuucagggacuuuccagcuuuucugucuuaguuggcuacuuucaagccacagggugucucccaaguaugcuuuaaaugagggaagucaaaaaagcacuguuuguucuagagaacuggucucuauacuuuuagauccugccugucgucaccacauugcaagggguaucagacagcuggaaucaauuucuccacuggaccuuaccuucagaguugucaaguacuguaggcagcaacccucaugacagacagagccaauuuuguaggcuugacacuuuauccuccacauuguaggguuugauccuugccacagaagggcugguuaauugacacagugcccuucaagccuugucuacuuugcuugaguuucucagucaaucaagucucuacuccauaucuaccugacucagcuuucuucccacccauagacuauggcaagacuucaccccuuuuccuuauuuguaauuguuucauguuuuucaacccccaagauuguuuguuuucaaacaaauguagaucccuuuucaugacaccugacuaguucuccagaauacaguuauaaacuggauuuuucccuuuccagugcugacuuagaauaagucagugucaugacgaaaccuccaauuaauucuuugugaguacucuugcuuguucugugaucaagacuauugcauuguuuuagucagucccaucuguuuuaccuuauggaugagauaucccuuaucaccaccacuuggcuggagccacuugcugcuuuuccuuuuugcuacauaguauuuuucucuguuucucaguuguaguaucucuuuugugauuuccaauauucuucaucucucuuagaauuugaauuuauccuuugauacucuggaaguuuucauucacuuuaucacauuagcaccuuguagucuugcaucuuauuccaaauguuccuguaucuuuuaucuuuuucuuaucugauagcuaugccuagauauuguacuucauccauuagaggugguaagaguaaauauuucuccuccuccauuucuucuuccucuuccuccuccuuuuuauguuuaucugugguuugcugggauauaucucugugcaccacauguagcauggucggugcccauggagaccagaugaguguguaacuccuccaggugucacagcugacugcaccaguuuguugguguggagaaucaaaucuggauuccuuggaagaggaggaaucagugcucuuaacuacugagauaucucuaucacugggagugguuauucauguucucaaaugagucugucugaaagccuuuuggcuucacaagauuucuuuuaaguaaugggauuuuagcaaggacauguguucuuuuucaaauguguuuugugcauugguuuugacuguauuuagauuuaauauguguauauguauauguguguguauauauauauauauauauauauauuuauauauauauauauaugcauauaugcauaugcaugcuauaugugugugggugccuguggcauuuaaugcucuuaagcuggaggaacaggcaguuuugugagccaccugacaucaugcuaggaacugaacucuguuccucugaaaaagcagcuagugcuuuugacuagugagccaucacucuagucuccuaucagguaucugcuguuuguauggcagugguacuaacucuuuccaaacuaauacaggacagauuuccauuuucaaaauucuuacuuaggaaauauacaaguucuaaaacuagcauucacuacaaucagccaauauucaccuucuguuuacagaaagaagagucaaccuaugguuuuaggaaaagaucuuuguuuaaaaaauaauauucuuugaaaguuuuauauauuuauacaauauauauugguggugugccucuacuacacuauguuuccagcuccacuagucaauuucuaaauuuguaaauguuuacuuacuuucuucuaaccaugaaacugggcaggugaaaaacaaacaaacaaacaaaaaaaaaaccccaaaaacagugguuuauucauuuuaaaagauaaauaauucuaugugaaaauuuaauuccacaguucuauuuuuacaacuaguacuuuguuguaaagaugaauaaaagcauuuuuaguauccauccauccacccaucuaucugucuuuaagaaauuuuccuuauuuuauauauaauugacuuucaaaugguuccugauacuaauugggucauauuuguacuuucagucuuguaauacaugauuugaugacacuucaauagacccuaccuuauacugguuuuaacuguauuaugaauaucucugguguuugugagaucacauuuuuuacucuugacaaguuucuacauuaaaaauaacuuggggcaaguugugaaauuugguuuacugauuccuccacauaaaguucauaauaaacucaagaucuuccugccuuagucuaguauaugcuacuauuauaagcauaagccaccauuucuuggaggaguagugauuuuuauaaagguacauccuuuauaaaaccccuuacaaaauaaugagacauuuaccuaugaaagacacuaagcagugcuuacuagauuaugcauggguuaauugagucuugggcuguauauguuucuuaccucuuuuguccaaucuuuguuuuuauucugcuuauuuuuuuaaaaaagauacuuugaauaagucauauuguuaguuaucucuuucauguuucuguuucuuguuuucauggcagcuauuucacuguuuuugauucucaugcugaacuaugugggaauucuuuauucuucuaguguauaaucuccuugaugcuaucuauauauaguuaugaauaucuuauaacuuuaucauuuuuauuaugauuuacuuacuauuccuaaguauucaacuaucccgaaauuaacuuaggacccagcaaauaauguuauuagugcuacugagaacacugaaaauuauuucucuuuauugucauuuguggaaaacaucaauuaguuauuaauuaauucuuucauauaguuuauccugucugcauuuucuucucccugcacuccucucaguucuuuccuccucccuucccucaugcuucagauccacuacccucuucuuucccgucauuaaagagcaggcuucccaugaauaucaaccaaaccuggcauaacaacaaguuucaauaagauuaggcacacacauaaccuucccauugaggguggacaaggcaagccauugggaggauaaaguucucaaaagcaggcaggagagucggagacaucccuuacuuucacugcuaauugucacacaaggacaucaagcuauacaaaacuauaacauaugcagaagacccaggucagacuccccaauuguugcuucagucucuguuaaccccuuaugagcccugcugaguugauucugugggcuauguuuuugugguguccuuuggcucccuuccccucuucagcaggacucuucaaggguuuggcugugggucccugcaucugcuucuaucaguuuccguagaauccguuuuaauggcuucuuagaaaguaauaaagaaguggaaacuauuauuuaaagaggaacacuuuuacugguaggauucacuugauucuuauaaacuaaauaaaaaaggcauauuuuuauuuaaggacucacuauauuguacuuugauuuccacgaagucaguggaauaugaauaggcaaaaguaacugcuaccuccuuuuuguagaguuuugguuaugaauaucaggaaacggauucacuucauuuccugaacuuuacuuugguuuuucuuuuauguuccuuccuacuuccccacucccuuuuuguuaaaguacuaaguaggaagaaagaaccuuacucuauucaucuucugaggacaaagagagaaaguaaggaggccagaugauugguugaaaguuucacuggcaugcacagggaauucauuuuaaggugacaaagcauuuuacuuuuggcuagauacauuaugauagagaacauacaggaaauauacaaguacuugaaauuuaccauguuacauuagaaauuauggacauagacauuuaaguuuuaugcaauuuucacacaugaaacaaaauauaauuuuuuaaugauuuaagacuauaaaauauucuaaacuucaacuguaaaaaaaguagauuugacacaugagguaugauuuagugaccaguccuauguauggauuagcauuggaagguuaucaaaagcuauuauuaguauguauguuuccaacuuuagaggccuuuuacauguccuuaaugaauuuauaugcccugcauuuggcauucaaugguaucauuuauaaugagaaaagaauagcuuauuauuguuaauuaaucauauucaaucauauuaaccaauuuaauuaacuuaauauuaauaaacgcacauuaaucaaauuagucaacuuaauaugguugauuaugaccucuguuuauuuaauuuaauauaauuauuaguauuagugggcuacuacuuguaacuuggugcaaaaaagcuggucaguuucaaacauuuucucugcugucuccccuuuaguaaugcuaaaauuucaaauuuuggaauuaagccuagauuuuaauuuuucagauuuagugcaauggaguucucuugaccaagucauauacucaugcaaaugauagaaauuauagcaauugcaauagcaucugauacuuaccauuagggccuagcauguagcagguaauacauacuauuccauuaauugaggauuucauauaugauacaaugcauuuugcucaucuucaccuccuauuuuuuuccuaccucuuccaaaauuuacugaaauagucuaaacacuuguaauucuuaaaucauuugaauucugaaauauacuggcauccuaaggaugaggaagcugagacacagaaagagacuaaauaaguaguuaacucagauacagaaacuguucaugaacccaaacaaucuggccucaaaauugugaauuucuaccuguuacagacugagucuucuuauaaagugcuuagcauauccauuuucaauaaauuaccgauaucuuaaguauagugauauaauuuauucaggaguuucuauacuguacccagauaguacacaugguuguuaaguuuagauuggaauuuuuuggaagauuuuguuuucuaauuauauauuacuuaggucuuuuuuucccccuuaaaacuuuuuaggacugcugguauuaagaauuaauucuucugaaauuauaaucuguaaaacagugauuggaaauaaauugaauucugaagcugaaaauuguccugacuucuuuaauggacauagcauaagaucaauuauaagauuugaucuuuucaggucuuucucuuuuacuagcuguagacagaagauaaucuucaaguucaaguuucauaugauaaucagaguaccugacaauguacugaguuuauuauuuggcauguagagagugcuagcuagacaaauuauaaggacauaaggugguaaaaugaggccuagaaaauuaguucauucaacuaauuacauugagcugacuuuuggauggucucauuucucccuucaguauugagaguucuuuaucacauaaagaaguaguguguguauguguguguguguguguauggguugggggggcggccuaguacucuuagaaaacuaguguuuugaacuuugaaauuaacgcuuaaaaauccuggauauaaacauaaacauuggcucuauuuaaaucacguagaugaaguuuuaaaacuuccguacugauacuuagaaauuuuuaguguuuagguacauacuuacagaaaaaacguagcuaggaagaauuaacucagucaauuauuuagaaaaauaguuaauauuucgaaacauucauccuacauuuauaacuugaucacuagcuuuuguuaaggaaguaacaaaauuaaaguaguugguaauuauuuuauuuggugcaugcugucaguauauugaagcgguuugcuguuguuaagcaugcugaguuuccauaaauaauagggaaauaagucuuccuuuugaugaauuuuucucauaagugguaucucuaacuucgugauacauuuuaaacuucaucacauuuauuuauuuucuguagauacaugugacugggcauauguuuugguguguuuagaguucagaggacaacuugugguaauuaguucucuccuuucaccaaguuggauacagggaucaaacuugagucaucaggcuuggccuuuguacacuaugcaugguaaauauacagggaauauuucuaaauauaaguaucugaaugaguuaggaucguaugacauaccauucuuugucauacaaagaaugacauaguccuaaagucacuuaucagugccauauuuguuuaucucuagugccauuagucacuuaguucuaucuaaaauaaugacaugaaguuuuagaaugaaauuagauagauucuuucuacuugcaguucccaugcuuguauagaaccaaacggauuccuuagaaugacauuauuaugggccagauauacauuucaacuuaaauuuugugguaaucuccaagaauagaauuuuagagucaaauuauagaauuuagguuauguagaacaacuucuuguuugguaaaauaauucauuccuuuaauuguauugguuacuuugcaugaaaaauauguuaaucaaauguuaauuuuaauguuuaaaguugaugaaguaagaugaauaugaguuuccccugauggaaguuuaaaccuuuaucuuuccuaugacaaggauuuaaugaagauagugacaaguaugggcucaagguuguaugccuuggugcuucucucucgguauaauaugaaauuagauaguuuauuuauaaagcacuuuuaaauaucucaugauuacuuacugaguaaaaaauuuuaaucucuagaaguuugauauuaacuggaaaucaaguauuugaaacuguuaaaaugaauuagugauuuuauauuagugaaaagggaaacugccauggagauguagcagugaaguuuguuuuuguuguuuucugcuaaauaguuaaggguccuauaccaucaacuuaagcuuaucuuuuuuuaaaccaaagaaaagccugccauauuaaaauuaucuuauaagcugacauaguuuaucacaguuuuuuuagaaaauguuuauuauuuuacuaacacuuugggagguaguagugaauuuccaguuucuacaucuaaauauuuaguuuauugcuuuauugcuuagcuaacuuuugccuuaucuguugggcuuuguuucugagcuauacuaauaaaugugcuuauuguuugaaugucugguacaggaagcgagcagcugcaaagcaucuaauagaacgcuacuaccaucaguuaacugagggcuguggaaaugaggccugcacgaaugaguuuugugcuuccuguccaacuuuucuucguauggauaacaaugcagcagcuauuaaagcccuugagcuuuauaaaauuaaugcaaaacucugugauccucaucccuccaagaaaggagcaagcucagcuuaccuugagaacucaaaaggugcaucuaacaacucagagauaaaaaugaacaagaaggaaggaaaagauuuuaaagguaagagauuauauuucaauucaaaaugguuaauugaaagcuauaucagauuuaaauguggaggggguuguuuauuuguuuugauuuuguuuuuuuguuuguuguuguuauuuuguuuuuauuuuuguuuuugcuuuuuuuaucaccuuaaguuaucgcacuauaauauaguaaaagucaccuuuucugguaaacugugguaaaggacugguauuuaguuuguuuacauuuuauucuuauauuuuacugauucauuaguugucagucagaagcaaguuauacucuaaaaauuaauaugaugaugaguugaacucaguuuguaaugauuuauauuguagcuaauaccuuauuaggucacaaaaaucuacuauguacauugcauuugccgugaauaccuaguaucggcucuagaacuccagggacugugguaaaaggagaaauacaaauauaaaguguaaaguagucuuuuuuuuuuuuucuuuucuuuuuuuaagaaagcaggguaaaauuuugcaauaguuaucugaaaauuacauuuuuuccuucuuacauucugcccucucuacgucaggaauuagauauuuucauacugcuuagggacguaacuuaccaguaauagucuuuacucagcucuugugggguuucguuucauuuuguuuugugcaaguuaaguggcacuauucuuguacuuuuaauacucacacuucuauuuccccaguaaugaaauuaaaguuuuauacucugauaccugguacugaggauagccucaugagugaaaaauaagcacucacgauuaagcuauguccccaaugcaucuaguauuuuaaaaauaguucuauauuuugaaaauucuucaaauuuccuacuuugccucaugauugauuuuguucaaucuauuuuuuucucuuaauggaaguaauugaauguuucagauugccagggauuaguuccacuaucacuugaaacauguuuaaaugaauuagugaaauaaaauuauaguacaacuucaugauauuacuuucacaauaggacuaaagaaaaaucagaaaaaaaaacuuucagcuuugcuacucaaaaauauauagccaguccuauuucaugaauuuguuuacauuguagauaaguaggugaaugcuaaucaauauuuugaaugugaaaauugcauuggcucaauuauacauguuucuacaacagaguggacaugacagaguaacaguaaaugaaaaauaguaucccaucauaguugaaugcaacuaacugugggaaaaaucuaguauauaauggauauaguugccuuguuuuagcccauggguguuccuuuuuuacagguucuuuguuuuuguggaucacuccaaauuuuauugccuuuacuucuuuaauauuuuugaauuauauaugcuuaaucauguuucccucaguuugauaauuauauuuguucacuuuaguuagagguguaguuaucagcuaguguaucacaacucuguuuuugcgugaaacuguuuggaguauaaaauguuauguuuuaaagauuuugagcugauuuccaguucuguuucuacuaugugaaaccaugucucaaacaguuuucaagcacacauauauuagaauguacaggugaaucuuaaaaaaaaaaaguuucuuuacuuaacuguuuguugauacccagauuagaacuuuuuauuucugauugcagugauuuauaugcacacaugagaggggugggggagauggagauaaacauuuuaaacauuuuaaguagaguacuacguggaacaaauaucaaugaauaguaguuuguauuacuagaaugucagagugauuuaaugacugugcucugaaaggaagacauugcaaaucaaagguguguggaucuagagcuuuauucucuuucaggcaggauguauauuguucuguauguagaauuugcacuuucuaacuaauuuuauaauucaaugauagggagauaaaacauuauauucuaacagucugccuauuuauucauuacugauauuuucuguguuuugguuacaguuuagagaaauuugguagacuugaaugguuaaagaagauuccauguauuuuuuucaguuagaauaacgagaaaugagcuccauguuaguguuuucuuuuuuacuuauucuuaguagacuaagaauugaacuuggcuugccaugcugccucagauagggacauguaacuacugaaacucacacuguagaaggagaaaauuaauucuuuuagguuaucaacucagcucaauacccucaucaccucuaauaaguaaauagaacauuuuuuuaaaagaaagaauugaagaucauaaaauuaaaaaguaucaauacucuagaaugggccauagacagguuuguaguauauauaguuuagugcuuugugguuuauguuuuggaagccauuccaucaaugaggacuugaauuuuauauuguuucuuauuuuugaauuagguaccuuuaauaauauguagcaaucauaauaaagauuuuacauguuagauauauuggcaauguaugagguguauuaucaauguaaccauaaaauuauccuaacuuaaauguuuaauaauuauaauauguuacucuuuggugaaagagauuagugguuucaacauuauuauuugauaaauauauuacuuucuaaaacuuuaauauguaaaauguuaccuuuuuccaaaaagauaaguaucuuuuguuuuguuaaccugaaaugguaaagccuuuguugaaauuuacauuuggccuaguggugagaagcuagagacuuuuaugaucccaauucuauuucugggagaaaauaaauauagguuuuagugcuugugguuuuugcuuucuuagcuucuuucuucuguuuguuuuuaaaugacugaugacuguaauaauuuccaguugcucuguuaagaauuguuagaaccugaguaauggucauagguaguaguaguuguaguagcaguuuuaacuucaguagaguuuacaugaguaguaauaucuuuuccucagccucugaauggaaauucuggaagaaauuaggaauacauaagaugagucaguuugguuuuaguauauacaaaaguauagaaagaguugauugcaaaugaaggggcuaaggaaaccuuguuauaaaaccuuaccuccuuaguuuuuugagaacaaugcaaaggaaaaugauuucaggauuuuauauaguagcuuuuuguuaagguuguaauaaaguacaaugaggaaaugacaaguauauauauuuguucauaccuacaauuaauguuacauaccaguacaugucuugguuacaaggcaugucuuaauuaucaaugcauaauuaauaauuauauuuuguucaaugaaugccaagaaagggugagauuguugggauuacuuguuaauaaguaaauuacaucauuuaaaaauucuaaaucaaguccagaauguuuagauauuuuacuuuuucacuagcaauuauuuuaacaaaauaaacauguauauuacaacauaaauguucuuuuucuuuccauuuucuagaugugauuuaccuaacugaagagaaaguauaugaaauuuaugaauuuuguagagagagugaggauuauuccccuuuaauucguguaauuggaagaauauuuucuagugcugaggcacugguucugagcuuucggaaagucaaacagcacacaaaggaggaauugaaaucucuucaagaaaaggaugaagacaaggaugaagaugaaaaggaaaaagcugcauguucugcugcugcuauggaagaagacucagaagcaucuucuucaaggaugggugauaguucacagggagacaacaauguacaaaaauuagguccugaugaugugacuguggauauugaugcuauuagaagggucuacagcaguuugcucgcuaaugaaaaauuagaaacugccuuccugaaugcacuuguauaucugucaccuaacguggaaugugauuugacauaucauaauguguauacucgagauccuaauuaucucaauuuguucauuauuguaauggagaauaguaaucuccacaguccugaauaucuggaaauggcguugccauuauuuugcaaagcuauguguaagcuaccccuugaagcucaaggaaaacugauuaggcuguggucuaaauacagugcugaccagauucggagaaugauggaaacauuucagcaacuuauuaccuacaaagucauaagcaaugaauuuaauagccgaaaucuagugaaugaugaugaugccauuguugcugcuucaaaguguuugaaaaugguuuacuaugcaaauguagugggaggggauguggacacaaaucauaaugaggaagaugaugaagaacccauaccugaguccagcgaauuaacacuucaggagcuucugggagaugaaagaagaaauaagaaagguccucgaguggauccacuagaaaccgaacuuggcguuaaaacucuagacugucgaaaaccacuuaucuccuuugaagaauucauuaaugaaccacugaaugauguucuagaaauggacaaagauuauaccuuuuucaaaguugaaacagagaacaaauucucuuuuaugacaugucccuuuauauugaaugcugucacaaagaaucugggauuauauuaugacaauagaauucgcauguacagugaaagaagaaucacuguucuuuacagccuaguucaaggacagcaguugaauccguauuugagacucaaagucagacgugaccauauuauagaugaugcacugguccggguaaguuugacuauuauuuaaaauuggaauuaaacuaaaaccuagacagugauguauuucaauuuauucauuuuaucuauaauuuuggaaaaaaauaggauuauguuaacauuucugaucuguauugcuacaccuuuguugcuucuuaccaaaaauacugguauccugguugucuaaugauaauucucuuuugaagaagaauagauuuuucuaguacuaggggaaugacucagugguuaaaacguuuguugugcaaacaugaggacuuauccuuggauuuucugaauacauguaaaacaggauaugguaguuccauuuguaauaguacugccuaaagcaagauagaaaguauagacagaaaaauccucagaagcuaaucugauauauaaacugacaaauaacuagacccugucucaguugguagaaagcaaagucugauacuugauguucuuugaccuccacacauacguuuuccccuuuuggcauuuacaugcacacaugcaugcaugcaugcaugcauacauaugcacacagaugcgcagacagacaggcacaaagcaaguaaaaggaauggauuuucugaaucuugaaagccagccucauauauuuccauuaagaagaaaagauugguuuucaaagauuggaacacaugacaaaugguauuguuauacacauuuuuaagaauggaagauggaauuggaagaaauaaugcaauaaauguacauuguaaaagaauaagagcugcucuucaaauuccauuauguguaacacaacucagcuuucuauugugaacuugaugauaugaccaggaaagguuagucuguauuaucaauaagacuuuggaguucuaagccacucugucuugugugacauuguaggauuuuguuuuuuuaaauaauaauaacaugaaucuugaaaauucuguaaaguggcuauuuugggagcuuggaauuaauguuaguaauaccagguaaaucuagaugauuuaacugggaagucaggaacuucuuacugcgugauuuuuguuuuuguuuucaaauaacauugccucuugucuuccuuuuuucuacagacgacaaaaauuacagagucccugucaguuaaaccagaaauuugguuugaaaauugucagucacauauuaacaaaauuauauauaaguaauucaggguaucccuugguauuaauuguuccuguuagugcuaguucuuguauaaacuugauguaagauuuaguacuaguuacagauugaagcaucauccuuauagucuaacaaauaauauuaacucauuaacagauaacuaacaaauaauauuuauuugaacauuuauuuuuuuugggggggaauggauugucgaaaucugaaaagccuuaagacugagcuaaauacacauuuaauaaaaaauuuaugcaccuguccuaccugauuuuuuuuuuauuaucuucuuauacuauuuuuuucuauaauaaaguuauugaguuaagaaccaguuaaaacuuggauaguauuuguaaaauuucauuuaggacgaaauuagccccuucuguaguuggaguaaaauuaacaguugagucuuguaauuaugcuaacaaacuguugcuaguaaaucuuauuuaugugaacuagucauaugguuugacaugauucauuugauaauauccauauucgacuaguaguauuuuauagaagcccuggccuucaucaauucuguguguuugucucauugauaagcaguagaauuacaaagauagguacuuuuugagaaaauuccuaagaguuucacccagcucuucuuuguccuauauugcuuucuuuuccacuucuccucuuuuuuucucuuucuggaucauuuucaacugaaccccucuaaaauuucuugguuuuucagcauacuagugggaaaggguuagaaauagaagcaaagacucagacuuuagagaucaaauugaugacccugagcaaaggauaauuauuauauucauauuagauuaauagcaaaaagguggagguuuacagcaagcuguauucaaaagaauacccacauaugaacugauggaauucuacucucuuuccacgucuuuauucuccacaaaucccuauuguuuugaaaccuuguucuuucuuucauaaaaaaacuuggcagaauauucauguuaaucacaaucuuuuaugacccggucauuuugaacugcauaguaagguuguauagagaaggaaugagaaguuuugcagugaacucaacauuaauaaauauaaagaaagaaagaaagaaagaaagaaagaaagagagagagagagagagagagagagagagagagagaaagaaagaaagguuauagaacccuaaccuugagcuaugaaggaaauaauaccguuuucuccuuaguuuauaagugaggccuagaaaagauuacauaugugacuuuuguaaguuuucuauugaaucucacauuucaguguuaauuagauuagcuggcuuaaugguagacaguaggcgaguaaauuagaauuaauuuuguuuguuuguuuguuuuuguuuuuuguuuuucgagacaggguuucucuguguagcccuggcuguccuggaaaucacuuuuuauuuuuauuuaauaaagaauguuuagccuauccuuggacuucugaucuuguuuaucuuuuccacuugagugcuaaaauuauguguguauaacacuccuagccaauucuuuuuuguaagcaaaaguuuauucauuauuuucaaucaguauaacaacucuuucccccaacuguuauuuuuagaagaucugucucacaagagaauagucaguauaaaaguauaagguacuauuuuuuaaaauuuguauguacuaagcaauaaauaaauaauaaagaaauaaaucuacaaauucuacuaaaaaggaaaaaacuccaauauuucuuuugcuuuauuuugaaugguuuuggccuuuuuuuuuuaacgagaaaauuauacagauauaaauacuaaugagaucccagcuuccauuugaacaacaauccuaguguagaaguuuuaacagucuuaaaaaaaaaaaaaaacaaauaaaacaaaaaaaaaaaaacaaaaaacagauauucuuuguaggcuguuguguugguuuauuggguaaagucacuugccaccaggcuugaugacugaguuuaauccacaagacguaauuaacuccuuggcacauguuuucuucuaccaccagcaaauaaauggcacauuuuucuccucuuuuuaaaaaauaaagugauuucaaggauauagcauauauaaaaucuuaaaaccuuuuuuuaaaaaguggaauaagaucagauguauccagagacaguauugccaugugcgagaugcuuuagacugcguucacaaucuaaaagcagaauugcccagaaaauaaaaacacagcaacagaauuuaaggucuggacuuuuaggaguucagacuaagaauucugauaggaaaaaaaaaaaaaaagaauucugauaugaaaauguaguggucuguucuuuacauguuuugguacaucuaugcuacaaaucaauauuugggaaacaacaguuaguacaguuuauaaguauaaauuauugaauaauauccauguguagaauauugccaguguuuaaaacgaauaaugaagucagugugacuaaaauaggaguugacagugguaugggacaugaauaaauuuaguuaaguucuagaauuuuccauaguuaaccaaaaauaauugcuaaguuguagaauuggaaagaaaaguccaaaaacccaggagcuggcacacaucgaugaagaaaaaguuguuugaauuacuuccucaauuucucugaaagucuagaugcauugucuagcugagcuuccaucauuucucuuaguauaaauaccuauugcaacaagaacuugauuuaaaaaaaucauuugacauacauugcuuuaauaauggaguuuuucugugcugcucuagguguaauucauucauuaauagaauuguacuuaaugugauuucucuuauuuaaaauuauucuaauagaaauuaauggaagccgggcgugguggcgcaagccuuuaaucccagcacucgggaggcagaggcaggcagauuucugaguucgaggccagcuacagagugaguuucaggauagccugggcuacacagagaaacccugucucguguaaaaaaaaaaaaaaaaaaaaaaaaaaaaaaaaaaaagaagaagaagaaagaaagaaagaaaaaaaaaagaaauuaauggaauccucuucccuuuaucuucaaaauaauuucuuacaaccagaaugggagaugaaguagucaguacgauaagagcuuagcaucauauaauaauuuaaaagaaagaaauuuagagagauuuuuacuuauagaaaugaaagucauauuuagauuuuuaucaaaguguauaaauuacucuucuuggagagucuaaacauuuuuaaauagagcuaauuugaguguuguucaacuuaaauaguaucauuaguaguuuuuuguuuucaguuauguuaacauaggauuuuagaugguaacucuggaugucuaaagguuuuauuuagccugccugccugccugccugccugccugccugcccgccuucuuuccuuguuuccuuccuuucauguuuauuuauuuucagacacaucagaagggagcaucagauccuauuacagauagcuuugagccaccaaguguuugcuuggaauugaacuuaggacuugaaagagcagucagugcucuuaacugcugauacaucaucccuccagcccugucuaaagguuuuaaaugauggcgcuaaauuuuuuuuugauccuugaagauaugguuauagaauguuuuuuuuuuuuuuuaaaucaguauaucauucugcuuagauuucuuggaaugcucuccuauaaggucagcuuguaaaaaaugaucucucuaggauuuuguauugccaaauaaauuaagaauaauauuuuaacaguugaugagagugagauuuccuaguaugaagagaaguacaguuaggaagugauaguuacuauuguacauuaauacagcauaguaauaccaguguauuuuuucuccagcgcuaucuaugaagccaauacuaccuauuuugucuuauauuuuuuucagaauuuuaaguauaucccaauaguuuucauguauccaauuacauguaagacagcuugauuuuacaaauucauuuuuaaaauauaacuuuaauuuuuuuuuuuauacuauucuuuaguugaugaaacaaugguuuaagggugugugugugucucuucuaagaguuacauuuuugggcggguuguauuuugagaggguuuauguagcccuggcuguccuggaacuugcucgcucuguugacuagucuggucuagaucucagagauccaccugccucugccucuugagugcugaguuuaaaggcuugugcuaccaccucucagcaagaguuacuauauuuaaggaaaaaaaaauaaugugacuuucuuugcuaauggcuuuuguguaugguuaguauuaaauuuuauguuuuguuuuguuaccauaguuuuuaaaaagacaggcuacugaugcaucaucucaaacaaaauaagaauuuacaaagucacuuuggcaacauugagaauggucuucuuaaauugcuaguuggacauuuucacuuacagaauuaagcugccaacuauuuuuaaauuauauacaaauauauccugauucugaaaauaauaugugaauauaguugaaaauauugauauccaaagaagucacacaaaaucuaaaagcaaauauuaucucuauuuucuuuggaaaaguagguaaacugugggcuauaagcuugcucccuggauuaaaacuucucuucugaauuacuauuucuuaaguuauuuauccuuuuauuacuucaagggacuuucuguaaaaugguuuuagcagccuacuugcuaaggaguuguagauaucagaacaauuuuaauuguaaagugagcuguaaguuucauaauuuguugcugcugcugcucuuauuccgggaauacuucuguuuuuaaaaucaugugguuaaauauucuagcaaaacuggaaauacuuauuuacuuguuaucauauuuuagauagagaaucacuauaaagcucucacuggacucagauuuucuguguagacauaacugcacuaaacuuaccgaguuugagugcugggaugaaaugcuuguucuaucauauauagaaaacauggaauauuuaaaaauuacuagaaugacaauacuugcaacuucaaacuuagaguuaaugguagagcauuaauuuacacacuucacuuauuuauuugauacuaucucauuaugcuuauuuuacauuucaaacgaaagcaaaaauauagaaaauuauuuuuagugaucauaauagaacauacuagaaccagaauugggggaaaaggguagagacuggacagauguaugcugucuugaaaccaacaagccuuugaaucaauaauuaacauguuuucuuagcaaguugagaacugggagaaaccacaguaauaauaguauauuguguugggaccaaauuugagcuaagaugaucauggaaauuuaaguguacaaaguuauucugucuuagaacagguuucuagcuaaugcuguuguugguauaauuuuguucuccauuucuaagguuaaauucaaaucuauauauuuggcuguaaagugucagaccuaccuauuaauuucuuggggacauaaauuuaugaauuuuaaaagucuauaguuuugaaggguaauauguuaacaguuuugcuccuuagaaaugauauauuaagcauauaccauuagaguaggaagaauauuaccucuguuucuguaauacauuagaaaauaggauugauuuauugaagcuuaguaauuaaauguuaauauuuaguggugauauguggaacuugugaaagaacaguuucuuauauguucaccaacaaaguacugcugaaaauaaauuucaaugaauacugaccugaaaauuggguaugcgagcugagaagguagaucaacuugcaagaagaacugaguuuaaucuucagaacucuauuaaagaaaagaaacuugaagugggcauuguaguccugaugcuagguaggcagguacuggcagagaugccaggggccauugacaguccaaccuauuguguuaugcagucuuccaggucaaggagagauccuuuccugacaaacaagguggacagauccugaggaaauacaucuuagguggaaggagacaugugaauauacauacaugaagacauacaaauuaguuaaaguagaccaauauagagauucuuuacagaauaaauucauaggcccuuagaccccuaaagaugaagauauacaggacauaauugcaacuauuccccccaccccacccccaacagcauuuuggcuauauccuuuacuaagaaaugcauagcuucuuaaacacaguacauacucuuguguguugaaauaaaucuugccaaaaacuguaagucaguuugcuuuuuuucuuuucagaaacaaaauucauuguuuucuuuccauauuguuuuguuauugcugcuucuuauuuucuucuacuuauaucuuacauuuuuccucuucucaacuguccucuuuuuuauauuuucaaucaacagcuagagaugauugcuauggaaaauccugcagacuugaagaagcaguuguauguggaauuugaaggagaacaaggaguagaugagggaggcguuuccaaagaguuuuuucaguugguuguggaggaaauuuuuaauccagauauugguaaguauuagugauaugauuaugaugguguguuagucuuuuaaaguauaaacuugguuuauaaauauuuucaguuaugguaagcaguaaaaaaauugaguaugccauaucccugcuucaggagcuguucuaucacucacuuaauuuagguucuuccauauauuacuuagucaaauauucuaguagaacacaguugccuucuagggaaauuuaauuugaaaaaccuuagagugguagauuugaaaaccugaagucaugagaaucauagguuauauaauuuauccucugguuaauuuauagcuuaauuguccuugagaccaagagcauccauuggugacauucuaucagauuuauuauuugugaacuggaacuuuugauauuaccuggauguauaaccuggcaugcaaaugauacagacauacauaacucacauuuuucaagcuggaaugcaaguaugaauugaauacuugugaaaccaguauuccacaaauauuaaauugcaagaaaaagcuuagacuuaauuuauauuacuacaguucaaggagaaaaguguacuuuucuuuuuaauuaaaacugaaagugaaaauaaggaaacauuuuaaauauuaaaauuaaccugaaaguacauuuuaaugcuuuauuauuuguuuuuuaauacucuuguuccauuagaaaaacauuucccaaaacuuuuugauuugcucauuuugauuuuggcuuuuuuagacaaucuuuuuauauuguauuaguacucuaaccuuaagcucauaauuuuccuuacucauuuuaccaagugcuaagguauacagcccacucucucccccagcuuguuagacuuuguauaaaaaguauuuccugagaagcaacugaaaauaaacuuagaaaaauugaaaggcauauacaauuaguuuuguuuuauuuuauuguuugauguuccguaaaaaaagaaaaaaaagacuaucucuuaauguucaccuagauaaaauaaugaugauaggaaaaaaaaucucuggacuuuggcuuugaauaaugaagaucaugugaagcugaaagaucacaaaauauuuuuuaaaauuauauuagcuuagauuugauaugaauuuuaaguaacuuaaaguuaaucaacuuucuccaauuguuuuuuuuuuuuuuacuuaaucaugcauuuguuucauauguaauuuucagucauuaaguggauaaaaugacuuuuaauuauuucuuuauagguauguucacauaugaugaagcuacgaaauuauuuugguuuaauccaucuucuuuugaaacugagggucaguuuacucugauuggcauaguccugggucuggcuauuuacaauaauuguauacuggauguccauuuucccaugguuguauacaggaagcuaauggggaaaaaaggaaccuuucgugacuugggagacucucacccaguaaguuguccuucguuaauagucuuuaagauuguaucuaaauacagaaguuuaucucaguuuauauaggaacauuauuuauuuguaaacuuuuguugauacugcuguuuaguaaaguaaaauacuuuuaaucugguuaaguauaauaaacaucauuuuuuauauauccuaucaaguauguuuugauugaccccauaaaaaauguugaaaacaucauguuuucaaugucccauaugagucuauguaguaaaguuguugauagguacaguugauauguguguggcuuuuuuguuguuuguuuuccuguuuguuuguuuguuuguuuguuuguuuuuccucauuuccuguacccugccacaaucauggagagaaaguguauauucuagaccaugguaugaaaucuguugcugaacugaucauuugaagaauuuuuaagauugacccauugccugugacaaccuuucuaucuuauuaaacuacuugagagauguggaauauuuauggcuucauuuuuguugacaaguuguuucuacaaagaaugaacaaucuauuauuuuuauuucuuuuaguauuuauuuggcaaccucacuucucuuucugguuguuagguuuuauaucagaguuuaaaggauuuauuggaauaugaagggaguguggaagaugauaugaugaucacuuuccagauaucacagacagaucuuuuugguaacccaaugauguaugaucuaaaagaaaauggugauaaaauuccaauuacaaaugaaaacaggaagguaauuaaauuuuugucauuguuuuauaaauauauaauuucaaagcaguaaaguuuucaaagaauuaccuaguaugguuugaagcaguuauaaaaacuuuacauaaacaaauuuaucuaaauaguaaagcuacacuuuccucuuagauaagagcuuaugugauuguacagaauuguuaauuccccuuuagagaaagacuaaacagacuacaaaagauugaauggguaaauauuacuauaauguaacgcuagaaacagggccuuaccauauuaaaccuaagagguauacagagcccagugauugacaucugguuuaguguguauauacauuuuccauuugagaucuaauuaugcauaucagauuauucacauuagauuugguuuuuacuaacuuuaaaagcuauuuacuuggcaauaggaaauaacuuagcuuaaaaagaaaauauuacauaguauaauuuuaagaaauauauuaauuuauacuuauuuuuggugaaauauuguacugucaugagaucuaauuaugcauaucagauuauucacauuagauuugguuuuuacuaacuuuaaaagcuauuuacuuggcaauaggaaauaacuuagcuucaaaagaaaauauuacauaguauaauuuuaagauauauuaauuuauacuauuauuuuuggugaaauauuguacugucaugauacaaacuacauuuguacuauaacaaauuuuauaauuuguaaaguuuucaaagaauuaccuaguaugguuugaaguaguuauaaaaacuauaaaauuuuauaauuuguuauaauagcuuaguuuaccaacaaauaacauuuuugcugagcuggauacaguagcuaacuuaccaguaccauaauuuccagaggaaaccugagacauucugguuuucucaaguucaguauucauaacaaauuuauauugcauacuagagguucuguuguuauauauauauacagucuuuuuaaaucuuuuauuuuaaucuuacuguuuacauuauuucauuauuauuacuauuaauuacauuuuauauaauuucucuuugauuuacucauagaaucauaauguauaacuaugcauaugaauacaacuuuuauaucugucagaagugagaaauugugaaaauaauuuucuuuguacauauaacaugugauuaauuuuuuaagacuuauguuuauucuucaagaguugcuaaugcuuuuuuaagcacugaaccaacucucugaaaucuaauuuuuaaacauaguaacaaaaaaaauacugcugaagguuuucuugggguggaggguggguauuaaaacuaguccaaaagcuaauuguguuucauuuguauagaauaugcuuucuuguuaauauuccuacaggaauuugucaaucucuauucagacuacauucucaauaaaucuguagaaaaacaauucaaggcauuucgcagagguuuucauauggugacuaaugaaucgcccuuaaaauacuuauucagaccagaagaaauugaauugcuuauauguggaagccggguaagaaagacauauacaaaaaaggucuuuuuuuuguuuguuuguuuuuguuuguuuuuuuuuuuguuuuggguguuuuguuuuguuuuuuguuuugguguacuauggauguuaaggugcuuuuuuuucccccuauaauuuucagaaucuagauuuccaggcacuagaagaaacuacagaguaugacgguggcuauacgagggaaucuguugugauuagguaagguguuuaauucuuaaaaaggaagauuuuauucaucaaacauguagaugugugcuuuuguguccuguaucuguagguacugguuaccaaacaaguaagcucaaaaauagaccuguauuaauauuuccaauuuucaugcagucuaaugcuuuauuucaugaauuaaaugauuuaagucucauauuuucucaacccuuugccuuauuuuuggucauguguaagauggcacauuauuuagucuuuaagauacuugggaagaaccauguauacuagugauucugaacaauucuuaggacaguauuaccacuaacaucguucucuagucaaaugcccuuauuucuacuucuguaauaugcuacuauccaauucugaaagaucuuuccccccaucuucuaaugugacugaucaaaaugcagaguagucuuuuuggcauccacuaugaugucauagguauuuaaacaguuaucuuuuuguagaucacuugagcuauaagacucaaauauguuaacaauagaaugaauauuaacugugucuaguaaugauacauuaucauuguuauauuuauauuacaguauuacuuuauucauuuaaguuuguagaagauuacucuugcuuugcccuuuuuuuuuuaauagaaaagcaaauauguuauuuauucagcuuuuagguaauuaaauaacaaaauucagaguaaagcaaaacaaaaaccauaacaugucauaugauauaucauuucuaagcacaauggcaauuauuaaugaauauaaaaauuuaucauucauauuugcuucuaacaccagucacaaaaguggcaaccauuauauugcugcucaguuuuaaagguaauucauaacagggauaaacaugguaauacagaagccuuaaugggaauauccuaguauuaucucuacaauauggcaaaauaauguuuuagauugauuaugauuaauguaugcauuuugauuauuauccuuuuguuauuggcaauagaauuaucaugacaguggggcuguuacaaauaaaguuuucauucuuaguguugaaguguuuucauuucuccugaagaagcacuuuggaggauugugguugugaaguaaauaacauuuuuaaccuuaagaagcacugcaagaaugcuuuuguaaaaugauacugccauuuuaccuaagaugacaagcagugcuagaacguauucuguaucucuuuuaaucuuuggucauguugucuuggagugugaaauaaaauuuuaccuuaguauaaauuugcuuaucacugaugacucaggaucaugagcugucuuuuagguauuuaucuuuuuuuaaaauauuuuuauuacauauuuucuucaauuacauuuccaaugcuaucccaaaagucccccauacccucccccccucaacuucccuacccacccauucucauuuuuuuggcccuggcguuccccuguacuggggcauauacaguuugcguguccaaugggccucucuuugcagugauggccgacuaggccaucuuuugauacauaugcagcuagagacaagaacuccgggguacugguuaguucauaauguuguuccaccuauaggguugcagaucccuuuagcuccuuggguacuuucucuagcuccuccauugggagcccugugauccauccaauagcugacugugagcauccacuucuguguuugcuaagccccagcauagucucacaagagacagcuacaucuggguccuuucagcaaaaucuugcuaguguaugcaguggugucagcguuuggaagcugauuaugggguggauccccagauauggcaaucacuagaugguccauccuuuuaaccauuacuuugugaauuaucuuccccacucuucuuuccacugauuaugaacuauuucuuuuggaauguauucuuuuuaaaggaucauaugcaaacauguuauacauguguuauucuagucugcagcuuucuuucccccacugaauuuuauuuuuguugaaauugaguuuugugugaguuacuucuagacuugguucuucucugcuuauucauuuguucuuugaucaaaaucacaucuugaugacuccuuuaccuugauagaacaaagagcaagucuuuauaucagauggugagaaucccuuuacuuuuucauuguucuuaauguuuucacuaauuuuacuuccauguaaauauuaaaaucuguuugcugaauuuuacaugaauaacauuuauuuuugauguuuugauuuggguugaauugauuggauaaaucaauuugagaauugucauuuucaucacuuuggauuuucuaaaucucaagcauggcauagcacuuuccauuuaguuauaccauaguuucauccagcauugauuuguaauuuuuguguugaaauaauguaugcuuuagugaauaaguuuaaauaauauguuucuuaugcauuauuucauuguucauuucugagaauaagcuuauaauuacuuucauugcuuuaaaagccuugucaguaaaauucaaacaauuuuuuaauuucuguuggcaugaguuguuuuaauuucuuuguucuuggcaugauaguuuccguuuuauuuuuugagggcuuucuuaaaaauggauuguuuuuccauauaauauauuuauuguuuucccuguccuccuaccccuuccagauugccuacaccuccccucccaucugcucccugccuuuucugacucuuauaaggaagcaaacaagcaucaaggaauaauaaagauaaacaaacaacaaacaaauuaggauaacgcaacagccaagcaagaaaaagaaccaaagagaaaaauuucuagaugauucuauagauguagagacacacauauuuguguacuagagaaucucauaaaaaaugcaaaacucacaaaacuagaagcucuaauacauaaucagaggaccuuuaagauaugggggggagaaacaccaugaauuaacauuaugagaccaagaaccucugcagaugccauuguguuggucaacuaacuguuggauaugggccccacacauaagaauggcauguuucuccagugagacucacucucucucucucucucucucucucucucucucucucucucucucucucucccccucccucccucccucccucccucccucccuccuuccugucuuugaguagaggaaaacuauuccucagcuauuugcauguuggcgaauauauacuucauguagcuucuugccagcuucuuuuugcugguacuucuaacaguaccucagccuaugugguuaucuuugucuuaccuagggucucuaagacucaaaggauaggagagcacuucagggcaacaacuauuccuagcagaacuuugcccauagcccauuaauacuguauauuugaaccauggugcaacuuaauugcuuuuugaaucuucauaguuuuaaucuuucuauuuuagguuuguaaaagauuguaaaauugucuauauuccuaguuguguauaguuuugaauuuaucucuaguuucuuuguauuuguuauaauuuuuaaaauuuauuucuaauugaaccuuauuucugucacauuuuuucaagguuccucucuguuaagguuuucuaaacuucauuucugaucuaguuauuguuuucauagccuuuauuuuagaauuuuaguuuuuacuauguauuucuaauuuucuugucuuuauaguuuucaucuuuuguugauauugacaaaguuuucaugauuauacuauuuaauaaaauuguguguuuuauuuugauuccuauuuuuguuucuuauuuuuuaaaauaacauuacuauauguuuauacuguaaaauaaaauucuuucaguuaauuaaaauacgaaacaacucaacaauagaaaauagguaauuaaauacuuuuaaaaauaacaauucuuugguuuuugauuugauuuuauuuuuuuuuuguaugaguggccugcauacuugagucuaugcaauguguguaugcaguguucacugaggcuagaggauggaguuggauucccugacacuggaauugagccaucauauagggguugugaauccagccuggauccucugcaauaguagcuggugcuuuuagccaccgaauaaguuccagcccuacuucuaaaauuuuaaaugaaaaguugugucaguuuugccuaugucuaauucucuuagaucuugaggccuuauuauguugaaaaucuuggcuucuacaugcaguacagauacaguuuuuuuuauaauguauccaucagggucauaucauauauuuguaaguauuauauauuauacguguuuuuaaaaauaaaaucuuuccuuggcuuuuuuuguuuuguuguuguucuuauccaugcuucuuucccaugaaaagaaugauagaccacuucaucacuauaucuucuucagaaagacuuugaaacuauaacaaucaaaauuacauaguacuacuauuaaaaaucggccauucaaagggaacaguuccaaauacauuguauuuuauguuagaauaauuuuugauguaaaagcucaaguaauuauucauucaaaauauauauauuucaauugcuauaaacguggaaaauccacagucuauuuuagguuuugacaagagaaauaaauuuugcauccuugacaaacaaaacuucuacgcaacauagugauuaucauuuucauuuguagaagaauguucuuuaguuccucuucuauaaagaggaaauaagccaacauaagaaaacagaacaaaacaaagcaaaaaaagaaguguuaccucuggucccccccccccuuuuuuuuugccacuuuacagaauagaugucuauacuaagaaacuuuaaguaacagggagaaaggaaagaagaccugcugcugugugcuacaaaagagaaaaaugauuuguuccaugccugggagaaaacauguuaauagauuaaaagaucagggaucaauuaguucuuacuuucuauaguaaaaauugagcuauuaaccaacuagguaacauuuguuuuuguuugguuuacacacacacaccuuccuccauuuucugguaaauuccaauaagcuucuuucaaucuccuccaaauucuccuccccgcauuauuucucccaccaaucaccuuguaauuucgggcuucaaaucuccuguuacuuuaaaucuaaguggggcacuugaauaguugguggauauuuuuauaauggcuuguugaacuacuuagcuccugguuugguuugcucuucaucuuucauaggguaguaauucauaaugcuacugcccuucuuucuccucaucuuuuguagugcuacuucaguucuuuuuuaguucaaguuaaguuuauuggaaauaacucuuguucuucaguucuuugugccauauccccuuuuuaacuauucauucaaauagguuuucauguucacuuuuaucaguaaauggagccuaauuuuucuuuuccuggcaugcucuggaaccauugcuauaugaaaguuuuccgcuuuuuuuuuuguuuuuguuuuguuuguuuuuuguuuuuguuucaaggucuauuagcuguccuuuuugcuguucuuuuuugcauuucuuuuucaacgaacuguuguuuuuuuuuucuuucaaaaaauuuuuuuaauuaucagugugaauaaaaucaccauuauuuaaugugauuaauucuucauauucucuguucaauucaaagguuuucauuuucuuucuuuuuuacuauuuuuugucuuaguuuuuguccuagcuucuuuauuuuuuuuuuuuuuccauuuuuuauuagguauuuagcucauuuacauuuccaaugcuuuaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauuugguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacaguacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcuagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagacagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauugucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggugcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaacgcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccaauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucccuagcuucuuuaaaaguacacauugcuuuaaaugucauguuucuucuuaaccuugagucaauauuccuguccuuguugcaaugguucuucaguccguguauuauauucuuuuguuuguuuguuuguuuguugcuuuucaagacaggguuucucuguguaucccuggcugugcuggguagaccaggcuggccucgaacucagaaaucugccugcaucugccucccaagugcugggauuaaaggcgugcaccaccacgccuggcucguguauuauauucuuaauuugcucagguccaauuuucuuuucuuucuuucuuuuuuuuuuuuuuuuuuuuuuguaaaagcacauucugcucauuucuacauggucauuccuccucgguucuuuugaguuuuuuucugauuuucuuucuccauuuuagucaccuucaagacugaaucuuuuuguucuuagaagagucucuugcuuauuaugaggagaaacauuucuuuugugaaauauucauacuuucucuaugucauuugaggcuuuguacauuuuuauguucucuucagacacaucagaagagggcaucacauuccuuuacaugguggcucaugguugugugauuugugggauuugaacucaggaccuuuggaaguguagucagugcucuuaaucgcugagccaucucuccagcccggcuuuguacauuuuuauacccauccaguucauaauccauccaucauuaaggaaacuuggagcaggauccauugcagcacugcuugcugauuuauguuccucuaacucccuccucauuuuuuuaaaaagagaaauaauucugucuccuuuucagaagacuaaaauaaacaaaacauaauuguugaccucucauuuuccuaucuaaauuugcucuguuuacagagauuguggagcaguaacaaaauugcugugaucaauaguccuuugccuuguauaucuuuuuugucuuuccuuaauugaugauuucaccugugauuauaaaaauggugauuuaaggaaauaauuuuaucuagucaucugacauaugucauucuccuauuuuccuaucuuuuucauaucaacuauuauauuguuaccuuaagauaucaaucuauugaaaagacaaagucaaauauauuuaagauugauacugaagagauaauaugguaauuuuuuuguuuucagauauuaugaacucaugaauuuacuuuuaauguaguaaauguguuuuaccauuaggacuuuagccuugcuuaggacuuugcuugguguugguguaucuuuaacaugacacaugacuuuguuaaaauuugaaauuuugccuuaucuugaacauuauccccuacccuguaagaaaacauuguuaaaagaaauuauuagaaaacugcauccaggaauaagacuuacuauuuaauguuaugacugguaaggccuugucaaggaacaaaccuagaaagaaucuuuuaaguauauuaucaaaauaaucccuuauuaacauagagguuacuuugcaacuuuuuugcucucuuccagcugucacauaauauugaaguauaguuuucuauuuucaaggucauuauauuaccuaaucauauuuuuaauauugucucuuacucauuuuauuguucaguuauugaucccccucacacccuucuuuugaacaauagcuugcuuguagcauagccuagccuagaacuugccuaccuuuugccucaaccuucaaaaugcugaaucauaggaauacuuuuuagauuuccuuucccuuugccuuuucuuguacaugagagacauuugucucuggaguaauuuacaguauuuucucuacauuaaugucauuuaucuuuacuuguuaggguuuuuuaccaagugaaagguuuuagucaauuaacaauuuguuuccauuuuacuuugauaugcauuucuucaguuuugaauauuuuguuuuaacuccuuuccccuucugacuuccuaacccuuugcuugcuuuuuguuucuagacuguugucaaguagaaauguuggauguuugucaaauacaaauuacuacacuucccucauuuacuuaccucauuuuugaaucaucuuuuauuucuagaguugaugugcauuugccucagaauuuucuuuuuucuuuuuaagaauuauuuauuuauuuuauguauauggguacacuguagcugaacagaugguugugagccuucgcaugguuguugggaauugaaguuuuaggaccucugcucgcuccggucacucugcuuacucuggcccaaaagauuuauuuauuauaauacauaaguacacuguagcugucuucagacucgccagaagagggaucaucucauuacggaugguugugagccaccaugagguugcugggacuuugaacucaggaccuucagaagagcagucugugcuccuaccugcugagccaucucaccaaccugccucaguauuuucaaguguuauuauuucuguuugaauucauuaaucucuuuauuuuugauucaugaugccaucguuaaacuuuucauguuagaguuuauauuauucacgacucagucuuuuuuaaaaauaguuucauauuccaaaaagccuuauuucucauuugaagaacucuucauaauauuccuauuggacuuaaauuuauuuuuuaucauuuacuuuuuuauauauuuccucccauggaccugcucuuaguaaaugucaugggguagcaaagcauaguacagucacuuuaagugguuucucaaugaaggaaaaccuuuuacugcuguuucuuuaauauuugguucugcuuuaugugauucaaugccuucuacuuuucacuuacaauuuuuuaaaaauuaaaaucccuucaccagguauuucuaucaucuuuggaaaguuucgucacuucuuucuuccgcucuuccagugucuacaauuuuuuuguccuauucugauccuuaacugugcuuaucuuguguauuauuucucucuacuuuuacuuuggggauuuauuacuugauuuuccaauuuuauucucagcauagauuacagauauauuuauugcacauuucucuugcuuuggagaagaucuugauagauuuuuagauugagguuuuagaaaugugaauaggauauugaacauguauuuuuuacaaaaguaaauuuuaaaacaucacgcuuagcauuaggaauacaaaaguacuuuuuaaguagaauuacugagcaaaagaguuauuaauauuuaucccauauauaguuccuacaagauauaaaaucuggcugacuaaaacuuacauacuaaguguaaaugguacuuuuaauauucacugugacauuggccuuaauguuguaguacuaugaucuuguuuauaguggaugucaaauuaaaaccaguauucucuuuucacauuagggaguucugggaaauuguucauucguuuacagaugaacagaaaagacucuuucugcaguuuacaacaggcacagacagagcaccuguuggaggacuaggaaaauugaagaugauuauagccaaaaauggcccagacacagaaagguaauaucaaacuccaacuuuguacccacuguaaaccuuuucaccauauuccauacacgcaagcagagccaacauguagccucuauauacucuucugauguuauauugaaauaucuaagucagcaaacacuaguggaauggauauuuucccuucaugauuugaggaauuuuuuuaaaaauuaguguaguuaaaaaguaauuauggagcuuacagaaguacagacguuaucaaguuguuauguuuuauucccccuuuguuucauaguuuauuaagaaagccuuauuauagaacagucuacuuugaauggcuacacuaaaauuuagaggauugucuguucuuuuacauuauacuagauucuuauucuaggguuaaaucauucugacuuuugauuguauucuuucuccaauaaauacuucacaauuuuaugguggggcugaacaauauguccuagguagacuucgauauacaucgacagauauauuuuuauuacuguuaauuagacauuuuauacaucuuggcucuaauuuuaauuaauuuauaaucaaucauuaucauuuucauuuugccagcaguauuucaaaucuauauacagagcauagacuucaaaaucuuuaaaagccagguuugaauaauuuuuaaucuuugguguaaguuguuuagugacuucagcuuuuaauggguuuaguaagauguuuguuguguaaagauuuaaaugaacuucaguguuaaaguaucuaaagcaauagguaacagaguggaaacucaauagauaauaaauguuacuaucaucagcaucacuuuaauuuuugcauuauuucauaggauaaagacccaacugaucuuuuuaacuaaacaguacaauguuuaugauauauuuaaucuguaguuucucauuaaaaaccguccuaacaagauauguaucuaauaggagcauuuaacacugagcauauuuccaaugacucaugauuguccuguuuuucccuuucucuuuauuuagguuaccuacaucucauacuugcuuuaauguccuuuuacuuccggaauauucaagcaaagaaaaacuuaaagagagauuguugaaggccaucacauaugccaaaggauuuggcaugcuguaaacaaaaagaaaaagaaaaagaaaaagaaaaaguuaaaaaauaaauauaagagggauaauuugaugguaauaguaucccaguacaaaaaggcuguaagauagugaaccacaguagucaucuaugucugugccucccuucuucauuggggacauugugggcuggaacagcagauuucagcugcauauaugaacaaauccuuuauuauuauuauaauuauuuuuuugcgugaaaguguuacauauucuuucacuuguauguacagagagguuuucugaauauuuauuuuaaggguuaaaucacuuuugcuuguguuuauuacugcuugagguugagccuuuuugaguauuuaagauauauauaccaacgaaacuauucucgcaaggaaaacauugccaccauuuguagaacauguaaucuucaaguaugugcuauuuuuugucccuguaucuaagucaaaucaggaacuuuuuucuaacaauuugcuuuugaaacuugaagucaaggaaacaguguggugcaaguacugcuguucuagcccccaaagaguuuucuguacaaaauuuugagaaccaauaaagauggaagggagaacuuggaauguuugaaccacagcccucagaacuuuaguaacagcacaacaaauuaaaacaacucaugccacaguauguugucuucaugugucuugcaaugaacuguuucaguagccaauccucuuaguauaugaaaggacagggauuuuuuuuuuguuuuuguuguuguuguuguuguuguuguuuuuguuguuguuguuguuuuuguuguuuaaguuuacuggggaaagugcaucuggccaaaugauaggauagucaagccuauugcaacaaaauuaggaaguuuguuguauaaauaagcauguaaaagugcacuuaaaaugaaucuuuauuauugcugagauuuuaauagacaauccaaagucuccccuucuguugccgucaucuuguuuaaucaaccauuuuucaaggcacucgaucaguguugcagcauaacagaaaguacagcuacugugccuuguguuacuuauuuacacaguuagcaggccuggaaaugaauggaacuaguacuccugagaaauaaauuguauaucccccaaauuaaaauuuacuucaaagguguuaaagauuucauguccuauauuaaaguacaaauaggcuuaaauuacuggauauuuaauguaguuucccaucccuagucuucuaugucugugauguuaauuucuuuuguugcauaacaaaauaaaagaauuauguauuuuuaacuaaggagagacauacugguauaucauuuuacuacaagcuacagauaaccuguugagcuugugccuugauuguuuuaacaacuagugcaaaucaaccugaugauuuuaauuggcaggggauaaugguagcuuucaaaucauuggaaggggaaaaggaugucuuaggauuauuuucuuucuuguaguaguugagacagagcucuuauuuacuguaaugcuaaaugaaacaguggcuuaaauauuuuaaugggaaaagagaacacagugcguuccauauugugauaagguaacgugagguuuuuuuguuuuguuuuguuuucuuuuuuuuuuuucugagcuagccuuuagaacacuguugugguauguaugcuaccuugauuauaggacccccuaaaugugacuauagucaucuuaaugggcaucuuguccacugugcuucuuauguauuaugaaagugauaagaagacaaauuaaguggguauauuuuauaaaauaaauucaugaagagauuuguguucuucaguuuauugucacuacaguauugaaguaguugugauacuauaucugugugaaaguuuucaaaugauaauauagauuaucaaacagaaguaacaucaauauauuuaaaagaaagugaaaaaaaaauccuaaaaaguuuucagagguaaaaaaaaaaacucucacuugcuuccuaaucaguuuuucucggcauguuaccacauuaauauggcugccuuuucaugauugcuuuacuagauugucauggaacaauacuuacgaguuaaaaaauaccuuuuaguaguguagaacauuucaaacuuauggcauaaaagcacagccugcagcaaaacuucucuggaaacuuggcagcugcagcaaacaaauugaguguacauaucguggucuauaguuaauugugugaucaaauucauuugcaauaaccuuaccuuuauuuggaaauacauccuguguaggaauguauauaucaaaagaaaccuauaaaugagccuucagagaacuuguucacauuaacauguggcaaaugcaucaacuaggcagcauuacuccguguuuccauaagguggcuauugcugaaaucaaccucuuuuaaagaauuuuuuucucaagaauccacauacccuagagaaagaaguguuuuacugaggcuacucuuuaagauguucauucuuuaacugcuuaucccagggucuauuuuaauccuuucuacccuucccagaauaaaauaauaauaauaauaauaauaauaguaacuuccauuugcugcuucuuucaucuuuagaguguaaaacaguuccugguguuugguaggaaaaauguuuacacaauauagacagaggcccuuuuuuuuuccccucuucuacuuucaaauaagaaaauugacuuugguaacaguuguaagaauauuugagugcauguauguacugcauuucacuauguaaaggcugcuaauccaggaauauuucacugaaaauguacuugcaauaauacuaguagucuccauuugccacaguaaagaagucuuguuuuuaacccuugagagccuugcagaguugggcuacagcuuccugaaaggcucacuuuuccaucccaacucauagacaccuuguauggauacucuccugauuguacuuagaaguacuccucugaacuuccuguucaacccaaaguuuuuucucuugccucauauuuugugggucucauaucucauaucauaucagacccguguuuccaggacaucauccugguaccucuaagucauuauauaguacaaaacaguaccgauaaaaacaaaauucuuacucuuguaucuccuaguuauuucuuguuacuuccuuuagaacugucaauuuuuuggccuggggagauggcuuaguggguaaaggugcucacuauauaaaacuugaccugaagacucugccuagacuccacauaaacauggaaggaaagagcaacuccacaaaguuguuuccuggccuuuccauguuuaccauagcuuuugcuguuuccuacccucucacaguuuaugugcauauauaugcauguugucaguuauugucucucagaccuauuuaauuguacuuuauuucaggccccaauccuuugauuuacucagguuaucuuccugacucugaacuacuucuaauucuuuucauucucaaaaagcauuuuuuuuucugauuuguaugaguacuuccccuuugaauaguuuguacagguggauuucugcauaauuuacuagugcauccuguucagcaucccuuucaucacuacucaaaauuccuuuuuagauuaacuuuauacaacucacauauucuuucaguuggaauuuugaaaguaucauacucauaaagacuucuauuaguuacagugugccuucauaguguaauagcagccuacauaucccuggucacagccugguggaucauauuuauuugaacaguugaggaggccuucagaagugcguucccuuccuucuuuccuguguuuuagcuuugauauugucccacuauuauuauuauuuuuuuuaaagcaucuucucuuuuguauggaaucugaguaaauucacaguggaaacuaccuuguacugaucuuucugucucuuaggcaguaggcagauaagcauuaaucaagaaauauacacauacauuuauugaauagaguuucuggaaucacuguauuauaucugccccaggguaaaaaagacaguaaguuggaaaagacuagaugguugaaagcaagacaguuuuguaacucuacauccugucuucugguguacucuugaccaccgucuuuaugccacucauacucuuccagcagucauggcaacugauaccuuaauucguucuguuauuacugacuagucucucaaauuuucauagaggaauccuccagaugcuguucucuguaaauauaugugagucauauuuaacauuuucuuauacuuugcugcucaaauuccuguaaauucugacaagaauuuucaaugacugcuaaagaucugugcacaugguccuucauuuucacaaagccaauaaauaucuguaacuugagagguuauacaccuuacuaaaagucauacaggcaggaaaagggaugacaaaugguaagguugcguccacaugaccaccuaaaauuugucaucuuccuuuuugcaaaaacaaacaugacuaaauuaaacaacaaauuaagauuauuaugcugacaugcauggaaccuuggaucauuauuaugauuuuucauuacccagaaacacauagaaaaugauaaggaauguaucuggaauauaguacacacugguugggguuguagccuucagucaaaugacucugaauuuuaguuuggcacugccauucccuugacuuggauuauacccacuccuaccuuaucucugguugugugguuucagugaaauuaccaugcagcugguagauaacaucuuggaagacauccugagaacaguucucccaacguugcuuguuaacuuaaaaaaagagagagagagauuagaaaugucuguaaugaagacuuauuuucuaaaaccugaccuuauaucguccaccuuuaaauggaagagauguguuuucucacaucuuuuagauauaauucacauaguauaaaaauucgccauuuuaaaaaguguaaaauuugugguuauaguauauucacagaguugugaaauugucuuuauaaaauuccagagcauuucaucgcuguaaaaaguuuucuguacccauuaagagugacugccuguucuuaacuccaaccccuggcaacuacucgucuucguaugccuaugaauuugccuauuuuggucauuucauguuaauggagucauacaauuauguggccuuuuugucuguuucgccaccuuccacaaagcaaugaguucaaacugcaucaauguuguagcauguacugguacuguuucuuuuguggcugaauauugucauuguauugauaugcuguauuuuuuugcuuguccacuugguugugcauacauguguucuuucugcuuuuugcauauuaugaauacaacuaugaacacuuuguguacauguuuucauuucuccuacugucuuuuaaguaucuuaugguuuugguucuuaaauuuaggucuuugauucauuuuugcaugugguacauuuuagggauccaguuucauucucuaauauguggauaucuaguagaacaauaccuaauuguuacaaagacuauuaguaauuuccuuaugaguaggcuugcuaucuuugucaaaaacacguacaaaugaccauaaauauggcuaauuuuggauucuugaacuuugucccauuguccuaugugugucucuuccuaugccaguaccauacugucuuaauuacuguagcccuagaguaaguuuugaauuuaggauguguuaguucucuagcuuuguucuacaucaagauaauuuuaccuguucugggucccuugcauuccacauggauuuuagaaucuauuuguuaauuucuacauaaaaagcaccugugauuuugauuguucuuguguugaaucgauacaucagauugacguauguugguauuuuaacaguauuaaauuuuauaauccauaaauauggagugucuuuccauuuauuuagguguguaauuucuuucaaugcuauuuuauagauuucaguguauacaucuuggcuuuuuugaguuaaauguuuuucacuugauccuuuuacaaacaacuuuuuuuuuaauauuuguuuggauuacucauugcuacaucuagaaagaauucauuuuuauguauuaaccuuauauacuguagcuauucugagcugauucuguuuuuaauuuuuuauacaagauugugcaucucugaauauaaauacuuuuguuuccucuccaaucuggauucuuuuuauuugauuucccugccuaagugcccuggcuagcacguccaauaugauauuaaauugaaguggcaagaguguacaucuuuuucuuguuucugauuguaguggaaaagcauuaggucuuucaccauuaaauaugauguuagcugugggauuuucauagauguugcaaguugagaaauauuccaucuauuccuaccuuacugagucuuuuuuuaaaucaagaaaaggguuuugaauuuugucaaaugcuucuucuguaucuaauaagguugucauguaguuuuguccuuuauucuauugauauguuguauuacauugauggaauuuuguauugaaagaaccuugcauuccuggaauuaccccacuugucuaugcuacauaaaccauuuucuaugcugcuggauuugguuugcuaguauuuuguuuagcauauuugcaccuguauucauaaaagauacuggccuguaguuuucuuguuaucuuugucugguuguuaucaggguauuacugauacuggucuccaaauaugccuggagcuuuccaacuguucuuaaauccagugagguguguuugaaauaauauacuuugaaaguu

SEQ ID NO: 3844 - RNA, 1549 nt, Mus musculus
gucuaacucuccucuuggcuuugucuccaggguucugcgauuaaaaauguauaccaccaggaccggcuauuuacccuuuuuaugguuuuaaauuagaaaaaugugauuucuaccugagacaaaacucauucuauuugauucguuuuuuuuuuuuuuuuuuuaacauugcauucauuagguaucuauaaugucucugacauguaaauuuuauucaguuguauuucuuaaacauuugugucuucccucaaauaauugcaguaauaauuguuucucucaauuuuuaugaacauuuucuuuuuaauuggccauagcuauuuuuuuuucuguucaagagcuuaagaugaucuuuucaaauguccuuuaaaaaaaccaacaccuuaaaugaaugguuacugguauauuaucauuuauucuaauuagguuuguuuguuauuauugauaauauuacuguuaauggauuuauauuauauuuauaugcagcuauuaaaaacaucaguguucugauuuuugcaacuggagaugaguuuuaagagguggucuuuuaaguacuuucaaauacggaaaaacaauauaaaaauauaaaaauaguccucuaagucuuuugauguucucuucagaaaggcuuaggauaauagaguuuugguuuugacaguuacuuuuucuuacugauaaaaauaaagacaauguuauguuaggcaugaugucucacaucuguaaaccaacaauugagaggcuaaggaaggauuguggcaagccuagacuaagaggcgagaccuugucucaaaaaaguuaucaaucagagaugucauagaauguguaauugaaaacuuuuuucuuuaauuaauuaauuaauuaauauuuuugggaggcaggguuucuuuguguagccauggcuguccuggagcuagcuguauugaccaggcuggccucagacuauguuuccagaauccuuaagucuguuuggccuauuuauaaaauaccaaagacuggucaacaccccccuuccccccaacuccaaaaaauguaucucacagucaaggacacugagaaaucuuaagaucagaacuaauuuucauuguaaauuugaguaguguuaggaggacuaaggacugaaccuagggccucucaaguucuaggaacugcucuaccacuuccuaguccucuguacacacuccagcucagaccuugaaaugggaguccugccgccuuccauaggagcugugauugcaggccaguaucacuaugucucuguaucucugucucuguuuauuaggguuuuuguuuguuuguuuuuguuuguucuuuuuuugauuuuauuauaugagaguccacauugguguggugucuguaggggugagaagagaguguuggaacugcugugacugggauauagacaguuguuaauugccaugugggcucuagaaauugaacccagguccucuggaagagcaacaagugcuuuuaauuuaacuuuugaaucaucucuccagccuucccuauauuucccuccccuuccuuucuuuuuucuuuugucuuuuuccccuccccg

SEQ ID NO: 3845 - RNA, 1549 nt, Mus musculus
cggggaggggaaaaagacaaaagaaaaaagaaaggaaggggagggaaauauagggaaggcuggagagaugauucaaaaguuaaauuaaaagcacuuguugcucuuccagaggaccuggguucaauuucuagagcccacauggcaauuaacaacugucuauaucccagucacagcaguuccaacacucucuucucaccccuacagacaccacaccaauguggacucucauauaauaaaaucaaaaaaagaacaaacaaaaacaaacaaacaaaaacccuaauaaacagagacagagauacagagacauagugauacuggccugcaaucacagcuccuauggaaggcggcaggacucccauuucaaggucugagcuggaguguguacagaggacuaggaagugguagagcaguuccuagaacuugagaggcccuagguucaguccuuaguccuccuaacacuacucaaauuuacaaugaaaauuaguucugaucuuaagauuucucaguguccuugacugugagauacauuuuuuggaguuggggggaagggggguguugaccagucuuugguauuuuauaaauaggccaaacagacuuaaggauucuggaaacauagucugaggccagccuggucaauacagcuagcuccaggacagccauggcuacacaaagaaacccugccucccaaaaauauuaauuaauuaauuaauuaaagaaaaaaguuuucaauuacacauucuaugacaucucugauugauaacuuuuuugagacaaggucucgccucuuagucuaggcuugccacaauccuuccuuagccucucaauuguugguuuacagaugugagacaucaugccuaacauaacauugucuuuauuuuuaucaguaagaaaaaguaacugucaaaaccaaaacucuauuauccuaagccuuucugaagagaacaucaaaagacuuagaggacuauuuuuauauuuuuauauuguuuuuccguauuugaaaguacuuaaaagaccaccucuuaaaacucaucuccaguugcaaaaaucagaacacugauguuuuuaauagcugcauauaaauauaauauaaauccauuaacaguaauauuaucaauaauaacaaacaaaccuaauuagaauaaaugauaauauaccaguaaccauucauuuaagguguugguuuuuuuaaaggacauuugaaaagaucaucuuaagcucuugaacagaaaaaaaaauagcuauggccaauuaaaaagaaaauguucauaaaaauugagagaaacaauuauuacugcaauuauuugagggaagacacaaauguuuaagaaauacaacugaauaaaauuuacaugucagagacauuauagauaccuaaugaaugcaauguuaaaaaaaaaaaaaaaaaaacgaaucaaauagaaugaguuuugucucagguagaaaucacauuuuucuaauuuaaaaccauaaaaaggguaaauagccgguccuggugguauacauuuuuaaucgcagaacccuggagacaaagccaagaggagaguuagac

SEQ ID NO: 3846 - RNA, 968 nt, Mus musculus
ucuucaauucagaauguucuucuggacauuuaaagcaagcaguuuggcacacaaauuacauagcuaugacaugaaugaagauacugucaguguuguacuuuucugaacggugguuuuuuguuuuuuuuguuuuuguuuuuguuguuguuguuguuuuugagacaggguuucucuguauagcccuggcuguccuggaacucacucuguagaccagggagaccucaaacucagaaauccgccugccucugcuucccaagugcagggauuaaaggcgugggccaccacugcccgacagaacaguguuuuaaugugauaaaauuuuucuuuuuuuaaaacaaaaaccuauguuuuuuuuauuuguuuguuuuuuugcuuuuuugaauaaaagagauggcuauucacuuaaaacuucuaauggacuuucugauaugaaaaaguagucuuagagauaccauuguggaaccauggccauaauuaauuuaguuuuauaaucugugauauaaaauaaaugcugauaccucuaguuaaauauagaagauaugaacaauauagaagaaauuaaaagaaaccaaccauguaauguaccauuuaguuugaacaaacuuuauauuuuguuauuuccuugaauucuugucuuuucugaaacucauuccuuguuuucauuaguugauaccacucuucucauuauagguuucagcacuuuaccuaguaucagaugugaaucauacugcuauuuuuuuggaaaggaaaagaugaaaugcauagucccucuuucuuuuuuuuucuuuucuuuuucuuuuucuuuuucuuuuucuuuuuuaagaaaaauaaugccuagugcauccuaaggggaaguagaguagccucaauuuauuaguauuucucccuuaagauuucuauuuacuaugccccuuuguguagauauauuugcuaagcguacaauaugcuaaaaauaaagauaauauuug

SEQ ID NO: 3847 - RNA, 1171 nt, Mus musculus
uacuccauuuuuuuuuuuuuuuugaguuaaaugaaacacagggaagaggugaacguaaaaacagauauaugcacauaacuuaaccaguugaaauuagaugucuauuccuauacugaagagucugggagaacaguaaauguuuguguacacauuuuguauucuguauccuuugucuucucccuuuuuccaucuuuccucuucucuuuuuucucucuuucuaaccucaugucucccaguucuuuccucucucacuguucucucccuuuuguccuuuuccuuucccuucugcagaugcagguauuuguaaauguuggauugaaugaacuacuuucuagauuguucaggucuggguuaggauaucugcuguaggcucuugaaauauguauguaugguaauacauaauucucuaggcuugagaauuuaaagguaaacagaauuaagcaguacuauaguggccuggacaauuaacaaagaccuucugaaggucuuuuaaaaauugauacuaauucgucuuuuuaguggucaagagauaauagcuuaauuauuuagacaccuauucugcgcuuaaaauuaucauguuauaauaauaguuuuuuuugggggggguucuuggcauuaaacccagggaacauuucuucuaguccuuuaguccuuuauauuuugucuuaaucuuuugaauuauuauuacuauuauuaucauuauguguuguauaauguguauuuggacauaagagugccaugcugugaugcggguggaggucagaggauaguuagguagauuaaggucucucaauuuuuaacuuuaaucccagaguguuuuuuuuuuuuuuuuaaagugucaggcuuauauggcuuuauccuacucauggagauaaucucaagagccauacauuuuuaucuuauuagcauacuuuuaauaaauugggaagauugugucauggaagucuccauagucuuaggguuuuguuuuuagcuuagaaauuguauauucagauuguuucuuauuaaaacauguuauaaaauauuuaaagcacuuaauaguauaucaauaaucuacuuaccuaccauccuggaauauaaaugccaguuuugauuuuuguuuuggaaacuuaaucucuuccuccaaguccuaauacccucucuucuuauccauguaagagauuucuugaag

SEQ ID NO: 3848 - RNA, 8613 nt, Mus musculus
ugggaggcagugucucacuauguagaacagccuguccucaugcuaaauccugguuuagcauucugaugacaggaaguauagcaaaguauugcugugugcaucacuggaauuuguucuuuaaccagauguucagaauagggaaauuggcuuauguuccacccaauaaaaaugggauacucuuuggugcuuuauauguauuucuauauuagcuaauauauuaaaaaauaaagaaaauaaccagcagauauuaaaacuaaaacuagccuacaauuaucuagcaaacauaaugcuccauauacacggugacggcagauagugcuuuuuagggaaaucuaauuuccuuauagaaccacaggaauuaugauuagaauggugcauagcauuuaaauaucuuaaagaucuaugaacacuguuauauuugaguuuaaauugucuacugcagaaauuggcagacauuuuucaagggauuuuuuuuuuuuauaauguuuuagguuuugaaggaaauaguuuuuucugcaaguacuuauccuugcuuuuucugaauacauagacaguguauaaaugaauacaaaucucucaguauaauaucacuucaaaauaaaggugauuauccuacaccuuaguguuugcucagguuacaguuugcaaacacuucauuuaauuucaagacuaugaauaccacaacccaacuuaauagaaaguaacagucuuguuuuuuaauauguguuugacauuguaaauaauuauggcuuauacuaauuugauaucuaaauauaaagauuuuaauuuucuuuuuaaacauugagguuucuaaaauuuguucuuaaauguguugugauaaucugaucuuucuacuuuuuuuuucuuaguuuuaaaucuuuuaaagcacccuuucauuggaauuuaagucuuguuuuccaguuuaucuuccuuacuuauauuucuauaccuuuuuuuuggaaaucacuaauauuugucuuuaauuacauuuuacagaucaccaggagaaucccagucugaggacauugaagcuagccgaauguaaguauaacuucguucagguuauuuugugucucaaguugcccuacacuauuuuauuugaaaauaccuuucaggcuuaaaauaaaaaaagguaaaauugaauuaaaaaaagaaaaagaaggaacaacuuuaaauuguaucuagagauuggaacaugucuacuuauaucuccuaaccaaauacuuccaaaccucugcaaaaaauuagaugucuaaugguaaguagauaauuacauacaugauucugaauuuucaauguuuuuugugcccuuggcaguuguugauaaauaggggaauuagaggaagauucaaacaucuaugugccugcuauuaauuuauaauuccugaaagcaagauuguuuaaauaugaccccuguucuaaauauuaaucaucaggugcuauguuuuggguauaaagaugcuugagacuuauaucucaaugcuucagaaagagcagaaucagauuuuuuaauuauugagauagaauuauacuugguauacagugggaauacagaggaguaccaaauuaugcaaaagaaaucuagugcauaguaggaacauugguauagcugaguaaaacuagguugaauccugaaauguuacuggggauuaagcaguuggauauuugaacaguguucuaggccaagucauugccaagguucugaagcaagacacuugaguguagggaaaaguaggaaauugagaaccuuuucaaaauuugacaaugaggaaugaaaaaugaaaauaggaauaacuagaaggaauuaagcaggggacuguggcaaagacuuggugaauauagcacuugcuauguaaguauuaagaagacuggaguaagaggcaagcuggcugcuagguuagcauaauugacaagcuuugaguauagugaaaacaagccucugacuucuaaacacaccucucuacauguauaaaucuaccuauaccaucuauguuaaugcacacacauaugcauuccugucuuaagaaaugaggaggaaguaaagauagauguguauagcuauguuuaaggugugguugaaaaaguccagguuuuccuuacuagaagcagauuacaucccuuuaaaugcuuaaguacauugugaagucuuaagaaacaacuaugaauuauccuuuaaauuuuugagaccauguaacuucucugauaacuuuaaaacacuuauaaaauguauaaaauuuacucuuuauuguucuaaaguauaugagccagugguauuguaaauauuaauauguuugagcauuugucaucagaacuguuugcauuuugcccuacugaaacuuuguaugcauuaaauagugaccuguuucuuccacuguggcuggcaauuaaauucuacuuuuugucuguggguuuggugcuucuaacuaucucaaguaaguguagucacacaguuuuuguuuuguuuugaugacuggcuuauuuuauauaacacaguguucuugaaguuuauguguagcauauacuagaacuuccuccuuuuuuuuuuuuuuuuuuggcugaauaacacuugcuugcuuguauaugcuauauucugcucauuuguuaauggguuaauucugugcuuuagcaauugugaauaauguugugauuagcaugggucuaaucuuuugucaaauucuuuugguccuauagaauaucaugguaauuguauuuuuaauauuuugagaauauaucaugcuguuuuaaacaauagcuauaccauuuuacuuacauuucuuagaauaaaaguuuuauacauuuuuuuuuuacaacuugacccguauauuaaaauuucuuuggggaacaauagucauccuaauggaugugagguuauauuuuauuguaguuuaguagccaaauaacuuuuguuguuguuguuguuguuuaaaagaaaacucguuuauuuuguauaccuagauagcugcagguauaguagaaacuaaagaacugccuuccccauguaccuuuuuucccccuccccaucgagauaggguuucucuguuuaacccuggcuguccugaaacuggcucuguagaccaauuuggccucaaacucagagacuggccugccccugccuccuaagcgcugagauuaaagugugugccaccacaucuuugcuccccauguacuuuuuuuuucuuuuucuuuuccuuuuucuuuuucuuuuucuuuuucuuuugaaaaagguuuaaugauguuuuguggaacacuauaguuauaauugaguugagauugaguguacugaaaacuuaccaagauaugaaggguuuuaaaaaaacagaccaaauguugaaaguuucaugcacugaauggccugcuuaguuuagaaaccucauagugcuugcaguuagacuguaccaguagucucuaauagauaauauuuuagauugaauauuagcagaauagauaggacaaaccauuaguaguguuucauguauaacacuuuuagcauuagagcauuuuaaguuugcaugcuauuauugauggccagaguugagaauguugugucaucagaagauggaaaaaucaggaauuaagucuuuugucacauaaagcccagaaccuaaugauaucacugaugaaauucacuaaaccuugaagaacuaauacuauaaguuaagucauuacucucauaugaaaacaaaagucuaguacuauaggcuaguaacaaaaguucuucagaaaggaauaaccaacugaauuaaacaauacauaauuauuauucauuauaauuaaguggaauuuauuuuagcccaguauggugguguugcaugccuuuaaucuuuaaucccuugggaggcagagacagucaggaggaaguucuaggacacccaaagcuacaucaagaaacacugucuugaaauccccaaaagaaacaacaucagcuaaaaucaaaacccaagucugccuaacuacaggggccauauugccuuacucucugacucaagcauucuugaggcugcaagguggcucagcuauuaggagcacugaccacucuugcagaauaaaaaaaccaguauguuaaauaggacaaaguuguguccuuaguuaauauccucuuuuaaguaucaccuaauauauuaaaacaggaaaagcuuuuuaauuaguguuuguaaauuuuguuuuaaaaacauaacuacaaaaaauagacuaaugggguuauacaaaacaauagcuuucuacacaagaaaagauauaguuaacagauaaccccccuauggaaugaaugaaagcauucacaugcugaauaguuacuuuaugaaauguguaauucagacagcucauggaagaaguggauaggggaccuaaauaggugcuucugaacaaguaguuccgguaggaagauagcucaguagguaaaaugcuugccuaagaagcauaaggaccugauuugauaacuuucauaacaacauaaaaaugcagugugugguaguguacacauaaaauuccggugcuggggaggaagauccaggaggauccauggggcuaaucugauugguaagcucuaugcuggugaaagaauguggaacuggacuacaguccagaggaugacaaguaaggugguauagaccagacaggggaaaaaaggaguacaaauggcaaagugguuaaaugaguuuuuaaaaauuauuuugauauuauaauauuuuuucuuuuccucuauucuuugcagaaucucaaauauuucaauucuugcucuuuuucuguguugaggaaaaaccuauuuauuuauuuuuguuuuuugagacaaguuuuucucuguguagccugaguguccuggaacuugcucuguagacaaggcugacuucaaacucagauauucuccuguuucugcuuucugagugugagauuaaagguguuguaccaccaugaccagcaucaaauucaugagaaaaaaaauucuuuaccuuucuaaucaucuaagaaaugaaacaacagugagauacuacuuccuaccugcuagaauauaugaauguucauguuggugagguuguaagcaaacagaaaucuuguacacaguuguuuggaauguaaauuagaucgauuauggaaaauaacagguuccuaaaaauugcaaugaccuagcaauuguauuauagaaauauauaguguguuauaagagauaccugcaguuuaauuuugauugcagcauuaauuaaacaaaaugcagaaauaaaccaguguuugucaguggcuaaacaaauaaaaauugacauauaugaugauguaauuuuucgccauuaaaauuuuuuucugaaaucuuaugucggugacaacauggauggaaaugauccuuuauauuuucaaugaaauaaaucagcacaaaaacagguagugcaucaucuuccuguacauagacuguaaaaacauucuaaaaauuguuuguuacuuagaguagaauaaaugauagacauaaaaaaugcaaaaugaauagaauguaguucaggaccaaaauuguagagcauggugacuucuuucuguauauuuucuugaauaucacuaaaagucaacuauuaaguauaugugcaaaagugcuauguuagaauuuauaaacucauuugauguaucacuuuugcauaugauaauauauguaguucuuauuugucaaugaaaauaaaaacuuuggaaaaacagccgugucuucauauauuaaaauuauuauugcaugagugaguguuuuuaacagacgaauaacauuuuaauaauccuacauaugguguuuauuaugcuuaagauaaaggaguuaugguuggaaauaaagagauuguaaaguucucuuauuaagaaauacaaauaauuuuggagacucuuaauacugggauauaacaugcacauugacauugauguccuuuagcccaugaguuuaauagaagaagaaagaaaaccagaagauaucuagguggauuauaugaaaauuucauauuaugaauuugugcauauagaaguauuaagaauuuugauauuuggcuggguauguuugcuugcuccacuucuguacucccgguacuugggagcuuauucagggacagcuucgccuauacaguaaggcaagucaaaguuacaugagaucauggcuuuaaacaaacaaacaaacaaacaaacaaacacaaaaagcagcuaaaagcagggccuaaagaguuggcucaguguccugcuuuccaacuauguggacuagaauuucagaaccuauguaaaaagugaggcaaggccuuucaucccagccuugguggaggggcagaaauggaauggugguugaaauguguucauucagucuagauaauucagcaagugucagguuuagggagagaccacgucuuaaaaaauugugugaggagcauuagaaaauuaugaccgccuuugcuuucuggucuccaaaugcacaugcaugggcaugcaugccuccauguuugugugcacaacacauguauacaccaccccccaaaaaagccagaaaucaauucauccaaaauagaacuguuauuuguaugcuaucaaucccuugaaaucugauagacauuugcaucuuauuuaguaggacuuuauuuuaaaccaaauucuagaaagcauccuuaguuucucuuugugucacauauuggaacuguuugcaaguuauguugcauuuaucuucagaauacauuucagcuucuuuaaaaagcauuuguaguaccauugccaucuuuugauaagggacaucauuguuucucaguacuuuuguuccuaccucuauuuacuaccaacaauucaaugggcuuuucugauuaaaaaaaaguuaagccaucuuuucuauacucaacuuuucaaagguuuccuauuucuuaaacuaugguuagaaauugauacagcccugaacuggcucuuucauuuaugugacauccuguacuagcauuauguucuuaaccugcaacuuuugagguuuuaguucuggaacuuacugacuguucccucuugaguuaaucuacguguuuuucuuuuuuacuuguuucagaauucuuagauaaugccugucauagguaucuuuucugaguaucucuaucaaaauaugauugugucccaucuucucaauucuuacuauuuuccuuucugagauuuaguaucacuucauuucuuuuaaggucucaguagaaugggaaccuaauguucuguuuauauuuaacagucuaacaaaaagaaacuuaggggaguaaaggguuuauuucagcuuacauguuauaggccaucguucaaaguagucagggcaggaacuuuauacuguugcugacucaauuuucagaccuaagcauugcuaacaccacuuacuuacaguccaaaaccaccugccuagggaaugcuauuauccacaguacacuggucccucuuacaucaaucaagaccuuccccuuucccccagucacacccaugggccaguuuaaucuagguagucccucaauugagagucccuuaggucacacuacacauuagacuaucaaauucacaacuaaagcuaccuugaauacguagcaaaauauauaaggaauaguuaguuaaugaguuaaugcuugcuuacuaaguguuagugaaaaaucauuaaauguaugaaaaauauuuagugucucagaaauauauugugguagcaguuuauuucuaaauaacuauuacauauucucagccugugauuaugagggauaauacauaacaucuuaagaauaugccauuugacaaaucacuuugccuuguugauccuugaauguuuuuucagaauuuuuuaugagagcugaacauuuuuaucagggugacuucugguuauaagaucggaugcuuuuaaguuucugugugaaacugaacucuaauuauaggugguucuauuuucaaaaauuuuucuggguuuuuugagcauacucuuggucagauugaaccuuugaagguucuuuaaccuaagauuagccuucuaauauggagaagaaaucugagaaguuuuucaucaaagucaaauaacuagaggaauaccaacuaaaaaaaguaagcaauaacaaaagagaaauuagagauuauugagucuguaauuugguauuuuggaagauacaaggauuaguuauugggucaugcuuucacuauauauaguuaguguggaauaguggagucagugauugcuauuggaccacagaaaugauauggaaacuuugggaaugaacugugauauaacuaaggaccauugguugguuauaaguugaauaucuccugauuacuuuucucgucagauaguuugcauagcauugucaaguuguacagauccuaguuaguagagaucaagcuucaaggugaguuuuugcuuaauuuuuccauuucuuuacugaaguguguuauaucuucaguaguagugucuuacugucaaguucuggagaguaaccaaaaacuauggaaauaaauagccagcauuggaagagagugaucacugggaugucacuggucaacaauucaagagguugaaguuuaauuuuuuuuuuuuuuuacaaaauucuuuuuuccuuuaaaaaaauuugaaaauuucaucuagucucuaaaugaauauaaucacuuccucaacuccuccucuuacag

SEQ ID NO: 3849 - RNA, 1359 nt, Mus musculus
cuuuuuuuaaauauuuuuuaaaauauuuuuuuagguauuuuccucaauuacauuuuuaauauauuuuuaaagagauuuauuuauuauuauauguaaguacacuguagcugucaucagacacaccagaagagagugucagaucucauuacagaugguugugagccacccugugguugcuggaauuugaacucgggaccuuuggaagagcaguaggugcuuuuaaccgcugagcuaucucuccagcccaguuguuuucuuuuauaguauacagucauauacuuaugucaguaguccaguucuuuuuugauuuccacucacuuuucagucuccuuuuuuuuuuccuuuagcuucuguucaagugaaauacauuucuuauagacaacaaauaauuugauccugcuuuuaauucauuuggcuaaucugucucauaaauggaacgcuaaaaacauuuauauuuuguuguuucuuucauuguucuguuuuucuuucauuaacuuauguagacacaguugcuucuuucuuaauuuuucauauauagaauuacaaaauucauuuuccuugagcuccucuguuuguaucauucugcuauguguaaguuuccuuuaaguguauacuguaguuuaguggucacaaguggccuuauguuaugccuaccuuggaaaguuuuuauauuacauuuaaaagauaacuuuggauauaguaaucauugaaaagauuuuugucuuuaaaaauuucuagugagagguuggauguuacagugaauuuaccuuuguuaguauguugauacuuuuauuuucuuuguaguguuaggauuugagcuacacugugcucaggagcaauucuuucuguccaugauuuauuuggguuuuacacaucuuucuguauagauguucauuucuuucucgauauuuuagaaaauuucugcuguuauuucauugacuuagucucagugcuuuuaaguuccuucugcuccauguauucuuuaguuucauuuugaucauguucuaaaagguuugguuguguuuacuuauuguguuguugugugucugaauacagauuuuucuucaauuccugcuguucugucuuguacuugauuuggucuauuauuuaugguuuccacugagauuuuuaauuauuuuauuuauuuccaucauccucccucccagcaccagucucaauuucuuugcuaaacuucucauugacauguacuucagaauucuuugaacagcauuucaaacaguuggccaucuuuuuauugguuauuaaaugcugaucuucugaaauaacuuuguuccauuuauaauguuuuguuuguuuuuguguucuaauuuguacacuugucaguauggauauguuuuc

SEQ ID NO: 3850 - RNA, 2659 nt, Mus musculus
uaagaauuauuuauuuauuuuauguauauggguacacuguagcugaacagaugguugugagccuucgcaugguuguugggaauugaaguuuuaggaccucugcucgcuccggucacucugcuuacucuggcccaaaagauuuauuuauuauaauacauaaguacacuguagcugucuucagacucgccagaagagggaucaucucauuacggaugguugugagccaccaugagguugcugggacuuugaacucaggaccuucagaagagcagucugugcuccuaccugcugagccaucucaccaaccugccucaguauuuucaaguguuauuauuucuguuugaauucauuaaucucuuuauuuuugauucaugaugccaucguuaaacuuuucauguuagaguuuauauuauucacgacucagucuuuuuuaaaaauaguuucauauuccaaaaagccuuauuucucauuugaagaacucuucauaauauuccuauuggacuuaaauuuauuuuuuaucauuuacuuuuuuauauauuuccucccauggaccugcucuuaguaaaugucaugggguagcaaagcauaguacagucacuuuaagugguuucucaaugaaggaaaaccuuuuacugcuguuucuuuaauauuugguucugcuuuaugugauucaaugccuucuacuuuucacuuacaauuuuuuaaaaauuaaaaucccuucaccagguauuucuaucaucuuuggaaaguuucgucacuucuuucuuccgcucuuccagugucuacaauuuuuuuguccuauucugauccuuaacugugcuuaucuuguguauuauuucucucuacuuuuacuuuggggauuuauuacuugauuuuccaauuuuauucucagcauagauuacagauauauuuauugcacauuucucuugcuuuggagaagaucuugauagauuuuuagauugagguuuuagaaaugugaauaggauauugaacauguauuuuuuacaaaaguaaauuuuaaaacaucacgcuuagcauuaggaauacaaaaguacuuuuuaaguagaauuacugagcaaaagaguuauuaauauuuaucccauauauaguuccuacaagauauaaaaucuggcugacuaaaacuuacauacuaaguguaaaugguacuuuuaauauucacugugacauuggccuuaauguuguaguacuaugaucuuguuuauaguggaugucaaauuaaaaccaguauucucuuuucacauuagggaguucugggaaauuguucauucguuuacagaugaacagaaaagacucuuucugcaguuuacaacaggcacagacagagcaccuguuggaggacuaggaaaauugaagaugauuauagccaaaaauggcccagacacagaaagguaauaucaaacuccaacuuuguacccacuguaaaccuuuucaccauauuccauacacgcaagcagagccaacauguagccucuauauacucuucugauguuauauugaaauaucuaagucagcaaacacuaguggaauggauauuuucccuucaugauuugaggaauuuuuuuaaaaauuaguguaguuaaaaaguaauuauggagcuuacagaaguacagacguuaucaaguuguuauguuuuauucccccuuuguuucauaguuuauuaagaaagccuuauuauagaacagucuacuuugaauggcuacacuaaaauuuagaggauugucuguucuuuuacauuauacuagauucuuauucuaggguuaaaucauucugacuuuugauuguauucuuucuccaauaaauacuucacaauuuuaugguggggcugaacaauauguccuagguagacuucgauauacaucgacagauauauuuuuauuacuguuaauuagacauuuuauacaucuuggcucuaauuuuaauuaauuuauaaucaaucauuaucauuuucauuuugccagcaguauuucaaaucuauauacagagcauagacuucaaaaucuuuaaaagccagguuugaauaauuuuuaaucuuugguguaaguuguuuagugacuucagcuuuuaauggguuuaguaagauguuuguuguguaaagauuuaaaugaacuucaguguuaaaguaucuaaagcaauagguaacagaguggaaacucaauagauaauaaauguuacuaucaucagcaucacuuuaauuuuugcauuauuucauaggauaaagacccaacugaucuuuuuaacuaaacaguacaauguuuaugauauauuuaaucuguaguuucucauuaaaaaccguccuaacaagauauguaucuaauaggagcauuuaacacugagcauauuuccaaugacucaugauuguccuguuuuucccuuucucuuuauuuagguuaccuacaucucauacuugcuuuaauguccuuuuacuuccggaauauucaagcaaagaaaaacuuaaagagagauuguugaaggccaucacauaugccaaaggauuuggcaugcuguaaacaaaaagaaaaagaaaaagaaaaagaaaaaguuaaaaaauaaauauaagagggauaauuugaugguaauaguaucccaguacaaaaaggcuguaagauagugaaccacaguagucaucuaugucugugcc

SEQ ID NO: 3851 - RNA, 3874 nt, Mus musculus
aaaaaucuauaaugcaauuguucugaggaguauggauguaaaaauucuuaauaaaaaugcuuaaccaaauccaaauauacaucuuaaaagaucacauacuaauacaaaaguugcuucauuccagagauaaaaggauaauucaacauauauaaggcaguaaauguaacaaacaugcacacauaugaaacauagaucaaaggacagaaauugcaugaucauuguaauaaauacagaaaacagccuuagaauaaugaauaacuguucaugagaaaauacuccaaguaaacuauuuauggauaaaaagacaauaccuugauauaauaaaggccauaaacauaaaauuauagcaaacgucauucucaaugggaaaagaacugacagcaucacuuacaaaguugggaaauaaguauaucucgucucuccacuugucaauauaaugcuuaaauuauucaccuagguaauaaagcaauggaaauacaggguacauuaagugaaauaauucaauccauuccuauuacagacaauauggaccuacacucacugggcacuaaaauucuccucagacaggaaaaccaacugaucugauaaaugcuccuaggaaaauagcaagauauaaagucaacacaaaaagguaugacaacaacuuuucuauauuugcauaaugaacauucugagcauaaaacuggucacauuuacaggaaugucaaaacauaaccacuagaaauaaaucucaccaagaagguaaaugaucucaacaaugaaaaccuuaaaacacuuccaaaagaauucaaagacacgugguuuguaaauuguuauuuuggguauucugaguuucugggcuaauauucacuuaucagugagugcauaucauggauguucuuuuaugauugggcuaucucacucagaaugauauccuccagauccauccauuugccuaagaauuucauaaauguaucguuuuuaauagcugaguaguacauuuucuguauccauuccucuguugagggacauuuagguucuuuccagcuucuggcuauuauaaauaaggcuaugaauauaguggagcauguguccuuaugacacguuggagcaucuucugggcgcucaguauuacuggguucucagguccuauguccaauuuucugagaaaccaccaaacuaaugaaacucaagaacaaagaacaaaguguggauacuuuaauccuucuuagaagggggaacaaaacacccaugaagggacuuacagagacaacauguggagcagagacugagggaaugaccauacagagucgcaccugaggauccaucccauauacagccaccaaacucagacacuauuguggaugccaacaacugcuugcugacaggagccugauauagcugucuccugagaggcucugccaguaccugacaaauacaaaaguggaugcucacagccauccaugggaccgagcacaggguacccaaugaaggagcuagagaaaggacccaaagaguugaggggguuugcagccccauaggauaaacaacaauauuaauuaaccaguacucccagagcucccagaaacuaaaccaccaaccaaagaguacacauggugggacucauggcuccagcugcauauauagcagaggauguccuaguuggacaucaaugggagaagaggcccuugguccugugaaggcucuaugccccaguguaggggaaugucagggccaggaagcaagaguggguggguugguguaaagggggagcaggaaggugagggggaggguguuuuggaggggaaaacaggaaaggggauaacacuugaaauguaaauaaagaaaauauccaauaaagucaaagucaaaaaaaaaaaaaagaaagaaagaaagaaaagaaaagaaacgauuaaaaaaaaaaaaaaagacaccggaagacagauugguagaguuaauaauguaaacauagcucugcaaauuaaagugauucacauuuucaauauaaucccuauuacaauucuggaaauuguuggaagaauuauuuuaaaguuuaaaaacaacacugaguacaaaaaccuaugaauaaccaaagcaauccuaagcacaaacagcaaaguugguauugucacaguauguaacuucaaacauaguauagagccauucugauaaaacaacaugauacuuaacacaaaacagacacaugaacaaauauacuaaauuauacuaaauaaaacaaaacauauaaucccaugcuguugugcccaacuauuuuuuuguuuuuuuuuuuuuuacaugagucucaaaauuauacauucaggggaaaacaucuuuaauaaauggugcuaagacaacuuaacauauauguacaagaauuaaacuagggcugaagagggcuuagcaguuaagaacauugagggcucuuccagaaguaaucgguucaauucccagaacccauguaacaacucacaaccaucuguaacuccauuucccaggguucagauaccucugcaggcuuccuugggaagccagguagccaagugauacacagauauacauggucacaaaacacucauacauacaauaauaaaaaaauuaaaaaaggauaaacuaaauucuucucucuuacccugcauaaaaauccacugaaaacagauuaaaggcuuuauuuaauaaaggcuuuauuuaauguaugacccaaagaauugaaguggacuacauagaagcacuucaagauauagaaaggcaaggacuuucugaaaguaggucagaaaauguuaggaggaauuuacaaaauaggauuagauuacauuaaaaguuucugcacagcaaaagagacaaagcuguagagauugcucagcuguuucaguuacuuacucacauaagaacuaaguuuggcuccacaugguagcacaguuaccucuaacuccacuuccaggcaaucuguugcccccaguucucugcgcacacaugguacacauagccucauaaaggcuccagacauaaaaaaaaaaacaaaaacaaaaacaaaaauaaauaaauaaacuuuuaagaguaaagauucagacuacacauggaagaaaaucuaugcuguuuuauuuuuuuauaucugagaggggacuaauaccaagaauaugcaaaaugcuauaauuagauuaugcuaccugaacacauuaagcaguuaggaacauugagggcucuuccaaaguuaaucgguucgauucccagaacaauugugguuaaacauugaaaccacaaguaauaugaauuuuccauaaagaaaaagagaucuuuacugauaaagcucaagugaccaauaaauacaugaauaaugaucaguauuuuuaaccauuaaggaaaugcaaaugaaaagacuggaaauuuaucuuaugcccaucagaaaggcuaccucuaaggaaauaaacuagacuccuuguggagauggcucagguaguauaguguuuuucuuucaagcaugagaaccugaguuugaccaacuaaacucaaguacaaagaagccaggcaagguggcacaagcuuguaaugccacugugguagaggcugagacagguaggaucucugggacucacuguucagauagcauaaucuacuauuccaggucagugagaaacucuaucacacaauaaacaaaacaaaacaaaacaaaaacaaauaagcaaacaggaacaaccaucacaaaacaaaaaacaagugaauagaaacuuaggaaagacuucuagccuccauuugcacacacauggaaagcaacaacagaaaacacugaagaggaugggaggaaagaaggaccacuauacauagcuagugacaauaugaauuaguucagccauacuaaucagucuguauacagguuucucaaaaaaaaaaaacaaaaaca

SEQ ID NO: 3852 - RNA, 978 nt, Mus musculus
aucaccugcaauggucagguucgaaguuccuuuuccccuuccugccucccugguauuuggcuaauucugccuguaauacuuucacuuuagaucuuucuuguuccagugcggcaugaagugaagacaccuggaccgucagcucguucuugaugcucugagacucauccacuugcagaaguaucucggccuuaucuuucaucucucccuccugaagcauuuucaguaauuguccauuucuugcuuuuacuucuuuauacuuugccucccacugagugaucacagcuuugagcuucugaauuucugcgucuuuccuuucaaguucuaacuuuagucuuucaauucuuccaucuuuuagaccuacuuccugguugugcucuggagcgggagaguuaucuguuccguugugcucugugaguuguucucuccuuuuuucucuaaucagaaucuuaugaacaucaucuuccagucuauugaagaaucccccaucgugugauaaagucugagcagaauucgauuccucugccuuuuuacuaauaugaucuucacacuggaagucuuugagugacaccgugacagguuuguccuugcccuggugguucuuccuuuuaucuuuuuuauuuauaccuuuugucugaguauuucuccauugugccuggaacacuguucugcugagagacuacuuuccugugccuacuugacccuccuaccgcuugcacucugcacaucuuccagcugcuacugccucugauuugugaagagacagaaagcuacuucaggugcuucccuaacccacacaacacagauucagucagucugguccugggcuuccagcuuggagaaggaaacaugggcuggcaggccuugcccuaccucuucauucugcugccauggaaaagcugcucuucgccagucaccuugcccuucugaauucugccugggacacucuucugcugaguuacugcuuucccugacaacauc

SEQ ID NO: 3853 - RNA, 978 nt, Mus musculus
gauguugucagggaaagcaguaacucagcagaagagugucccaggcagaauucagaagggcaaggugacuggcgaagagcagcuuuuccauggcagcagaaugaagagguagggcaaggccugccagcccauguuuccuucuccaagcuggaagcccaggaccagacugacugaaucuguguuguguggguuagggaagcaccugaaguagcuuucugucucuucacaaaucagaggcaguagcagcuggaagaugugcagagugcaagcgguaggagggucaaguaggcacaggaaaguagucucucagcagaacaguguuccaggcacaauggagaaauacucagacaaaagguauaaauaaaaaagauaaaaggaagaaccaccagggcaaggacaaaccugucacggugucacucaaagacuuccagugugaagaucauauuaguaaaaaggcagaggaaucgaauucugcucagacuuuaucacacgaugggggauucuucaauagacuggaagaugauguucauaagauucugauuagagaaaaaaggagagaacaacucacagagcacaacggaacagauaacucucccgcuccagagcacaaccaggaaguaggucuaaaagauggaagaauugaaagacuaaaguuagaacuugaaaggaaagacgcagaaauucagaagcucaaagcugugaucacucagugggaggcaaaguauaaagaaguaaaagcaagaaauggacaauuacugaaaaugcuucaggagggagagaugaaagauaaggccgagauacuucugcaaguggaugagucucagagcaucaagaacgagcugacgguccaggugucuucacuucaugccgcacuggaacaagaaagaucuaaagugaaaguauuacaggcagaauuagccaaauaccagggaggcaggaaggggaaaaggaacuucgaaccugaccauugcaggugau

SEQ ID NO: 3854 - RNA, 1988 nt, Mus musculus
ccccgcccgcccgcugcugcggaaggcgcagugcucaguaaagcgcacuuccucugcuggucuccaccgagggagugcccgcuccaagagcuccaagccgcaucgguccugcucugauccgaaggcgcagacaugucggaacaaaguaaggaccugagcgacccuaacuuugcagccgagguccccgacugugagaugcaggacagcgaugccguuccgguggggaucccuccucccgcuucucuggccgcuaaccucgcagggccaccgugcgcucccgaaggcccuauggcagcccaacaggccucgccaccgcccgaagaacggauagaagauguugacccuaaaauccugcagcaggccgcagaggagggccgcgcccaccagccccagaguccagcccggccgaucccagcaccgccagccccugcccagcuggugcagaaggcgcacgagcucaugugguacguguuggugaaggaccagaagaggaugguccucugguuuccagacauggugaaagaggucaugggcagcuacaagaaauggugcagaagcauccucaggcgcaccagcgucauccucgccagaguguucgggcugcaccugaggcugaccaaucuccacaccauggaguuugcccuggucaaagcccucagcccagaggagcuagacaggguggcgcucaacaaccguaugcccaugacaggccuccugcucaugauccugagccucaucuaugugaagggccgcggggccagagagggugcggucuggaaugugcugcgcauccuggggcugaggcccuggaagaagcacuccaccuucggagacgugaggaagauaaucaccgaggaguucguccagcagaauuaccugaaguaccagcgugugccccacaucgagccucccgaguacgaguucuucuggggguccagagcuaaccgugaaaucaccaagaugcagaucauggaguuccuggccagagucuucaagaaagauccccaggcguggccuucccgauacagggaggcucuggagcaggccagagcucugcgggaggcuaaucuugcugcccaggccccccgcagcagugucucugaggacuaaaaagguccaggggcacacugauaguuucugacccauacuagggcuguguaagggugggguugagucauuagaguaucccaaauccacagugcaguauuucauguauaauuuuuaaguuuuccauacagugcuuuuguaccuuguaaugcuauucauuuguguacucguguaguguuuaagauugaugcaugugugauaaguauuugguacuuucacuuuugugcuuucgugcauuuuuguacaagagaugugcugugcuaaacuugugaaauacauugagguguucuguaucuuguucuuuguaugggacugaugaucuguaucgacaaagaaggcccuggagaguuagcaggacuuaacagcaacgcagaccugagcaagagaaaggucaaggccuuucuccauaugacuucaacuggcacaggaagcauccauguggaauggacugauuugaacuggacuguucucaguguaggcacuuagcacccuuuacaaaacauguaugcaaccccaccauaaauaaacguuaaaaugagcauuaaagauacugugaaauaauuucuuggggggggggaggaggcauuuauuuuugaugaaagggggagugggaauggguggggaugagaaagauucucccugugugcagcauaagcaaacacgguguccuaacacagugggagaccacacgaccacucagaagaaacuugcagugcuuuaaucaauuugucacauaaaagguauaacaacaacaacaaaaaagcucauuaucacauaacauggggauaauaacagguauauggagggccugccccuuuucuguugcauuuuuuaaaauagucuuugauggacacuuuagcagaauaaacccuuaucaugca

SEQ ID NO: 3855 - RNA, 896 nt, Mus musculus
gagauggcaaaggucauugagcuuuacgaugugacuuggaaagaaaugagagauaaaaugagaaaauggcaagaagaaaacucgagaaauagugaacaaauuauggaaguuggagaagaauuaauuaaugauuaugcuucuaugcuuggggaugauauuuggaucauacaugagcaggucacgauugcagccguagacuauggucgggaugacuuggcaguuuugucuucaggaauuaagaagacaauucccugguagucacagaguuaagcgguuaacaggcaugcgauuagaagcuauggaaagauaugacgaugcuauacaacuguaugaucagauuuugcaagaacauccaacuaacacugcugccagaaagcauaagauugccauucaaaaaggccaggggaaaaauguggaggccauucgagaacugaaugaguaucuggaacaguuuguuggagaccaagaagccuggcaugaacuucagaacuuuauaucaaugaacaugacuaugccaaagcagucuuuugcuuagaggagcugaugacgacaaauccacauaaccacuuauacugucagcaguaugcagaagucaaauacacccaaggugaacuugaaaaccuugagcuuucaagaaaguauuuuguacaggcacugaaucucaacgacagaaacaugagagcucuguuuaggcuuuacaugucugcaagucauauugcuucuaaucuaaaagcaagugcaaaaaugaaaaaaagacaacaucaaauaugcuaguuugggccguuaaucgaauaaacagggcuuaucaauuugcagguugaaguaagaaggaaacaaauccucucuuaaggcaguugaacacauguuggagacauugcagaucacucagucuuaag

SEQ ID NO: 3856 - RNA, 3050 nt, Mus musculus
cgaggacagcgcagcccacaaggauaaggugaagucuaauucaaaagaaggcacuggccuucuugggaggaauggggagcugaauuugaggcaugaugaccuggugggcaaggaagaaaaggaaaggagauugaaggccaacugcuguugaggccugggggacgggggugggguugggggggggucaaggcuaggcaguguuuguugguggcacagggugggggaagugccuacauaggcacaagcuaucggccaagugaaggcugggagggacccuauaugcuggguacgggaggcgaggggguaagggaaggcagggggcgauuuaagcuuugugggaggaggggagguacagugugcccugggguuuggugggaggugggacuggccacggccaguuggcgcgccagagacacgguuacauaaauguucccuggcgccgccgcgaggccgcugguagcagcaagcagugcauggcgcgggcugagcgugauugccucaucuuaucagggaacacaacgucccauaugcucuugcccaagccacaggcuugggcgggaacagcauguucucagugaagccggccggaggaggggaagcgaccgcagaggcucucuccccgccgccaaagcccucaccgggauugaaugcgcacugucccgcagcagaaggacacacaaguacugcuggcuucccagagcguucuagcucagagccugagcuggguccuaggcugcuacuaaggguccucugguccaaagggcauucucccaauacuugcacuaaccagauagcuaagccucacugccacuagcuccuccccaggugggugggcggcucuuggcuccagcagcaccugcacaaaccacagugccuuccuugcugcucugugugagccugccgcucaggaguagcaaguguuuuuagaggauuuucugcucucccaccucuacuucuuguaugcagugauagcgguggggcagagcagccaccugcuuaauccugguuuagguuuacugcccaaaguccagcauccaacuggaagccuacccugcucucuuauuguggagggagaagagagggccuggagcucugacuaggagguccugaaaaugcagauagauccauccaucuuaugcaguaucccagacucuaagaucagcccucuguaggcauaaagaaucuaugugcgagucgggaggcaaggcagagugguaagaacccuuuaagagauccuacaccuugcaggcucccagucucagcuacuccacaccagagugggcugccauucauuaguaaagagcuucagucuguggucacuggcuuagggccacuucuagcuucaaccucaagaaugccuugagguagucuccacuccaggaaggucugcuugcucuccuagcauacacauagcucagcaaacagcuaaguauuuggguugaucaacuggagaccuccaagaaaacucggguauauagauagccucaguggguuagaaagacuuguuucugaauggugaauagacuuucccaauuccuucaggguacaucuggcuggugucuugaucacuacaaaugcuagugaccaagacagaggaucugcagaugacuugucucccccacccagggaccagguaagagaccuaugcccuaugccccaggaggagaagcaggcuaguggcagagccaaagucauaggcaugaucccugacucagucugcaucaggagagaugcacacaucaaggaagcagucuccucugaccccauacugcugcuaaugccaucuuaccuuucucagucauuggggggaaggggguaugugaggggacuccugcaggacacaaagauguaugccugagcaaacugguaaugcauggaacauugagaaccgcuggcuacagaugcugugggagccagugccacugaucucagccaagaggcuaagaagugaugagcgcgcacacacacgagccaucaggacgcagaaguaagacugcuauuuaaccucagaauccacuucggacugcuaugugucuugaaaauuucagcaauggaugcaaggauauuuccugagguuggcauuuuagcuguugcaauuugguaugggguaacuuguuacuacgaugugucuggaaaauuaagugagaaaagcucugucugugaaggagccaccccuguuagaggauacaacuguggcagcuaguaacuggugggcaggaggucagagcuagacccgaacacaguggcaaugccaucagacaucacuuguccauuuuuaagauuuauucuauuuuuuaaauacauguauguuuauuugucugucuaggugggugucucugcuugugaggugccacuggugaccagaaacuggggggggggggggauaaaauguauuaaaacaacuagugucuauagugguucauaccacacuucauguauuacacuaaaaucaauucuacauggcaucaguacagcacauggcccuccauaaauagauaguacuuuuacauacugguucaaauuucaaaaauuaagagaaaguuuaaguugucagauucgaacuugaaaaaacaauggaugcucuaugagaacuguuuuauaauacuuggguaaaaguucuuuccauauaaaucaaaguccagaagccaugaaagauaagacugauaacuggacuacauugagugucauggaugaagucauuauaaacaaaagguaagugacaaacagcaaacauauaugugaagcucacuaccuucaauauauacacaggucauggaaacuggaaaagccaguggaaaccaggcagacacaguucauaaggagaauacaguggaucucucaaacaaccccagacaucccccuaccacgaugucaaggcaaaggaguccacugaauuguauucaccagauggucaggcuacagggacacagccauucugucccucugcucaggacaacugugaaaagcuccucucugggagacuggcaacauuagaaagauuauaaacguggccacugagacuguagcucaguacuggcccauuacuggag

SEQ ID NO: 3857 - RNA, 3050 nt, Mus musculus
cuccaguaaugggccaguacugagcuacagucucaguggccacguuuauaaucuuucuaauguugccagucucccagagaggagcuuuucacaguuguccugagcagagggacagaauggcugugucccuguagccugaccaucuggugaauacaauucaguggacuccuuugccuugacaucgugguagggggaugucugggguuguuugagagauccacuguauucuccuuaugaacugugucugccugguuuccacuggcuuuuccaguuuccaugaccuguguauauauugaagguagugagcuucacauauauguuugcuguuugucacuuaccuuuuguuuauaaugacuucauccaugacacucaauguaguccaguuaucagucuuaucuuucauggcuucuggacuuugauuuauauggaaagaacuuuuacccaaguauuauaaaacaguucucauagagcauccauuguuuuuucaaguucgaaucugacaacuuaaacuuucucuuaauuuuugaaauuugaaccaguauguaaaaguacuaucuauuuauggagggccaugugcuguacugaugccauguagaauugauuuuaguguaauacaugaagugugguaugaaccacuauagacacuaguuguuuuaauacauuuuauccccccccccccccaguuucuggucaccaguggcaccucacaagcagagacacccaccuagacagacaaauaaacauacauguauuuaaaaaauagaauaaaucuuaaaaauggacaagugaugucugauggcauugccacuguguucgggucuagcucugaccuccugcccaccaguuacuagcugccacaguuguauccucuaacagggguggcuccuucacagacagagcuuuucucacuuaauuuuccagacacaucguaguaacaaguuaccccauaccaaauugcaacagcuaaaaugccaaccucaggaaauauccuugcauccauugcugaaauuuucaagacacauagcaguccgaaguggauucugagguuaaauagcagucuuacuucugcguccugauggcucgugugugugcgcgcucaucacuucuuagccucuuggcugagaucaguggcacuggcucccacagcaucuguagccagcgguucucaauguuccaugcauuaccaguuugcucaggcauacaucuuuguguccugcaggaguccccucacauacccccuuccccccaaugacugagaaagguaagauggcauuagcagcaguauggggucagaggagacugcuuccuugaugugugcaucucuccugaugcagacugagucagggaucaugccuaugacuuuggcucugccacuagccugcuucuccuccuggggcauagggcauaggucucuuaccuggucccugggugggggagacaagucaucugcagauccucugucuuggucacuagcauuuguagugaucaagacaccagccagauguacccugaaggaauugggaaagucuauucaccauucagaaacaagucuuucuaacccacugaggcuaucuauauacccgaguuuucuuggaggucuccaguugaucaacccaaauacuuagcuguuugcugagcuauguguaugcuaggagagcaagcagaccuuccuggaguggagacuaccucaaggcauucuugagguugaagcuagaaguggcccuaagccagugaccacagacugaagcucuuuacuaaugaauggcagcccacucugguguggaguagcugagacugggagccugcaagguguaggaucucuuaaaggguucuuaccacucugccuugccucccgacucgcacauagauucuuuaugccuacagagggcugaucuuagagucugggauacugcauaagauggauggaucuaucugcauuuucaggaccuccuagucagagcuccaggcccucucuucucccuccacaauaagagagcaggguaggcuuccaguuggaugcuggacuuugggcaguaaaccuaaaccaggauuaagcagguggcugcucugccccaccgcuaucacugcauacaagaaguagaggugggagagcagaaaauccucuaaaaacacuugcuacuccugagcggcaggcucacacagagcagcaaggaaggcacugugguuugugcaggugcugcuggagccaagagccgcccacccaccuggggaggagcuaguggcagugaggcuuagcuaucugguuagugcaaguauugggagaaugcccuuuggaccagaggacccuuaguagcagccuaggacccagcucaggcucugagcuagaacgcucugggaagccagcaguacuuguguguccuucugcugcgggacagugcgcauucaaucccggugagggcuuuggcggcggggagagagccucugcggucgcuuccccuccuccggccggcuucacugagaacaugcuguucccgcccaagccuguggcuugggcaagagcauaugggacguuguguucccugauaagaugaggcaaucacgcucagcccgcgccaugcacugcuugcugcuaccagcggccucgcggcggcgccagggaacauuuauguaaccgugucucuggcgcgccaacuggccguggccagucccaccucccaccaaaccccagggcacacuguaccuccccuccucccacaaagcuuaaaucgcccccugccuucccuuacccccucgccucccguacccagcauauagggucccucccagccuucacuuggccgauagcuugugccuauguaggcacuucccccacccugugccaccaacaaacacugccuagccuugacccccccccaaccccacccccgucccccaggccucaacagcaguuggccuucaaucuccuuuccuuuucuuccuugcccaccaggucaucaugccucaaauucagcuccccauuccucccaagaaggccagugccuucuuuugaauuagacuucaccuuauccuugugggcugcgcuguccucg

SEQ ID NO: 3858 - RNA, 1533 nt, Mus musculus
aaauauggagaagguuuuuauuguagauauaagggagagaguaggcagagggaaguguauaggcugaacacggccugcagauuaaaccugaccaugagaggagagaguaggagggagaucaggagagaagccacagaucaagagaggugucccaggccaagagaccaaaaugguugaguuccauagggaucagguuaagguucaaguaaccuaggaggagccacagguacugagggaugcagggagagcuggccaguguuggcuuugauauguuaauaagcaagccagccauuuguccaggguuucugagaccuaacaguuacauaucaugagccaaugaagauaguuccuggguacccugcaaaggagcaaagaugguacugagugucggcaucuugcauuuugaucgaagaacacucuauagaaugaaguacagcccuuacuccuggcaccagucucauuucacacacuuuuguuguuuugcuuccucauucccauuaccguaggcuaauuaaagaaccccuuccacccaaacuauggauccaacacagugacaguccaagaggcccagcuccccucuaagucuaaggauggagaggaagaacauggagcacagaggccgcuaggguuugccuauugaauccaucccuaagucauuggggguuguaagguucuaucccuagcauggugguaacaggaaagggagacccuuuaaaaugagugagguauuuaggcugcugggaagacccaagccaugaauuucagaguuggccucaccaucugcuccugccccaaaaugccgcuugccacaggcccaaagcugcagccaaaagaccaaauugugagccaaaagaaggccugucccucugagaauugcugugugcuaacagucaauuuacacaaagaugcucuuuccucaaagccccagugcagaggugaggcagcuguucuccucuguaaacaacuggagcucgcugggcuagggucccaccuaauugcaaagguacauggacucuguggucacggcaacuguggaaagggcuuuccugauuuuagcuuuucccugaaucaagucauaaaucauccucugucucuauuggggcacuuguaucagggccccuuguagauuaaaagguccgagguggccaggccugauggcacacuccuuuaaucccagcacuugggaggcagaggcaguggaucuaauugaguuugaggccagccuagucuacaaauugaguuccaggacagccagggcuacacagagaaaccuugucucaaaaaaaaaaaaaaaaagcaaaaugaaacaaacaaaaaaguccauuuaaggauggcaagguuguguccuugguguugcuucuaggugauuuuuuacaccuagggcaagggaguguugaguaaugaucaggugugcuguuuugcuuaggaguaaugauaagaaagccuagaugaaagccaggugugguggcagcacucaggaggcagagacagguggauuucugaguucgaagccagccuggucuauaaagugag

SEQ ID NO: 3859 - RNA, 438 nt, Mus musculus
ggugugagcacugguaagagcggccccgcccuugcugugagucugcgcugauggacucacugaagcugcagagggccucccaguaagaacuggcuggaagacucgacacaaggaagccugaucccaacuguaacagcauguugagcuuuacucaacaugguuuuuacuauuaucgugguugauuuguuuagauaguacaaacauacuuuuguuagguggcuuuccaucaccaugacugacagcugagaugaucaguuuauaaagggaaaagguuuacucugguucacaguguuagagguuucagccuauggucaguuggaccauugcucugggccuguacauaucucauggugggaguacacagcucuucaagggcacuucccagugacuggcagaccacaggcuggguccuuucucuuacaguguccaccacuuccc

SEQ ID NO: 3860 - RNA, 8783 nt, Mus musculus
cuguugaaaauauagacgucugcguggaugccguaggagcugaaggcuuccauguuguuaagcuuuuaaaaaaaacugccagagggaaaaugagcgugaugaauuuaguugacacuuuagguuuuaauacacaaugucucucuacuaaaugcacuggcaauggugaucccugaauuugggguugucuuaugguuauccaagaagggaagaacccguaggaauuuugauuuccauagggggaaaguaaaaacaaccaaaacaaauucuuucauuuaaagggaggaaggaucacaauacguaucaagcuucaagcuuuuggauuaugugugauuaaaaaugugugccaagauauuagaaaacaguaccuuccugagguauccuaacuuugccagaaguuggucuggaaccucacucagcucucacaguugacugugagaugguuuaccucaucaaagaaaacugaauuagcccauuccugaaagugaagucgacucucugcuggccacgccuccuccugcucaccucgcugagcccagccccagcacggacagugagaccugugcucugcugcccauuugccaaggagcugcuuaccaggucgacucauguguucaugaacugacuggcuacuguaugccagguauaggaguuuaaaagccaggaagguaauauaugauuuuugucuccuguggucacaaagaagcuuugggggaggaggaaucuaugaaaauaaccaaguacaauacaauacaauacaauacaauacaauacaugguaacaguuacuagaggaaggaaaaggggugggggacuuuauuuagaggauaaaaauguuugugcuagucaaaguaaauuauguugcugggaaugguggcucacaccuguaaucccagcacuugggaggcugagacaggaggauuaccuugaguuuaaggucagaccaggcuacaaagugagagagagagagagagagagagagagagagagagagagagagagagagagagagagagagagagagagagagagagagagagaggaagaagaagaaggaagaagaagaagaagaaagaaagaaagacagaaagaaagacagaaagaaagacagaaagaaagacagaaaagaaagaaaggggagagggagagaaaaaggaaggaaggaaggaaggaaggaaggaaggaaggaaggaaggaaggaaggaaggaaggaagcagcagcucauugugagugcucuucucacucugugcuguggaucaagcagauugauaagcaaagaggugugaagucuuagggaagcaugggugcugguucccaagccagacccuaguaaagccuaagacccacacaguaggaaagaacagacucuguauguaccucacccaugugccaugguauacacaggcucauauacacacaauaaauaaaaauguguuuaagacguuaacaacgcucagugggcuuuguuugaauuugugcgauagcuggaggugggcauuacaauaauucuauuggcaggucugauggaaauagccaggauauuaagccaggcacucugaccccaaaaacugaucuuaaugggggugggggugaaacaaauuauuucaaguggagaaggauccagaguauuucaguugaagugucagaaauacucuuuuuaagaguauuaaauguagauucaaaacaaaacaaaacugauacugacugguuuuucugaucccuuacauuaaaaaacaaaccaaaccaaauugcagccaucucagauguucaucuuuccuccaugcagaaaggaggaaacuuucuaugcaugaaaacuaaccugggacuuacugaaauagauguggccuaagaaggaggccaucacagauagaugaggaagucagaagccaccugaguccaguggacugcagaaagaacuucaagagggcucaggcagcaugacaaaaccagcugucugucccgcuggcagcuguuuuugucaugacaggacagauuuggagcagagcuuuauguagcccaugcuggccuugaacucuucuaccuucaccuaccaagugcuggggucucaggacguugccaccacaccggcuagcuuaugaagcacucucagccguuugaguuuccucuuuugagagccauugcaaugugucucauuguugauuuggguuaucuguuuucaugacaccuaguuccgaguucuuuauauuugguccuuaguccucuauuggaugugaagcuggucaggcaccuucucccuuucucuaggcugccacuuugaaugacagugcccuuugucaugcagcagccucgcaguuucaucaagucccauuauauauauauaauuuguuugguugauuauuuauuuugguaagcugaugaauuuugggggguuauuaacagaaauguggcugauagaacaaagauaacucacaaaagcagcuauaccaccccaaaagcccaccuccaacacaggcagcaacuccugagagccagaacccagagcucugcacagcuuucgggcaggcagcucuccacagaguccuccgccagcugccgcuuaccucaucuuaaaaugccgcagaauggacucugagaaucuuuucaguuuucacuuucccagacaugggacauuuugucaauuuccuaagucccaucaaccucuucgccuauuuaaagagcagaguucaauagaaguuauuacuuacuauuaaggcaccuaucuauucaucuuauguugauacauucaagguuuucucuggcuuauuaugcauccauguuaaaugcacucaugaugaaauuuuaguauucuuuuuuaguauuuuuugagauuaucuccaguauaaguuucuagaaugucucuuaucguaauauucccaaauaauuaauaauaucaaaacaaauaauucuguagcuccuacugaguuccagccaugguucuaacuacuucacacauauuguagugugggaacuauuuggaugugcacuacuuugcugcacgucugaggguugcguccagggcuucacgcaucccugcaugauaagguucucuuccuacccacacaucacaguaugagaagcucaagagagguuaaguaauguucccagaguacaacaguagcaaguccagaauucuaagcuaggcauuguggcuuucgaugcaaugauaugcagaugcacaguaaugaaacuucagugugaagagaaaaauuuaauuuuuuuuguuuguuuuuauuuuuguuuuuugagacaggguugcucucuucagacaaaccagaggagggcaucuaaucucauugcaggugguugugagccaccaugugguugcugggauuugaacucuggaccuuuggaagagcagucgggugcucuuacccacugagccaucucaccagcccgagaaaaauuuaaaagugagaaaaaaauugaauauuucuaguauauuuuauuuaacauaaugggauauuauuuugauuuaaaaauaaggcaguauuaucauuuauagcaacauggauaaaccugaaggacauuguguuaaauuauauauauauauauauauaugaaaugaaauauaugagguccuauuuauuaauugcugauuuuagugacugugcuaacaguguucuguucagaaagucuuuuccuaugccaaggaguucaaggcuauucccaaaauuuuccaugcuguaugcaaaagaaugcagauagguccauacuuaucacccugaacaaaacucaacuccaaguggaucaaagaccucaacauaaaggcagauaugcugaaucugauugaagaaaaauuauucagcguuucuucuauuucuauuaugggaauaauuugaggaauauugguguuaacuuuuuuuauuuuuuaguugggagacuuuuaauaacugcuucuauuucacuagggguuauaggucuaucuaaauuguuuaaccaguuuuuauuuaacuuugguaaagugauaccuacugagaaaguuauucaugucucuuaaguuuuccaguuuguuggauugcagucuuuuaaaguuugaccguaugauucucuggauuuccuuggugucugaugucauaucccuuuucaucgcugacuuuguuaauuuggauguucucucuugaccuuuuaguuaguuuggguaagcguuugucuaucuugggauuuuucucaaagaaccaacucuguuucagugauucuuuguauucuguuucugugucauucauuugagcccugaguuugauuauuccuugacuuccacuccucuuggugcaauuucuuuguucaggagugaacuugcucuuagagcugacuccacugugcuccguaaguuuggguauauguauuccuuuucauuugagcuaucccucagcuugggcuuccucuguugauucugcuuccacauuuaggucuugaacggcuuggcgcauuuccugccaauuguuuguucauaaagguuauuuuaaggccuuugucuugcucuucugcugucuuaaaauucucagagccuacuguuugguaggguuucugggccccgguagagacauacuauccuggcuauuaaugugguuuuaugcugauguggaggaguuugagaugaccguaauucuacucgcugacauuuggucuuaucuucauuggguggguguuuuguuccuugguuucuguugcccuuuauggcucuuaagaugguguggugagugcugccuacaggggaauucugggauacugcuaggugugaccacuggggguucuggauaaaauaugauucuaaguauugggagcugccacuuagcauucgaaagggaaugagguagagggguaagugggguucacaugaaggaagaaaacaggguauucuaccaaauuuugcuuagugcccuggaaauaggggcagagauggaggcgaagccauaagagguaguuugcuagagaccuggggaugagaggaggggaugggacuuggagaggagggagaaugaagaucugaagcucacuuaccugccucacuggccuacuggcuucuguagcaggcuuggcggcaggaucccaggaaugcccgcuggaguuggugguuaggguaacaggaugcguggggaggaaggcuggaaaagaacuaugugauccacuggagaugggagcaggaaagaguaagaggucacaguaggugguuagcuacacaguuagggaugaggcagggguaugcaggcgcuuguuugggaugggauaaugggaugaggaggggaaaggguggaagagaaggucuagaugagcuaguggagauggggcagaagggaagaacagucuguagcagguggucugugccugagcugggggugagacugggggauuggauuuggagaacagggagaagugaaggucugcaguuaggcuaccugcuucccugggccacaguggccuuugagaaacuccuuguuaauaacacauuauuacuaaauaaaacuaugccaguaacuuauaucucuauucuauaagcaccugggacuagauuaacaaaggcaagaccaaugccaaggcauuuguacauuuauuuuaggaacaucuccauuggcuagaucagguuaauuugauacacuguaaauguaauggggcugcucacgaccacugcugggagagucagguuagacaaaggaccuagaaaagggugacuuaacuguacaucuggcucaacucaauguggggucccagucuccagggacucgaggaagcagaaugcccauguuaguuuuuagugaaugggaagaacaaaagagcugcaguccguucugaacugacgugaaagcuguuaguccaccccaccuuagagaguuuucaaaagagacgaaugaagggugugugcauccaggugggagcugcagccuuccaucaccagucuguguucuaauggguucauacuggugacgacuacaaacgguauccauggagauuuuauuuagcagucagagagcccuuuacauccacucuguugggcaggauccagucaaccugcucagccugcuuaggcucagcaguuggauuuaggcacaaaggguuuaguuuugucucgacaccaaguuuuaauugcuugagguuacugcuacagcaagaggaucuuguugaaaaacauguugaacaguuuucaucuucugucaguagaaauuaauguccuuuccuuaaguaaaguuaggcauuuuugguuuuagaauugguucccaacauaaagcaacaguaagacaguuugaccucuggagucagcauuaggaugcccagugucaucagccccugcaugggcgccgccagcacaggcucugcccggguggcuucggagagagugcuucugagcucuuugguaugcugcucacagccacgcuuaccucuucugucaccgcagggucacuuuuguuugcagaggugccaggcagcugucccauaggccacacuaggacucuggagcuguuucacauaguaagcuguuguacaauaaucgugauguaacaaccacccaguuaaaauagaagaacauuuacaauugauuaccauacaaaaauaugcaauuuccaucauaaaguaguguuuguuaauaguaccugaccuucuuguaaguuggcaaaaaaguucugaaaggagcugaaguaaaugugagggaugaaaauuacaaagaaacgaauucucaaccgcaaaauaaaucuagaacaacuuauagaaguagcaaagcagcuucaugaaaaugggggccauuacugucagguuccaguggugacaccccggugucucggaccagggcuaacuguguggccaacggcuggcgcauccucacugcugauaaugcuauuuguauaaguagacaagagcccuuauuuuauagcaacagaugagugaaaacauuaaguuuagccauaagauaagaacuuuuuuagacauaagaacaucugcccuguuaaaugcagagacauuauuaaacaguuagaaaaggucaauuuaguagaaauggcuaaacagcauauagacaggucacacuauuuugagaaauucaguuuuugaaaaagaaacaaacuaaaucaacacuuuacuauaaaguauuucaaaauccaagguggcaauuuaagacacugccauuguccauuaggacauguccaccuuuaaacagggagaagaagcccugcacacacgcacgagcauucgugagugcagaagcacagggcugggugaagcugaccagguucucaucaugguuuggaucaaggcuucagauucucagccucuuggcauugcccccaagccaggaaggggugcaucucuguauuaaaauggcaacaacugaggaagucuuccucucuagucugugcauguguccaucucgugacccugccugucauuucugaggagaaguguuggccugcgucagcaugacagcugaggugcucaggaggaggccagagcaucccuacagccugcggucugccuguggcaugcuccugugcauggacuuggcacccucagccacagcuggagcugggcaucuucuaccuggagagccucuaagauggcagggugacuuucugagggacaaaacuguggcucuggagacuccuggcuauugauguaagcuuguuggcaaaaagcuauuuccacuauacaguggggucuaaagagcccaauuuugaaaauuuuguuauucuagcuucuuugcuacuuuuaucugaaugucaaaggcacuucuagguuuaaauagcuacagugaaugcuuuaaaauuacagugcaucuuuuaaguuaguuguauggaauugaagcaaauccaugauuuugaaacacagugaucuuagguccuaacugaggugaacuaaaaucuaaacccagaacacaagcuaagaauauuagcuaaacacguggaugccaacugaggccucuugggaguuuuaucagaugaucuagaaaugcauuaaauacacuaauuuauuaacuucccuauccacuuucucuggguuguaaucugacuaucagaucaccuuuaguagguuggaaaauagaaguuggcaaaauucgcauggcagaggaaccucaauauuuugauaucaaguguaacaaugggaaauucgugcugcaaaugacccaaaugagccagacccaaaggucaaacccaaaagucacacugcccuuagaauaacugaaggcagcaugauuaaacaugguuuaaauauuugugcaaauuucuuacauauaaaauguuuuaaaugccucaguuagcaauuucaguucagagagggaaauguccagcuucucucaauauguccagaaaaauaccuuaauuuagucuucauuugcuagugucucaguagauaaccauauuuuggccccacuuaaaaauuugcuuaauggcguuccuaaaaugcuucgucuacacagauuuccuacaggagaaaauggaaaugaagaggagaggaacucugguguccccagcgugucauguggccccguggcccggaaguacauccugcucugguccagcucugcauagcaggcuuccaaggggccgcugcggugcugccucagcauccugcucagcauguccaccucaucagccaggagagagagcuuguggaaggccaugauggagcccccgagguugaucugggccucagggacccaacggaaguagcacaguuuccacaauuuuauguguguuccggagagacguggcaggauaaugccguguagguuggcuggucuggagaaccacucuuuaaaauacugcucggcuccacugugcuggcugucggugugcugaggc

SEQ ID NO: 3861 - RNA, 15735 nt, Mus musculus
gacuuuggugauggucuuuauuaaaacaacaggaaacaaacuaagagagggcucaggaauuuuauuauaaaacauaacgaugacagaaacuuacagauuuauacauuauauuuaaauauauuacagcuuuaauuuaugaacagaaauguccuguuuuuucuucuuuaucuucucaggcuguuuugcaucauuaauuugcauuuuuacuugaucuuguaauuuagaaaagaaugccugagaugacuuuaagggcuuaucuuuucguucauccugcaguuaaaacaaaacagagauguuauaaaaugugguuauguaagaaaacccaaagucuauagcaguacauuaugauuacaacaaugaauaaaugcauaaauaugaaaagccacuacaagaauucaaccagcucccuuaacaaauauuuuccaguauuucaacacccuuguaucuuaagggggaagaagagagaagaaagcuugccgccagaccuguuuuuguaaagaucugagaggcuauaagaugcugagaccacccuugaguaguaugucucuagagugcagaggcagcucugacauccuaguugagaaacagcccaaugcauacccugcauacucccucgggcuuccccuuauuuaccuuuaacaaggacaccuugcccguuuuggucaacuguuugagcuucucugaagcugcugcucugcuggacuuagacugaucuggguuguucuuuucaagcaauuuuuuccgcuucuccuucuccuuuauuuucaaacgcuucugauauuucuuuuuccuucguucucguuucuugucuguagcuguuuucucagcagcuguuuuuagaucuccagcuuuauuuuucuccuauuaaauaaaacgaacaaacaaacccuaaaccaccaccauacuaauugcuauucuugauugucaacaugacuauaccuggaaugaacucugucugcuaagggaugagacgagcacacaauggccagugacugagugucuauggcaguaugugagauugcagagcgagccuuguuugguuccaaccucuagaaacucuuaaagccuaaacuauguucuuugccagaacuccaaguaagaguucagccccaaacucacaaaggaaacagagcuaaggucucaagaccccagaugcucuccaacaugggucacaggauacaucugucucagccuucgcucuaaguugugacgacagguccuggguuuggacuaguguaucccagauaucaaggaagagaggaagcagggaauccuguauccagugaacacugacuuccucauuucuccugagcugucagcucaucauacuggcuuaucauuggcauaagauggcagagguucugacacagguaguagcuauauauuaacaacgcaggcgagacagaaagagaccccgaugcuauuccaccagagcagauaugggccugccagaagccacugucucuguaagguaagaauuuugauguucuggagucagaagaugucagcaccugauuauccaauguguuccaguguccaaauggucuacuggauucuagauuauaacacugcacuacacuaauauugcacuagccuuacauugcaguuuauuauuauuacgggccaggcgugguggcacacgccuuuaaucccagcacucagaaggcagaggcaggcggauuucugaguuugaggacagccuggucuacagagugaguuccaggacagccaggguuacacagagaaacccugucucgaaaaaaacaaagcaaaaacaaauuuauauauaugcaugcaacuuugauugagacuugaauauacagauugauuuuugguauuguauacucauuuggcucacuauguagguacccauagucacagaggaucaaucccaggccccuguagacaguccaaguuacuacaugcucaagccuuauauauaaaaucaaucauuuauaucaccuacauucaagcuuccauacacuccaaauuguguauggauuugaucaauucagcuucagcuuugcugaauauuuucaaagugcaauuagccgaaugcaucaauguacaacucaggaguaugggggggugagggggauauaccuagaaauuacugagaucuaaaccucaagggaagucgcauuaaaucaaugcagaucuuacuugcagggagucacuaaacauccccuuacuggcuucuuaccuugauuuccucuggagccaggagggcugcaucacugacacucacuggggccacuuccuccaugguuauggcuggcagauucgauacaacuuuaauuucagguacaggcuagaaaagagauaaggacauuuaguggggagaaggaaauggagcaagcaaacauccacacucuuauuuuuauagagucgacuuccucugcauagauguuaggguuguuggcuuggugucuggggaguggggacuccugacagugugagggggagucucugacucuuucacuugcucuuacgacacuuuccuccuaauggguugccucacccagccuucaugugaggauuuugcaucuugugcccuguuggguuaagaucccugggagggagauggaagagggggcgggccugggggagagggguggguggugaacugagagaaguagagggaggagaauuaaaaaaaaaaaaaucacacacugaaaacaaaacaccgucccacauccccccaaaaacccagaaaacaaacaaaacauuaccaugcugacuggaaugacuaugacaaugggcgacauuccaguagcauuuacaccuacauauccacauaucucugccucagccaaauaccacuccacguuuaccuauguggacauuuucaagcaaucccauccacuuaauaaaacuuggugauauguuaugauguugcuuuuuguuguaaaaaauaucuaaucuuucugacgaaauauaugaaaaaaaaugcuuaugagaaaaauacaaacuauucaagcuacuagaaaccuaucuuuauauaucaucauguagugguacaaaacuauuuauaaaaccuaaaauaagguauaugagagaauguuaguaugcucaaccuuaugagagguacuguauagcuacuaucauuucaagauaccaguguccaagucagguacaggggacaauguucugggaaaacgucagaauagcaaaaacacaugagaaacagaacaggaguccagacucuaaacaagaaggaaauguggaaugugaaaaacaaucccuuccaaagaggccacuguccaaacaugagaaauacugugcucccccacagucaaaaacagagaagaaaucucaaaauacaauacaacauggcagcuggugaacagcucauaccugcacagaggguguguaaaauacggacacacauaugcaggggaaauaguaaaagaccuguaacagccacaugcacuccuaacgaguugagggggagacaacagaaaauccuuagaccaaggcaaagcagcggcuguggaaauggucagggggcuaggugcuugcuauaaaagcgagaucaccagucuccauguaaaagaugggcaugcauaugugcacaagccccuuaaguccagcuggcgaagaggagacaagcagaaccugggagcucacugacaaguuagucuaucugaaauggugaccuucaaauucaauggagagaucuugucucaagaaauagggaggagagcaauagaggaagacaccugauguuacccucuggccucugcaugccugcaucuagccuggucuuuaguucaucacagucaaaaggacggcaaagggcaacaugugagcaagcaccaacaggaugguucaagcccguuucagggaacuacagacggcucuuaguagauggccuuucaaggagucaguagauucucagccagcccaggaaagauucaggacuggaaaggagacugagaggucugggacuggcuggagcacauuaagcagugcagagcacaagagcccaguauuaguucugccccucccacaccagcuucagagugcaucugcaaaauggaaacacuuucgagcagccaaagugauguaagcaaaagacuuaauaugacuugcagcgggcaccaaucaaugugagggacagacaccaucacacaauuaagcacuacugagcaccaggaggggaggaaucacugaggcucaaggcugaaggugaccaggggccugcuggagaccagguugcagcaggauggaaggcggaauuaacccaggaacaaagggacgcucccuuacagaagcccuguuguaaccugcagguguguguccugacaccaacugaaauucgaagcucuccagagcucagagcuguucaguucacauaugcuguuuuuucuaccgcacuguaaacucacauaccgguuuggggaugaaguggaaguuugacagggcauccaauuuuaggaagagagaauccaucaucuucugaauuucuacaugcucuggauugucuucuucuucaguuuuuugcuaaaugagcaaggucaacauuagaugaaguagcuuaacaacguagcacaggaaaaacacuacaggcaaugaaguuucucagacccacagcuuuaacuacccagcaacauuccagcccauccuggcagcaugccuuuaaucucagcucuccagaggcagaggcaggccgaucucagugaguuuggggucacacagggcuacacagugagaucuugucucaaacaaaaauaaaaaacagaaaccaaucccagucagggauaauggugcuaccaguaauccccccacucaggagacggaggcagggguaggagagaagaauguccccaaaguaaaauuacagguaucaacaccaugauggugccagugccugccaagguugcacauuuuagcacccauugccucugacauguagaacaaacaguaaauccuuuggcauuuuccaacaagaguaaggcuaaucagagcaggaucacuaaauuuaagggauguuaacaaauguugcugaggaugaagaaauuagaucccugggaauuauaugaacccaaggaaaugaaagcagaaaaacacacauacacacacacacacacacacacacacauacacacacacacacacguaggauuugcuauauccagaaguagugcaacaguccacacguucaauuaaaaaaaaaugaaucaagaaauuguggcacauauauaaauggaauauuauccaauaauaaaauagaaaugaagugcugcugggcgugguggcgcacgccuuuaaucccagcacucgggaggcagaggcaggcggauuucugaguucgagggcagccuggucuacaugaaagucacaaauuacaugacuucauuuauacaaaaagccccgaaacaggcaaauucgcagaacuguagcagagaggguaggacuaggaagccguacaucagugagcuaggauuuggggaacuacaaacaggcagcacucgcuuaagaccugcgguagcugcuucugaauuauccauuuacuuaguccugccuuuuccagacagucucacuauguagcacagaaccauugcaaaauaugaccauguaucagucuuugaguccuagcauuucaggaaugugccaucacgccugacagacugucuauggaaagcaaauguuuaauuuuauguuaugugaauguaacuuguuaaagauuuacucagacuuuucccauugauauggaaaugccagccauuuaauuuuacagagucagguuguuuuauuuauauuuguucuuccucuagcacuaaaugugcacugugaaagguaaaauggucuuugcuuguuuuucuuugucauaauuacaacauaguagaggugccgggggggggggggggggggggcgcggggcgcacaggaauaggaagugagcggcucugccuguggcccaggucagauaacauaugucauucaucccaauaaacccaggugaagaaauaagucuuccccaggauauggccuuguucugcuauuuaacuagaaacuaauuuuagaauuuaaaaaacaaaaacaaaacaaacaagaagagccuaaagguccagaucaucucauaaagaaauaaaauacaucaauuauuucaaguaucaagaaaauaugacuucagaauuacaacauccuuuaauugccaggaagucaauagcugauuauauaaaucaaugcuuuuguagagcaagccccaacuugcucacacucagugggaacacuggaaguccucuauuccuaccaugugcugugaaacagguaucugagagcuagguuagaucaggacuggcugacgaucugguucuucagucacaaccgugccuuggaggucaccuuaccugguugaguuugagauauuccugcucauaaaucucagcaaggcuuagcuuacucuucucauggucuaaggucaaacgcuuuuuauauucauacgcauccuccuuagguuuuucuuuucguucuacgucaucccaagccugaaaugcaaauaagucaauagaauaacacaucuacuucuaugcuuaguaagaaguauagcaaagaaauuaauuuuuaaccucaaaagugauuaucuggggcuacagcucaggugguagaauguuugucuugccuacauaaagccuuggguucagucccuagccccacaaaaacagagcaugguaguccaugccggcuauaccagcaccugaaagguugaggcaggaggaucagaaguuaaagaucacccucaggcuauuuagugaguuccaggucuuucaggaguacaugaaacccuaucucaauaauaacaacaacaauaauaaugauaauaauaaugacugcucaauguaauggcccaugccuuuaaucgcagugcuugagaggcagaaguaaguagaucuuugacuuuuaaacaagcccaaucuacacaguacuccaggccagccagggcuacauagugagacccugucucaaaauaagugguccuuuuuucauaucacaaaaaagcacgaugaaaaguaaagagaacauuagcuuaaguauuccuucugcuuuuguuuuaaaucaguuuuucucuugauaccaacuuuaauuuccuugucaccauuugcuaggaauuuagccagagcuucauacgguucuaccagagccauaccaccaguccuuagauuucuuuuagagccauuucuccagcccaucuuacuacaugguuaaauaaaccucacguuuguacuucacucucacaugguacugucuugcucuugcuccuccauuuuagacacacuaaggaagcaucucuuacuaugcuugucauagaaugccuuuucugggcauuagauuuucuggggcuggggcucaaguggcagaacacuuauggcauuuagaaauuuuauucuaggcuuacaaaaacagaucaagucccaaaaauucuuugguaggucauuaacaucugaaaagauggacccuuaauugacuacagcauauccugugucuagacugaagaagggucuuggauaugaccacagcaggccagaugcccuagaguccgcccacucaacaagauucagaacagcugguacuggccacccuuccuaucaggcucauuacuuucuuggguaugagcaaagagagugcccuacauacagugaaugcaaaaauauccauguccagugucaaggcuuuaaggucaagaggaucaacuaaaaauuuaaaaaagcaucguuucuaaaaauugcagugaaaacuaaaauucacucuguucuuacugaccugaucucguauccucuguuuaaugauaucuucuagauggaggguggucuccucugugauuacaggggcuaaaagaagcauaucauguuuguuagaaaaacuacauaucagaccaggaauucucaaauccuuauuggacccacaacauaagcaguaccugugaacuuacuaaagaaacaaaaucucaggccaaccuuacaccuucuaaaucagacaguggagaacuacucaguguuuuguuuguaagccuacacccugcacaguucacugaauuguucacaguugaaguaaaaacccuggcuaugucaucaaguucuuguagcauuaaguucaaagcugggagugggggcgcacgccuuucaugccagcacuggagaggcagaggcaggcagaucucugagcucaaggccagccugguucacagaaacccuguuuugaagaaaaagaaaaaagaaaaaauagaaaagaaaaauucuguguguguaugugugucuaggcuggccucaaacuagccaaguaaccugaggaugacuuugcagaucuguggaacucugaaacuuuugccucaaucucucaaguacuacgcuaggccaccaugcauuguuucugugguacauggauucauauccaggaauucaaacauucuaggcaagcauuccaccaacugaacuguaucuguaggcucaucugggauuuaacaagccuucugauguuccuccaaguuuaagaaccauaaaacguaaauggaucugguaaaugauagcacuucuaucccaaugcccuaggacacccuccuuagcaguuaagugccaagauauuggcagcuuuccuucugugugagugagcacaugagcacacauguguauguuuuacggaggccagaggucaacacuggguaccuugcuggaaugccuuccaccuuaucuuuuagacagggucucuaacugaaccuaugacaugaauucuaccaaacagcuggucuccagccguccccccaucacugccuucucagcacuagaaucacgggagcuuuuugguggggaauggggaucccaauuuagguccacauguuugcagagcaaguaauuuaccaacuggaacaccuccccaacucuaacaauuacuuuuuaaugaugaagagcacauacaaucacaaagaugcacaggagaccaaaggccaagauuucaaccuguuaccaacugcugaauucaguuaaauggcacagguauucaccgcacuauuuuuucaacucguauguuagcaaguuuuuaaaacaagcagaggaaaaaaaacgaucagcacucaaaaucuuucugaaaggaacuacagaaaagcacaaaaguagacaugcuguagaagcucagcagacaccauacccauccugacugcauggucaaaguggagggucucuuccagcaggcuguucucuggccgcuucugcgcugucacuuccccuugaagcugccaaggcuuuuuauccaauaacucuuuuuccaaagaugcgauuuucucauucaucuaggacacgagccaggaguuaguugcgaugcugugcuuacugaggugcuaagcucccuaggagcaccgugguuuacuuggggacucuguucugcucaaaugaccuacaucuucacaagccacugguaugcugcauuaucacaacuuccuaaaguaauuuuuuuugccuggaauauuaguuuugauggagacuggcucuugacuccacagccaauuuucucauuucuacuccacaacagacauuuucaaagacaucaacagacacagugcaacuugaucuuacagaaucuuccuguuugucuacucguccuucugcucaccuguuaggucugaagugguucuuauucugcaaauaacaaguguuuacuuucaccuuauccuuuguuucuuuacugacaaguccaaaauagaaguuaggugacaguggggacuguaacguggacacuuuguccuauucuuauuaaagcaauguuucuagaaucuagccaauaaccaugauggcagcuugugaccugaugaauuuguaguucacugaauacaaaaaggaauaaaauuuggucagaucucccugacuuaucugcagcugaucauguuuuacucaaaugaucuaaaucucuacaacaagaauuaugcuugauucccuaaaacugaauuaaaagaaugagguccaucugacuuuguggcaaugcucucaccaaauucuuuuagauucuugcuuuaguacucaacaaugacacucaagacaauguggauacuuacaugcugagccagacuuagucccauuuauaaacacugcuuuacucuuuacaugugguuaucaacuaaacauuaauuacuuauuccucaaaggucuguauaauuccucugugaaaccaaguauuuuuugggauguggggagaagugaugugggaagacauuaagguagcaacacauuauaaagcuauuuccuuuagaccgucuacaucuucuagggacaaggugacaaucguggacuucaaauugccuuugaaaaauaauucuuuagguaauuguaguauuucaguuucuacuugcucucacuucugugugauguaacuuuaagaugaauuaaugacagaaccaaaggacaagggcuaaacuaaaguuauuacaaccaguuacauauuaucugccugguacucaauagagagacaccuccuagagcagcucacauaguuaaaagaaggucacgggauggcuaagcagaagcucacacaaacaggaaaacaagaacagagaaacagagaauuuacaaagcaggcuccaaaugaaggcuacuggcuagaacauggagguacuaacuuaugcagauuacaggguguucuucaugagguaucuauguacagcauauagagcacuguuacuauuauuauuucuacuuuaugagagaaagucagcuacaguucgcuacucacuauguagcccaaauucgcccugaacuugacauaaucuuccugucucagauuuccaaauguuggauuuaaaggaauacuccauaauaccuagcucgguaugcagaaccuuuagaaagcaaggucuuugcuuuuaaaaggauagguuaguuguuugagcuccuaccauguuaaacauacaauauuccuaauaauuaccuucuccugucuuuuuucaaaagaggauuuaacuucgucagauucuugcuuuacagcuaagggacuuguaucuucagccucaucaucuggcaaagcaaaugucacucuuuucaagcugccuuuauguugaucacuauucucaucuucuuccaagucauuaucuucaucccuauaauaccaagauggaucaaagaaaaaauagaagcuacuagaaacucaaagauaaauaucccaauuauaaaguacuucuuaauacccaaugacagucaacagcaaacucucagggucacuaagucucuauggagcaaaagacacucuuuguuuuuuuuaauuuuuauuauuauucugcauacaugacauguauggguauaugcguagcccacaauguagaggucagagaacaauuucagugagcauagaggaucaacuuuucugaucacucagguuccaaggcucacacagcaaguccuuuuaucugaugagccaucucacuggcccaaaaggaagauuuuuuucuuucuuucuuucuuucuuuuuugguuuuaguuuuuuguuuuuguuuuuaaacagggucucuauguagcucuggcugucuucaaacucuccaggucaacuaagcuggacuaaaacucauagagauccaccucuaccuuccaaaugcuaugacuaaagcuguccauuaugauuaaagguguacaaaauuauaccuggcuaagaaagauaugcuuuaggugaaaugcuugcuaugugaaaacaggaaaaaaagcacuaauacaccaaauccacaccauacucccuuagaaaaauaacccugggagcuggagagauggcuaagaacaugaggaucagguuccagaagacacaugguggcucacaacugucugguggcucuguaucuccagcuccaggggaucugacacccuauucuggccuuugcagucaccacacauacaugugguguauagacauacauguaaaaaaaccacucauacacauacauuuuaaauacuuuaaaaaaauguuuuauuggcacaaaacccaaugcaagcuccuucuuuauaauauaaaggacaagcuggguaguggcuacacacaucuuuaaucccagcacucaggaggcagaggcucugugaauuuggggcuauccugcucuauagaacgaguuacaggacuucuagggcuaaacaagaaacaaacaaacaaacaaauagcugcuacugguggugcaaauuuuauucuuuaaaugaucuucaauguucuuugaaauucagagacauuuucuaacugucugauagcagagaacccuuuacuagauuuggaaguuaacuuguuauguaucugacaaccugagaaauaccuuacagcucugacuggaucacuccugcuuagaaacucaagaagaauuugaaaugcucacgugucagagaugcuuucgucugcuuccucagcgaacccuuccucuuccucuuucucuucgucugggcccagcucuucaucaaccccaguuauguccucgucacuuucaacuggaucaaagaagucuuuguauuucagauuucugcuacuuuuauuugacuaaaauaaaaaacauuuuugaaaaguuuaaagauaaaaaaauauauaaacauacucaugugccuauguauauuacacacacaaacugguuccuaacaucaccacuaccccaccagaaauaguuauuagggaaacuggcaacuaguugaccaccauaaaaccauaaggacaacugaagcacaacuuagcaaaggcuggcuuugagaagccacaaucuuccugccucagccucccacuucugaggauuacuacacuccugcaccacuggcucagcucuuaauuuuaauuuauuucuuuauguuuguuuguuuuuuccuuacuucauuugggcucaaaugaggucugaggcacauuacauuucucuguaggaaaacaugacuuguacuuuaaagaaacaguuuuuguuuuuuuccaaaacauuaccuuaaucuucugccgcccaaacagcccucccucgcuuucaucugaaucaaugucuucaaaaaggucaaugucuuccucguccuccucuucaccaucuggucuuuuuuccucuucuuuuucuacuuuuucuaagaagcucuccauuucagacaguuugaagaacuuaucaucuacgacagacuuuucucuugguuuuccagguggcuugauuugcaucuuggucugcugcuccaauuugccaauaucaaagucaaggucagaaucuucaucacugaaaacuggacuuuuccuugggucagauuuccuggagcuuuuggcucugucccucccuuuaggaacaucaccacccucgucugacaguuguucuucauccaagucugucucuagguucuccugguugucagccuccaccucugaggcauccucuucgcacuccucaucuucacauucugggagaaggcugauaucuucauccucaacugucucacuaacugcauucuggaaguauuguaagacagguucauuuugcaauucgaguuguugccaaaucugcucaucaucaaaacuguuuaucucaaguuucuguaaaggacuuccagagauucggccauucucuaauacuuuauuaaaaucauauagaacuuuuguuaaagaugugaaguuugaugcuaguccauucugaauucuauuggaaagaaaauuaagugagaaugaauuauacacaauagcaucaagcauuuuuaaauaaaagaaaaagacauaucguauuugcaaauuaaaauguaaaugaagcaucaauuuuaaguacagacucuaguucccaacaguacccugcugaugagccagaccguaaaaacuaaaaaccugacuuugcuguauauacugaagcuuacgcaucuacuugccuggagauacccaggaagucagccuuaaauccucaaaucugcaucauacauacuccucaccuauuagucguuuggcaagugauucccaccuggcuuuaagcuugagaaaaauuaucuaaggauaugauaucugaaaugggauugagaccuacagguaaaauagaguauccuguacagauguggaaacacauaacucugguuuucagacaaugugaagaacagaaagaccaagacagcuguagugugacugaggaggcagaguguacggcugagguuauagaagcuggggggggggggguggcaagacagaaaccacgcagaguucuaagacaggaacacuuuaagcguaaugagaacagaguugcaggcugaaguuugaaaugauaauuuacaauguggaaacaaaaagcacgauagaguugaguuguuagaaagcugaugaagcaucgcaaaggauuuuuauguuggagacgcagucaguaugacaacuaggaaucagugucuaaauauagcguaggcaggaugcuaaaggggauagagaaaauaggacagagaaaaaugaaagcaucaaggaagcagacuagcugaaucuaaauaaaugaaaugauagaacugccuuuucguggggccguaaacguaauggaaacagggaaaugacuucaggggagagaagaguacaggaggggguaaggagcucuauuuuggacacaaugagucugugauacuguugcuaagauuuucauuauaagucagagucauacgcaaacuuuauaugccccaguacaggggaaugccagggccaaaaaauggggaauggguggguagggaaguaguggggaggguaugggggacuuuugggauagcauucuaaauguaacugaggaaaauacguaauaauaaaaaauauuuaaaaaauaauaagucagagucauaauuuuacagaacuuaaucaaagugcugggaagaaagaagucucuccuauuuuuuuuaaauuuauuuuucuuuccuacaaagcaucccaauugcagccucuucucccuccucaccuccuccagauccacaguacuccuccguuucucuucagaaaaaguaggcuuccagagauaucaaccaaacacaaccccucauuucaaggcaauccggcagggguacaagagcuccaagagccuacugccacugcuacaaguuccacaaaaaucccaagcuuaacaaucacaauauauaugcagaggacccagcgcuaaccagcgcaggcuccuugauagccaguaaagucucugugggccccucccugagcccugguuaguggauucugugggccauguucuugugguguccugggaccccuauggcuccuacagucaccccuccucccucuucugcgggcuucuccgagcuucgucuacugucuggcugugggucuccaccacaagucaugaaaaugcauugacaagcaacaaguacguacuuucaguguguauuuuggggacaaauucagaaagcauauuccgcccucaaugagccucucuggacgcgaauaacugggcuuagugcaauagcccacaacuaggaaaucugcaccgagccgcuuuuacuuuuagcauuuugacaggccaacggagcaaaaacugucugaaguuggggcuaagcgaccuguacuuucccuuccuggcuuucagaaguugccauaugcuggcccgcccagcaccggugagaugcgcgcugcucucucccagaccuggaucuguacuuacgugaggaaacacuccggucgguugguggcuuuccugauuucccucagacaccguuccagagucugucgacgaaacacgcgaggcgccauagcuacacacuacggcaccacgcgagugcugcgagccggccggccggccggaagcaguacgccaaacacacgccu

SEQ ID NO: 3862 - RNA, 1453 nt, Mus musculus
ucaauugagguuucuucaaaugaggcugagcuuaauucgaccuauuuacaaagcacauucuauuaaauauaacugcauguauaauauuuguguuuuguuuuuuauuuauuuuauauaaauuuauauugaccaaaucuuuuauucgaaauguuauuuugaagcuagauauggugacucacaccucuauggcagcuucugggaaaaccgaggcaagaggaccaaccacuuggggucuaguuuaacauagagagaccuugucucaaaacaaacaaacacacacacacaaaaaaaacccacaaguaauauuucacuuuaguacagugguaguccauuuauacaugcaaggccuugaguucaaucccuagggcugaaaaauaguaauugugaauaauuguauuccuacauuuacauaugaauauugccaaauaagacuuuaaaauguaauaauuuuacaaagcaguguacuacugagaagagaagaaaucacaaguuuuaaugcuuaacuggauagcuagauacuaaugcaggacauguccuuguucuaggcuaaucagcacuagacaggaaauaauucacuaaucauaccgcagaggcaggccaucagaugguaguuacuagaggcugucugcggaaggggggaugggaggauagaguuucaaauuugcaagacgaaaauuauccuaguuguuaguuggcugugaugauggcucaacaacaaugugaacugaagcacacacuuaaaaaauagugagguaaaagugacaugcacacuggaccgcaauuacacucuuccauauaagaaguucauaguuauucaacuaauacaagcuaaaacagucacuggacaguggugggggcaggggagacugcucuaggugcuacauaaaggggcagucaaucuuuggcuuugcuuucagcagaucgaugacagaaaucuuccuccaagcaggaugucaacaccaggauccauucugcauuccccucucacagugccucuccucccauguuaacacucugauguugaggugccucgugcaagcaaugucaaaagaaaucugcuaucugccaagcagaggagcaaacugagaaagagcugugcgugcccccgcuuagccaggcaagaggauucugguaagagguggcugucugcaccagcgauacauggugcagaaucuggacuucaacugaaacaucugacuaucccguuaaacacagucaacaagcuuacauugcaauaagcacuaaaacuaggcauuacuggauggacagacggcugccuuucacguggcuaaguucugaaguuaaauaagcaucaggucuuuggggaagaucguaacgcauuuacgucaggauagguugaugagaccaacucauccacaauaaggaccaucacugaacauuuuccaacgcuaaguuccagcuggcuuuccugaacagcuguuuaauuuccaca

SEQ ID NO: 3863 - RNA, 30488 nt, Mus musculus
cuuggcacugugagaggccagggauggucacuggugaagguguagccucaguuggaguugauggcccagggcugaaggggucaccacuacauaaacucacuccaauaauccuagcacaugaagauggaggcaggagagugagcuguucaaguuccuucucaggucagucauuccaugacucagcagguaagagaguguguacagcucuuucagaggaccagaguucagaucccagcaaccacguguaaccccgacuucagaguaucuggcaccucuggccuuuguggguaucugcacucaugugcccaaaaccacagagauauaacaaauaauuucuaaaaguauuuuuaagaguguuuucugcucaugcugaggaccagggguugacuucuagcacacauguccaaaggaucacaacggccagcuccagggaauuuuaggcugaagccuccccugcaccuauacacaggugggcauguacauuaauuaguaagcuaugauuuaaaaaaaauacgcauaugauuucgugcauuuaaggcuuggcacugugagaggccagggauggucacuagugaaggugcagccucaguuggaguugauggccuagggcugaaggggucaucacguauacacaggugggcauguacauuaauuaguaagcuaugauuuaaaaaaauaugcacaugauuuugugcauuuaagccuuuggagacagaggccaaggcucugcagguauauuguauucacuguggggcacucaucacauggcaauuucugauauguguauuccccugcacuucguaugaauuuuuuugguguuguuuguuugcuugagauagaguuucucuguguaucccugguuguucuggaacuggcucuguaggcgaggauggccucuaucuccgagauccaccuccuucugucuccaaacugcuaggauuaaaggcauucuccaucacagcuagucaauaugaauaucacuuaugguuuauuuuauuuguguguguguguguguguuugcgguugccggugucugaggaggcuagaaauggacggcaaauccccugaggcugaaguuacaagcaguugucagguguccagacggauauuggaaugccaacucaaguccguuacaaaaguugcaagugcucuuaaccucuaagccaccugaccagcgcuuugguaugaacaccuaaaugucuacaggcuacaaguucacccucaagcuuuaaggugacuguaccaggucagaaggguucuguuuuaaggcaauccagccuacggguccugccccuuaccugcggaagcccaaguuagacauuuaggaacuugacuuucaggagacuucacagucuccgccccuuguuggguggagaagggagaguagucccaacuaccccucccuugagguucacugacgugagacagagcaucccucgcguguucuuaucuuuuggauuaaaaaaacuggaaucugggcuccccacacucccaggcacgcucaagcccagaacccagaagcaaagacacgggggcuacgucuucgauugcuuuagccuggcggucgagcugcgcggggauacgauuggugcugucuggcggcgaggcgcggugcacugugggacacggcacuggcgggaggcgcaggcuggugucggaggugaggguccgcgggcugcgacaggauggugaagcugacggcggagcugaucgagcaggcggcgcaguacacaaaugccguacgggaccgugaacuggaccuccggggugaguuagacggagcgcgggcuguguuccggccccggcgcguggcugcgggaaaccagccccgccgcgugcgcagaggcuggagccuggcccgugggccuccacccgggcugggcgccuccgauccaccgucccgcagggcccuuuggggcuguuuguuaccggcguuccggcuagcaaacacggcgccucgauuccuuccccggaccguacucacuaggcauugccccgcucaucgagcagcuuuaacuguuggaggacuaggaaaauagaaaacgcuacggacaggccggcugcuggcugguguuuuuuguuuguuuguuuguuuguuuguuuguuuguuuuuuagcaaaagcguuaauguggcaccugaggguaggguggauauguaccagaguuaccuuaauugccccaauaauuccgguuugguuuuguucauuuguuuuugagacaacgucucguguauuccgagcugacuucaaaccguuauauaguuaagguuuaucucgaacuucggacccucuugccuccacuuccugggagcuggguuuaaaugccugcaccacguuuauauggugcuuuggaugagcccaggguuucaugucugucaggaaagcacucgcgcuacugagccagacccgcagccccggauaauuugguguuuucaagauugagcuguuugaccguggcauaauggucacuucugugugugggguggcggaacucaccuguucaguucugacagaaguagcacuugauuuuuaaaacauagaacugagagguaaucguuaacuauucaggagauggcuuuggaagggguuaagauuauaagacugugaccagaggcaaucaaagucucgggggcgcugugcacugccauuuuugaaaguuucuuccugccuaugggaaauccuaguguucuuuguguuuguugaaugaaauuaacuuucuuggagaaaaguccgguucaggagcaucuggguccuuucacugucuuggcacaguuuugaugucugcugucucucugaaaaccgugcagucuggagaaugcuuauucugcuaccauaucuuuuauugcacuccuucacagcuggguuguguccuuccuuauaguaccuagcucagugacgaaugugaauaccucauagacguucuuaauaaaccaugggcaccaauacuaguaaauaugcccaucuguucuuccucuugccuucagccucuucaguuuuacuucaagcuuuguagcacuaaggccuccacuuaacccuuucgucauuuaccuuauuuuuguucagugcacggcauggugcuagugccugguuaauacuucccgaaugggagcgcugagucaaauuccaucacauacuccugcgauuuucaggacuuuucauuuauauuaauauuuguuguauguauguuuucccucuacaggauauaaaauuccgguuauugagaaucugggugccaccuuagaccaguuugaugcuauugauuuuucugacaaugagauccggaaacuggacgguuucccuuuguugagaagacugaaaacauuauuagugaacaacaacagaauuuggugagugacugcuagugagaauacuuucuucccuuaaguaaguguucuaauguacccugaagauaaugggguuuugguuguuguuuuguuuuguuuuaauguauauuaguuuuuugcuugcagguaccacacacccuccuagugccucuggaggccagaggagggccuuggcuucucuggagcuagguuuacagauaguccugagcugcuccagcuguaggaauagaaucuggguccucuggaagaucagccagggcucuaaguugcugagccaccacuccagccugcccaugugucuuaaagggagaaaugaauagagcccuuuuccuaagagguuggagauuaacuugggcauuggccugaccuuacuugcuacucuucagaaaucuuuaauauucguaacugacauuaaacuuugaauuugaagcauugugcuaugucaacaaaucagauuuuagaguagucaucaauagcaucauaauuaaaaagauuuauaaaggccauguguagugguaucugccuuuaauccuaacacucuggagucugaggcaggcugaucucugaguucaaggacagccuuguugacagcaaauuccagccagggcuacauagugagacccugucacaguaaaaaucuuuuuaugaaauaaaguuacuuuucacugaguaccuauaccucauccacuaugcugguuuugguuuuuguaguugguuucuacaauauaauucugugaaauuaagaucauauuuguuuguaugagugggguuucucugugagcccuggcuguccuggaacucacucuguagaccaggcuggccucaaacucagagaucugccucccuuugccuucugagugcuaggaucaaaggcgugcacuaccaccacccugauggcaaagcuuucauuaagaaaaggaccauuggcuggagauaggacucuaguuaacagcacuggcugcugcuuuuccaagaccagcguggcagcuugaaacucuaguuccagggaauucaaggcccuuuucugacuuccacaggagccaagcacguaguugcuaugcggcauaagugcauacacccauacacauaaaagcacugaguaguguuuuuagggagaagccacuuucaugauuaaacauuuucucugaugaaugucuuaccccaguucucuaaauccaaaauuauuggguuuugaguuuucugaacaagaaauuguaaauuggcuaaguaguuuuuuccuaccccggagucucaccuucccuuggguugcacuagacuacucggcagugaaaagcucagaaggcauggguuucugaggucaucccaucccugucacugacccugugccucagacaagacucccucuuggguacuuucccugagauggaaugugggagauggguauucuaucacugaagcguuaauacucgaaaagauggagaaauauuagcuuauuuaacuuuuguuuucacugagagccucucuauuuuuauuuuagccguauaggugagggacuugaccaggcucuucccugucugacagagcucauccucaccaacaacagucuaguggaacugguaaguagaauggagaaagcucuuuaaggggcaagguuaaggauucuuccuacuauggaaaauuaccuccuacuuccucuuuaaguuuuguccuaauuaucuuacuacuuaagccuuuauuuauuuauuuauuuauuuauucauuuauuuauuuauuuauuuauuuaugguuguguugguuucauugguuuucugggaauuggcaaggcgucuggauauuuggaguaaauguuccagaucucuuugcccacucaggucugccuuuugaguuuugauucugcuggguaucuugguaggagaguuuacauuaggcaaucuaguuugucagucacuauuagcacuucugauguucuguugaaacuccccuuccccuuucauggauuaacaaauucccauguuugcagaauugaaguguucaguaugguaguaauaaaaaugaacgcagcagugaguuugcucuucugcucugugcucccggcgguugcgcuuccaggcucccaccaggaacuuuggauucgagaaugaaagacacacacacucaacguuagcuuacuuuugaaaugccuugguuagcucaaaggcugagcagugcuaauccucugccugacuaucauagauuucccuccaguacuccugacucaacguccucuaaaucuaugaucuaucuuugcugucguguuccuucagggcaucccccuggucuuugcugcccaggacacuucugggcagcccuucccggggcccaauuccuucucaccuacauuuuggaugauuuuccuucugcagcucuaaaucugaucugacucccucugaaaccugcugauucuccucucuucucucuuugguguccaaaccuaaggggucuaccccaucucccuuugcccagccauuggcagcuggcaucuuuauugaucgaucaaaaaacaaauggggacaagaaccuucagcguuuggacaggcagauuccugauuaaaucaaaacauuagaaccaaucccuaacaaaugaagguguuaacuuucuuaguggcuuuuuaugucauagugcauugauauuuuggauaagagguuaaauuucauuuuaucuguuucucuguauuaacauagcuacuugcaaguucuacaauugcccaagucucauggcauaguuuaaagugcuuacuaccuaagcacgaagaccuggguucuaaccccaggaucuguacaaacaagcaagcaagcacgcugggcauaauggggagggagagcuagauccuugcggcucacuggucagccagccuaacuuauacacacacacacacaugcauacauauaucugcugaaagagauauaguaagauuuuauguaugauaauagauucaauugccugucuggaguuuugucaguuuuagaucucuuaauacauacaaguuuuaaauuuguuaguauuuccagaaacuaaaccuuuugaguaacuuuuuuugugaccucucuguguuaacacuguuugaccuugagguuuauaucauguaauauaauaaaccccaaacaagcuauuuuugguuaacugcuuccaugacaaauuguuuucuauccagaacuaacuuucaucuuuguugucuccuaaaaccugcagguaggauucuguuuuuaauuuuuagauuuuuuuaaaaauaacuuacuuaauuucauuuuauguguaggguauuuugucugcauuccugucugugugagagugucagauccuagacaccuguaagccgucaugugaaugcugggaauugaaccccagcccucuggaaaagcagccagugcucuuaagcacugagccaucucucuagccccaaguuuuagauuuauuuuauguguaugaguguauggccugcacauauguauguguaccacguguaugccuggcacccaugcagcucaaaaggacaucaaguccccuaaaacuggagcuauggaugccugugcugccaaccucagcucuuuaaaagaaccucuaagccaucucuccagcaccaguguuucgauuuuuaaauccacuguuaaguuugucucugaacugcauugccuauauccuguuuacauuuagugcugcuggcgcaucacaguugucuuuugaggggagccuucucugucauccauuuguuuuuuaaaauuguguuuguauauauaugcacugucucuuucugccauuccauucuuccuucaaauggcauagaauuuauuugcucuaucgaucucuauucuuagcaacuucaucaguuuaaagucaaccuuuacucuucucaacaauuauucuuuuuuaauauaauauuuuuauucuuugaaauuuuaauaccuguauacaguaaguuucagucauauuuaccuccaguuccgcccauaucugcccacaucuucucacaacuucauuuccucccucuuuuggugagaugggaucuuuucuguaauucuggaacucauauucuccugccucuaccuccugaucaguuuuuuuaaacccaccaaguccuuugugcuggucuuauauuugggccuggagccucuuacaggagaauggccaaccuaccaggagccacacccuaacuaccauccauucugcaaagaaacuucucugaugagguccaggagcuguaaucuguggggauagaugcauauauagagaguagugugaugcuauguccacuuaccaaaagaguaaugguaguucaucccuagggccuaugagcuccuccaccauggguuccuagccagauuuauuguacggggcaugcauuucuuucuguggagcugggucuuaaaucagaaaaguguaacauuugugccaccacugcacucaugggugugucuugucacauggucauuacugagcugacagugcccacaacuggauaagacugcugguggcgucccccagcaaccuucaguacuaugaaagcuagcccgcugagagggagcuuccugcucaguacccacuugauuucuccuagccagugacaaaaguguuugcugccuucaccaguacguucuuaccagcacauuuucugguaagcagucuacgaucaaccauuagccuguauuguguuuugagguagucccuuaacugugucacccacacugacuuucaacuccauauguagccuaugcuggcuuuaacucauucuagucuuccugacuuagccucccaaaugcugggauugcaggugugagccaggacaccucgcuuuaaagccagugcucuaccaucacauagcugggguguagccagucccagcagggcgccucuggugauuguagaaucaaaaauuaucuaggaccuuucagacaccaggaaagcuccccuccccuacuacuaagcgacauucuuaaccagauggucaugcugucauuguguucucgugagugagugagugagugagagagagagagagagugagagagagagaguguguguguauguguguguguguguguguguguguguguguguguguguaaaacagacacuuggauucuuucugugguaguaggccaguuuucaagcucuaucaagcucuagcacucccucugaucauguaaagauaguuguuugcuuucugagaacuccguucucugucauugccuuuugaaguugugaaccacuucacaaagguacacauccauuuacaaggccacacugaccucuguauccuuccaguuuggugugugugcuguagaagugaguacuccugcuuucaccugugcuguuucccuccugaguuacuuaauuuaguuuuauuccaaauuuuuacuuaguguaagaauuuguccuagaagggacacaguuugagcacccaggauauguaucucugugugugugugugugugucuuaguuaggguuuuacugcugugaacagacaucaugacaaaugcaacucuuaugaauauaacauuuaauuggggcuggcuuacagguucagagguucaguucaguaucaucaaggugggaucauggcagcguccaggcagucaugguccaggaggaguugagaguucuacaucuccauuugaaggcuucuagcaggauacugacuuccaggcagcuaggaugagggucuuaaagcccacucccacaauaacacaccuauuccagcagggccacaccuccuaauagugccacccaacccccccaggcugagcauauacaaaccaucgcaauauauauagcaagacuuuguuccaaaugggaggagaggugacaagcaugaggacccacauuugcuauagccccaucacauacccuaacuggaucucccuguacuuauuauuggaacaugcagauccuuggguaacugcucaaacugaacaccuguugguuauuauggaguucucugguuucucauagccuuccugccuucacugugcaaguccuguagcugguaucccuaacuauuccuacucugagaugucuaggaaauaccuugucuggcucaauuauagcuuuugauggugaguuuuuagaaaugcuauuuuuguuucaucaugguuuccaggacaauuugggaaaagcugagaauaucccuggcuggccugaacucacuacauagaauaaauaggcuggccucaaacucacugagucuugucugucucugccucccuaguucugggauaaagacaugugccaccaugauuggcauccauaauuuuuugaaccauacuauucaccuugucuuugaagauauuugaagagaugggggcagaggugggcuaggaugacaggaccuuuucaaagacaauaaauauacucucugaggccacuugggauauacuaauaagaaaagacauucugcaccagguguggcagcauauacccauaauuccugcauuugggaggaucagaauuguagaccauccuaggcugcacaaguucaaggccagcccaggcuauaggagauucugucucaaacaacaaaaaacccacauuagaccaagaucuuggcuugagguugcuguguaaauagcuugcuccgaguaagucacugguguuggcauuggcuucauguuugagcuuaguagccauguugagauugcuguugauaaucaaaccuuuuugucuuauguugaagcagauguuguuacuaccaaaccuuaaggaagcuagaauauauuuaaucaguucauuagguagaagauauuuaagcaguuguguuguauuaauaauggaauaggugccagagcaauaaauaaauaaauaaauaaaagguagauacuugcuucaaagauacuugucauuucaaacuaucagguaguaguguguccgucagccccguucuuacugugacuuucauuuuauagggugaucuggacccguuggcaucucucaaaucacugacauaucuaagguauggaaauuacuugcgaugaugugacuguaguucugaaauaacaccuucaggcugcuaauaaacagcucuucccugggugguaugugcuacccugacaguaaagugggaagagugaaugcuggcuccugauuuaaagucauugcaccuucaggugacccccaccuuacauggacugcaguaagguuagaacugucccuuuucuuacagcauccuaagaaacccuguaaccaauaagaagcauuaucgacuuuaugugauuuauaaaguuccacaagucagaguacuggacuuucagaaagugaaacucaaagugaguauugcgcacugcugugaggcauuccagaauuguccuuuacauucauugccagaaaacuugcuuaguaagucaauuuuguuguuacuuugaaacuuaaccugugggaaagaaaacauuuaauuuggguuguuuguuaauguuuuuguggagugguucuuuuucaguguuuuguuuuguucucuuagcaguuuaugguagggcuuuguuggccauuccaaaguuggccaaacuuuguaguugacccccacagugaauugucagcuuagauguauuuccaacugggagcgaacuauaacccugcugugagcagcucugccuguuggaauggccuuuccauguuggacgugcuucuucuucucugcagucucuugggaaugaaucccucuuugaaaccaggagggcgagcuuuuuaacaacuuugcccaagaauguuggaccacugugucuucuaauuuaaaguuggcuuuugguguuuuuaccaacccagaauacuucaggagaauucucuuccauguuuucugaggaaugcaucuaaaugcauaugguauuccuauuucaauuaacucugugugugguguugcuguaggagcgucaggaagcagagaaaauguucaagggcaaacggggugcacagcuugcaaaggauauugccaggagaagcaaaacguaagauacggauauccaacuuaacucuacuucaccuucagaaacacugucugacagauugccuccuacaaaauuaaacccaaaacugugguuagucugguauuacauuugaaugauggugccugaccauuuauggucugcauaucaugggaaauuucuaccugguuaacagagcauaucuuucgguuuacagucuuaauugugauguuaaacauccugcuuucucuauaggaagauaaauugggugguguuucugaaggagagaguucuuguaucaguuuguuaacaaagauaagauacuacacugguugaauuacuuucaaaagcuuuugaaaguaagagaagcagcuugccccuuucagaauguaacaauuauauucucccuccccaguuuuaauccaggugcugguuugccaacugacaaaaagaaaggcgggccgucugcaggggauguggaagcaaucaaggugaggauguguugggguuguggggccgacggugguguguccugguacuaagccuuguagagcccucuuccuguaguccuuaggaugcugguguuucuaguucaggaaaaacuuccuuaaaacuacucuuugcacagacuuugauuugaaauaauugauaaaguaguuuaaggcaucugugugccucuccuuuccccaggacccauucacuucuucgagcaguuaaguaccuuggugugcagucugggaguuuguuuuagugucuuugcuuuccaagauuugcuggcugacaguucugguuggaauauagguagggaggcuaaagugcccaguaacaggguugcagacagauccuuagcuuuuuaaagggcaugggaaaugauugcgucuucuccuuuccuucuaacuaugggaaugcacagccuguucucuagguugauuugcaguaugcccgugaaguccucccaugacacggagcugugugcugcuggacacugugugggaaaguugcuugggguuucugcagugcuuguccucauccaucuccgcuucccugugucuucuagaaugccaucgcaaacgcgucgacgcuggcugagguugagaggcugaagggcuugcugcagucgggccagauaccuggcagagagcgcagaucaggucagaaagcuguugucugaacuugugaaacaucacacucagugauuacacaguacuaccugacuggcauaaugauacagacccauaauccccgaauucaggagguuaagccgagagggucagaaguugaagggcauucuuggcuacaaauaaguuugagaccagcuugggcuacacaagacgcuuuuucaaaaaaaaagaaaaagacagcugggcgugguggcgcagcacucaggaggcagaggcaggcagauuucugaguucgaggccagccuggucuacaaagugagugccaggacagccaaggcuacacagagaaacccugucucgaaaaaccaaaaaaaaaaaaaaaaaaagaaaaagaacaaaggaaggaggcagggaggguccauaaagagaguuaagccacugggauauuuauuccgucuuuacaaguuguagcaaaacauauggacagaacuaaguucuagaggugacuaugugaacuucuaagucacauacuauauaauggacugguacccugcaucuacaguggcgauccuauaggguaacagcuucaaacccccucugccugguguuuuuacuguauguuuucuguguuucgcuauguauagaugcaaggcuacuuaacccuuuuuucagcucuaugcauuauugagaacauguugucuagguucauagauuagaaaaacacuugccuucagcagguagguuaauagcuucugccauuuagguuugugcaagugugcacccugucauguucaccuucacaaaauaucaaaaucuccagugaugaaaauuuuagaacauaaucccugcaaagcaagguauugcuguauaugguaauucagugguucagcacaggcuggauaaagagccugacagggcaucaaugggaggagaggccuugguccugugagggcucuaugccucaguguaggggaccaccagggccaggaagcgggagugaguggguuggugaacagggggauggaagguuuucggaagggaaaccaggaaaggggauaacauuugaaauguauuuaaagaaaauaucuaaaaaaauaaagagccugaccaguacuguucuugggcagguuucaucauuuaagguaaauaucuacaucuuuaaguuucagauaaguacugucauuaaagguuugcaggaggaccacuguguuugcuggguguuagcuagucuuucguuugaauaccaaauuugugucagcauguugagcacuagagauacgcuauucaaauaaaguaaacacguacaaauuuggguauggcaucccuggggugaccaaugccuuagucaggguuucuauuccugcacaaacaucaugaccaagaagcaaguuggggaggaaaggguuuauucagcuuacagguccacauugcuguucaucaccacaggaagccaggauugaacucaagcaggucaggaagcaggagccgaugcagaggccauggagggauguucuuuacuggcuugcuucccuggcuugcucagccugcucuauuauagaucuaagacuacuagcccagagauggucccacccacaaggggccuuucccccuugaucacuaauugagaaaaggccuuacaguuggaucucauggaggcauuuccucaacugaagcuccuuuuucugugauaacuuuagcuaugucaaguugacacaaaacuagccaauacaaccaccuugacagcuugccaagggucguuaucuuugagcuguuuuguuuuuuuaguauuugugacccacugaguuuagucaguugcuugcaugaguaugggguagggguauuggcuggagcaagggcaaccuacagugaguauccugcugaagaaaacggcucuuccuacgucagcagcuaucgguugucagucacuccucagggggaguggaugagauauuuuuuuaagaacugugguacuguguggucucugggccccuggggacaugaaagguagaauuauuuauguaguaacuccaagaaguuugcucuuugcuuugaguagcaucuacagugauggguuaaaccugcuaugcucagcaaggccgaggccugggacacuauguguucuucccugcuuccacuaugagugaauuuccgucagugucccgggugaaggauagaagugauuucuguagugcugaagauagagcuccguaauaaauggcauauuuaaguccuuggguucaauccucagcacccgacuauuuuauuaccaaugauaaaacugaggauuuuaaucagaaauucaaauuuggaaaacuuggacuggggauguaaauaugguagagcacuaccuaacacacaugaggcccuggguucaggcuucacuguuaauggaaagacaguuaaagaaaauauagguuggccaguauaauguuacaacauauguggggagaucagugggaaugcuaaugaaucaugaaacaacucagcauuugaaagguguacaaaacacagugaaggagcuugucuaagauacauucagaguacagguacagggcugcaggggaaaaggggaaggacuccuagaaaaauguucaacuucacuuugugagcugucuguaagaagcuaccaguauagccaaacaagccggguaacuuguaucuggaaaacugcaguuugcuuccaaguaauagacagacuugucaguaguuucucuaaacauuggaguaaggcaaaacuuuuugggguauggugcgguaugguguguguguguguguguuuguguuugugagugugugugugcgcgugcgagcaguuugagacaggaucucucuacauagcccuggcuguucuggaacucacuaucaccaggcucgauucaaacucagaucugccacaaaucuuggaacacaauuaacaacuaugugugcacaugcaugcauguugauguauauucauuuuuuaaucaauguguaugugagugaacaaauaauacaaaacuuacauaacuugaccuguguucuuucagggccgagugaugagggugaagaagagauagaagacgacacagucacaaauggguccugagcucugccagaugcucugauaagcucucuugggacaagucuugcauuuugagcauggaguaacaaccuugcuuguaucagcaacguggacucucagcuuugcugaauguucagaacgacuggugauaauuuuuuaauaggaaccuugaaauaacaaugccaguuuucuacaaaugguaaaauaaaggcgacuuacugugcugccggacugugugcuguguaucugcagugagauguaaggggauguuuaaguuagaaguuggagagagugguguuccggaauagacauuauucccacucaugaaauguuacagguucuucauaaagguaaggcaggaaggcuugaagacuagacaaauaggcauucuuugaccuuuuaaaucaacauacaugaauaucucacaaaucaauuuaaaaugauuugaaaaguuuuaaauagaaaauggggcuuuugcuugagcaaaaauaaucuuccagccucugggacagaggcacagaggccaugguuuuucuguggggcagguuaaggcacguuuuucucagcaucuaggcuucuuacuguauucuuuaucuagggaagauuuuguuguuaaauaccagugccucaguuucccuacucugccuuguugccuugagaacagugccucccacugagccucucacuugcagccugcaagucccagcaguccuaccucugccccacaguacuggguugcaggcacgaguguagacagacccagccuuuuaccuggguuguaggaauuugaacucagguacucaaguuugcauagcaugcauucuuaccugcuaagccauccuuccagccccugguuacaguguucaaacuccuucgaugauucugaaugugacaagcauguuagguugucucuggaugcuuuuuggugauugcugguaacauacaguucucauagaggcaaaugccagaugccuaagauacagcggaacuguggcuucugcugagccccagccuuaaauucaguucucucccaugcuggcucagcaucuccagugaggcuaccuguacugcuuccacagcccuucugugaaugcauagccccguugcugacaagaguacuuguuucuuuuggcuagggguguggcuugcuggcagucuuccucagacuacaagauccccaauaccaaagcaaaaacagauuuccugucuuccauugcuucauuuaugaguccucuuacuggaugaggagucuuggucaacaaucccaguuaugacaagccagugguugcucuguaauugcacaguuuuuacuaaaaguagcuucaugaaacccuggccuggacaugcacugaauuagucuggacugaaacuauuggcacuuagaugguuuaguauuugggguaagugagaaaaacaggacaccauugccucaugcaugccauugucccagucaaggacuuggcaaagcuagcuagaggcaaaugagguuuccuuucuuacgugucucaggacccagauaacugaugagguucaauucauuugaacuuucaaucuguguuuuuccuggagccuaacauuuucagggaauaguuuuguagaguaugaauuucauucaggcgaguauugucuguuacagcagaaguuuguaucaccugauaguugugcaacacuugcaagaauggacagauggaacuauguuacgaugcugauuugagguggacucauguagcccaggcacauaggaaacuggccugaaguccuaauccuaccuccacaucccaccagcugagauuacaggugucuccucaccugaccuugaauguuuccucucuagcauuuguauaacugguaaaugcccuacuuuugaagcuugcccuaauuaaauuaauggauaugauuaacaagacugccuagcugaaggcugaucccuggaaugggcaggacagaacagaucucuccauacaugugccugcauacauguaugugcaccacacaggagcuggaguuggagagauggcucaguguucacaggacuucucccaggggaccuggguuugguucuagcacuaacauggcagaucacaaccuucuguaacaguuccagggaggugugccuacauuccggcacacgagagcauuccuggaaaguggcagguccuuacugcuugagcaggacuggcauuuuauugccuucucugagcccaugagcuccccacacccuucauccuguguagcugcuuguuauauuggaaaacagcaauuuuggcaguuugccagcaggaaacaccaucuguuuccuuccauauugacucugcucuuuauuuuuaaugcuuuuauuacccuauauuaauuauauauaguaauggacuucauuacaugcccauaauguauuuuaauuguacacacacacaccuauuagccuccuuuguccuucagauggucucccucuuuccaauuaacuacccacuuucugugucuggcuuuaggguugauuauggaagcuugggcagccuuaccaauggcuacaccacugaacaaaacguuucuuaauccuccaucaacuaguaacuguaagucuuggggguggggcaggccccaguuagcaccuccucaucucagugguaggauguugaggagcccagucuugugcaaaucuugugacauucgugaugaacaaaacuaggcuuucuaugccuugaacaacuaacuaagcuauacucaaaacugauaacaggucugcuuacucuccauuaaccaaagcauuuaccuggcugaauacaguggauggggaaauucuaaccugaaggacauggcuauaagaagggcccagacaaggaugugacaguaagugacagguuagagccagacauugagucuacauagccaguggugggcguugugguuacuauucaccuuugcccuaguuuuccagguaacaucugagcuguucagguuaaguacagggaggcagcuaccacaugaaaugucaaaggcgucacaccugagaaguaggagcaggauugcaggaacugaaauuaaacccuaaaacccaugcacucaauucaaaauaccuuaaauuuuaguugaauauuauacuguguaucuaaguauguacacuggguuuguaaacaaaguuauuguugggugugugugucuauuuuuaaauuuggcuuugcuguuuggagagggggcuaacuacagagauaugccugccuuugucucccaugguuuugguuuuguuuuuugaggcaggcuuacacugccaaguguggccuuccuguugacaccaaagaugacucugaauuccugauccucuuaccaccaucucacaaaugcugggaugagagacauuugccacauacucggguuugcagugggggaccuuacaccuaggauucuguacgugcuaggcaaggaagcaccuggccaauugagauacaauccuacuccuacuuuguauguuuuaacauguuaucuuucugaauugcuaguuuccauguuagauugcaaaguuccaagcggaagagauuccuuggcuaagacuauguaaaauaaugauuucauuauuacacuguuuuaucuguguaucauguacuuugauccuauccauucaccucccuuuuuauugguuuuggguuuuugguuuuuuucaagauaggguuucucuguaguccugguuguccuggaauucacucuguagaucagguuggccuugaacucagaaauuugccugccucugccucccaagugcugggauuaaaggcaugguuuugguuuuuuaagacaggguuucucuguguagcccuggcuggaacucacccuguaaacagagcuggccucuaacucagggaucagccauccucugccuccugagugcugagauuaaaggagugagccagcaccuccucuuuuaaugaaacuaaccccucuuaaccagugugcggggauuaaaggcuuuuaaggcaagguuucucuguguagcccucacuguccugagcgucaaauucagagacucaccugugucugccugcugagugcugggguugaaggugugugccaacauuuccccuccaccuugucuuuuaaugaaacuaaacauuacuuauuucaucaucaugauugcagauguuaagggacuggaucaacaggcaaaugagcaaccuccucucucguaaccagauguuucacuugcucuguaugaugugagaaaucaccuuaagcaaagagagaggguucaaacuggccucagaggugggguggcagucaucgguaccaaaaaagaaaaaaaaauuaaacugauccuuuuuuaccacugagaaaacuauuaaaaucauaaaacuuuaaaaauuuagcaauuuuuuaaaaaagccauguugugucugaaaaaaaaaaucagcaaauucauggcuaucuucauauucuuagcuucauauccagucaucaaagucuauuuucaaggugguugauaaugugaagugacuccaggcuuuucucucccauguccccagauggagucgcugaauuagaagauccuuaacagacuaguuuuuaugacacagugaguuuuauuuccauuuuggagauucaaaguccucaagcuugguacagcaccguauagauuccaucaggcuccucaggcugagucaucucacgguggggugcacagaaaucuagucucuuuuucucuggggacacccacauugaccucauauaguaguuucccaaaggaucccaccuuuaaacaccacagaguucucaccuucuuaaucccauuaaucuauggaaacuugauuccaucaguuccuuuucaaaucgcagcuaucuccuuuauugccuuccuaguauguugcagagaaccauuacaaaaacugugguaauguaacacauaagagccuaaguugaagucauuacuacauuaauuccuucccuugagacaguggaucagaagaaaggaauucuaaguagaucgcuuuccgcacguuaggggaggggaaucuaugcugcaaaccuuuagggcccggugacaagggcgggacucaaaucucaucuccaggagguuucaaaucucuugagccucaauguccaaucaguaucaaauacaagaucgguuauccgagcuaugccgaguugagcugcgagcuccucccugaaagucaaacgcgcuuccgccugggcaucuuucagccccgcccucuggucacacccccccugugauuggucgagcgucgagguaggucgagccacgauaggucaguaccgccacggcagugagcgccacguguacauagggccgaaccggaagcgcagagcagagaggagcagcgggcuugucguugguggcgguggcgguggccgccauggaucgcgaugaggaaccucuguccgcgaggccggcgcuggagaccgagagccugcgauuccugcacgugacaggucaggggcggcgggcgccgccaugcucggugggucggccuccaggaggcuuggcguuaacgccgcggacuggccgagccugcuuguugggccggagcucaccuuucucgaagucgcccuagcugggcgggcgcucgcggacuuggcucacgggagucccuuuaacauuuuccuuuugcaguggaguccuccgcccggcguuucacucuacccgacacuaacacacuguugucucacuccuuaacaaaguguaacucacggagucuggauggccuuugcuuuccugaaucagauagacacguccccuuuaguccuucagaaccuagcugcugggcucugcacccuccgggcuacucccgaguccccuuguaguugagaaguuucuguacccagcgauucgcuucuuaggaguccauuuccagcuagacugugaagguucugaaagaagaagcuaugacuauuuuuguagaguauuauugaaaaaaaugcuauuaccauuucugaaacugguuucuuucucuuuuuuuuuuuuuuccccccagugggcucccugcuggccagcuauggcugguacauccucuucagcugcauccuacucuacauugucauccagaggcucucccuucgacugagggcuuugaggcagagacagcuggaccaagccgagacuguucuggguuagugccaugugguagaaaugaaggcgccugucauuuacuuagugggugguggcaagacaugccuuugagguuugaaagauuuuuauugagaugcaaagacuccgugaugguguauagcauacucaaugcacaucuuguucggugcauggggaccagucccuggagauggccaggucuuguggaggaaacaagaagugucaaggggcggggguggggguggggggaucaggcauugggguccugggaaucuugccaccugacugacuggaaguggggugcugcuuuauacagcacuccguagacagggauggauucauagaucauauuuuuguccccagauguauuuuagcuuccucguagucauaaguuuagccaucauugauaaaccgugacagagcagaguuaucuuuuacaaucauuuucccucaucaaccccguagcccauuuuuuuaaagaaucuagaggcauauuuugccaaagcaugacaguccauucucaggcugguagcucuuaugguuucaaaggcacuagacagaaaaucuccaagccagccuggguagguugucauguccuauggcaguagauuagcaguuuauuuaaucaacuuuugaugguuagagugcuaauugucauuaggcccaaggaaaaucuucaggccagaacugcuacaguuauuauucaauuuuggauguaauacaauguuuuuaucuuuguggaauuuauuuuuaggucugaacuugguauucuuuuguuccuuggccauaggacaucacagugguccugcauagacuaauuuuuccaagggaggucuuaaucccucauucuucuaucauuuauccacaccauccuuuguccaucaggauaagcccccguguagggcagagauaacucaagccgguuuaacuuuguuguuguaucuuuuuccuggaggggcauuccauaugugccccccccaauguuauauaugccacguauuccccugagugacaggaggaagaggcuuuaaccugauugaucggcugccaaccucuccagccugcugagucuuauuucucuuuuaaguuuaccuuguucuaauuaucuugugccugaguaaauggagaggcgagugcgugauccaaggauaucuuggagccugagccucacaaggagaucucuggugucuuuauuugagacacaaccuccgggccuaaggaagacccucaaguagagccagauaaggaugucucccuaaaaguggggugagugguaugcuuaggacuccccuaggaacgcuuagaagcuguccucuugggagaaggcauaagagagucauacgcuucccaucaauccccaaguuguacaaauauuaaaaguccccaagcaugcaacacauggagaucaagaccagaaguggaagaccaugugacagcgauuguaucgcucugcucagcuuugauagauagcggucaagcagcugugcuggcuuugugacuuucacuguucccauuagcuguggcugggccaguuagugggucuuaauuuacagaggauuaaaaugaaaaugucacccuuuucuuugugcuccagcgacaccccccagugaaccucucuagaauuauugugagugaccagaaacucaguguuagggucugucugucccuccaucccucccucccucccuuccuuccucccucccuuccuuccuuccuuccuuccuuccuuccuuccuuccuuccuucuuccaguuacugugccacaccuccccccaucuccaguguuagguuuuacacgcacuccauuuugauuuuucccugaccucaucagaccugauuuccacuuaccauuugguuguuuagagaaagcucaaagggcagccauucuguguagaagcuucacuccuguguguguauccuaaagaaacacuguuuuauauugcaguauaacuuaaauauagauuaccauucaacugauuacugcaguacugagauggguggauuuacaacuagguagaaaacuaaacuagggcuggguguggggcacacaccuuuaaucccuacauucaggaggcagagcaaggcagaucugugugaaucuggggucagcccagccugcauaguuuuaggucagccagagcuacauaguaagacccuguucuaaaaaaaaaaaaaaaaaaaaauuaaauaagcuggggcuggggcuggggcuggggcuggggcuggggcuggggcuggggcuggggcuggggcuagagcugaggcccaguuuguagagugcuugacuaacauacacaagacagagcauuugaucuccuguaccaaguagaagugggugugguggcagacuucuguaguccugcacauggacguggaugcaggaggaacaggaguucaaggucauucugcuauauagugaguuugaggccagucgagguuaucuaauacaugauuaauuuauuuuuuaucuaauauauaauuaauuuguuauuugcauauacaucugcaggccagaugagggcaucagauccccuuaugguugugagccaccaugugguuacugggaauugaacucaggaccccuggaggaacagccagcgcucguaaccacugagaauuucaccaguccaacauucagauucuuaaugcuaguugaaaggacuuugcuuuguaggaccaagaauaagaaucuuacaccucuucucauugaccugggccggucaagugauggauagagaugcaaauuccuucuguuuugcuuuguggaaugcuggucagugcaagugagauggccaccuuguacaguguucucucacucaucuugguggccaucagagcacuuagugcucugccaugaguauacaaggggauccuuuguugugguuuccugacauuugaaccuuucucuagagacgauuucauauggacucauaccuacuugcuuuucuauuuuagaaccugauguuguuguuaagcggcaagaggcuuuagcagcugcucguuugagaaugcaggaagaucuaaaugcccaaguugaaaaacauaaggaaaaacuaagacagguaugaacuggguugacuuaauccauuuguugggucuuuuuguuuuucccuugagccugcuaagcaaggucucucucacuaaucaggcuuagugauaacaguaaaguauuuuuacuguuauuuguaagcuuagagagcagggucgugucucacuagauucaagaugcauuucagagucagagaaaaguaugcuagucggaauaguugugugaauacauuauugcagugacagacagacaugaacacgguguaugugagugcgugucuugggugaauaugaagauuaauuucccuuaguuuacaguuggucagcauguuugcuuugugcaguuuugaauugucaagggagaaacacuguugaagaaaaguguaucuuuuguuuguuuugccuucaaguguuuucuuauaacaguauuuacucaacagaacugugugcccaggucacaugccucuggagccaggguagaugccagccugucacccugugcuugaugccuuguaaucccgagcgcugggauuacaggcuuugauugaaguuguguacggccuaugaccugguuuagggguggucgagcacacuacaguggguuucagaagagccaagaaaagguggcgguguagaccagaaggaacaaggauuguuugaucagccagguuacucaugggauaucggugcuuuucccguugcuaugguggagugacagaagcagcugggggaggggguuauuuugguguacaguccccaggggagguuacagucugucauggcagcaggaagcagagugacaccauuucaucuucauacaagcagcggagaggauaggaaauagagcugggcuauaaauccucaaaacccacaugcuuucuccagcaagcugccccucccaaaguuuccauggcauucccaaacauugccaccagcuggaggccaagugugcagaugcaggagccugugugugaccuuucauugagaucacacuugcacaccagcauugagcuggucucucauuaaagugacugcuuucuaguuuuaauccagaaaguuuccagagccugccucaucuucacagaaagauccucugccagcuuugaggcaccagggaauuuggucagauuacuauagucugaguuguguuacugaaacgucgagcacaggaaagggacucgugccuuucugcugucaguuggcagcuucucuuauuuuggccuggucauccacuugggucuggucugcccagcuuggcuaggacucagaaagaaaggacguguaacaagacccaagcauacacccuccccgcuaacgcuucuucuaguagcagccuucaguggaaguuagcggucuguccucucagucacuggccuacauuggaaaccugugauauagaagucuguucugugaaauaggucuccacucucccugcugcuuaucuacugccuaauagcccaugucaugguaaauucuuuuagguauugucacagauguauuuuaucuaauauuuuaugagcacauaaugugggucucucuccauaaaaauggaaagaguguguacauuuuuuuuaauguuuaccuaucugccugccucauaguuagcuuagaucucucauagaucaugcuagcauuuaucugcuauacaucuguuugggauguuuauuuuauuauaaucugugugugaguacaggcaugugugugucaugguauucuauggaggucaggggacagcuuacaggagccauucuuuccuuccaccaugaguucugaggcucacauaggucauccaacuuauucagcaagcgcuucugccugcugagccagcuugcgucauaccccucuccccuuugcuuuugguuuuauuaagauagaucagguguucuuuguuuguuuugaguuuggguuuguuuuguguuuuguuuuuuuguguuuugaggcaugguccuggcuagccuagaaguuugccucugcuucccuagagcuggggauucugggaccacaggcauguacuccaugcccaggucagcuauacuauaaagucuuuuucuuguucauuugcuuguuuuggggguauuuuugucauuguuuguuugguugauuguuuucuuucaugacgguuucucuguguagcccuggcugucuuagaauucacucuguagaccaggcuaccucaaacccacagagauucaccagccucugucuccccagugcugggauuaaaggugugggggcugcugcggcugccaccaccaccaccuggcuucuggauauagcuaaugguauaaagcaaccuuuauguuaagguauuuucuacuuuucucaacuuucuguguuuacaagcaauggaagcuugaagggacggauuagcaagagauguauguacaugccguggagagacuugcucaaucaugcuuuuaaggagucuuugucacaugaccuuauaucacaaucuaauugaaccagaauggacuguauuaggaaugggagaguacacaccgcugacauucaugacgcugggauucuugguugcggaaaaguggcuccuguccacggagcaggaagcggagcaaaggccacgugguggguucucccaccgcuuuccuuggugcucauuacugagugcaggguuucuguuggauucaucuucccuuagguucccggacugcuuuccuuuccggugcacuugaaaaucuguugcccuaugauccagugccugaggcagaaaggcuguggugauacccagccaggugacaauaaaacagggcugccagccacacacagucauuccaggucauuucugagagugggccucacuguguaggccaggcuggcuuugaacuuagucuucucucgucuucucgucuuccugagugccaggcuuacaggugcauagcacugugcccagcuuucuauggcagcuuuguuguuguuguuguuuaagagauggaagugaacacuuguuuugggagauguucaaauuaagaauucuuuuuuuuuuuuaagauuuauuuuauauaugugaguauacugucgcugucuucagacacaccagaagagugcauaggaauucaucacagaugguugugagccaccaugugguugcugggaacugaacucaggaccucugaaaaagcagucagugcuauuaaccacugagccaucucuccagcccgaauuaagaauaagcacuuucuuugagaauaguaggagcuuaugggugcuugcugugugugcuuucuuguaugugguucucuguguguguguguguguguguguguguguguguguguguuuugagacaggauuucuuuguguaacagcccuggcuguccuggaacucacuuuguaguccaggcuggccucagagauccaccugcuccugcuucccaagugcugggguuaaaggugcacgccaucaccgccugacucauuguaugugguucuuucuuagcuugaagaagagaaaagaagacagaagauugaaaugugggacagcaugcaagaaggcagaaguuacaaaagaaauucaggaaggccucagguaacuggagguggcaggacuuagucauguagaaugcuuggcauuuggaguggcuuuguggcuuugcaaacugaacccagagcauagcauauugcagcuguaccuccagccccaaguagaauguauugauucuuaagcuuauguuuguucaaacaggaagaagaugguccuggaccuucuacuucaucugucauccccaaaggaaaaucugacaaaaagccuuugcgaggaggugguaagaaccuagcgaugugaaagaaacauuuaggauuuucaacacuuuuuaucugugcucuaugugugugguguguguguggguacacaugcccaugcuuguacacagaggccagagaaggacauuacgugucucguucuaucacuuuccacauuacugaggcagggucucccucguccuagagcuaguugggcaucuggaaagccacagcagcccugguuguaacccuaaagcacauggagugcacgcgugugccacugugccuggcucuauacacggacgggugcuaggauuuccacucgggucuucgugcuugcucauguccuuuuucccaccgagcagccgucuucccagcuccguauuuuccuuuucaaaguaagauuauccagcugagagcaugugacguuuacguguaguccuagcacuugggaagcugaagcagagggauugcccaaguggaggccagccuaggcuacacugugagguucugucucuaaaagaaagaagauucccuuugugucuggguccccaguuuaggacuauaaauauaagggaagcagcugcaggcugccauguggcaccucccuaagcaacuaggaugaugcaggagacgcccacagaaauagagagugugcagucuuuggugauucaagccgaguuugaggcaauggagccugguguguuagguagcuccccuccugccccccagaguucagggacauggcagaaggaaggguggaaacuugaaacuucucauauauugacagcacaguggaaguuguggaaaacaaagcaccuagcaugcuuaaguuuguacauggccuguugugcuguccaucagcccugagcugggccaaccuaaauagccuggcuuugcagaugaggaaacuaaggcucaaggcaagauuucacagugagcaaugaaaagaaccagcccacagaaggucuggcuggaucuggagacugggccauucggcaaagacccaguuauccauguuggcuaugaggagcugaugugggagggagagauggaaaaaggauguaggugacccaguucugacgacuagcaguggaaaguuccauucugguuguuggguaugguuucuguuguggauuuguuuuugagacaaggucuuacuuaggcuuagguuggccaccagcuccauauguagccaaggugaccuugaucuguuguuccucuugccucuaccuggaccuucacacccuuuuaaaaugcuuucauuuuguuuuguuuuugagacaguuaggucaucuuaacuuaggacagcuuaaguaauugccuacugggauuuaaggcugcacaacuaucuucacccaccuuauuuuuauguaauagcugaagucccuuggaaauggccauaagauggaaucuauaccuugcaauuuacaugcuagauuugugguuauaguuuuaauauaggauguucucggauuuccagccaucaaaaugguucuguuuccuuuucacuuccagguuauaacccucugacgggugaaggggguggaaccugcuccuggagaccuggacgcaggggcccaucaucuggcggcugaaacuaagacucuuguuagugucgcucugacauuagcaaggugaaccuuuaacccucaacucaauugccuuacgcacacuuucacagugacuggccaaggagagguggggcuuuucucuguucuaaacuacuuguacuuuaagggcuuuggucagcaugagauauagacauugccauuaggccacacucuagacaagacagccauggcuuuuauggcugcuggcuaguugguagguugaaggcuucuugcuguuuagcagacuucauaaagaaggcccagugaugauacuuugggguagaaguccuugcuggcaggauggucucugugacgggaugcguugaaugaugucuuccuuauaaauggugaacccaccagugaggauuacugauguucacaguugacgggguuugcuucuguauauuuauuuuauguacagaacuuuguaaaaaaaaaaaaaaguuaaauacuuaaaaaguaacauuuuuagcaucuuuauuaaacucaaggaaauuucuuugugagcuugacuuugucagacaguaaacagcuuuguaucauucacagucu

SEQ ID NO: 3864 - RNA, 3546 nt, Mus musculus
uccaaaggagcccccccccccccccgaggcuuggcuauccucuucucaggcagggagaaggccgaguccuaaauguggcucugagaucucuguucuugagucacuuugugugaucugggcagccacugucuucagccaccuggcgcugugccaggccacacuuuggacaccaccaaucggaaauccagaacucugguccacaccucacagcaaggaaaccaugccccuuagcaaauagcccaggaagcaagauaaacauuguuaucuccguaacaaccuaaugagcucaccaauuuccucuguaacagucagcccaggacuauauuaguaacagacagcuucccuaacuuuuggcccugcuuucaguucaggucaaccugagaaagcuaaguauuauggccccuacagagauauacaggaauucuuacuuccagcgaugucuccaauuuccaugaacaauaaccuccauugaagacacaguaaaaccuucccuugguuuuguucugagacuuaucaacuccucugugcccugagucucugccacaugcaaaccacagcccaaccuucuugcuguggcacacccagaacauguuccuuauuuuuuuuccacaagaggaagucagaaaucccagugaucugcuauugccaggcagcaaauggguccugguuuaauacauaagacuaagguuuucuucagggauaucaaagaaucugagacucaacuggguuucuggggagaagaaaucuguuucuuuuggcuuguauauccaaagaaaauucauaacagaaaauuacagggccagaauauagacaaaaaugaauguuucacaaaugggaacguguaagaaccacaggaacugugagaaagcuaccagcaaucuugguuaagcuggccuuggcaauuggcagcggcugugaucauaucuggccacaagguggugcugugcucccuuagccaaauccugugccuuaccgcccuuccaacagaaaguucuccuccagucuuuaucucccucuucauuuguguagaugaagaaggaugaacaacuaagauccagagagaggaguccuagccucuggcaauuguguuagauaagucacucaauuucccuggcggcuuuuuuccuuucuaaugacugacguuucccacuuacucuaaacacuuaaguccagaaaaaucuaaaguuugccaagaguugaacuaggaccuaauggaccccacagaccuagaguuaccugcugucaaagcagcaucaccagggaugucucccagcaccuuucuacacacaaaaacacacccucuuggggcuggcuggggagauggcucucugguuaagcacuugcugagugugaccccuaguccuuccugcuguuggguggcucacaguugccuguaacucuagcguugagggaauccuaugcuucuggcuccgagggcaccuguguucaucauaugcacuccuccacacacacacuaaaacauucgaaaauaaaaccaaaauucuucacucuuuacugaaccauuuccgaauguuguaucaugacaugcguccuaguaaggguuucuauugcugugacgaaacaccagggccgaagcaacuugggagaaaggguuuauuuggccuucacuuucacaucccuguucaucuaaggaagucgggacaggaacucaagcagggcagggguugguagcaggggcuggugcagaggcuuccuucacaggggucauucugguagaaggaaaccagccacaccaagagugugguguguaccacuaaccucacuagacccuaaggacagaggaaugcaaucugcacugccaguucuuaacgcucuuucuagggcucacugccacacguuucuuuacaacugaaaucugaucaacucaagcccagagagaagcggucaaagucugaagauaggacgacagacgagcaugcggcacgaugcaugcugggaaagauggggcagacuguagaugaacacggaagcuuuccaccuggucuuggcauacauugggaauuuggacugaugcguuuuauuauuuucggugcacgggcacccagaguacuuaaguauuuacagggugccaccgagaguagacaaaaaacaucaaaugacaacgauauccacacacuugacagaaacagguucagcaagccuacagcgcucacugcuuguuuguguuagucugggcaaaauuaccacaaaccaagcuccgagggagcacagccagccauugcauaacccugucccagagggcugaaccgaaagaucaaaggcagcuggcacugagugcugaacagcccagccaucaggucucacgaacugaacaggcccaacacagauggaaaauguccugguguuugucuccaagccuuucagacgccggccaaaugggagaaagcacacaggcagcaccauccgccccagaggcagcaagggaaggcuuagaaagcuguuuuccaaggugaugguuggaacuuacaguguucagggguuaagugggaagcuggggagaggcucagugaggaaaugggguuugcccugcaagucuggggaccugaguuugagucccagaacccaaguuaagguggaaaaagacaacggccaggccucucagcaggaaguauuccggucauauugggacacaagcucuccucuccuuuuuacaguucucauccaggaaucaaauggcuccuucuacugaucccccaaaguuaucuucagaucuccauacauacaucacacaaacauucuauacacacuccaucacauacacaccuuuguacagacaauagacagacacacauuaguaacaauaagauuaaaaguuuuuuuuuauaaagaacaaaaaaggguugugcauguauguugggccauaggcaaagagucuuauagagaaagcccuucugaucuggggguggaggcugcaauacagaugcauuaucugccuugcauauucuagaagcuacuggccacaaaggugucaccuucccccacccccaaauaauuuucacuauauuuuauuuacucuguguauuaauuuucacuauauuuuauuuacucuguguguuaauuuucacuauauuuuauuuacuccguguguguuuguguauaucuguaugagcaugccacaccacagcacccauggaggucagaggacaaugugaagggauuggcucucuuccucugccauguggguccugaggauggaacucaaguuuucaggcucagaggcgaucuccuuacaccuacugagccaucuucuagcuggccuacacuuuuauuuuuaugucacuggcuaaagaagaaaaaaauuauucaaaggagggcuggacucuccagugguuuuagcuuagcuuuaagacuccacugagaagccgggcgugauggcgcacaccuuuaaucccagcgcuugggaggcagaggcaggaggauuucugaguucgaggccagccugguccacaaagugaguuccaggacagucagggcuaaacagagaaacccugucuuaaaacaaaccaaaaaaaaaaaaaaaaaaaa

SEQ ID NO: 3865 - RNA, 1285 nt, Mus musculus
uuaucuggcaagcucuuuauuguugaacuauaacucuaguuuaaagaauacaccuccugccccucaucuccagagcaaccaauuagaagcuuccucuacgaaaaggaucucucauuuaauggcaacuauuuuucauuaaagaaagcugggacucaggggugccuuaguugcgcccuaggaguagcaacggggagccucauaaggugucccagauagccagcacgcaguaauccgacaacccacgugggauuacccugggccaccaggggggccagugcugggcagccucgccauggcccgaucuguccggcagggggcgcuguccggccgcaguggccgcgcgggccgcguccugauuggcuggaggcgauggcccaaguccacagccgcgcgaccgggccacuaaguggggaagcucgccagucggugcgccaguccaagggccuccgaggcagcggcgcggcgggcgcggcgcggcggggcggaggggacaagaucagggcaggaggcaagcggcuaaucgaaaggguccggcacacccagcaagaugcuguccuggcggcugcagacgggcucugaaaaggcggagcugcaggagcucaacgcccggcuuuacgacuacgugugccgggugcgagagcuggagcgcgagaaccugcuacuggaggaggaguugcgcagccggcugagccgggaggaccgcugggcugaggaucaggcacucuacgccgaggaggcgcgcagccuacgacagcagcuagaugaacugaacugguccacagcccuggccgagggcgagcgcgacgcgcugcggagggaacugcuggagcugcagcgggaggguguggaagccggcacugcccgcagccgccuggaugccgagcugggagcgcaacggcgggagcuagaggaggcucugggcgcgcgcgccgcccucgaggcgcugcugggccggcuggaaacugagcgccgcgacuuggacgcugcccacgaacgccaagugcgagaucuacgagcccgcgcugccagccucaccaugcacuuccgagcccgcgccaccagccccgccgcgcccccgccgcgccugcgggacgugcacgacagcuacgcccugcugguggccgagucguggagggagagcgugcagcuguacgaggacgaggugcgcgagcuggagcaggcgcugcgccgcggccaagagagccggcuccaggcggaggacgaggcgcggcugugcgcgcaggaggcagacgcgcugcggaaccaggcgcuggaguuggagcag

SEQ ID NO: 3866 - RNA, 281779 nt, Mus musculus
agagcccccaguguguggcggcggcggcggcggcgcggugaggcugagguucuuguuuaccagcauuaacuccgcugagcggaaaaaaaaaggagggggggggggaaccgaggaggagcgagcgcaccgggcgaacucgagagaggcgagcgacagggaagcugccugcgagccugucccggcgcgcccggcgcucgcagacccucggccccgcucuccggacccuccacgccucuccccgugccugcgagagcuccacggcacgcggcgugcucggcuuugaccuucagcgagccggagcccccgcgcacggagucggcggcgggcgggggccgacgcggggcggcgggagcgcugagcgcugcgcggccgccgcuuuguguguguccuggauuugggaaggagcucgcggcggcggcgcugagggaggaggcggcggcgagcggagcccagaggaggaggaggagccggaggagggggaaccgcucauucauuuccacuccgcauuucugccccucgccggccucgcccgcgcccgggacuucggaccagucucgccaacugcgucgcgcucucccgccgcguaggcuccgguggucguucccuccggggaucggguggcguuuguccucgccugcggcgauuugggcuuugcuccucuuucuguacaguuuuccuccuucuucugcaucucugcguuugcaaauggaggccgacgacgccgacagcccgccccggcgcgccccggcuucccgacuccgccgccccgugggccgcugcugccggcgcugaggggccgccccgcgccacccuccuuguccacgccgcuuuccgaggaucgucgccugcgcucuuguuuuuggacgagagugaggacugaguuggagacuuuuuuuuucuuuuuuucuuuucuuuuuuuuuuuuuuuucuauuuuugagaaaagggaauuucgucccaaauaaaaggaaugaagucuggcuccggaggaggguccccgaccucgcugugggggcucguguuucucuccgccgcgcucucucucuggccgacgaguggagaaagugaguauuugcccgccgcccgcggccacugcgggaacuuuuccuccgaggggcugcgcccuguuugggaaaacccaguugccacgggcgcagcugucggacuucggggcucgggaguggaggguggggcucucucggaaggccggaguagagcagggcccgagaguucacgacucaggagcuccuagagcccuagcucagcgcaucugcgcgcgggaagggccuuagggcuuucucuuucgcuguccggggagcgcugucccgcacgcggccuggugggugggcagugccuucucgcuggcgggucaggggcagcccccgcguaggcgcuugguggggaaguuggcgucuggguggccucgggaaccccgcuacucucgccccccccccuccggggcgcuccacuuggcaccccagcgcccaucccgcgcagcucaccaugacagcacccuuggaggcuccacgggugguugcugggguagaccuagugcuccguggcggcaauucggagccuccuacccugcgggguguaaguuguucuugagggggagauacaggaugguuggaagccucgcggccccaggacacguuuccaaacaucagggcgcagccuccuaucacccaacuuguugggcccaucgacccccucagguucuuggccuuucgcuucucuggagccugugggcgucuacccaccuaccccaaggcuugauaacuuggacaguccaguguggccuuggggugcagggugugcccaccauuuuccucuaggaaagugugaacuugggacuuucuucguggggggaggguuggaugauccucggcuuaggggcucucaguuucuauccagcucuggacacuuuuuucccagagcgucuuaguaagaggagauagguacguccacccuugugcagagucgacgugcuuuuccacacacacguguucagcgcggauuuaggugcauccacagccacacgaccgcgaggggagaaccggacucccagccugggggagagaugugugcgguggguugagcugcgacgggaucuguagugugguaguggacgggugguuguuuuguuuugcgagcgcggagcccuggccuugguuuuguuguggccaaaguuguggugcacugccaacaccucccccccccccccccccgcucugcacuuccuuuguacauacuuaauaagcaguaucgcucaugcuugcuaucgcuugcaaucugauagcuuuuguuuugguggugucggguaggaguagguggugguggggggugucucugggaaugagaacucuccacaguguaugcgggcaggaggaggaggaggggguuuuguucucgagaaaaacaguguggcauacuggugcuuuagagaugguagaguaauuugaacgcgauuaaaaguuuaaaugcagucuccgaguaggggcuggggaagugagggcgugcggaugaguaauguuugcagaauguaugcagguggugccuauuaacuucgaaaaaucacgaccuagccuugaguugggguggggggggggugugacacgauggagccugcuagggacccuaccgcugccguaguucacaaaggcuguuucuauaaacaaacccuugagccucuuuuaagaaauaucuaugauggaguccgaguaguucuuaaaagaacuauagcuauaguaagacuagagaaagacucgcagacuauggccgaccucacaaaucugggcucuccugcccuuuguuuuccaaacuuugagcacacuggauugggugaaaggcgguuagaugguguuugggggcagggaagauuucuagccuuuaaggacuaaauaugguuuagaagacacuaggaacgaguccauuuuccuauggcaucuuauuguacuguguacaucucuacuuuugcuauuuaacagcagaaguucugcaaugcaaagaagcagugguggccuugccuugcuucuuggggcaggaugcaggcauccgaaacaggacggagcugggucuugcugaaggauauucuuuguccagagcaggggcagcaggagaagggucuuucauuguguuguuuuuaauccgguggggaccaaacgcuuccugagagccgccuuuuaugauggucaauuuccuaaaguuugauggccauccugaaagcacuugggauccugguuagggccugcuaaaguucugucugggugucugcccuucccucuuuacagcugaaggguuaaguuuuagccccaaaggugcuaaaccacauaacugaggagaaagucucugggugccagcagaggcagucuuccagccauacagguauuagguuuaaggaauggugauucuuuggagugcgacaucuguggauauguuuucaucuuuaacuugggacuguggaaguuucuugaagaaaggcagcccugcagacauguuuguuuuguagcgggagaaugagcagaccuaggaaagggagcagccagauaauguagggccgcuuucuguuuugaaaaucaacaugcacuugagaguuauugugguugucuccuaaaaaggauugagucaucuuucugccgagggcacgguaaaauccuauugucagaggaaaggagguaugugcaauguugguguuuaaagaaguuagugcuuuauuaccuaccagaaggagagcccagaauaagaacuucagaaagaaccuaacuagcaaauuauaguuuagguuuugaugcagggaaauagcaagucaacuauacuuuguggagggccagacuggugcggguucagggcuugaaguuuaaaaggucauauguuugaauugucaaaaggauuagaaaagaccaucucugaaagauccaaggguugaacauccgggcgcuuaaaauauuaaaaacagagaaaauaaguuauaaacugccuaaucuuguaugaacacuacaugaacuuacaugaaauguucagccaauccauagggagagacaaauugcucaccagauauuggggaggacaaacugggaagugauuguuaagggguccaggauuuggggcaggugugugugugugugugugugugugugugugugugugcgcgugcgagugcgcgugugcgugugugugaugaaaguguuuuagcuucaguuuguggugaugguuguacaaauucucaauguacuaaaaaaaaaaauugaauuguaugguugaaaacagugaccugggggggggguaugugaguaacaucugaaccuguuuuguuuuuuuuuuuuaauuuuuuuucaaagauugagaagaaugcauugugcuaccuuaagccuuaaaaucugacuaagauuauucaguaaacauaggugcagguuugaguuggucucucccccccacccccaaauucaugagcuuuuaagauccaugaauuccugcaguacagcagauugguaauugaagcuguaacagcggggauuggaugccaggcaagaaacagacaaguagagggaaaggaaucuugcucuuccuuggcuugguaaauggagggauggauggagucaaccgggacagcacaccagugcuaaugaaggugugagcuccauagugaaagcccucaaacagaaccugaagugaacuucugcagggcucaggagccuaaggcaaggggcguguuucuaucuacagcuuuccaguagagaaguaguaugauguuagccacacggaaggaacuucuucccuccuguaguagccacaagugguccugaugcagaggaaggaccgcuuacuguagggcagugcgcgugcgacuuuccuuuucuuuuucuuuuucuuuuuucuuuaauuuacaaguuuuauuucuuaaaaucuccagaaucugagaaggugcaucuugguugguuacaguuguuguuuaggaaccuguagccuuaacaguuuuguuuuguuuuuaauaaaaauaaauaaauaaaauuaauuuuaggcacacagucaagugguuuuguuuucaaacuggcgugccuuuaucuaaauguacuuugccuuuuccguaggaacagaccuagacgggaauguuugcauuggguuuuuggucucugucuccaggucaucuguuggugaucucuuguuaugguugcaagguauagaucaguaaugaacaucagugagaucaucuucacuccuuguccgucugucucccuguucaucuguaugucugucuguccuuccuuccucccccccccccccccgggagcccugagagcacuuuaguuuuccuuuuaaugugguuucauuugguuugucagaaugcacuucaagugacugagucuagccagcaguuagugggcccuuacugugugaaagcugaagugaaugcuagguggcgcgaucaccaggagaggaaggacggacuccccuugcuguugccuuugguuccacucucccuguauuugcaggagaggcccuuuacaaaaacuaacaaucuacuguaggcuuagcuggucugguguguagccagugcuacacuguucuuacccucucaggcucccucauauuggaauuucaccacagaccauggcccacggauaccuguccaucuaguugggcgucuuuguaacacuggugugacagucgugguuaacgcugccuguguaacgucaugcuggaugcacucauagaccuguaagccuaggcagggggaaacgccaguuugagggcagccugugcuaaguagugacaccuugucuccaaaaucaacccccccccccccagggauauucauaaguguugccuggcuuggaaggugggaccaguugcagagguguuucccauguauacauugcuuucacaguuuggagauaaucauuaggaaguguucagaauuccaaaucuuuuguaauuuaaaaacgaauggacuuuuuuuuuuuuaaguaugggggaggggguguaagaacgagacagagaggcaauuguaccuuuaaaagaauuuuuuuuuuuuuuuuugaaucauaaagcacacaagacagguuuuucucugguuugugauuuucuccgauuuguuuucaagacucauuuaaaacucaaacucuaguucguggaagagguauuugugcccggaggccagcuugcuuugaacugcuuuucuuagccagcgugugacaggugcuaucugagcaccagaaaugaacgccuuucaguaguacuaaguauguaauacuuccacacgugcuguggccacggcggcucuuggcuucuccgucugagacgcccgaugcacgugaaagacagcaaacaggcuguacggugugaugaugcacucggagcuuccuguaaguaguguuuggcagcaggucugcaagaggaaguuuccaaguuccuuauaaagacguguuauuugggacgggcgcaguccuaguguucggugacgcugagaucuguggacauuggggagugcguggcugauguccaggauugguaaagauuaaagauuagaauguguacaggugccuugucucgauccccucacccccugggucugacuuguucagagaagaggacaugggcuugugaaaacaguaaacaaaggaucuuuaaaacgaguuaguucgcuaucucagcagauguaguuccuuagcaugaugaaguccguuucuuuucuuaaauuguuuggaauccuuuaacugaaaguacuagccuccuugauuuggugacuuuggauuucuggagauggaugccauguguucucacgcgugccaguuuuccuuacucuuuauuacugugaugggguuuagagcccuaagguugcuaugucccuacuugagugagaauucauccacuuucuuccauaaauacccuggguacucacaaggcuccauucucuggguuagaaacgcugauaccauaaugagucuuaccaccaguuuuucagaguaugaauugagccacagaaaucacggcuauguuugcauaaagaacuaagaagcuagugagcaaggcuuuaauuuuucuuucuuuugggucgcaaauuguaaggauuuauaaacucacagauugcuauucaggcauuacucgaacagaacaaaaacuggcguccuuuauguugagugaugaacagugggacuguggugacuuccacagauaacgacgcugcuguuugguuuuauauuuauccucaaguugguuacugcugguaugggaugcgucuugaggcuuagggaguaucccuccuguauuuucugguaggcuugacacaauuucucauggaguaucugguggccugcuaaagaagaagaauguggccauguuggaaguguguauugcagagagaagaaugucugucccaaauuguuuacuuugcaguggaaugucagaaacaacuuuggagagaccccgagguugcuuucuugauuuuuguuuuuuuccuagagauggucuugugguguagcccacacuggccuuggacuugaucuacccuugccucagaguacagggaucacccauaggccuguaccaccgaaguuggcuaggcaccucuugaagcguuuguagaaaggaguuuaucauuauuacagaaaauuccuccugguaguaggagcugaaggcuucaaacucuaucuuuuuacuucacaccucccugcaggaguuacauaaaugccagcuccucacaguggcacaugugcauccagaugggcauguuuguccaggugugcaugcgugcacuccuccacccacagagacugagugaccgacugaggugcauagcuccugggcuucuguguacuuaaacuugccaguuucuuuuuaaacacggcacuuccuuuaagcuggcuuuggaguugucguuuuuaagauuaaucuuuauguggguaacacauguuuuaugguauugaagccuaaauuguuuuacagaucagaacuugaaaguuccugagguauuuugcuuaucuauaaguugauuauugggggagugugucagaucgaguaaaugagacacguaccguaaggcacagaagccugaugauauuagauagcagugaguuaguguacagguauuuuucucccaauuugaauuauuuuaguaaccuuugauaaguagcugaaagaaauaaguagcaccugugcagauuucagguaacagccgucuguccgguugacuggacauuugacaagaccauucugagucacuagccguccacucuguuuagacagucagugaauucuucaccaguucaucaugccuagcugugucuuacgguguucauucucuccgacaguucucccugggcaucacuguacugagggaacgcacagggacgccccgccgaugguucugguguccacuuuggggcguuacuggcuucgugaugucuguugagccacaauguagaagagcuggauccuagagacuuccguugcuaagagcggccuuucuugguuggaugcuguauucuccccauuucuucuagcacgcucaccagugagcuuuucagucaccaagauuggcugcgauggaaggucuaguuaaccucagcucugcuuccugcccuuuucugaagagagugcuuaauugaauguuuccucucaacuucacugagucacuugaaaucaugcagauuugccccauccuggcuccacccccauccaguccagaccugcaucccaacccuuugaguagacagggcauacuuacuggccuuugagauacuucuaagugccauaaagaucccugggcuugcuuaccaagccugcuuccucgcuguguaccgcaggcgaguccccagucuuaaugugaaguccaaggccccucguauugggcuguaguagauccucauaaagaccucgcugucaggauccacauugauccccagaguucugcaugagugggcucugaugaucccccacuccagcuuuugcccucuuucugugacuuggcaugaauuccaccacagucuucugccccccuccccgcaauggacauuggaaagccccucuggaacaauggaaggucacgugggccuagauuccucugggccguccaucaguucucugauauaaaacaugccacuucucugaguuugagcaaauaggcggagacucgggaugacugugaaagacgguucuccuugucucuguaaacggcaaaauaaaauuaucuucuacuauauuuagaaaaauuaaacucaggaaaauuuggcggaaauguggauuuuuaaguuucauuacuuuuugagugugugugggggguguccaguuuuggauguugguacuguaaaguugggccgauaggguaggcuuccggucaacuccucccaggcccccccagcacuuucuaggguuuuaauaugugagagaugccgcccuugauguccuacccgccgccuucuccuucacaugaggcuguuagcguuucucuaacugcacagcucuaacuuuccccucccucccuuugaguucaggcaccaccaggccgcacacugagaagucucccucgggcuuuguccuuucccugucaugacuuaccgggaugaggaguggcgagggaggcugguuugaaugccaguucuucaguagcacagucagauuaauuuugugccuuuguuuccuccucugugaaauggggugaagggcgauugccaucaagccuaagagaccaguguuuaaucccugggacucauggugggagggagaaccaacucuccaagguagacuccccccccccccacggguacucuguggcaugccuccccacccccaacaaauaaauacgggaaaucaaagguacaggccuguaaucccagcauguggaaggcagaggcagagacaggugaaucucauugaguuuaagaccagccuagucuacauauguagugaguucugggccagccagugcuacauagugagaccuugucucaaaaacaaaaacaaaaaaccaccaaaacaaaaacaaaaacguuaacccuuucugaguuccguuauuuuauccccucccgccauccccccccccccaaaggguagccagcuccacucuguucaccuuccauuuuacaguuguuugucauaguuucuuccucaauccuuucucucguuaguuucugccagggucuuagaacggguccuaucugcacuuuguccgccucaccgaugcgaagucgccaucuagcggccacauagggaguucagccaucucccuggcugaaguagguguuguccagaggaggaagaaagccaauccccuuaaaguuccucagccuuucccugcugauggugacugagaaaugguugcaagaaaauguggguacaccaggcuucuuuagagaucgccgggcugugguuuaggauacagcuuguuuaacuguucagagagcggcucagagaagcaacuguauuccgaagugagguacccuuccuguaaaacccagagggucuuacaguccuaagaguacccuacccccaggccaugagaccuuuacgugugugcaguuuuaaaauauuucuuaugagagauuaauaaacaauacugcuaggaccaacaagauggcucggccagugaaggagcuugcugccaagucugccucugaguucaguuccugggacucagcacaguaggagaauagaacugacuccugcacguuguccuguggccuccauaugugugucgugacacuugcacgaccccucccagauaaacguaauuaaaacguuuugagaaggcugccaauuaauuucgaauggcauauucauagagcaaggucugucuuugaccucucugcuuaaacauagagugacacuucaaauuucgcucugaagugcguccccuugggcugcuucauguaguuaaaaugucuacccaacaguccugaugacagaccaucacaggcagcuccauuacucccuguguuggaggcacugugucagacuuuuuugguuuuguccucagaacuuauugauaauuucucaaucuacucucccauuuccccagugacacuguaucuaguggucacguucuucccugguggcucuuuguuuuuuaauuuuaacugggagauagcucauuugcugggcugagagaggacuucaguguguuuucugcccagacauuucaggcagcuccaccugcuguuucucaggcaggcccugacugaagccagauguugaacacacuagauuuucacugcccuagauugguucagagcacagcauauauacuaaguguucaauaaaugugcguucuguaauacaagguuugcuucgcuaagaugugaaagaauaauuaaauaauuuacaaguuugccccccuuaaggccagacaacaguugauuguacguuucugacuuuuuacacgugaugcacugaaccuguucuuccccaucauaggggaggggacaguuucucuacuaccuuugaacaccaggaaguagccagauguuugguggguaagagaugcucaggaaauggcagacuucuuaaagggaccaccuguaggucauucacuuggaugcauguaccguucauugacagcgaaggucuuauaucguccuugccauaguagcuuagcccuuggagacuuuuuuuuuuaaagauuuauuuauuuauuuauuauauguaaguacacuguagcuguccucagacacuccagaagagggugucagaucucguuacggaugguugugagccaccaugugguugcugggauuugaacuucggaccuucggaagagcagucgggugcucuuacccacugagccaucucaccagcccccuuggagacauuuuuaucacaccaguuacuacauagcacuuagaagcaguagaaugauguucaggucuuuuguuccaagaacugggcaaaaaacaaagcaaaauacccaacacuuuagaaaagccaucugcagaucuagucuuguaucccugaggugggugaccacgccccuuaagcuucauucugaugagaagacaagacugauuugccauuaucaguuccuuuguguguaguguacgcugaaccauugggcagccagcugccucauaaaagguugcugucuucagguuggcaguggcugccugucccucugcgguggauccugaggauuguguuccuucuccuucaggaaugacccugggucccuggaagaguuguuaugcuuguucagccuuuggauuccaaaaccaggcagugagggugguuuccuugggagggucguuuggaugagaccagcaaaaaaguugccucgcaucccggcaggcgcaguagccaggucuuagaugcuuguccuuugaguuccugacacggacugucaagaguuuaugauagggguaucgguaaaccucaccucuacagaauugaguuuacuuagccuaggaugcuguaaggggacugcugaacuuaaaacccacaggucauugcuaaaagcuugaugcuccugagguggucuguuuccuguagaaaaaugucaacagaaucauugaacgcaguauguuuuauuucaaguguggccuauagaaaaagcauuuuugaaaacucacccgccucacggcugagcugaguggacgugagcucaccugccuacccugccuuuagggaagccggcucuccccagguacuugguggcaugcuagagcgggaagcacggaccuugguugguacccaccuguaaauugaaaaagugccacucuagcaggcaugccaaagggaauuagcaguaauguuuuuaagaugcccgccagaaacaggcaguagaaggcaucuagcaaacgaauguguggauuuuuguccucccacguggcugugaggcccccggggauuccugucuuuuaguccuccuagcagccccugggaaaaugguggaggagggaaacauuguuauaucaguuauuuuggcuuaaaccugagaagccgagguuggagagauggcuuagcaguuaagagcacuggaauuagaacccagguucacuucucagcacccacaugaugacuuaacaaccaccuguaacuagcuacagagguccggugcugccuucuggcuucugcggacgacugugcagacaagcaccgguacaaguagaauaauaauuaaaagcuugaggaaguaugagguuuuuggaagcacaguucaaggccauauccucaccugagacauggaaguaagagcuuugaaguuggggaaggguuggauacaaagcccuguuucuguacagagacuuaguggccuuuccccccaccccccacugcccccaaaauuuguuguccuguuguccucuugggaaaaaaaaaaaucaagaacaguggaacagcuuuagcuugaaauuugaaaugcuacagaauccagaacuugcauccauugccucagugccaaggaaguuucccugauuuuagagcauuuuggauuuucagauuagggcuacuuggcagcgucuacgcagauauccccagauccaaacaucccugucucggaagcacuucugguccugucauuucacauacugucaaauaguaauaggaaguuuauguucagcaccaaauuaugggaucugagaucaaaaacaaaaaccccaaacacccacacacaccaacacccccccacacacacgcacacgcgcgcacgcgcgcgcgcacacacacacacacacacacacacaccuuuggagguccagucuuugugcugcugaagagcugagggagccuuagugugccaccaguauuuaguucagaguggugaagacagcauccugggggugggggcgugggguggcaggcaguagccugcucagauggaguggaaggugggcgugagaaccaagggcacuggagggaguugacugaugcuuggguaaugggaaaccguaaagcuuuuggagccugugaucagaggaguaagagcuuucaagaggccgcugugggaccagcacuggagacuggggauggugucacagggaggcacugagcagagagccagggagggccaggccaucgcuagacccaggaucugaggagcaggggcacacugcauagugacuuggcucugaggcauggcagugggggugagugaugugcuggagggguuagugagaugugacccugggcccagaggaggggacccuguagaauguggcccauggcucuguguuagcagcugcaagucugaggucagcagcauaaagcaggcccuugaggaagcccagggugaggaaccugcuucuaguggggucuugaguuagccuuccuuccggagacugcagaacuuaccuggggauuaaaacuggcuucgggaaaaggggucgugcgugguguuugcggucaagaugcuucuuuccuccaaaaauaaacguuccagcuuuccaagaagacacucccacaguuauuugcugggugccucuuucugaguuucagagccacccaggccaaaggagauucuugcuuacuuguaggcugugucgggugggccugaggcuggcccugcccucugccacugcauugaucuuggcucccagugguugagacaagcaagcagcuccuucuacccacguagugccagccagcaugguaggaugauuuccagcccuugccaauguggugucccagccugggcugcgacuagugcauuuuaacauucacuccuuugugacuuuaaaugggucgggcacacggggauucuugaugagaacaguugaggggcuuuagccaagggacagagggacagagcucccagcuggccggccugcaacuggagccauucauuucauuuccacucacaacaagucuaaaaauguggucacacaugaggugcccuaggaagguggcaucauuuggucugugggaguuuuagugcauucugaaauuuacggcauuaagugacucaguuucccccacacacaucccccccacccccaaauucagcaaaguaggcugcagacuguuucagccugcuugcuucauuccccagacuuguuuggcgagcucuguucaaucuugagccucagcuguguccugcucccccggcuccccucuuuccucaucuaggaaacggaaggaagucucgcaaguacuuucuuagugaugcuggacaaagccauugaacucugcccucccuggguuccagaugguggaugcugcuguucuucccagcagaggggauacgcaguggaagauaguuuggaggaggaggaggggguggggaagaacacucuccuggcugugugcugaucggaugcuugccucuuagcuacaccuguugguguugaccaugaagguuucacacccugccaguggacagaaacguuccucgucuguccaucugucuguccuuccugcuugucuucucugccuuuucugucuucucgucguguuccugccuuuaggggcaaggguugaagcaucuucuuccagaagacagaucuggguucugauacccuuuaaaggaggcuccugugccccacucaaguggccgaaggacagaaaugagugguuggugcauuaugaugugggcagagccuugugucccuuugcucuuggcccuuuucaaggaugggguaguaauuggaggucacguagcuucuggguaggaaccagaucgaggggccaagugugucccacggugugugucugcgcacgccuuuaacccagcacucaggaagcagaggcacaaguauuucugcucauuugaggcuggccugagcuaugaagugaggcuuguuuuuuuggauuuuuuguuuguuuaaaaagccaagucaggaguaugggaauaggguggggguuuaaguucccagccagauuuuggauucacgauuugaagugccaagaucuauguuucuagaugacugguaagauuagcugaaguuaagggugggacaaguugaaauccuuugguccuuguagaucaagggcuucccauagggauaggaggaguucccagagaugaccccggcaguauguggagaacaagaaagcuccagugggacccugacacauagaaccugguaaaugaguucuuguaggucagccuuccuugaguacagagcaggagccugccucuuauuacgcuucuagauuccacacccccuuccccacuuccucaggaccugcauucaagccuacccaugccugguugugcuugguaggagguagaaguaucuuuugagcuugggcuauucagccaccuucacaaaucauagucaauaguaaugauaguuugcuuuucuaaccaaacaucucuuaggaguuggagggauuccuuugguuuagagcuaauuccuugagcucagucagccccacuaagucacugaugaacugaagucagagccgcgguugaugcuacuucauaccucuuccuaugaaguugucagaaaaccagucgguaacaagaguagcacguggaaagauuggagccgagagccucggcaauguaaaugguggacaccugaaugugguguaggcuccuccaaagguaaaugcggaguuaccaugauauagccauuccacuucggaguagaugccccaucguguaaacuagcauuuacccauauuuguacacaguuaaugacgagugagguuuaaaagccaaggugaaagcagaccaaggacccguggaagcugauugaguacacagaacgugacguacguacaauggaaugcuggucagacuuaggcggugggucuguuccgagcuguagggaggaugaauguugaacgugguaugcgaagugaaacuugaguuguguguauuucacuauguuuuuaagaagaaaaaaaaagcuguccaucacauugcauagugacaucauaccaugugagcuaugggcgagacauuccaggccagugucccaggccucaguggaagugcagggacaccugggggagcugggugucauggggcugagucugccuucugcagcuggacaccuuuucucccaaggaaaucaaguccagagucaaacgcuagugccggcuaguguuguugccaucccaggggaagcuuauugcuaauuguuuuuuuuuuuuuuuaauuuauuauuuucucauuuuuccagaagagagucuuguuuagauguuugguucccucccugauuguacuggaaguuuuuuauuugcucuaacagcucaacuuuuaaauuuuuuuuaauggcaaauggacugccccaucacauagagagauggaaggaagagauuggaugcaguagucgagaauucaagggucuggaaguugaaacuggccagagguuuuuccucauaggugaagaacucggagcacuuucaaguccgcugcugcuugaggucauaggacacgugcuguggggcuuaggccagcguugccucaacaccuccccagaauguacucuuuggggccagcccuuuggaugugguugucucaaucuaguuuaacaaggcacaggacucaggccuggaccugccgaauuccagacagguagucaagccugucuggcagcgaaaggagcuuccuccaccccagugacccaccgcagcuccucuuggccugugacccaugggaagagccauugcucucugucugcgagucagacuaguguuucccuggaugccagaagcgaaccugacugauccuucuugccuuuuccaaacugguaccccugucucugugugucugcuuugccugaccaucccaugggagguguuaccaagcccaagguggugagacccaucucucacuuggugguaggcaguggggaugucucaguuagcuaauuugcuaucacagauuacagagaccgaggcugagcggcugggacagacaccucuugguaagcgcuggguccagcauugagauaucagcuacuucaguuuccuaucucaccaauaguaaaugucugcuugcuguguuuucauguggcaaggagagcaacugaagacacugaucccauccugugacaguuuccgcaugaccucuuuccagccuaaucuuguuccagagggccuaccuuuuaauaccaucccuucagauggaagacuuggagcuuccaucugacauuuuaggggcacuuagucauccagucuguaacaacagagugaugugcuguaguuccggauucucaguguccugcuauuuauuuauuuauuuauuuauuuuacuuuuuuggccaaaucugagaguggauugcagauuaacugugagacaagugaaacuggacaacuaauuguacauuucagcccuucauauccaugggcucgcauucaugaauucggccaggcacagguuaggaauaucuguaguuccggauucucagugucgugcuauuuauuuauuuauuuauuuauuuauuuauuuauuuuacuuucuuggccaaaucugagaguggauugcagauuaacugugagacaagugaaacuggacaccuaauuguacauuucagcccuucauauccaugggcucgcauucaugaauucggccaggcacagguuaggaauaucuguaguuccggauucucagugucaugcuagugcuauuuauuuauuuauuuauuuauuuauuuauuuauuuuacuuucuuggccaaaucugagaguggauugcagauuaacugugagacaagugaaacuggacaccuaauuguacauuucagcccuucauauccaugggcucgcauucaugaauucggccaggcacagguuaggaauauuuggggguggggagaaagaagacgcaugcuguauugaaacuggaaacuuguuacucauuauuauucucugaggaaaacauuaugacguguguuguaccugguacugcccaucuucuaggggugauugacagaugggggaagugaggcacgcagaugcuuuuugucuuaagacucucccugacauugugggcuuuuuguguguguguguguguagggaucuuggaaucagucccccaccaaugcugagagaccacuguauguguuuggagaacagcaguguguauagcccauugcuuuuuuuaaaccggaugcccucugagaggcccccgcuuacacgugccuccaucucccacuuuaggaaagauaaaacugcuuauuuugagcucugcaggagcuaccugaggacauuauacucuggaggaauuguaacuugaaaacccaguuccacauaacucccugucuuggugacuguggucuuaucggaccucuggaaucaggucagaaguggcucaucuggaaccucccccaggguuccguucuguggagccgacagcagcaccggugggcugcacagguugcagccgcgccaggcccccacagcugcuccuucagagccggugaaaccaugagucuuucuccucagcacauccagaaggcuggggaggcugcugcuaauuguuuauaagcauuaacuguuuaccagucauacuugcuauuuugaaucugacccugcuauuauguuguuuguuucuguucacagcugagccuuaagauggguagguuuuuguggugagucacucccgugaugguaaaaccaguaucgaucaagcuacucugcuaauccugggagccgucuagagagaugaaacagucugaaggaccccuucaccugggacccccacaccccacacccaacccccaaccccagagucucuguauucaggucaggagaacaugggcugucugcagcucugaauccuccaaggggcccacgcuucuuagaagccaugcuccauuagaggaaggggagacaagccccugagagaauuucucagacuccauccagauuaccugcugguguucucaggagccaugcacguuuguggagagucagggacugugugaaguccugggauguugaagguugguuagaguugccugagggcagcugugcugguugcugugaauuccuugaagcuguacggugaaguauugagugucagagcuaagcuggaaguggugaggaaagaccauagugauuggauucuucuuucuauauccugggaauacagggccaccagcucacacccuccacacugaaguccccugggcagauuuauuaccaugucaccauuaaugugugccagcuuuggaguccugaggagaaaaguccccaagggcccagagggauguucugauuugucugugguaccuguggaagagccuagauaucgcuggauucacugucagugggcaguagaauugagccgauugauguugcuuuuucaaagaguagggggcagcucacaggccccuugaaaugcuugggcagagcuaaauuccauuugguagggauuggagagggguggaucagcguucaggagccuguggaaggauauacaccguguaagauacagccacgccuugcuacuugcuugccucgaagaggucucguauuaaccaguuaggaaucugaacagacacacuugguguugcugacaguggaaaccaaggaagagaucauugugucacccaaauucugauguccccauggaggaucaggccugacuaggcuugaggucgggacuugaugugugauggggcucagaacaagguagaaguauauugaggaaugaggccaggcuauggagagcccauuguuucuuuagagcaaaggaauucuuugugucuuuuuaaagaaacacucauggcuccuguuguuugacuaggacuuuaagcuuuuugaggguaggguggauuauagagaaaauaggagaagacugucuccgagaagcuggaggaccucuauggcuuacuucagugggccuugcaaaggcugcucuucauugcucuugggcuugagugcgcugcuugggggacagguugacucaggaugccaggcaaagggccauucagugacuuuacauaacucuuucugcuucccuccuaggucagcauucacuuuuuuaaagcuuguccucuaacauugccugcucaucuaguuguguguuugauccguaaggaaagcaauugggauugugcuauaaauuacaguaccuucccagugcuagaggacuccugacuccuccacauccuacccagggaugaugaagguuccugcuggaguuuuugucacaucaggaaggugcucuguuccccuacagcauagcagaccuaaccacaguagugucugcuccuggguggaguucaugagugucucuccuggauacugguauagucuuuugguaaagugagucgggcaggugggcuggucuaagagcccuggcccaggugugagcauucccccauguugucucucucaggccuuugcaaagccuuuugcuguauuuggccaggaguagugucucccugggaacaaaugaaaguuguuuacaggcagaguaggggacauuuggagauguaaagugccuagcguccucauugcauuccagguucaacuuuggggaggcgugacaaagcugaagugcgaggcagcagacuguguguguagaaagcucucagccccucuuaacagaucaggaaacaaaacccuguuuguagagggcaaguuccaguugagcguuuaauuaugggggugacauuuguggcacuagagagagacuggggcuuccuggccgccucauuuuuuuucuggcccggguucccucgagucuccacucguuuuaagauuugaaaaacuaacguaggaugccuaagauuuuuuaaauuccuggcuuuggagaccugacuacagaaaagagccaggguuuucuggcuggccauuugaggcucugcaguuucucacuuccugcuucauagccuccaggguuuguaaugccugcaggcuucccccuuccaguuuaaaagcagccauugacagaaaaauaaauagaaaaaucucucuccagaaauucuacuuccuguuguugucacugcgcucugacaaauagcuuggccaguucaggcucucguuggggcuuuuucaaagggauucuuggacucuuucugcuuggauagacuguaaggaggugauaaguuaaaagaaccgcggcuuaaucagcagagugcagaggcugcaguuuagggucuguuuuggcuuuuggagcuugugaaugugauacaaguagcagccaucugcacaguuggggcaaacuaagcaccagucgcuuccuccguaauguuucaguguuaauuuuuaaaagguauauuuagacacaaaugaccuuuugugacaccauggagggauugggaauacuuaugguacaauaaggaagaaggauccaaagaaauccagccaguaucugaauagcagacuugauggauauuaccccccccccccugcaguggaccugagaguucagauguguccuugcuguagaguuuauuuaccuaguuugaagauucugggcuccugugugcuaauuugagaaagauggaguuuuacgggugauguauugcuccuccaagugcgugccuaugaaucauuuugucuguggugaguggacacccccuacccccauacaggagccuaagcaguugaagcaguguaucuuguaugcuuggucagagacaguauuucugggugguuuccuagugcccggugucuacuccauagcagaguaaauugguuuuggagacuugguuguuagcuuguugugaagagccuuuagcauccuucccugagguuacugugggguccuccuagaacacaccuguuuuuauaguguaugauuaauugauacggugcaucgguuguguuguauguaucguuauaugauuaauugauaaacugcucugcauacacguuuguaaauaugugugagaugcugugucauuaaauaccauggcuaauugcaguacugcugcuauauugacuauacugugcgugucauuauaauacgugguuaauuaacccacuggccagacagccauguucuggagggaucuuguuucaguacucaguggcaaguccgagguuguacugaaguaaauaagugggagaucauuguccuuaguguguuuuguuuuuucucaucggcuggugggaaugacaggucucuacugcugccuucuggggauuguccccacaauaggaaauggaaaaaaaaugauaaaagaccccuggguggugacuuucuaucaauucuauucaagcaggacuaugauaacuguuaaaccguauggucauuagauucuugaugcuggguccauauucuuuaacacgcccagucccagcugcacuuuuggcuaacaaaaucuuuccaauuucagccuguggcacagagcucuuaggaucggagggcucuaaaucacaggugucaggaaccugugaaggcugcaugcgugauggcggagggcuggcaggugaaugcuccacaagcagcccuuguuuguguguguguuugaagcuggcaucuuuucauuucccuuuuucuucucuggaaaucuagucaguucuuuuaccccucacuggcugaacuuuccacggugcucaccguucuuguacaaaccgucuggggaaaguagcagagacuuuuaauccaagguguuaggugggcagagcgacucuggugguuccuuggauagcaucugguguugucuuccaaagcuggaaggucuguguucaaagugugacugaccaagucuuaggucuuccgaggguagauuucaagcaauuuuuuuuuuuuuuuuguaaagggggugugauuuucauguggaagcagacuuuauuaucagaccauauugagaaacgucagauggguaaaccugcaguggcugcaguggcuugaacuuaaaacuuuugaacuguggaaggacugucgagaugauucaguggguaaagguguucgccaccaaaccucaguucaaucccgaggacccaccuauggaaaagcaacgccuacaaggugugccugccgggguauauacauccacguaauccacgaaugcaaauggaugugauaccauauguaaaagaauugaacuguuagccucccccaaagcaagacauguucauuaugcgugugugugugugugugugugugugugcgugugcguguguguguguguguguguguguguguguguguguguuuguugggggcaguaugggacagucguuucugacacaugauagaaguuguguaaauguaagcuaagacaugacuauucugaguauacuugggucacagacacgcacaucaaagcuugucccuccuggcaagugacugaucaagucuuaggucuuccgaggguggauuucaagcaauuuuuuuuuuuuuuguaaagggggugugauuuucauguggaagcagacuuuauuaucagaccauauugagaaaugccagauggguaaaccugcaguggcugcaguggcuugaacuuaaaacuuuugaacuguggaaggacugucgagaugauucaguggguaaagguguucuauguacccaggagaggccagugcucagaacucggacuuuucuuugcacaauugugccugcacauaacaccucaggaguuucacaugugaccugguuaaagauaaugugcagacaugaugaacagugaacuuuuaaauuagggacaaauuugucugccaccuuccacuacaauuauuuuauuauguuuaauguuccccccucaaauuauaauagcagugaaugguuauuaagggaaaaaugagaaaaauacaguuaggaaagaaaaggaauuaucuuuaaucagccaagagguaucuuaaccaguuguuuucugucguauuuucuuaaagggcucugguccuucaacuuguacauauuuacuuacauauuaagauguaucauauauaccagguuauuuauuauaauuuuccuauuagcacauugaauauuuguccauuacauuauuuaugcugcuuauaucugguauaugguguuuaaggaaauuauuaaaauuagucuggcacguagaauuauuccauagcuacagaauucaagcauuuaacacucucugcauuaaaacuguuauuaagaagcuauguacuauuguuguuuuaauucuuuggguaaaauuuguaacuucuuaugaggggauggucauauuuggggagagcuugcuuggaugggugggugggugagugagcgagcgagucagugagugaacgagcgagcgagugauccaucuuugauaaauaucguagcagugauuuccaggaagcuccagcuuccugcuucagaggcagugccugccaucuguaccgaaugcuaaaaagagcccugacuguaguuuuagcguuaaaacguuacaaucuccguauucuaauuuuuaaaaauugcuaguaggaucuucauccaucaauucccauguuuugcuugagguaacaguuccauagaugugucuaugacuuuuaagacuuaauguaucacgugaucucuucuacauaucugcugugcucucucucucucucucucucucucucucucucucacacacacacacacacacacacacacacacacaccaagucuaagacauuuguugacugacaguacuucauucgaagcuagcacagccucuucacucuuaauucaggacauguuuaaugcuugguccuuuuguguaaaaguucacauucaugucagagucaauucaauuuaaucaaguguaggacuucucauuugucgaauuucuccuuucagucuuuaauaccuguaaaauucauugggcauuuuggugacgugggacaugggcuccugacaguucgauccucucucgagcuaucugccaugcuacaugggcagguuuucaccacugaccugcugcucucagagacacagcccuauagucucagagugcauauuacagccugcggagcaucauuccugcuaacuuagagcaugaguguacacauguguuuauuuuuguuuuuacaagucuuuucucacagugccccaagaaaugggaaaaccgaacaaacaaaaccccucuucccaaacgaagaagcacuggauuuugauugugauggucagauugauguaagucagguuuuggaaaaauaagguuccccaaugcuugagcuacuuauuuaaggcauguuauugcuuuccagucagcuuuuauuuaucaagucauggaugauuguccuuuucacuucugauuauuucuggacguuuuagcaccuuacugcucauguagaaggauuuucuggauuccuccuuguucauguagaaggauuuucuggauuccuccuuguuucauuucucugaugacuccuguguauuggcugagaagguuacgguauuuuguugauuuauuuugcagcuaccuaauccauugauuguucccguaguggugcuuucccacccgaguuccccgauuucuccugugcacagaaucauugaugaucaacaaaaaugcuugccuucguuuuccuaguauccaauacccccuugucuguuuaaggugucaugacauuuaggaaauguuuuaguuacuuguucuguugacguuaugagaccaugaccaagguaacuuagaaagaaaugacucaguggggacuuacguuucagagguuaaguccauggucuccugcugggagcaugggagcaggcaggcuagcauggugcuggagaacuuaaaucuuuuccacaaaugggggagggagggagggaaggagggaaggagggaaggaaguaaggagagaggagggacacacaagcaugagugguggaaaugcaugggcuuuugaaaccucagagcucacccccagugacauacuuccaucaacaagaccacaccucccaauccuuccccaaacagcucuacccacugggaucaagcauucaaauacaagagccuauggaggccaccacagggauagauaagcuaaacaccugccuaauaaagucuuaauucggcgagguaaaggaagucugaagggaagcaguguguggccuuggcagcaugguuuucuaagaggacaugaaggaccagaccccuggcuucuguaucuuuaucauuagcauccgucuuucacccucacggucacaagauggcccccauaucuccagguaccaccacuguauuucaggcaggaagaauagaggggaguuaaaaaugaaggagaaaaaggcagggucaguugucagcggcagcaucugguccacgagcugguccucucgcuuguuagugaguccuaacucaccuggcuaccacaagugaguguggcuuucaagccugcuguggagguggagguggggguggggguggggguggggguggggguggggguggugguggggauggggauggggguggagguggagguggugguggggauggggguggggguggagguggugguggggauggagguggggguggggguggaggugggugggcccugcaagggcuuuucacuuugucuucuccacccuaaagggugcuaaaugcugaucaugcuauauuugucugccucuuucuuauauugauggccaugccugucguaguucuccuuacgugugauauccuuugguuugggaagguuuccaucauguugaggaauuauuugucuaguuuuugugggugauugauuagggauggcugugaauguccucccgugucauuugggcaucccuucggauucagauguuguuacagugugggcgcgauacaggaauagaucaccuagcgguaaucccguuucagauuucuuugagaaaugacuugggcugguaguggggugacuguuuaaaaaaaauucuaauuaaauuuagucagucuguuaaaugacagaauucaguuuuuccuuuuuaucuacaguuugaagaaggauguagcuuuauguuucucuuugugugcguucuuuuccagauuuugcugucugguuuaggccagcuuuguaagaugaauuaguggcuuuccuuuuuagcuucuuugucauggcuuguauaguguggcaauaagcugcccuuuguuaaaagcuuagaagcuaaugcucuaaaaacugcccaguuuugucaguuucuuaaaauuugucucuggguauuggugugcaguuggcuucugauuuacuuucugauuaguuuuuggaauugaaaauaaaugucaacagauaauuaaaaacacucgguuguaugagggucuccuccccacccuugagguggaggugagggcugaacccagcuuaccacugagcuaaauccccaagcccccauguagcauuuucuucaugauuuucucuuucauuccuggucagaccugccagagugcuccuuguucggugcuccuguccaaacaguugguucugucuuauuaaagcaauuaugccacggcauuuugcuggcgauggguaaccucuaucuuuuccuggccuugcuggguucauauauuaucagugacuugaugguagaggcuguagauaacaccuuuuggaugcacaccuggcuuguuucagguaacccugaggauaguccuguggcugugccugcuggacguuuucauuggcucucuguaaugucccgugaugggugccgagaguagaugccaccuuaggaccucuauggagagggaaacauuugcauaccuggguucaucccaaggaaugcauuaaagacaugugugacucuacacauggcucuauauguggguccuggggauuugaacucagguccccaugcuugcacuguuaaguacuucgcuugcugagucaucuucccagcccagauuauguuuugauggaaaaggguaucaauuguaauuagaaggugguuccccccccccccgccccuuuuuaaaaaggcucccuucaaaauuguugcugguuuaauuaaagaguuuggcuuuguuguuaccuuuuucccuuagugacccagaaaccaguauccuucucuggguugcuuuuaaauuuuugccugaucucuuauguagggcucacaugguauacgcaguuaaacuugacuuuucuuguuacacauuuuguucugaagaggcauggaggcagcauucguucuuccagacuugacuaauccauuugugcugguugguuuuugucaccuugacccaagcuagacuuaccugggaggaggauccucguuugggaauugccuaccuccacuagacugugugggacaugccugggaggucuuuucuugauugcugauugauguaggaggacucagcccaucgugggcagugucaucccuaggcagguaggccuggacugagcaagccaggguagccagccagaggucaguauguaaugaucugccauaguuucuucaauaaccggcuuugacuucccucagugauggacugguagcugggcauguaagaugaaauaagaccuuuccugcccagguugcuuuuggucaugguauuuaucacagacauagaaaacaaacuaggcuaccagcccacagguggucuaccugcccacuagaauguguaguauaaaaggcuggguauacugaccgaccguggggugcugggauaguaggccaugucuucugcuuucuuuaaaagcauggaagauguucauuauuuauuauauugauauuauuauuaauuauauauuaagcagccaacaaaguaccugccacauagcagguauucauuaaaacagcuggacugcagauugagacacauggcuuuaaaaagagaucuaauuugaguauggcacuuggaauggagcuacaguuuguuuuaugaaaacauguuuguaauugcucagauggucuauauguuuacuuaggauucaaguacuguguagcacgcugaguguuucacuggucuccaguugugcucuguccccugggggugggggguggggguguucuugugugaagacgagaaggcucuggagaaucccuugggcuuugcagagagguucuuaaggauuggggucaucuuagcucugcuuaguguaauacacaagaguuuaguuuguuaggaaaauuuuuguugguggaacuuucuaaaaaagauguuagcccaguggugguggugcaacaggacuuuaaccccagcacuggggagggaggcagaggcagguggaucuuugaguugaaggacagccagggcuacgcagagggcguccauuuuggguggaggggagauguuagggacauuguggagugcaggcaagugaaugcccuuuugggcuagcucaucucacgggcuaguuguacagucuccucucucacagccagaugguaagguuuauuguugaaaguuucuggguuuuuuuuucuuuuuuuucuuuuuucuuuuuuaagcuggggaaggaagagucugcauagaacuggagaguuccagaggccaagucagggcacgaaggccauggguauuuggaaaucuggguguaguucacccuuguuuuuaauuuauugggagucucugacagcugauaauugaaccacaugugugcaguguuugagaggucuguguucugacccuguccgugggugcauucuuugggauccuccucaggcugacaggguugcccugugcacgggcaucuuggccagcuggcccucagaguagauuggguaggucaguguuuguccucaggcuagguugagccaguuaucaaaucacuuggggguguuuugacaggcucagaaagucucaaaaaaaaaaaaaaguucugacuuuaaaaagguaaggaaauggucucccagugagacgacuucugucuaagaaaaaaaaagcuucuaagacauaaauacuguauuauaaacaacuuguaauuuucauaguuuucaguguuaguacuagcagcuucuaugauagaucuuaaauauguuuaucacagcuggaaaaauguuguauugucauccuuguuuaucauaauaugccaccuacucugguugugccuuacaguguagcccugcuugcuuuaugcuuuaugguggggagcuggggugggggggccugaugaauacaaaugaaaccuagaaaucgaaauggagaagaagaaaccuauucagccaggacgcugccuuuacagugagagauuaagacuggcaguguccuacacugugguuuauugaauaauaaugccuaacacagccugagcagagacccuucgguggcugucuucugaacguuuugcagacauagcaagaauguaucagaugaccacgggaccuuuguuucucucuuuguuaaagcuaggugaauuugguuguugggauguugcaguguugcaguuuggagauacuggaggagcggaaaccuucccucugugcgccaggagaguuugugguuguuggcagucuggcuucucaaucuguccaaugcucguccuugguggcuaugauuugagcaaauaacauuagguauuugcuauccuuuaugagaaguuugaccucguuuuauuagaaccauauacagucagcccucugcacccacugcuucuacaauggcacauucuacuaacgucagacugagauaauucuuuuuaaaaaguacaucuuuaugaacagcacagacauucucugugucaguuccugaacuguauagaguaaggacuauuuacguagcauuacauuguguuagguauuaaacacgagcuaagcaaccuaaagauguuuaaaguuagauaacgauacaucacucuugauuaaggaauuuaagugugaauuuuguuaaccaaagagaagugguguuuccaugaauuguuucuucgaauaugagaucgacccuauacugacuuuuuucguaguuuugauuuuuguccugccucucugcuugugauugcaugccauuuguuaacauaauuugagaauugcaaauucaucuuaauaauuuccaagaccacaugucaugaggaaucaaauuacaaagcuaaauguaaaccagagugagcguaguuaacauuucucucccguuccauacucuugccuagagcauuggauuucucaauauugguuccuagcguuucaaaauuguauuuaauuuucaauuugaacuauugacuuuuaagaacagugaucacaugauuucugagaaaucuguagaaauguuggcugguagacgaggcccagcaauguugaguucugucgcuccuggaauuggccccucuguguccccuaugagguguaacuagccaaaggauggccucuagauaugguacagcgguuuccguggaguugacaucugccuacagguuccuucauacccaguuggauacuucuuucucaggagcucagcuacaagccccugccccacaguggcuuaucuagagucuguaucugcggauuguuguccauugucucgcuaaagaugcuuccccaacucacuucaccaaagugacuggaagacaguaugugugagguguauguaugagguguucgcggugguuauauugguggggcuccccuccucaggcugauccaagucuuggagcuauggcuuccuuagaugauagggcaacuccuagagucuaaaacugccuacagccuuacuuuagaguaacaggggaagguacuauucaggugugaguuuauuuugauguuucauuaacauuugaguuuucuuuggaguuuuuggagaccuucacuggaaagccucaaacuuuuuuuuuuuuuaaugguuuuagagcuuuauuguagaaaggcagagagaaaaagagaagguagaaagagagagggcggccauggccaaguggagagaggggggaagggaaagagaggaggagagcuagagaauaagaaaggugagagcuugagugagccucaaacuucuaauccuccuccuucugcgguggaccaggaugccuggcuuaaaacuuaauuugguuuuuaaaugguaacaauuuaucauuaucuuucacuucccuuuaagauuguaggugagugauacuuuguuuaaauggcgcugggaacugaacccagggcuuugugugugcuaagcaauaugcaggcugccaacgucgcaucuauguugcgucguuuugaagugcaaaguccaguagcuuagaguacauugcauauacccccacccaucuccagggcuuuuaucaguuucucagacagaaccuccaguaacaccaguuccuccuuccuucuguccgucugucuguccaucauuuguccuggcagccaccauucuuugugucucuaagacugcacuuagucaccucagagaaguggagucauagucuuugccuuuugugucugucuuacuuuucucuguguacuguucucagggcccacccuuugugugagagcuuuguugugaguuggagugauacuccaguaaacagugggccugugccacauuccuacacauggcaguuaaugcuuacccacuuaucuuuggggugcuuggguggcuccccagauuggugcuuaucaguaauguuccuauaagcaugacauaacaauagcuuuucaaguuucugcuuugaggcuuuggggggcgggguguaucuccagaugugguggggucauaugguagcucuacuuguagauuuuugaggaacugccauguuacuuauuuuguaaucuccccuuucucuacccucccccuuucugugguguugggaauugagcaaaacauccacacaugcuugugagugagcccaaccgugaguccaguauuucaaauuuuugucgguguaaacgggcggaaaccugaggguuugggaaggaggaguugagaggagaaugcuccucuguguggacagcaguuagccccgcuggccaguauucacucagcacccagcauucucaggcccuuggggcagagaauaacaaguguguaguccuagcuuaccuggucgaccccauuccaguagucaucaccgcucacauucaggagagagaggcuggggccccauggcccugaggugaggcucgaaggcuggcauccccgaagauaggugucaggauaaaggacuucuggggagcauguggaugugaagccucagguggcuucacagccuuuucagugggucacugauaaccugugucccucugucuguugucgggagaucaggguuguuuuguuuugccacuccccugcugguuagugggagaacuuagauacucucacuccuggugucaguuuacucauauggaaaauggcaucacagaugcuuacagccugaaggucacacagaccuuuccagugugauauuaaugccuuguacauguuaggagaaagggugaagcuuuuaugagaugucccaggggauccaggaccuuagaaagaacuguagaucaacucuggggguuccccuuucgccaacugugcuugguucucccguccgugccgaccggacagccucacaggccagcuccuccucugcagggugggugagaguguucgcugcccagauguucgcaucaaguaaacagaagcucagucaguguuagggaaauuaaaucacccagcagaaaucaauguuagugaaaugaaaucacuugaucuuaaaagcaacaauggaagagccauucuucaucuucauugugcuguugcgcucucugcauggcuuacagugcguauccuuucuuguaucccugucaaggagagcagcuuugguugguuguauuagauuuuuacacgcugugguugaggcuccggggauuuguaaucagcugauugauuaaucaggaaauguuaaaggauuagaccguauccagaagggcugccuccuuugacgacucagaaggcaggcuuguucccuagugcucucugccacugcggaugggggcuguugagcacaugacacaucacaugggccuuucuggaugcuucgacaggugguagugcagguacugagagcggaccauguuucguagaugcugcuaccagccagcagugugagcgaaggacaggccacccuggagggcaguuauaucccuugugcucauccucaugaccaggaaacuagggcagaaggaacaucgcauauccuggcuuuagaagcagaguuccaaaauuccuguuggcuccauugggugagguuuggggguuaaggagguggaagaggcaaguaauaaauuauaaagauucgugaucguuuugaugaugacgguuauugaaaaaauacggugguaaaguacuuaaacagaagguaguaagaacaccaagcccccugcugcuccuccucuuccuccaacucuuccuccaucucugcugcucccagaaggcaggcuuuacaauacgucuuuaugcagagcaagcaugcuguguccugcucuauuuaagaacaaauuuauguuuuguaauuuuucaaauuaaugugucuuggcucucuuccuccaguaggaugaucuuuguucuugaauuggcuuugaguguuacgaggaauacagccgcgugcuccugaguuaaagcgagcaguacggaaucacagaguugagagugguggccugcccucuccucucccugccgcucugcggagggagcugccaguuggucaguguccacgcagggggugucgagaaggaaacugcagagagagaauaaugauauuucuuuuuaaaaaaaaaggacaucaucauugcuguccuugaggccugcucuccugugcacacaagccuccuugcucugccuucuuaaguagacuuucuuuuagaacagaguggggcuuacagaaagaguguuuugguagcacagcguucuccuguacacuguaacugccuucucugccagcacccuaugucaccacagccugugagugagcugaacucggcgucuuccuuugagcucucuccagggcauugcuacuuugcuggcagaggucuccugcaggacaccucuccauguuaccuuuagcuguuacguccucucggccaucucugagccugugacaguguuuuagcucucuguccuccuuggccauggugauaguuuuaaggagcacuggccagguuuuaugucccuuaguuugaauuugucuaauggcguucauaggauuaaggggaaauaugaggcuuaaggagcagagccgacauguuucucgucccacuguguugugggaacggcccugccaaaguaccucccuucagguguguugacauugaucccaggaugaagcucacagaagccagcugcacaguccccauucuuuguaacugccguguucccuugcaaugucuuuaaaaaggauuuggguuuuuauaagucagauccuuugggauacugucaagugugccuuccuuuucauccaaccugugcgagaauggcauccguggaagagaagcuaaaaugaaucaggagagugggcguggggaaugaccgauggauguguccucccaaauggcugugugcacccaccggaagagaacugcugcggccccgacaccaugcccaagaaugguacuguuagaucuguaauuucuuccuguaaguucaguaagugaaaaacaucuuauuuuacauucuucucauugcgagaggcguaccccauaccccggaaaccuuaacgugagaugaaggcgagaacaggagccuccagugacauuugggaaacaccuguuuaguacgaagcucugguaaaaauacgcuccaaacgaggaucuacucaaggaaccaagccuuuaucucagaguucuuucccacagcacauaccugcuguguuaccuuuggucauuggcccuaccguuuaacuguaguguuagugugaaccuguuuucucucuuucucuguguguuaugaauacauguguguucaugcgugguuuugugcacacguguuagcauguggaugggggccagagguugagucuuccucaaccucugcuuuaccauaacuuaagagacgggguuucuuagggcacccggagcucaucaguucagauucgcucucuggcuagcaagccuuggguccccagcacuggggcuauaauugcgugucacuccugccuggcuuuauuccaugggugcuguggaucagaccgaagcacucagguuuugcagcaagcgcuuuacucacugagccaucuucugagccucaagccuguuauuuucuguucaaugcuucauagaggagcauaucauugauggugaggacacuggggacggaacaaacucguuauccagcaucaagagagauucagggugaggggaggcuggguagacauacgcuaggagacccuacucuuuaguuuccagggucagauaucccuuugcccugugugcuguuugcccccagcuuugauggaagaacuugaggcucacauggagcuuggcuuugguguuuccuuacuggggcugggugguccucacagcuuccuaugcucaccuccagcccuccuggcugaucccgugccagcauccuugaggucugugugagcugcggcuggcucaggggcccaucacuauugguccugucugagacugagcagagaacagcaggcauagaggugguguugacgaugggcagugaguguugaccuugaugugcuugugguaccaagugcaugcggcaggacaagacuuaguaccucuuguacggaggagcgacuguuguuugagacuucuccauugcugagagaucuccugguccugcaccuagaguuuuguuccaggcaaguuccuuguagaggcugauacacauagcuccuaagcagggaugcugcugucuucugcaagagccauacaugcaagaguuguacacacaggcuuaguggucuccaaagcccucugcuuccugagcacagcuguccuucugggcuuucucugccuagcagggauucguuuguuccucuguagaaugaugugcaauuuucugagcuccucagccgggguggaguucuuccaggcugucccuuuauuauccaaaagaggaggaagugggagaguuucucucuugagagagcugagcuuagaucugcucagcugagcucaucuuaagucacagucccugcuaucugcuaccaagaagcacccuuuguuuagcacuuaagcuagauacuuuugcauucccagcauuugguuugguuuugcauaacuguuuauugacaauaugguguacucaccuuuaacuuuuaagcaaauuaacaccguggcccugcuaagguaagagagggaaacaaaguugggugguugcuagaugccugaguuggguccucgcagacauaccggcaccaaguauucaugugcaccugcucugcgcuggacucuggucucacucaggaaccuaccaaguugagaugccggcccccucuuccauccgagcaagccuauaggagacuuuuagguccccauuuguuguguguuguggcuuuggggacuuuggcugccucucugaauuagcaacuguguguggccaggcuaguuuucuugucuaaggaccccagucugugaucagggucuccugccugcuuaguugaaggaguugguacuagccuggcaucucacugaggcaggguagcuuugaagggaaagcuugcuugagaucaucagagcacuccauguacuugagaauuauauuauucucagucagaaccuguaaagacaacaaauagaacaauaccacccaggggccaaagagauggccauguuaggggcauucgcugcucuugcagaggaccagggauugguucccagaaccacaccggguaguucacaaguaccucuaacucuaguuucaggagaucugguacccucuucuggaugcuacaggaagcaggcacauccauauccacaacaccuauaagaaaacaacaacaacaacaaccaaaaacaaaacaaaaaccaacaauaacaaaacaacccuaaaaaaauguuaaacuguacuuguugauuuccaaaaaaaaaaacauguggccuuugggguggcuuuuuuuuuuuuuuuuuugcacauguauauaugcauggagagggggugugucugucuguaugcauguguguucacaugccuguggguacacugcuauauacaaauauguggguauggagucccaaaguuuguaucacaugccuuccaugaucauucugcacuuuauuuacugcagcccccgucucguggaggcagggcucaucagcggcagucagucuacuuagcuacccugcucugucugcuugccugguguuggaguaacaggcagcucccaugucugccccccucccuuucuuaacucagugcuugcaaucugcacucuaggccucucaauugaauggcaaguguguuaccuacuaaaccauuaaaucucuacugguaacuuaaaaaccaaaaacucuucagguucccucucccuuccccucccccucuccucuccuccccuccccuccccccuccuucucccccucucccccucucucccucucucccucucuccuccucucucuuuauuuuuuguuuuguuuuuguuuuuucgagacaggguuucucuguauaguccuggcuguccuggaacucacuuuguagaccaggcuggcuuugaacccagaaauccuccugccucugccucccaagugcugggauuaaaggugugcgccaccacacccagcccucucucuuuuuaaaaaccaaaaacucuucagguucucucucucucucugucucugucucuccccccacccccgucucugucucucugucguguguuauaugugauguauguuuugucuguauguauguguggaggcuguguguguguacauguggaggggaggucacaggaugacuuuggacaguuacgucucuccuuccaucuuuacaaggguuccagugauugaaaucaggucaccaggcuuguacggcaagcaccuuuccucacugauccguuuugcuggccccacuggugggugguaggucuuacugucaggggcucuucauauaaucugaaugccagcaucaaaggaagaacgugcagugaaaucagggaggccagcuucuccaggccuugcagagggaaauuugaaugguaucaucuaagugcuguguggaagcagcugucugcuuggggguugagauugagaaggggaugugauuugauagagcuggggagugaauggcagaugccugcggaugcuggagucaugggcuugaaguuccugagagaugcucugcccucgaaggaugccugcagaguucuugugguuagguuguguugucgugugcuuucugucuucaugucuuccuaugggcuaugguuucugcuguugcacauuuuuauugguggaaacacaugcuuuuaaggggcagccuuucacauacgggcugacaaggaggagauggaaccuugcuuuucauaguaucuuucuuugagggaucaugagggacuugacagaggucuaccaggcaccauaugaaagugccuacacugaucagauggcucuugguacacgguaugacagucccuccucagcccucuguaccuggaaguaacauccuuuucaaccgcgagacaucucuuuaaacaagaauacuguaaaacugcacgcaguaauuuagauuuaaguccuuguccuuuccccucccccauaccagugugaucccugacaggccacaugguccuaauuuacguucuguuuucuuugauauaaaacaaggcagauaaagggcugaagauggcacaucgguuaagagcccuuacuguuuuugcagaggacccagguuugguccccagacagcucacaaaccauguguaacuccaguuccagggggauaugacuccgucuucugaccucuuuggguaccagacauauaugugguacauauaaauacacaggcucucauauauacauacauguaaaguaaaaauaagucuuaaaaccaaggcaaauaagagcccaagagucucagugucaaugcagucaggcuuaugaaguuucagaacugggcuacaucguagaaacgcucaucaccuuuaagggaguguaguaugcuuuacaaugagucuguccguguguguuggcuaaaacccuuggucugcucuucccagcaggccacaugagacccaaccagcccucccuaggguccugacaugcuuaguaucuguagcugugccuugugacaggcuuucugguuuccaccccuucuugccugucaaaaguauugaggcaggaacaaacccagaacuugggggucucuucugccaucucuuauucuacuaaggaccacuuagguaucaccuaagauugucuugacuuuuugggggugcaggcacaacaccccaucaucacauacagaaauuauaucuaauuaaguugccuaagucuuuuucacaccuccuacauuugcacauuucuuuuuugcacccauguccaaauaauauuauuuccucucuguugcaguuccaaucuguugaucuuuuuuaguucuugacucugucauccggugcaguugcuaucuccccuggaaacuugucccugauuagagggacauuuuauuagcauuauuggugauguuacugauaguaaugcugaaguagauaugacucagaaggagcaucauggcccuucuucuacugucccuuagucaaucagcacuucggacuguuacugagccauuggaaugcaguucuccuugccucauucugucagcagggaugugaugagauuguuuuacguagcucuguagacaaagcaugugaucuuggaaacagccacuuugucagggaagggaaagauacaagacagaguccuuaccugcuguggugucuaugcuagcuuguggaccauggcccaugacuugauucuccaucaguaugcuucuuccaguucagccuuugguugaugaugguucaaggaugcacguaaggagauauuacucucauguuugggcucauguacaagguguugagaugaucugagaaccuaggugggcauugguuucagauaucuucuccuggaggaugcugggagcagagcuuguggguuguuuggccuggugaauggagccuucuccauuucguggagaaauccuaaauucugagaauguuuggucuuagugaguacagcuugccucugaagaaauuagggguucacaccauccucuagauaauuggagaaugcaaaacaguaccacucaaaaguggguuguccggaggugacagagcaaagcagucaaugcagaaguugcaggagauaacaaaggccaucacgugacuaggugaggugaggaugauggagaccagggaaggaaggaguaguaggagugggcagguuggagcuauaggaucccccuuuccaugauacuuuacaaggcaagagcaguguugacauucagauagacccguguuuaggaaaacaacccacaaaugcauaaagucaacagguaggggucagugguagggggugucauucuguccuucagucauaccagauagugacacguuacaguuuaguuugcaaagauggugaguuccaugugguguuguggcuucugccugauccagagagaugggugcagacgccuagguacuucaguauguuugccaguuugccagccgcguguuuagaacuuaucuccuuggugagucagugcaggacucuuguggggucucugccuggggucucugcaccuguguguuugcacugugguaaggcuguggccaaaccugccucccaccccacuggacucuccuagaccuauggaugugugguccauguacuuuggguugguuacugcuguuucacacuucauauuuaucuaggguuugugccucagcaccuacaguggguuccuugccauugccuuguagagguugaggcucuugccaugcaaguuucccccuuaaacuugagugucuucugggugcucuuguugcuggucuggccugccucucccuguguucucauucucuuuuccucuucucuguuucugucucugugucuuucuggcaaacucccgcgcacacacgcacacacacacacacacacacacacacacacacacauccugcuuuugacuugcuucuguugucugucucugucccccacagucuugacaucagcugccuaauugcagggacuuaucuuccugagguuugguuagguuaagauuucaguaccugcuuaaugauuuuaucucuguuaucucagacuuguauucuaucguaucucgcaguuuauuugucuacauagagggcccuuagcccggugugagugugcagcaagcccguggcagugccucugugucguuacugcagaaagcacagaaaaccuugucacgggugggugggcuuucauuucugccaggauggccacuucacgaagucuaaaguugucacugcugaguucccagcauauggguagcacuuagcuuguaauaagcauugcuuacauuuguauuggaagaauuaauaaauuuagucccaaaccugcaucuaagccaugagaaaaacuugaggccuugagugagaguggcugguuucaguccaucuguauggcugugggggacucaggaucacucuaacagucaccaagucagaagcucuaugcuucaggagguucagacaggcuuguauaugaccgugcacacacacacacacacacacacacacacacacacacacacacacuuuauauguauauuuagacauguuuuuuuauuauuauuauuagccacacauggggauggagcccaggguccugugcaugccaggcaagggcuguuccacugaauuagguccccuagcccaaggcuuauaacuugacacaccauggagaaccacuuccuaggguaggaggaacaugugagugaaugugguuuccacccugacuaucagcuagauaucgguaacugguucaucaacacaagcucaggucacuuaaggauacuggaacuuuguagggcgaaguaagacacugaaggagugagcaugagcacguggccuguaagcagaaagauguaaccggucugacagccaaagccagcgugcguggguaugggaggacagagggacaaccuucacggagaaugcuugccugccugcuucugagcagaaaaucgcaagucagagaaagaaaaggaaaggagggguguaucucugcaggguuucucugcaggcccauacucagugggggcuuguucuggcuuggcugcuccucaaagacaccccgacaccccccccccccagucccaacaccagcuucuggcaguauaguucacuguucguaguacaaggugaacaugaagacauaugcccugcugaggcucaguccuggggaaugccucauagggaggcagaacacugcuucucugggcccccccaccagguguggcauggcagggacugggcccuguaugcuguuuuuuuuaugaaaugccaaucauagggaguggagauaauaagaaagguuucgaaccauuuccaaggguguuauuuuaaagaacaagcaccuugaguccuggacuuucuggguauguuaagacgagaauggcaugucaaaucucugagcaggccagguuguuuuuaugacgaucuguaaaaacagcugcccuugugcagaagugagccccacuucguucugcacagaucuguuugucuccagaugccuuacguggaggggacacgcgugcguguucuuuugccuuggaacuaauucccuguaaauuucccacuucuuaauuggcaggauaggauaaaaaacgucacaucagucucuguaaauuccuugccuugguuucaguguccccaggguucagggcugcaauuuuuuuuuuuuuuuuuuuuuugugggcauagauuuuuagauuguuucuauggugagacagcucuucugucgggcagcaaagaacaauuugcacauucagauuacacuguuuuauuuuaauuucuguucucaaagucacccaugucauggaaaucccuuacauuccugccguugcccucacuuauugacuaugucagguggccgggcugucuugucugugugaaagagaaauguacauauacaguguaaacaugucugcguugacacaugaagauaaaaggcuuaacaugaauugugucuguuuacacucgacacagaaauucuccucugacaaacuggaguaucacucgugcuuguuaccauaacacucuccccccuccugucugguuuccuggcuaguuacaguuuacagcagggagagguccucuucucagagcucugggauggugcucucaggcuaaucagcugcugugggaggacuguggauucgccccccuuggucuuuguguguuuucugcauugucuauaugauauggguuauuuuucucagcuccugacucaguggguaaaaaacacuugccauacaauuauggagaccugccuguguuagagucccaagcaguagggucaaagcaaaacauaagaacaacaaaaacagguauggcugcauguaccuggaaccucacauuggagaauggggagguuguggaguccaggaguuccauggccagcuaacuuggcccaaauggcaaguuuggggcucacugagaaccucucugaaggcaauaaggugggaaacaguagaagacaauccucugcuuccucuaugugcaggcacagguauguguaccugcauaaucaagugcaugggacacacauggaggggggagggaaaggagggagggagggagggagggagggagggagggaaaggagggagggagggaaggagagagggaaggagggaauauauacaugcacauagguuuuuccaugggucacacugcagaucuuggugggugcagagagaggaggggagggcagggaaggggaggggaggggaggggagggggggugggguggggugggguaguaacaaggugggaucacgucuuuccugggucuccuugugucucagagaaugguagcugaaacaucaaaaucagcauguggaauuucucagaugcagauuuuaggaccacuuugugauuuagcaagccuccuugcuagguguaacugagcucuacugagcgcuguucuacugagcucuacugagugcuggggccuuugaaugccugucucccaugcagaacaaagcgggggggcccuuugagugccaugucucugucuguuuucuagccucuguucugccuaaauccuuacuuuuccucuacuccagcuacugcaccccugccugggguugguucccucaagcugccaccacgacccacucagcuucacacuggcuccaggacugcccgggaagccuuccccuuacacucuguuagaccucauuugggguccuagaaacagaaaguauggcaggaccaucuucagggauccccuccugagccaucuuccaggccccuuuagcgugagagagcugugagccucuuucucuauggucccagaguccugcccauugcacggcaggauauuuuccccaucagcucagcaguuacuggagaaaggguuguuuguuuacucuccugugcaaaguucauugacagugauccccugccauuuugacuaacaaaaugauggcaucuagaagugguuuuuguucacuuaguuacugguaccaguggauucuuuuuuuuuuuuuuuuuuuuuuuuuuuuuugagaugugacuauugugggcgagccacuggcuaagccacacugggcuucuuucacaaggcaaaagcuuuguuguguugggucucacucucagaacuggaguuaguuccccaaugugucuuuaguccauugacccauagucaacacaagauucugauucugcucuguaucuguuguuuccgaccauaaaccaagacugucugaaggaaaguugaucgaaauugaaaacauuuuuguuaaauggauaacaugauauucuuuguguguguguuguuguuguuguuguugauagauuagccugcuguuuugccagcuuccuuucucuucaucagauuagcaauauuuagauugggguaagagaauggaggggucacuaaugcuuucucagugauguagccuucagcauacauaccccugaggacagugacccagaacuugccugacgucacugugguagcaguagccuguuuuacagguuuuacaguugaggcuuagaggugguguuuguccuuuugagggcacgagccaacagaagacauuccaaaggguuuucuaggauucaaaccccaguuaagcgcuuugucacuuuccaggaccccauggugccuugcgcagggcagaugcugaacauggaaagcucacgcagacguucagauauccagcuuuggaagguuuucucagucagauauuucccaucagccuugcuccuaauagaagcucuuagggauugguguuccaaguccguagaguugaguuuggcagaacaaaaguucugccaguuaacuuuuaggacauaccuaggaauuuuuggaaagacuugacucuugcaccugaaaagcuuuauuuaagaugucaucuuggcagaaaugaauuuuuagccuggguggcaugcuccugccugguggccucccaucguuuuugcuucugcuguccucauuccuagguuggacccugcagcagggguccuccuucagcuccuccuaacacugcccuuucucccuguuccaggggaucuucauuuccauguguuuuuacuauucuuugcaggccaccugggaucuuacauguuuacaucuaucuuauauccugaaagcaaguguuggggucucuuuggggugugccaaguaucuguuggcuuugaaagggagagaguguuucaggccugacucugccagcugugagcagagggcgugucagcuucacgugccuuccagugcuuucuccagugcguggauucuuugacaggcaggcgugggacauuugcuuuccuguuugcggcuugugccuuugaacaccguacuaucauucacaguccagcuugauugcucucuuuuucugucacaaaacacccaaagaccagcagugucggucagaauucaaagcagcuggcugcugggcccugccuuguauuuuguggcuugggcucgucuucucuuccggaacaaggggguaguuucucccuauuuuuuuccuuuguucuauaaaugggaaugagggguguaaauaaggaaauggcucuuucauucuaagacgcuuccagucccagcucugugugacaugaggccagcuggcagaggguaacaggcccuucguacugucuuuguacugacugcaugugaaagacacuauauuaugucucuuucucucuguuucuucacuugguccugaacuuuuaugauuuguuggguaaaauaccaaauuacuugacacauaauacuuuuaugauauggucaaacacauguugaauacagugauguaguucaauacuccuguaaagucuaagagcaaauuaauacacuuaauuuacagugguauaggaggaguaagauauuuuagacugggcacucgauuucugacgagugauuuggugccauuauucucgugggcuuugagucauugagcagaggcuggguaaacaugaaguggagagaugaggcuugggggagaagaggggagcugaagaagaguuggggaacuguugaagcucaggcauuagcacagagcaagcaccucucugggcccaaagagagaaugggguagugugaaggggaguccuaucaagguagugugaaggggagcacuauaaaggcagcaggccaugaaagggaggagcugagccuguuggagguagugaacaagugugcuaagcaaagaugugcuaagaugagacagaaggagaugggccugaacucuuacagaauccuguugacuugguauuuggucaggguuggacuggacagagggguguguuggaggaagauguugcugucacucaggccaaagaugacagugguuggaucagaguugcagagaugaaaucaggugucuuaguuccaguuuucauugcugugaagagguaccaugaccaaggcaacucuuaaagaggacaacauuuaauuggggcugccugacagauucacagguucaguccuucaucaucaaggccggagcauuguagcauccaggcaggcauggcgcuagaggagcugagcuuuugauaucuugaucugaaggcugcuaggagaagacuugacucuccuaggcagcuagaaugagggucucaaagcccgugccuucauugucguacuuccuccaaugaggccacaccuacuccaacaaagccacaccuaccacaacaaggccacaccuacuccaacaaggccacaccuaccccaacaaggucacaccuacuaauagugccacuuucugggccaaggauacucaagcuccaccacaggguacaauucauugugcuccaugugugugucuucuggugucugccauguaucaagugguguguuagccucuggagacaaaacuugagaacuaaauagaggaugauuuuccauccucuggaacugccaccaugauggcagugagcagaauggagagaagaugagaagaaaggccuagagcuaggcucccaagaaggugggcguaccccgagugggaaacaauugggcuuggaggugagcagugagcaucccaaagaggaaaaggggguucaccaugagaaaagccccuaagaacccacuagguuuggaagggaauuccagaggcggguguuacuagguggcgugugugcaggugagaggcaggcugaauugggaagccuuacucucagcaccagcaaguuacauggcagcaucccugaucaagaugugggagcuggggaguaggucagugccaaggaaguggcgccauuucuucugucuuaggggcccuguuuccucuucagaaaaaugaggaaauuagaccaaagggauucucaaguucuguccgcucuucugcuuucuaccucacccucugauauugcccaguuccuuccuucaguggcugucaugucuagggaaugucugcuuccuuuccuccacuccacuguucuggauuccccccccacacacacacacacacauacaaggccucccuugggcuucucuccccucucggauccuugagaggggcuccauccugugagguagcguucauccccuccugagauccuucucaccaggcuucuaccagccuccuuuccuuugaucccucuuuguauccgugaccuccugucacccugccugucucuggcuuccauaauaucacaggcugcuuaaaaccccaucuuugaugcuaccucuacuuuguccuguuggaaauggugguaggcuuucccuguguguuccuuucaucuuacccugucuauauugacaguugcuugccauggcucuuagugccuggucuuuugcuaugagcccauggaaucaaacuaauuaauuacaugggucagaaaacuuuauggcuccugaacagcuuuaauaaugguugggauuauuagaugcuaagaaagcauagugaccaaggcugucuuuccauauacauuucagacuuuuuaaaacaaaagauuuagagucuagaagaugguccagugauuaaaaacagccuccaaauuuaugugauucucaacuucuguaacucuagcuucaaagacucugacacccccucuggccuccgugggcacugcacucaugugcauagauguacacacagauagcagagucaaaaauaaagaaaaaaaaugaaacaaaaaguucuaguauuaagaccacuuuaccaaaaagacacacacacacacacacacacacacacacacacacaaagaaacaaaauuaauacauaaguaaaaaguuguaaucugcaaaugccuugggcuaguuccucuacuuccaggaucuguucuaagaaagugcucuuggauaucuggaauauuguuuauaaugugaaaaauuagagaugacuaauuaacaguagagaaucagaacaagggacuaguacguauuaauaauuuaaaacaaguuucucugggcuagagagguggcuuagcgguuaagagcacugacuguucuuccagagguccugaguucaguuccuagcaaccacauggugccucacgaccaucuguaauggaauccgaugccuucuucuggugugucugaagacagugacaguguacucacauauaugaauuaaauaaaucuuaagacagccaaaaucaaaacacucuaauaaaacaaguuuccccuuuuaaauuaaaaagagagagaggaaaauaagugcgccugugugugugcgugcgcuuguguguacgugucugugugcguguaugagugagcgagcacgggcgcgcgcacaugcauguggggaggaucgugcugggguugucucacucacaguggguuccagggaucugauggaagugaggacugcuaaucagcuuccuuuuccugcugagccaccccacaggcaccuggcuuuucuuuuuuaaaaauccuuuggaaaaacauuagauugguuaaauguuuguauuaguuaagugaaacaagucuuugcauggguaugcucgugccugauuuuauuauuugcagagaaaggacaguuggcgcagguagaugaaggcuguuuaucugugacuguugcgaucgcuguugauuuuuacugcugcugcuguuaccucacuuguauaggaaacgucuuacucuguuaagaacguggcacauuauguuacuuuugcgaacccgcgccccuuucaguuuucuucagcuauuucuuuuauuugcguuuuucgagccucccgguuacagguccaauuggucuauauuaaauggugucugcucccugggucgcagugauucuucuugaguagacuucguugcuugauguccuuuuugccagacacagaaacuguaggaccugggcugcggauuuuuuuguguaguguugugacugaggaccuuggcgacacugggcucguucggguuguagcaugaacucugcacacaacccuuugugaccucggacugaaaccuucaguuuggaugguucauguagcaguuucucccacaggucagugaguaugucguacggcaucugggccagcguaggcagcugagugacaguaaccagguagcugugcgggugugcacucugcccugaaaaacagucaucaucuuuuauaaugauacagguucuaucagaaagucaucuuaagaaugaucucuguuuaaccauaugccccgcuuugcccucuugucucccuucagucugugggcccggcauugacauccgcaacgacuaucagcagcugaagcgccuggaaaacugcacggugaucgagggcuuccuccacauccugcucaucuccaaggccgaggacuaccgaagcuaccgcuuccccaagcucaccgucaucacugaguacuugcugcucuuccgagucgcuggccucgagagccugggagaccucuuccccaaccucacagucauccguggcuggaaacucuucuacaacuacgcacuggucaucuucgagaugaccaaucucaaggauauugggcuuuauaaucugaggaacauuacucggggggccaucaggauugagaagaacgccgaccucuguuaccucuccaccauagacuggucucucaucuuggaugcgguguccaauaacuacauuguggggaacaagcccccgaaggaauguggggaccuguguccagggacauuggaggagaagcccaugugugagaagaccaccaucaacaaugaguacaacuaccgcugcuggaccacaaaucgcugccagaaaaguaagagugggcagccgggggacuuccacuuucugcuccgugcuuucuuccucuuccucucccuccuccucuccuuugucuuugguggggcaggacgaaguucucucacaucuccacacugccuaguggaaguguuuccuggggauggggagggaugggucuuaucuagcuuuucugugaaucgggaucucucagaguacaggaccggagccuggauggaggcugcuguggcugcugucaagucugguuagaaauaauuugcugcaucuggaggcuacaaguuuacuaaccgucaacugcucugaugagauaggggacuuggugugcuuuguaagucucugauucucgacaaacaggcacuucuuacagcucagugccuguguccuuuguguaaagggauuuauaguaucaccacccaccaccaccaccaccaccaccaccaccaccaccaucauuuuguagagcaagauuccuucucacaaauaaaggaaacguguuaacacccguguccugagaaggugauccuuggcucucaggacccugaugcugcaggaaaucggguuuaauaugaaacacgugauagaucagaugccugcuugccagcuuccacgaguccuagguccauucucuacuuaaggcagcucuauaggagggaauguuucugagcccuuggguuuucauuccuuucucguacaccuguuguggcagucuugugcagacacuuagugaagagaacuuggaaagcaugcagugaccccagggucucauagugguguuuaaagcuuguuuguuuaccuguaauaugcauauguucuuuguagaaugccuaaacucauaccugaugugacauaggacaugaaaaucaacuuuuggcuaaaauguagcuauggcucagggcauuggcuguauugaauucaguaauugagcaauauuuagacguaguugccagcaagguuccccucacugguuucccucagcacguuagcuguuauuuuauggcuagaccaguuaaagacucaaugaguccauauaccugacuaguuaugaagauugccccauaaaucccgcacagaacccccagauggauaaauuugucuaaauucugaaguguguauaaucaacaaauggaagaccagcccucauggguagcuauuauuucaucaugccuggaguuggggccagaguaggucacacaccuugauguuuucugucauuugauuugugucugucuguggaauguguagggguaagguguaugcauuuguauguguggguguguauaagagauauuaguagggccaguauucuaauggcuaguacuuugaauagcugagugaaauauacuuuucugauugauuaaaaaacaauucccuaugcuuggcuuaauuaaugguuugaaaaaaaaaaacccuguaauucuuuuuguugguuuugagcuagggucucagucuguaguuggggcuagccuggacauguagcucaggcuacccuugaguucauggcacaucuccugccuuagcuucccaaguccugggauuauaggaaugaguucuuguccauugucauaaaauuuuguuuuuauuuauuuuuaaauuauuuauuuaucuaauauguuugaguacuuugucugcauguaugacugcucaccacguaugaguguagugucccuggaaagaccagaguuacagucaauuugugagcccugaagaugcuggaaaucaaaucuggguccucugggagagcagccaguacucuuaaggacugagcuacuucuccaguccccaacauuuuguuuuuaaaguagccuuggcauuugaaaaaaaauuaucuuaaaaagcaucaucagauuuggauacagaaacaagagugugugacgacuggacuggccagcuugccugagcuguggucgagcugguacuacggcagccacaccacucugucaugguggccaaacuaaguauggacaggaaaguguuucggaagcguagaagcucugcaugaaagggaugugcgguuugcagcaucauuagcuaacaccugucagcgaccccacagaugcucugcucucacuguggcuuuucagcagcuucugaagaagucaggggcagagauaaggccuguauucugggucagagucaagggccaguagccaggaacuaccaagcaauuuaaauguguaggguuuaguuuguucaucuucauaauggcauggauccugucuuccucauagaguccauggaagguuaaauuagaacaaagaaaacagccggccugaggccagagugccuguuggcuagaacuggucuucccaaggccguguucugcagccuuuuccuuggccgcuguaccaguccugaugacguguucugugguuucacaauggagugcuuaaaaucgcugacuccauucaagaauacugucuucuuaccuuguccugaaaacuuagucauggucacagcuuccuguagccuuucuaauucagcuagaaugcuuucccucuucguagacuccuauucuagucuaugcugucauguguguaguggcaccagucacacgugccugaguggagcacuugacccuuguggccugccccaagaaagcccugcuuugagcgaaggguuuccaggauguagucugggaagaaucuuugaaauauugccuacaugauuaaaaaaaaaauggauuccaugcucugaugaauauacucgaaaagguaaaacgugcuauuuauuaaaaucaguucauuugcuucucuuuacucgggaugaggccacuagaauguuuacaacacagauggcuggcauucucuuuccuuuggagagcggggccuuaguggcucucccuagacaacuggcuucugucgugcuguguucagccagagcccuccgucauccuucaaggauccagggcaagggcaucgagcccucacagaaugcccacuucagaguucacauacgccauucaaaaugaauauuugaggaaucccaguaaacuauuuacugcuggcugguggcagaggauugggaauaucagcaucuggagagaaaucccagugaagaauacgagugaagucaaugcuguaaaggagaccacuugaucaguuuaccccauaauguaucuucauucuucccgggucguaucuacuggcaguguggaggcagcccacuaacgaggggccacucuaccuguuacaaccucuguauuucuuuguuuuugugauuuuuaugcaggccugaguuguuccgaaagagugagggccccccccccccgaaaggaauuguguuggggaauuaauacgggaauaacugucagugcccucauguuugauggucgguccuugccuccugucuuguuugaaauggcuucugugucuccuccuucgccuguaguggcugcucuguuggccuuuucuccaucuaggcuuucauugucucuggccuuaauccaucugggcugcuacagcagaaugucacaagcuggauggcuuaugaacaauggauucacuucucuuaguucuggagaccagagacccaaggaaaggggcugacagguucucugucugaugaggaccugcuuucuggguucagagcccuccaccaccaucuuucauguggaaagggguaaggcauuuucuggugucucuuucacaagggcacuauuccacuugugagggcuccagccuccugagguaaggacaaagccucaccuuuuagcaccaugugcucagggacuagaucucgggauaggaguucuggaagacauaaucauucagaccaagacauggccacagacaggcucucccccuucuuccuacuucauuauauuuacugguuccuuagcauccucuugucuuuaucugacuuucaaauaccaucucaaguccaggccucuugcugagccuuuuuuuucccccuuuguguggcucuggcugucucauaacuggacuuguagaccagucuggccucaaacucagagauucuucugccucugccucccuagugcuggggaucaaggguguguaccaccacucccugacuucuauuugagcuuucaacuacaggugaagaccacccccauggaaugucuccuugcuucuaugguuucucuacauaacucuccuccccguggcggggguugggggggagggggucaaugcucuuguucuccuagcuaacgaucaucucagaagcaccaccacucgagccugcuuccuuucuaauaggccauccaagcccuuaccaucucaagaucugcuucacucugccguucucuacccuacccguugugaacacagugauacugcgcuucuccagccuccugcucuguguccucccacuucacuugucacccaugaaugucccaugccuugaguggcucuguuguucaccugcccuucuggaguagauccuuaaccaaggaguaggcuccuuggugccgcccccugcccccauuuuacugccccucacacuccugcaggcagcauccuugaccccccuuucccagucaucuuuguauuaaccagucugccuccuccaucucagaucugagacugaggugagcuccagccuugccuuucacgagacuccagggcuuuggagccuccacuaguccuaccuagcaccuggaaagguagguuuucuuuuuuucuuuuuucuuuuccuuuuaaacaguguucugugacuucuagcuguaucuaucuaugcacuccaggggugagcauggcaccuacuuugugaagauccacuuucccccaagcaaagaacaguaugcagugauaguccccagcaggcuuaaagaugguaagaucguaaaaugugguucugacccugucaccgucacugcuacugaggagcguguccuuccaaaccaucucuaguuccaaaauggcgggaagagcaccagaacuccccuucucaggaccaagaugcagaagucuaaaaaggcugggcuucuggccccagaagcuguucccuaggauguacacagcuggccuuguauuggaaggggcagcggugacaccuccugaguaccugugguuuucuggcuucucggugaauuuacggaaagugcugcuuugacacagaggcuuuucugguauuugauuucaugcgaggacaccuccuccaaaaaaacaaaacgacaucaaauaaaagguaacaaaaguaaagccugagaccucacugcuaaacuuggccucugagugccucuuggcucgccagaaucaacagcuugugacuggcucacagcaccccaucuagccuuugccagaaaauccacagagccgugagccuggcuacacuggaagccagcuuagcugccgggccagccuuacuccagauagaaagaccacuggcugagguaguggucaugcaagguauugcauuucccucuacccuaaaaaaaaccgaggaaccauggucauugcugauuggagcuucaggaugguccucugcucccuuuaucaacgggaaaacguuaccaucucuggauggguccagggacucaaaaugagggcaggugguguacaccagauaauucuggguuuuguucuuccccaugccguucuuaagucuuguuuaucaaacacuggucgucagggcagcacaggcggagagagaauugcuucccugucccugucccuuuguauuucuuugcaggcugguagaacauguccccuggggagaaaguggaaggguuuguugaagcaguuguaaauccccuggaguuuuugcccugugagaguccagccauguguuuggcaggauuuuacuuuaacuuuuaaucuucagcuaccugggaagacccagaguaugucuagaaaugcuguggagucuuccaccaagcugcuguagacugcuaaaagagaucaugauguagaccaugagacaggcccauggcccaugguggguaggcagacccagagcugaacaagaggccucuggcuuucgcauuguguuaagagcuugucuccauuccccgggaacgccucuguucuggucagcugcucccacugugggggugaucuuuauuuagaaggggucacaugcccugggccucggugcuauaugccuuuuauagccugguguggagauugcauucuauccugauugcgaaccccugguccugaggugcuaaagcaguuguuuguguucacguguuugugccaccgccuagugaucuguaguucuuagagcaauguauuuaguuccagaggggcuuugcuuugggcuggguggccuuugcugggcugucauucuucuggauccacuuuagaaguuagcuuuuuucucucuuucucucucucucuuuuaaaguauagaguagaguuuauucagggcaugggggaggggaguugagaggguaguagagacugaaaggcagggauggacagaggaagggagggggaggggccagccaugagcacguggagagaggcgggagaaggggcaacaaggggacaucuucauagugguuuuguuuugaacuugagguuucugaagaauacuauauauccccuucuaucucuuggcuacuuguagauugguucugaggaauacuauauauccccuucuaucucuuggcuacuuguagauugguucugguuucuuccuguuuccugauaacccccuucuuuguuugcauuucuguucuuaucuugcucuucucaugccaguguagcauccucaacuagaguaaggcuaacauagagcacaugggacuguggcuaaucucauucuggacugcacugcucgacucugguguaucgugguucaaaggucaaguucggccagugguggggucucuuuccagcacauggugugaaucagggauucagguuuaauaaggggggucucuucugagcucggcccuaugguagaauguuccccuuugacaaggagcagcaaggcaaggcuugucugccauccacaaaacagggauguucaggugguacccggaaagcccccagcacacugaccagcauugggugaauucuuggucaacagcagaagcugcugcuguuuuaaaaauagcugcauuuggagacccucuaaaauuuugagcauuaagcugaacuaacuguauauguacugcugucccuuaaguggucuuucucuguugccuuuccuaaauugcaaacauugaguuaucauaaauagcagggcauaguguacgagugguucuugcuaauuuaaucggaauuguucaaauuuucaugucugcccagauaagccauaucuuuaaagaacacucagugacguacauacgucuauccagaugccacuagagagaaaccuuauaggugucuguagacuccauuuguuaucagacucugaauuuauucugcuugcaagcuugguauuugggagaauuuaagaaauaccaacagauuuuuguuugacauugacauuaaacacuaucuuuugacucccccacccccaccccuucugagagcauuaaagugguuagagagugaguggguauagguuuuuaguaaagaaaacaaggaggcacguuuuuauuggugacaacugcagaucucacauacugaagguagcagccaucugcuccaggcuggagccucugccuauuuaugcuccucuuuggguaauaauagcuguguguauacacgucugugugcgcacaugcguuugcauuugcacguuugugugugaguguuccuucgggcauguguguuuaugcgugugugcauaugcagucagaccaccaccgucuuggcuuuuucacccggccuccucuccugcuuuguuauguuugguuguuuuguuuuguuuuguuuuguuuuguuuuguuuuuuucuucuccucucgcucauugcaggaaacaaacacuggcucucuguguccucucucagcucuuccuuccguuccaggggaucaggugggcgggagaaugcugugcaggaaugccaggcccucuuccggaagcagggcuucugguucuucucauucuugaacagaaguugcuuguugucccucugccuuggucacaaacaagcacucgguccucucuucuuccugucauuuguuuuuucccccauggggccacgugggauggcagcagagacagucaguguuuagugacuugguugcuugauacucagccuugguuagagacgcugucagacugacccuguauguagcugccucaaguuuaucuuugcaaauccugcugaauggaguagcuaggguugcacaguaguuuccccuacacauuccaugaccuccagcagaugacuaaagccauguguguauucacccuuccuuaggcuaugaagcuuaaaaguugggcaggaguagagauuagcuacaaugacagugugcuauaguuuauagcaguguaaugcaaugcaauugccaacaccacuacuccugcacuuagaagccguuguuaaauaagacaauguuuacuugagcaugaggcuaucaggaaggaggccccuaucccaaguugaugcaucuccuguuggcagcaggucuguggagucagguugcccaaauugggguuccucauagugcauaguuuucuuucagcagcugcggcugcaggguugcacuugguaguaaaagggcaaaagaucagcauacaaagagcauagcgcccccccccaaagagaagacuagaaaagggaagaugauugguccccccacaaacacuucugggcaguucuagcauuugaauuaggucuccuggugccccuacucucuggaaggauugugauaaggagacagguuggugaccagucagguccccgugacaaggaaaaccuagcucugcuccuggggcggugacuccauaggauguuuucucggauuucuuuuugacccccgaauggccuccuuauacuuugcugaguaaauguuaucagauaggauguagagaaaucuuuuuuguuccaucucucgguggguuugagauaauuggguuauucugugaugugucucuguucccuucagaagccucugaauaacgaaucggggaagcuucagagcagaagcagccagaaaguauccaguguugcuucccucacagacccgggaagggaagcgcagagcagaaacgcccagcgguagaccuccuugguagaccuccucacaguugcacagccuguccagggggccugaggggccuccuccucacaucagugcggauggaucuugcccucuucccccagcugauaccucuuccuagcuguccacuuuaugaacacagcagggcucuggccucgauggccauacggguuuaugaauggaauucugggaauguauacuuuucucugaagaauguuucuguagcgcaacaaacacuucuuguuugcugagggguggggggggggggagaaaucuuuccaaagagucacuggaugccagagauggcgacuaggggugggcuggagcucggggugaagcuguucacacugacaauggacaaaaagucagagccccuaaccuugccgaagaagucugucuugcaggauuaauuucacuguagguuuguugcuagcuauauagugacuauggcauuuggugcccaugcccuuaauaauacagggcuuauggguauucaguucuuagccugcgggucucugagccucaccugauugccuggcaugaguagguuucagaccuuggagguggcccaaucucacugggaggcuucugaacuucuuuggauaaaccaugacuugaucuugcugggcgcuguuacccuaagucuuggaaggccucagaguauagcaggguucuuagccugaggguugagaaccccuuagggggugaggaguugaauggccuuuucacaggggucaccucggcccaucggaaaauacaucuacuuacuauucagaacaguaaaguaauuccaguuaugaaguagcaucaaaacuaauuuuaugguuggggagucaccgcagcaugaggaacuguauuaaagggucccagcguuaggaagauugagaaccacuagauuauagggaaagggcugcagaagacgaguuccgucaguuauaaagaaaugguagucaggguuguacucagaccccacuucagcucacaaguuaaaggugaguggcucgugaguggcuucuuaagggcugcucggauucuguuagcaagcuugggguauagacaguuuuaaaaguagugcucuguuugcgagcucuucaacuccuguuauuacaguuuuguuugggauaauauauucaaaugaauacaaaccugaccuuccucugugccuucccauuuaagccagaugagaugcugagaugcugggaugaucagguaaaaagaggaaggcacaaggcagccucaggauccgggaguuuugcaugacaauagaaugugcagagucaggucgcaucuucccaacuuuugacuuacaaaggcugucacuuucccuccccccucuuuucuuaaccuuugacacagugaguccugcauuuucuuccaaccuugagauuuaaugucagggagggugguaggggucuaggguggaugugcuagcucuggggguuugacaaaugccgcuaagauugaugauagauauucuacccagccucuuuggauuauacccucuuguaaagaguuggcucuagauuggcuuuagaaguaggcugugaacucccauagguggcugaagcucccaaguucucaagaguauuuuuggagcuagaagcaggcuugaaggcuagcaaaauaccuccauaauggggcagaaauaaggagagauggucagagaaguugagagcaggaaauucagguaggauuuacauuuaagucuugcauuuuugaagugacauuuucuuggucuggcuuucgcuguuaugaaagugaauuauuuaugagcaccgaggagcaccaaugaaacuugauuauguggaaugaauuuaaagucagugaagucuuucuuuuagaccagugucagcugucccucaucuagcagcuugauaaccugggaagaguccaccggugauuauugcuguuuuccagagggcugcuuuugagagccaucagaguuggcagugcuguugaaaugguauagcacaggaaagucuuccuuguugguuugugaguugaguguauuuuguuauguguuuuucucauaggcaucuggguuugccaugcaggucugagccagagcaaacauugacugcugagguaguuuacgagaucgccccuuaucuguuguccaguccuugagugcuuacguccacaguguuccccagaucucccuugccaagggcucuuggagguugugcugggauagaucuggugaggaugugguuucugaaggucauuucuauccuuugucaguagguuaaaaagaccuuguccagucaucccuuaccucacucuacaaagaguuaauaaacagcuuauaacauauuuuuguuccuccugccucacagccaauggcuggccuguggaggagguauuauguggcccugaccaugugucccuuaccauauauaguguuuuagcaguuuguuauuaaugaagacaggaggcucagcaggagaugguggaggcugaggagagaaaagagguaagaccaggaugaggcacauagaacuuccuccuggcaguaugagagugagaacuuggguaacccaguguuuuaguuacuuuucuauuaccgugaagaggcaccaagacuaaggcaacuuacaaacaaaagaguuuauuggcauguaugcucucagagggugaauucaugaccaucauggaagggaacuuggcuugguagcaggcagguaggcauggcacuggagcaugagagcuuauaucuguucuacaagcaaaaggcagagagaaagagagcuauuccuaaaaaggcuccucccaccacacccagcaacauacuuccuucaacaaggccacgccuccuaauccuucccaaacaguuccaucaacuggggacuggccauucaaaauaggggccuguggggccauucucauucaaaccauuacaacuagacaguaaucuugucuuacuugccugcugguucugguagauagagaaacuuuaaggagggauuuauaaaguguuuucagauggcuaaaauuguccaugguuagcugggauaaauaggccaacuaaaugguagaguuuaugagugaaugugugucuuggguccuuggagguucgugcuccuugcuacccuugcagcucagugucauugaugaagcagagaagagguugauacuccuguggaugaggagaaagaugaagaggcuugaaucaugaggaauaucuaagcaggaucuucacuuuuuuuucccuuaguuggcugaaguuuccauucuucccccuguagcuaacuaauugagguagccuugcuuagugugaguuccauggcaagcaggaugagaggacacaagcuuacaauuuuguugggugauaaagauaaaaaugcaugaugcugggauggguggcagcuuacuagucaaaauguucgcuuuguaaguauuaggaccccaguuugacccccauuaaaaaagcgaguauggaguccccugcuuagagccacaguucugaggggcagagaggggguguuugggguuuuucugacuugccagacagccuagccuauguggugaaucacaggccaauaagauaccuuuucucggaaaacaugguggaggcacccgaagaacaacaucuggaguuguccucuggcuucuacagaguucccuccuuuccuuccucccucccucccucccuccgccuucaaaguauaaaaggaugacaacuuacauuguguggcaagguaaucccagcuuuggcugagagggaacuagagauacuaagugcuaagaacucagaggagggcaaguuuggucgguauuuggaguuuuguuuggaccagauauuugccuccgguaaagcugaggucuucccuuaagaaugcuugcaccggcucacuccuguuuacacggcuguauacacggcucucaauucaugaguagguugcacuucagauuuuaagauguuuggaaugugaaguaucugacauaaaagcagagguuuaguuggugauuuggaucccaggaucccuccaucugcuugggccccccgagccuguuuggcucguuuguaucugacuaguguccauagcuuuacuucugugaggauaaggcaaagcuuucuaugcccuauuucuguugggugaggcaggagcgguaggaaacugguuguuucauguuuauaccccuuacaauagccccuucugagagcuugacuuuuucccagauguugaggauuguaggaguggggcagcaggaaugcagggguuauggaagcuggaaaccaguacuccaggcucucugcucauucaguggggagaauucugaacagaaucagggauaucuccaccaacacuuaaguucgugaagguuaugcuggaagaaguguggacuuucagucuacagauggguucguuucugcucuacaugaaaggcugcugagaaaguugaaugauaguugaaaguuaguauaguguucagcagcauuugagucugaaaccacagggucuggauuacaaauguugcacaacuuuucuucugcaggcuugcuuuauggaguugucuguaaacacuauuccagaccaccccacccccugcauuugucuccucugcucucaaaucaaagagaaacucuuaguugugaucauuggccuggagaaauauuaaaucuauguuaaguaugcaggcaugaaugggcaaaggagggauuuguggaugagaaucugcugaaacuaacaagucauacauacagaugggcagagagagauuaaauugguugaucuuucggcuccugguacuuaaggcagagauaaaguagugagaaaggucguuguuugagcgaggaaaaaauggaggaguuugaagcgcugggcuuuuccugccuguugauagagauaguagacagaugaaagacugggacagccccauuuagaauagaguaugauccaggcugcucugagcuaauggaggaagcuggcauccucaggcuggaguuuauuggauaauagcucaguaaacuccagucagaagccuucuuuaacguuguggggagacuugcaguaucuacauuacgaaccuguucagauuuguuuuuuaagcaugcacacaaacuauuugcuuauuaaguggggcaguagaugagaacucagugcaguucuucuggcucgugguaugcccugaagaccaagaucucuugggauuucuauuaugauaguagugagaaaaaaaauuaauuagcaaguugaaaaacacccgagaagaguuuaggccagcgcacaguuaacuacuguacuguugauacuauuuugagagaauagagagaaugaagcagauuuacccuuuuuggggguauaggagaguuauccuucaagaugauaagaaaugugaauaaauauuuaaauucccagacaggaacaaacuacaacagguaacuugugacauuuaucugugcagauuaucccauaguguugccuauaaaucccaaaucuguaaauuuacaagggcuauugacugugugcgugcgugcgugcgugcaugcgugcuuggcagaggugcgaggccagccaccuaacacuugccuacacaacuuuuccucauuuauguguaggaaaucuuuuuuuguagaccacagaguggauuuacagaggggagaaugaccacagaguugaggggccguuuccgacguaggguggacugacgcaggagaguacaguugauguggaugaugccaggauggcaucgguuuuggugagugagaagcagccucugauugcuugccugguacuucuuuaguucaggaauccuuucuccacuggccuuagcaagugcccucuuguucgugcuuauguggccuaagguaagcgccgugaccuuuucuuaccuagaacuuuauuuccugaugaguggaggccccagucucucucuuccuuaggccuacagguaugcgcaggugaguugggucugcuagcucccgcuuugguaaauaggagaugaugcuuccuccugugggguccauggccugggguaaagugaagacauuuugugggcagagagaagacaagaggaggugcacacugugccuuccuccuaccauucacagcaggguccuucaaaccucuuccguaucugcagauuugguaauucaaggacguguugccauuggcacaguggaaaaggcagccccuggaguugaguucagugauagagucuguguuccacagcacuuucugggaaauagcuucauguguccccuucauccccagaagagucauaggaagccagaaaggacgcuggcucggauagagccaccucccguguaccagagaaccugaacacucgcggcugcugccuucaguucaccugccucagcuguccuuaacccugucaagcgcucugcucugaagcggagauggagcagccgaguaagccuuacugacacacugacccgacgguccagacaauacacagggucuccucagaucaggaucuuuguccccuuuuucaagaucuuugcauacuccacugcuuuuugaaaagaagaggugagauucacuucuaaaucugggggcuaauuugagggcuacuauuugugaagaaagauguucagaaccuuugcagagauuccuccugccuuuggagguuucccaaguuagucucccagauuucugcaaccugagcaaugaacugcauauccaaaaacuuccugggucuugucccuguugaccuaaccccccacacauguggacagcagggugugggucccagaauguggaaacgguugcaugagucugcacagcuggauggcuccaguucugccuuugaacaccuguguuaacucucuaggaaaggacugugucuaaugacuggaguggcaucuuuugagcaauggccagguucuacacagcucaagaguuuuuuuuuccucugaucucuauacugccugccauaguuugcuuucuauuuuuguacccaagcaauagcgacaucacaaggaaagcauuuauuuuggugauaugucccaaacgcagcacuucaugaagggaagccgaggcaggaacucaauccugagggugggaacugaagcugaagcuguagagggaugcugcuugcuggcuuauucaaccugcuuucuuauaucacccaggaccgccuugcucaggggcggaccccaccccagcaaucugggucucucuguauuaaucauuaaucaagaaaaugcuccacaagccaaucugauggcagcaguucuuccacagagauuuccccuuucucaguuacgucuggguuuauguccaguugacagaaaaccaaccagcacacugccaauucccuccauggccaggaaacugaagcacagaguccuggcauaaguuaugcaagguaccuugcagcuagcuaagucucuagcccugcccucuugugggaaugacuuuaauggccucucuugcuuggcagaaggcugaggcccugcugggugaauucuuaaggaugauuaggcuuguauauuuguauaucuuauguggcagggaaucuccauagugauuaauaaauacagucagaguucuguuggcagguguccuccugcuugccccuccuccuuuaccuguagguccaccuucucuuccuucucuccaucucucuacccuuccucaucuaaugucccuccaugccuuccuuccuugccacuggucaccugucucuccuugucccccuuccucacgaaugaccugagcaucguuaguuauggcugcuuagucgcacggcagcguggcucugaguuguaagaccuugcuugccuuugucugacuccucuuccccaagcacuauugauuuuuguuuuuaaacauagauucauuauuuuuauuugggaggcaaaacuuugauguugaucauugaucaagcaccuuuguuuggcugauuauuuuaacuggggagacuuuauuuucaaacuauucuuuaauuguaaggaaauggauguuccggcucugaugaauggcagguugugguagaggaagaaagggaugugguuuacaguaaacuuucuaucuuuuuaucuaucacucaucacagauaguaaaauauauaaagccucaggauguaauuuaucaaagcagacccuggacugcagguuuccacccugaauugggcuccggaacagugacugaggucggugguaugagcuggcguuuacuuucuugccuuuuacuugugaaagcugaccuccagguugccgacucagacccaccaacauuuacugggugucuuuucaagaguuacagagguauauguauaacuuggcuuucugaccuguugugaaauaaggcccaaguauggacccagaugcuauugcagagccuuguacuccugggugucaccugagcacagaugggcucuucuccuaaccaccaugucccugauucccacauacaaggacugaagaguguagguuucuucaugacuagggccugggcagugagggcccucccugccuguccugugucugccuguccuccgggugggucuagcacugacuggaauuccuguggacuuagucaccaagcugcagugguuggaggacagggaaaccgcugggugcucugucaccccaaaagaaugcaggcugggccagggcugccuggcccagaaaguucucuaggcccuguggcagauccaucauagcugacucaaaacuaccucucuuuuugucuuuuuccuaucaaaggagggugggggaggcaggagauaggagcagagguggccucuuuauucacuggggaggacuuuaaaaacucacuuuaaacuguauuucuguucuucaccuuuccagaccuguaaacacacaguuacuccagguagguauuuuaccaagagcuuauguuugaggagaaauccugccgguguggcugucuucacuggaugcuuuuguuugucuguaggaggcuggcuggcagggugaggugggagugucaggucaccuuaaguucuucuuguacuguagacccacauguagcgaccuuaaaacggggcugggguuggccgccuuccugcugcuucuagugagcgggucuggcuuggugcuggguuggucucaguugccucucauggugccugcugauagaucagugaucaacgguagacuuccagggacagagcccaggcaggaguuagugaugggggaugcucugccacagcucuuuaaaucugacccagagcagacaucugugcugcugcuccucggagccaucggcagagucagcccugggcucugccagcuccuaagcauuggccagcacgguuuuaaucuacaguuuuuagaugacaucuuuuucuccggugggucugucaggcggcagcaaaauucucaugguaggaaucagaucuaacuuaacauuuugagcaacagaacugaccuguggaagauucacuaggugucuaacucuagauacccucucccuucccuuugaaaagaacugugaguaggcaagacuggccugagaacguugcugaaaugggggcaguucuucagcgaauagcugugacacuauuauacauuaaagaauaaaauccccacauuuuauucuauucuuuaaaaaggaauacacuagauuggcaguucacauggugaccucuucaagggucaaaugggucuuucacaggggucacccaagaccauugggaagcacagauauuuacauuacaguuccuaacaguagcaaaaguacaguuguggaguagcaagaaaaauaauucuaugguugggggcuaccacaacauaaggaacuguauuaaagggucacagcauuaggaagguugagaacugucgagaaccacugcaccagauagagaaaaguagggcaguuuggguuucuuucagguguguaugguuccaaagaacaaguuucuuaacuauacaacucuucuugcuuuccaaguuaaaucugaugaggggcugaugagaugaggucugaagagaugacucagugguuaagagaagcuacugaucuuguggaggccccacagucuauccccagaccucuugaggcagcucacgacugcuguaacuccagcucuaggggaccuaagcuaucagagggcagcagcacucaggugcacaugccuacacauagacacauaaaauaaauguaaaaacgagaucucuguauacuucuguaaauuaagugaaaaagaucccaaacggcacagucucugaauuaucaggugucagcuggcguacucauuagaagcuugccagaagagauccuaaaacauagucucuaccuucuguagcaaggagcugcaaucacaggguggugaccuuccccguccaucucguauuuucuuggcagaguuuauguuuuuaacccgugugcuuuuaacuuuuuuuuguagguccagagguguuaucuggaaaagugggcuucuggcccuguuuguguucauccuguuucuuugcaccgagagaagcccaaacacauacacaaagcugaacucaaaccuuccuauuguuuuucccuagaggacauccccacuuucagcuucacuucagggagcacagacuguguguggucuuagugaccucucagcucccuggagacaguagcuagggucuccuugacuuagcugggcuuucucaggcauucacgccugggugggagucacuuucuucuagaggaacccaaacaguaggccuuggcagaguguccuugagacaguaugugugagccugugugucuucccuuagaaguaugugugacuggccuugaaaaugcugugggcuuugaaugagguuucccugggaagacauggcucucgguuguaacaccgugucugcagguccgugauccugcaauuaagggacaccauggcuucauuuucagggcaucugguuuaaaggcacaguuaaaagaauuuguguuggugguucccuuaauuucuaaaauacggcugucuguggcuucauccaucuggauacuuguauugaguauuuuauugccacauagaaagaagguuuaaacacgaggaggacucacucacuucuccugucugaacagaucguugauaccauguagcuucaccacacuaguucaucucucuugaaaacaagacaucauaguuuauugguauuauuuuuuuuuuuaccagccccaaaguaagaccaagauuuacaucagagacaaauaacuguauaauaguuauaauaacaaauaacuguaaagcgggaacggguguuuccagaacacuugguacuuggcgcagcacuuaccuguaguucccagguugugccccaguguuuucuuccucugcuuuaaugaucauaggagcugcuuuggugaucuucgagacgugccaguggaacuguuuaggaagcacuuugccaaggcccuucccagcucugaugcagucucuuggcugaggaccagguucucauacccagggcggugaccuuccaggucacccucuuguuugcuuaugaaaaugaggcucccagggaauuaauuguuucuuccuggcuaccuccagaggacugggaggaauguuagaauucuaguauagauucccagugggacuuuauaguuuauuguuugcucaccuuaaaaaaaaaaaaaaaagagaucuacuggguuuuggauaauuuauauaaauggcuuguaaaaugauuaaaagucagcaauugaagaaacaaaaaacaauggcuaauuuuuaaaucuuuuuuuaugcuuucaauacauuuugagaugacauugcagugacauuacugauaaauuauuuguguaugguagcaugauauuugcacgcucauuguguaccguggcuucuguucauucacgcuuguagguagcugugcuaagagcuagcagagcuuugguaggaaucauuagauguauuuugaaacuaacucgcucuguuaccagauucaaacuguuguggacgggugcuugguaacucugauggccauuuugaaguguuaccauagugauaauucuucuggaaucuccagucauuaaaagugauauggguagcucuuggcucuguguuguaaaaauagauggcauggguuauguguaucuuuguuuuuuuccaaugcuauagcucauaauaacugaagggacauuuaguugcguugugcauacuuauuaggggcuaguugucuggccauauaaaucaucuguccguguaauaauuaaccucuaagaaugaauggcauuuaaagcacgauucaauuuuccccucauuugacuuugguuauucuguucuguguucuuuucccaggacauuuuucaaagguugggauugacagauuaaucaucauugauauugcucccauggguuuacugagagagugucuagagcuccuccacucuguggccagauguggaguuucuuaugcacaugggaagugccuucuggggagcacugguuguuggcucagucugugucccccuucccugaagguaacuguggauauguuagaggacagugccuccuuucagcccaggacugcuucucuuacuucugaagcccaggguaguaauuaaagguaucuguguucucucccugguuagaggcaucuaaguugcagacugguaaauagggguggcccaguugguccaggguuugaaugaaaacguugggaaguaugguuggaugguuggcagugacacugagcaguguguuugccgacggcagggauuuugguucuacuuguugacuagaaucacaugccugggggaagcccagcuuuacuuagcgaagggauugcgugugagcagucauguuccucccagucuccccaccuccuucacuggguccucugcgugcugcaucuguuucucacaaacguuugcugguuggcaggcguggaugaaagcacagcccuuacuugugacaaacacccuugucucaagguccgugguacuguaauuagaaauucaugugcucacaggggccgagcacuauacuuggcucugugagccugaauaagaguagagaguucugcuggggauuccuggccugguggggaggcugagaggugaacaaaugguacugcccugugcuccuuuuaaugcaagaacagccggcccagaaaggccuggagaagggacagguugguguggagagggcacacucaggagcaggaucucaaagucugcagaguuuucgggggaucgagggaugggaagugauggagaugaguggacaaagagagaauguaaggucaggcauuguggacagauacuggugagggugagugugggauugcugguggaaacugccuaugugccugccugcacucggaagccgggccuuacuuuccagacagggacugagaagcaggggagcgccugccgcagcauaucuguguucuacaaccauucugggauagucacccaaggaaggacaggaagcagcacuuccaguauguaagugagcugggauaaguauagaaaaagauagaugggagaugguggugaaugaaaggaugggagggaagaaaaucaaggagccaguggauggaugacuaagcaccaacaggaagaaaugggcugaccaucgguguggugcuguuaacugggauugcaaaaaggcagagauagaacggagcaggagacaaaaagagcaacugauggugcguuguuuggggaucuucugugugugcaggcugagcugguguggaaacacagaccugggagaggagggaaggacacuuuagacacucgacuuggagcccaccucagugacaucuccaggggauauuagcuuucugcuccugucuuagucccucuucuguugcugugaagagaugccaugaccaaggcagcuuauaauagaaagcauuuaauugaaugcuugcuuacaguuuccagaaaguuaguccaugaucauccuggugagaauagcacaggcacaacacuggagauggagcagagagcucacauucuuauucaaaggcaggcggcagagagaggcugagaccaggccuggcaugggcuuuugaaacuucagauacuaccuccuccaauaauaccacaccuccuaagccuucccagauaguuccaccaacuagggaccaaacguucagcuaacaaccuauggggcccauucucauucaagccaaaaugguucccguaacaaauacuugaggaaaaaucaacuuguaaauagaaggccuuugcuuuggcucacaauugugggcguuuggguuaguggcuagggaacacaaguguuuuggacccauggaagggaagcacaacaccguggagugcccggggaggcagugcucaugacuuuauggccaaagagcgugauucugccaucccuucacagguacaucucagugaccugaagaccucauacuagauagaucauacguuucaaaauuuccaaucuccauggccagaauccauugugcuucauccaaaggcagaaaagggggguguuguuaggcuuggggaagagggaacacgggaggggaagggggaggggaagggggaggaggaggggaggaggagggggaggaggaggaggaggcgaacgaugacgaccaccaccacuaccaccaccaccaccaccaccacacucaggcagagaaaucuuucuuugggagccuguaaugcccuugcccauccuucuggagugucuuuugagggcuagauccuccccaaacccuuaggauuucucugguaaacgcaaucugaacauugggaauucaagcauaccacccccgacuccccacccuguaaggcaggaugugaggaacucaugcuucccgaaaucacugugauggggaccucaaacaaucuacccaaaguugccguugagaggcacagucuagggguugguccuauuuauacucugucuucucuucccuuuacuuauugucaaguccuggguccagauaauguuaauuugaucugcuaacaagcagggucagaacugggguugauacugcacucaggggaaguccucacaaacacaccgcagcggcaacagaagugugcauaucagcaguuaacaugagcccaccccauggggcccucagacaucggcugucaguagguuucaguguuuagauucaggaagcagugcaucaaauucacacuaacuaugcuacugcuucugucaugagcauuaguccugaugggauuuuuuuuuucucuguaaagguuuccugcaaugggaagaacacuuggguuuugugacugagcgcgaugguaucaggcguuccccauuuggucauuuugcucagauauguuagccuaaaguuggaggguuugccacauuuuuauucugccuuuaacuuuuuuuuuucccgagucucaggcauaagcaaggcaucuuuuuaaacaucaaagcagcucagcauugagucucguuauuuuccuuugugcuuuuuccccucuccuucauauggaagaagcacaaugagaaaauguaguauguccaauagggcaugugaacuuacaucucuaaagauacauaaagugacauuaauuuaacaguaaagucaccaaccccaaaccuaugucacuucaggcuuagucagaugcuaacagugauuuaaaacgaagaggggacuugguagauacacgccucuuguggauuaaccggggacucuuacucugaaccuuaacugcccuuuguaucuauccaaggguccagaaggucccuugaggaccuagaagggccuugauuggugggaaguaaagcguguauuggcuccuucugggucaugacaacuuuagggagccagaacauuguuuucuuagugcaguuuugccuuuuuaaaagucguuuuuaauucuguauuucccuuuaaggcagaaacaaguguauagggugaaaauuuucuacaaccugucuguaaaccugaguuugcugcugcccuucaccgcugccccugaaaguagguucugaggacuucgaauggcagguuugauugguuguagcagguguucaccuuggguuucagagacuagggagcuguucacugaaauguccccaugcauacgcacccuccugcaccaugagaaguagcugccccaagucucaucuacuccugcaaguccaaguaggguuuugcaggcccguuggacguguguugcaugaagaaaacucauugguuuaugugacaauaacauugggucucguaacggcagagucucaggacaguccucaggugagucagggguucuccaugguccugccugccugucuguguguuggcuucauuucuaggguccaugugggagcaaaagguucacuggcucugucuugugccuccuuuaacauaggaugcaguaccaaaaagcaagggcucuguucugauggcagaagcaauuuucuaggucuugcucuguggccauucuuuccacccauguguucuagagaugggcuggcgcaggccauggggucccgggacucagagaggggaaaaggacaaaaugguucucuugaggaaaccugggguucugaacaaggugaagaggauugccagguuuaaaaacaaaaaccaacaaaacccacccaucuuacauagcugggccacucagggugugagaauuccacuuuggauauaaagacgcacguugagaguuugauuucucuuagugacgcuguguuagagaaugagagacuuacacguguaccuggaaauaggcgcucccaggacccgugugcagcuuguagcuucccucucucucuacucugcagugcccucugcccuggaagcaggucuguauugucacagugguauugagcaggcauaucaaauuaaaaacuuuugggaucacucaccaaaacaguuuccuguacagcacucccccgagggggcauggcaguaguuagacauccauuucauugaucuauuguuuuuauuaaaagaagaagaagaagaaggaggaaaaaaaaaaccccuucaaccaagggaggaaguacagccagcugccugaggaacagacaagaucggagaugauguuuugauuacauuaauccguauccuguucauucacuuugcuucugucgccgcugcuggugaaguuacuaaugugaacuaauuacauuugcucugaaaagccagaguuuuuaaugcaucucagcaagaaagguuaauauuaucaauuuaacagcaugaaugaagcauuguguguguugaacuugaacuguccuaaaagcuugcagaauaaaaaacaagucucucugauaacucacuggauaaacagcuguggcugagaucugggcagugcguucgucucaucuuuaagguguauggagaugguaacugguuaauauugggugcaagagaacuucgaggguuuucccgauugauggaggcauuuuaaagagaguggcccaccgcaccccacccuuugaugcuaacaggcguccgguuuuccaaagaauaugcaguuuacagcagagaugcuuuaaaagucagucauuucucuggcacaaacccagugccugaagaagguguuuugaaaagcaaagugugccgggagagccgccuugucuacagggacugaaaucgcccuguucccuugcccuugcacaugguaccucaacgaucccugacguuuaauuauuuccugcuuuugugugacucacucggcagcacacaaugaggacagaacagccugccauccgcccugccaucccugucuugggaaccacagugcuggcucugucuggucuguacccagcagggugcugaaguguuugaccagugacauuucaguggccaguugguuccucggugucuuucacuguagggauuagggacugacaggggacuuggaacuuugcaugcauucugccugggacagcgugucucuugccuugagaguagaggaguaaguugauaggagauuccugggugggaucuauccaagagggugggcugagucccagcacucugcuuggaaucugaugaugaaucacgugggguccuaugccugaaaaagucucgugccacggcugcucuuaaaggguauugagagggaacgucaaauugacaacucaaguuuauucaagauugggaguguucaauuuuaaaaaguuaccucguuccucccuuuuaacuccucacuccgcuuuagaaugaagaaaaguagcuuuuagaaugacaccgccggccccaauagcccagccucuggagaucuaaggggcugaagugggcagaaagaaggcaggagcagacuugcaggagguauggguagaaggggucaggaaguucuguggcuuauucaguguuccaugucaacccuucaggcuugugccaccgaccuguguugacagggaaggaucagugugugccuuugacgucugucauaaaaggaacaguuccuguccucucuggaguuucugcuccuuuguuuaugaagaccugucacuccuauuuggaugaugaucuacgcaguugucacagugcugggucaugcucucguguauggaacaaagucccaugacaguuggucaguucccaucuaaauaugucagggaacccuaugauagaaguuguggaggcaguacagcuguuccuuuaccuagguaacacaguuugucccaaaguuugaucccuuuguguacuaguaaggguuuucuguugucauagaacuuacggaaugucuaucuauauauuaagggaauuuauuguaaugauuuauggucuguaguccaacuaccccaacaaugggcagcugugaaugggaagacuaugaaucuaguaguugcucaguuccacgaggcuaguuguuuuaagaacuucuguagaaguagguuccaacagaugugcuggcaguuaaguuuaagcagucaaagaagagugaaucuuccuucuuccaauguccuuacauaagccuccagcagaagguguggcccagauuaaagguguguaccauguaccaucaugccuggaucuaggacuugcucugucucaggcugaccuuguucucagagaucuccuuaccucagucuccugagauuacaaguguauacuccugugcccgggccugagcuuuucauggccacuaugccucaagaucuccaugucaagaucugggucagaagccugugucuuccaucuuuaagaucuggaucacagaugccccccucuauuucuggauuuguaguuccuuccagauguagucaaauugacaacuaggaauagccaucacaacuuuguaaagucagcugauggucuccugacugaguaggggacagagugaccagugagucugguacucuguucagauguaugcuguuccauugcaaaucgagcuugcuggaugguggggagauaccauacugacagacaucaugagggugagaacuacuggucuacaggucucuucaggaaugagugaguuggcagauucccccaaagaauauucguccugagaugcauacuguuagguaugucuaucucuacuuuauagacauuguuguccccugccucuuccagaauuuuugugaauaaacccaacauucauaaucggauggauuuacccauuaaaguuauaaaagaccagauuaacuggaaauucaacauuguccaccguaccuaaccuugagcgucuucuugaagcucaucccacaguguacagugauuuccccagacuccuugccuggucuuuuccacagccugucugguaugugugaugaaccccagugccuggugaagaccaugccucagagcccucagugaagcuuucucagccucuaaaauggccaugcucgaguccccaugccuucccaacguguuacauacggagacgcaaagaugugaagggaaaugaggaccgaacccagagucuaagguauaaaguacauuuccccacaaauugucguuuauguuauuuguaaaaacaaacaaacaaaaaacaguuguaacauucuucauggaucucaaaaguuaacuucaguuaaugcuuuauucacaacugugccacacauccaagaaaaugguggcagcccaugacccacaggucuucccuggucuccagugagggucugaucugagggacuucguugcuugcuucuguagugcagccuucguaggcaugaggcauagaucaauuuuuuuuuaauuuccuucaaagugacacuuuugcaauuuuucauagcugaagcuuaacuggguauuuauucuaaacagaauggcaaaugauuagacauuauguuuucugguaccaaauagaagauccuugguggcuaauuugucuuuuaaaucuguaucauacauaugauguguguaugaaauagaagauggucuguggaaaaugauacuuuagcuaaaagaaaauauuaaccuuagaacaagaaaucuaaucugcucacucacaggagugccgugccugugccuggauucugcuuagcgccucugcuuugaugaaggacaaggccucacaguacugugaagaauccuggcuguggaagacagcccaagccugggcauuauuuuuuacugaaaacaauuuugacucauauuauuuacuuuagagacuaaaagaaguauggccaaagcuuuggguuaauaauccugaugauguaaaauaccuuagcauuccugucucgcuuuugcuuggcaugugguuuugccccaguuuuacacacccgugugugcacacgucaauucaccccuacacucaagggcuuauuaaugccuuuuuugcacucuuucuuuuggagaaugucauggccaugguuaauaagaugacgaaugggaccaagaagaaaagcaagcuagagaagcauuuaacaaacagguuaagggucugagucguuugagaagacggaaacaaaacaaaacaaaacaccaauaaacaggaagccaaaacaaagguaaaaagagcucgccugcugaaagcugaguuaggcauuugcagucaccaugcugacgagcuaugguggaggcugagaggguuuugugguuaguugugugugacacagaaaucgaugugccugagagccuugggauuucaacucuggaggauaaaaguucaacagagggaagugugcuguauacaauuaagauguggcaugcugugucugcuggguaaagaugggauuagcuguguucugaaggcaggagaaagguggcuaguaaaauggcugcccuggaggcuagugugccagcugcuucugcaaaggcauguggagcagacuagaaaaccagagcacucuguccaggaagcacuuuuccccacuccccgccauucucugcagucuccuccccuacugucuguuaggguucagcucucaaaggagauugagugaaacuuaauuauguuggagaacccaguuugcuugaaguauuguauuccaggagaggguccuauuggcuggcaaaucuuacuugaauauauuugugguccuuaaaaaacaaucaugggggcuggagagauggcucggcaauuaagagcacugacugcucuuccgaaaguccugaguucaaaucccagcaaccacauaguggcucacagccaucuguaaugaaaucggaugcccucuucuggugugucagaagacagcuacaguguacuuacauaauaaauaaauaaaucuuaaaaaaaaaaaaaccagucacggauagaaauaacaaagaaugguacuuaauaauauuuuauguuauaaaaacauuuuacacuuugauaacuuaguucuaaccuguagguaagagguaaggucuugcuguugcccugcaugguaagguuguugcucgugauaacucgucaucugccauucuaaugcuccauaacaaagggaggauuguaggaauccuuuaccaugacaacaugaucuacucuugagauaaacaagcuuuccauagguugagcauggcacaguauagcuacauauuaaaaucccacacaaggcuggguauggcagcacaugccucuagucccagcacccugcuuguggaaauagaagcccacaccauuaaggccagccugggcuacagaaaacaagaguaaaauagauacaaaaauaguauucacaugauacuucauaaaccuugaguuccauuuuucaaaaguauacuucguagauuucaguggaauuugacauuccuaaacucuguagauuaucucuuuuaggugaguuauuaccaaaaacuccuguggucaugcugauuuuccuugccauuaagcugucaccauuguaaaucuugggauguagcuucacuguccuuucccugggcauuuuugauggcuauuucugguugucaacuugacuacauuuggaauggacuggagaaaacccaaaccaacccuccacccugaaagaaagaaaaaaagaaaaaaagaaaggaaggaaggaauggaauaaagaaagaagaaagaaaaccaccaauaacacccccucgucucucaguuuuuaacauuuccugaaacugccaggacacuguauguggaagugacuuucuuccaggguagaguaaguugcuucucacaugaacacugugccauucagucaugcacacugccauucaguuggcaccuguuuuugcugcuugcuuaagaaagaaaggaagaaaggaaggaaggaaggaaggaaggaaggaaggaagaaagaaagaaagaaagaaagaaagaaagaaagaaagaaagaaagaaagaaagaaagaaagaaagaaagcgcgcucuguauguccucccccccccccccgcagguauccagagggccauguugaaaaacugccccucccccagcauuaguggcagagacuuugggagagcaaagggucacaggugugccuggccuucugguccuuuguaucuccagauauaaagauggcugaagguuguagauuuuucucaggacagaugugaagauugauccagaaaaaaaagcaagagacaggaaggacggcucagaggguaaaggcgguugccaccaagcacccaaggaaacacauuaugucaaucaugauuccauaauuaauggguuauuuuuaguuuuuuaaaaaacuccuguucuuccaaugaccacauccugacuuuugaaaacagaacaaauuagauggauuuaagagagagagagagagagagagagagagagagagagagagggagggagggagagagaacucaaaaaaaaaaaaccauuuguuuuugaugugauuuagaaacguaaacacaagaaggcacguuuccaugacacugauacaucaucagguuauuacagugugcuuuugaggucacuggaauuaucuuguccuuuagaguagugcuggcuuggugauucauucauguccucuuauuggccuguucauccuggcaguccgauaaaagccagccuuccucaaggacuugcaagaaaugggucuuguguccacaaaaggagucucuuacuugcuuccagcagaagggacacaacuccaaguguucagggggcucuguggaguccucaugagcgugcagggggcauggcaaagagacugcacacacaugacugcuccguuuuuaggguaaaauuguuuuuuauuuugguuuuuguggauaagagagauacuaucuagagucaucuugaagagucaucuugggggagagagagagguagagacagagacagacaagacauggccagggcuaucuacuagagagacaugacagcaagacacaacaguggucacagugagauaguaagagagaguuggggcaggaacaaaacucggccuugcucuugcauagagaacaaagugguaucuggaaggagggaaggcuggggagguaaaaagggccagcauguuaguguggugacuuugagauaaacaacaaaugcuugcagguaggaaccaagggagccuggaggccagcguaggcuuuauucugcaaccacagguauaugucaucggagagccguucccuucugcuguacgcaaguacgugacucuguuggggucagaaaccccauuuguuacaaguucuugagguaggcuggcuuuuaucugucugccagaaauccuucuauaguccagcuugggcucauuucuaggaauaugggcugccugcaaccuaacauugaguggaacuuaauuauguuggagaauccaguuugcuggagguauuguauuccaggaaagacaaguguuauuaagacaucuuuuaucaaaccagccacacauuaacaggacauugcuggagguaguguaagauccagcagaaaaggaaaugucuguagaggaccuguaaugggagagaacaauuggggccacauaggaucccggaaaccacgaugaggguuuuguguuaacaguaggaacaacuagaaauugggagacugauguagaauaguaaggugaugugguacauggggugaguaugggggugggggagcaugguauuugcauaaaacaaucacucuggccaucacaugaacaauugugggguggccacuauuagaacuuccucggaguagacaagguagagggugauguuaccauggauacaugguggagagucagaugacuaacuguagggaggucaaguuaaacaggccucucagaggugauggggugucauggguaauguccagguccaagcacgugugaagccucugucacugcccaccccuaagaaugagugaggagagucagcauggagucaagaaaacaucagugcucagagggcagugguccacgugguggugugugaaagcagaaacacaggugaaaagaugaaggagccuuggagcggaaggaguggcgucuuuuaauggcuggggagaggaaaaugaguuguaaaggagccacaagugaaggccauaaaguguugagucaagaguagagaggaggcaguccgugcccacaaccaaauggaaagagaaauggggaucucugcaggaugccuuggagggccagaccugagauccaguggguauagugauggggacagauguggcccuggaauggaagaggaugggggcugaggagcuguaggcaggaagcaaaacacagcugggccugggcugugcagaagcccagaauggagcauggcaagacaugcagggaggauucgaaccccaggguggaccaaagcacagagacaaccauuagcuuucaguaagagaagggacagauaguccuuuaaaggccauagcaaugaaacuaagcugcuuuuuaaaaaaaauuagagaugggacauuuccuaugaaugaccuguauauuuuucucauuucuaugaguaaaagccaccgaucucuugguuuuguacagugggacauagaaccuuagagaagcuaggaaaucugccggggccugcaucagggcuugagacguggauguuuucugcacgcaccgucucugcucacugcuggcauugcagcauuggccuguacugugaccaggagggccgagaguaacagucugacgguuuuagcacaaucauaucuuaacacaaacuuaaugcucuuuacguuuuauguuaauacccuuuuuccuagugauauuagcuagauaggaggaugaggugaaguguuccucagguaaagcaagaaaaucuguacugauuugcuuggcuaagcccuccacgugaauuucuacagaaaucacgugaguuaauuuuugugugaccacacugcgucacuagguacucuuaacuggagcugaggacuugucagcaugaccccaugugauccgaucccucuaaugaccccagucggucgguugguucgugauuagugaguguuagaugaagggcagugcugagucagggcucccacacuucugagccauuuucccuuggauucccucugccagcuugcuuuucuucucacuucacaugagaaagggcgaugggacuggcuaaggccagguccugaaaguagggagcagcuauuaugguguccugagaauuaaggaccugcccaccccucuuggaagaacugcaggugcugcguaaagaugguagacugaaacuacuggcaguguuaacucaucugcgagaaacguuuucauguuuugauucugacucauggcuccagcugcauauguagcagaggauggccuaguugcuuaucaaugggaagagaggcccuugguccugugagggcucuaugucccaauguagcggaaugccagggccaggaagugggaguggguggguuggggagcggggugggggggggaggauaaaaauuaaugaaaagauuaaaaaaaaaaaaaaagaacaggcuguguucucaggauuuugaggaagcaagaacuccagugcauugcugugaacgguauaaaaugguucagcccucacagagggcaaauuggaccaaucauggccauuuauaauuguauaugaccuuccacacggagguggcacuuggggagauuuaucuuagggacacaccugcuuggguauggacugcaguauugucuguggugguaacccuuuagaagcagcccacuuguccuccagcagcagcagcagcagcagcagcaggagggugcugguuaaugcaagaagauaaguacauggagugaaaugucuacugcaccucaaaaaagccuaaggacacccugcuccuggucugaauagauccccaggauacuaagcagaaaagccgaggugugcuuuguaaauuugaagaagagacaaggcugcuuacauuuugguuguauuuguguagacgccaagaaaaugauauacaccguguagcacacaggguagguggggagcaaauuuagaugagagccaggaugaggcuuuauguucaucuuuguauuguuuuuaagaccuccauguaguaaacguagcugcuaggcuauguccugguuagguacgggggcuuuggaaugugccauagguugguacgagacgguuuccuagcaggcugggugcagugagaacaaacagcucuugaguagauuucuuuuuuuacggaggguguuuuuucucucauccacauacgagccaggccuggugcugcuuagcucccuaggugagacgagaccuggcacguuuacggugguauggcuggaguagacugcaggguguuucccccaaaaagcaccugucagcccugacucuaccucaugcucuacagucgugcgugcguccguguagagggcagggagcauuuccagacagggugccuuucccauuuccuugucagucauaggcuuaagaauuaaacaugcccuuaggaguuuauaagaacuugcauuuuuguuguuggagaacagaggccccugggugaggaauucaagggccucaguaugggugugacuugcuaguuauuucuuugaaccuguuuuggcacuuagauguugucaggguugguuguuuugguuugguuugguuuuugguuucucacuaauuaggauuuggugaaggaacuuugaauguggacuuggagcuggguucgucuuuaguccugaacaacaaacuugcaauucacuagguauauguggaucauuaucauuaauucaagagaucauccauuaaacccuuuaaugccagauguucagaagaugguauggguuuaguguaauagaaauugaaggugauggcuucagcaguuuccuccucacaguguacaccuaucaguuucuguuuauuuacaucuugucaguaguuuagacauggaaugucccauagaggucugagcaagaaagucugggucccuuuugaugcuuuugagaguugauggauccuuuaggggguguggucuaaggguagguauugaggucauuggugcugugccuuccaaugggauuaugggacccuagccucuuccccuuuuggagugaguaguuuuaccucuauccuugaauuuacugcaauccucuugccucagccuccuaagggcugagaucacaggugugugaucuccugguugaagcuaccgcgccuggccuuaaucucucaguuuuuguguuuugcuauuagggagugaucacucucuaacaaaacuccuucuggauuaugcuuccacauguaccgcuuucaguaucuucagcuucuaggagugaugaucagcaagaacaugucugaugagaacauagaagccaguuagccuuucacuuacuguuaaaugugagaauuacauuaucuguaacaaauucuauucauaacucucaauaauguguauacuuaaccauucuuaucauuuguccagccugaaguuccugaucguccugccuccaccucccaguguaccacaugcccaguuuagaguuguaucuuaaacauuugucuuacuguugguucuuggugacacagacugcuuugggucacucugacauuuaaucaaauugaacagcuggcugguggagaaugcuuagcagguauuccuagucacccaagcaagggauuucagcagaauucauugauucauuucuuaagacuucuucucuauuuuacuuugccuuuaauuuuuuuuuuauuuuucuaagaguuuaucuagccagugugaccuugcucauuauuuacuaaugaacaguuacaaauuguuuguauguuuugguaauuagaaugugaucucaaucgccuaccagaugaacugacacuguaaugacacgaagucagcaacaauuaugccuaacaggaaaauuaauuauguaauccucucaucccauauuuugucuaagagauuagauuuggcugcgagcagacugccugggugggcaaagcauggcguaacaccucuugcuuguggcuggagcagcuaacaagagugcucacugugucaucuggggacaucuuugaucacuuuguaugugguuuguguguuuguguguguguguguguguguguguguguguguggcuuuugauucuaaauggcuauuuuauauccuaacuucuuagugaguaaaagugccucuucacucucagucucaaaggagccaucuuuugcccucucccuuccuuccucauaagggacacggagcucagaauggauugcugauacacagcaauaccccuuugacacagguaugugcauucuuacauccuggauccauggaacucauccguuccucuccaggacacaacaguuaacaguagcaacaaaguccaggguccaggccaggacugcaggagcugaggaccaccuggcaagcagcagagacaagcaccuggcugugugucuuagagucucuuggucugagcaggcuguucugcugcccugcuugccuccugguaccuaagguauugugaggcacagacaagguaguuggccuccuuauacagguacagcaggccuaagaggcacccugggacgaucuugccaacuucucauacccuggguacaaagcugaucucugagacgguuuugagauuggaccaagggcagagcuggggccacagaacccaggugcucugguccugugugguauucugccuguuggccuuugguuuuauuuuguucuguuuaagacguaaaacuggauaagcauaaagggacagugcaguaucgcucugacugacaagucgaagggaagaagccacagccaagucuuacaauuccgucuccaagagcacacugggggacauacuaccauagauuuuaaaagcacauuaaaauguauuuuucaaaagcauauaguugagccucugauaguuugacauuuauuuccuggcaucucaaagccuuucugugcugugcauuccauacuaacuuuguuuuuaauuauuugucaaguuaugugggaugaagacuucauaaucuacucccuguauguacuugggcauugacgucauucauuguuaguugguggcaacauuguuguaccuuaaucuuuauuuuaaauuauuuccauggaauuuuauuuguuuccauuuuaauucuuguuuuugucuuuugagaucagguuugugaggugguggguuuuuuuuguuuguuuguuuuguuuuuuuaaagaaagaaagaaauuuagguucuuucccuguaugcccagggucgcacuuuauucucugacugcugcuucugaccuacaugagaggugucaugccggcccugugagaaaugccccaugcauaagaugaaguaaggagauccuucagucucugcccucccuccaagcccauguucugcauaaaauccauaugcauucuugacugucuacauuuauagcgccugucaguuggugugcucuuagcuuucuucccuggagaauuguguauacuguugguucuuuggguacugagcugaggagccccaaacccauucagaugacugcucagacaggucucagugguggcucucucagacauccccuccccaugucaguccgugauuucauccaucuguagacuguuggcauuuauggcuauugccugaacccaaaccauguuaguuuuauauaaaaaacaggacacaaaacuaggaagacucggggcauggggcuguuguagugagcgagggcggcugucuuugcaauuguuuccauugagauguuugucguaguauuaguuagugaggggaacuuaacuguuauccucuaaacgugucucaggugaguuguguugcacaggugauagugauaaauauaaaacggauuguuuuuaauuauuagaagugauccauuauucaacaacaguagcuaauauuucagaagaaaaaacuaaugaaguagaaauucaggugagaucaggaaugugucuagguuagagaaccagggaaauuuugauauaucccccuuauagaaaauguggcuucacucucaaaagugcaguuauaaaguuaauugaauuucucacacacacacacacacacacacacacacacacacacacacacaccccagcuacuuuuggcuuaguucauuuaguuuuaaaguuaucugcggagagauugagaagaauuccgugguagccaagccauggugaauuaauguuccucacagaugguuuuauuuccuuguauaauauuauuuggaucacaaagcacauagcuuggaaaacgugagcaggaggccuuucugcuguagagaagugauaacgucaggaucgccggauguuuuguuucuucuuguucuccaguuugucuuucuuaaaaggauguaguugcugggcacugcuuggccccuuucacuuuuggaacaaucucuguuugauacugcaauguuucugucauuuuuaagaaccuuucauuucuuacgaaagccuugacuuuccuuugauaggaauucaaagccauuuacaguguauaacuuaacuccuuuaccuaucucuguugaugguuuucuacuucauauuucguucuuaauuaauaauguuaucagcacauuacauuggaugaguaucaggacguggagguggacauggaggugacuguguguggacauuuuuuuucuuucccuuaaagaaaaaaagacguagcaugagcucccuugugguuucuguuccacucuauuccugucccgggggcuuuggacauagaggccuccuuuagugccuccugugcccuuucucauucuucaagucuugagucaucuccaggaugucccugccagcagucugccuguaaguauugagagaaguugcaguuucuaaagugccaauuagaagccgaggguuggugggauaguggugauaagcuuuggggagacccucagcucaccuaccagcugccucagucugggagcuggaagcaaccacccaaacacccacccaacuauauugggaaguagcacaugcuguggauguagcugcugacaggcagggccuuggaaacccacagugggguaguugaaaauccuucuuucugccauuauuuuuuuuuuuagaagaaugagcuaauaauaaaauauaccaguaaugacuggguuuaacacuagguguaaacguuucauccuuacucaacaggccaguaaggacuggccaucaucauccccuucccauaggcuaaguguagucaggaucgaaauccaagcugaccugaagcagccaucgcaggguguuuccugccuccccuucugauaaauuauccacggggcgauuguuuucaaaguuuuguaugccuccgagguacucuguauauauucaccaauaugucgaccagucggucauuagcuguuugugcaaaugcagguguaucuggucucugcuuacaagagccuguaaucccagcauguggggaacuugaacaaggauggaauccuggagcccauccagggaugcuugacaagaccuagcucagaaaaacagagcaaaguaaauaaaaacuuacacauacaugcaugcacgcacgcacacacacacacacacacacacacacgcaggcacgcacacacaaacaguuuaguacuucaggugaucuaggugugugacucacugguagaugucuugauuaucauacauagagcucagaucauagauuaagugauccaaacauugugugcuggggaguggguaauauacagguggaaaacauacuguccuuggucuuuguuuuuccucucagcauguaaaaauaaauacaugcauccaauauauugggccuagguuuuuuaaaagggagcucaugauauuauauaaaggauaguucuuaacaguguuuuguauaguuuuaauuaauuuuucuugauguauagaucacuuguccauugcaaauauuuaaauaagauucuaaauuauagaaguucaugauuuucaugaaugauucuuaauuagcuaucuuauaucgaugggcaaauaucauuaaucuguuucccuuugcuccuaaacaagaugauauuaaauucucuuguuaaugacuacauauucaaccuugucuguuuacuguugcuuuuguguuuguagauaaggguacucacuguacugguucaaauaagaaccuucugugcuuaagcaauggacacucugaguuuuagucaguaacaguguauuccaucuaaggcuguuguguccauuccuguucuaauuuuaauugagagaagcugaugcauuucauuaaaugccuuuugacacaauguaauugugagcucuugcuuuuauuuuguggcauaauuuauauugauuagauuuugaaauacugagucaucuuugcguuccugaauaaaccauaauuguugcuaauauuuaauguuuuauaauagcaguuuugagaugggucuguaauucuuacuauuuugcuguuaggguuauauuuuuuuucauaugauuuaagaagaauuuuuuuccuagaaucuauaauuauuucuagaauguagaaaauaucugauuuuuaaauauuaacuguagcaaacugcaagauucuggaagaauaaaaucuauuuuuuaccaaugagcccuccuucagcccucuuaaaccuuuucaggguuucucuguguagcccuggcugucuuggaacuugcccuguagacuaagcuggucucaaacucaaagguccaccuaccacugucuccugagugcugagacuaaaagcccuugcugccagaccccccuaaacuuuuaaagaaagguuguguggggcacaggcuaggaaguaggcuacaggcugcgacuugaagauagugaauuagagaugagucuggcuauagugugagaugcuguuucagaaauccgaaagggcaaggaaaagugcuucuggguguaucgggguucuuagcuggccccccuuuuuuuauuuuuuacuuuuuccugcuuccuggguaaucaguguaucucaaguuuaaguucauuguccagagggagugcacuugcacuguuguuauuaauaccugugcuauacaugauacuaucccguuccucaugaacacuugggcucuuguucuuuccugaucaagcuuuauagaggcccgugugacuugcuaucguuaaaggacucguuacacuaaccuuuuaguuaccuuguguuuugauugugguggguauauauauuacuuuugaccagggcuuauuaaauugaccauccaucuuguuuccccaaacaguggcauccagucggaaaguuuguuggaggacagcuguacucugcaccuuuguuuguuucaguugccugcuuggccuuugauucugagguuguuuagacguuuguggccaaguuucucuuuaauuuaccuuuggauauucuguuaugaucgcugcauguaccucugaaaccucucugagggaacuuacugaggcugacuugaguccaagaacauaguuaauuuuuaaaucaagucagauuuuuuguuuguuuuguuuuuuuguuuuuguuuuaaauagagguuucguuuuccaauuuaguaaaucagacuuaacugguugcauuauuuucaaguccuuguuuguuguuaacugucaacuggagaaaaauguucaaguaucucuguaauugugugauuuuuuuuuucacuuuaagaaugcuuuaaaaaacaaucuacauuuacuuauuuuuguguauguguuuugccuguauguauguauguauguguauauauguauguaugauauguauauguacuguaugcaugucuggcacccauggaaguauggaagucaaaagaagauagggagcccccuggaacuguagccaagugguaagccagcauguggguguugggaacuaaacccugguccucuacagagccacuagugcucugaacugcagagccaacucuccagcuccuccugagaaccucugcccacucagacucaccugcucacagugccccacgucuguguuguguacaccaucccucuuuguuggguuugacccaucaguugccacacuugucugcuuuccucuguaacuucagcucucuauuuggcaccuuucuuguucgucuguuuugucugagucucagguuuguuuuaaggagagcuaggucaucuccuccccccucccccacccccccgauugacaguuuuaucuuucaacagaagauucugacuuucuuugcugacugugacaaugaauauauuuuugcaugccugcuuucuagcgugucauauauuucacacuuucuucuucguucccauguugaccucacaguuuggaaagguguguuguucccauccuguuaguguguugccauuaaagguuucaucucccccaccccuagaaacagaugccaguaucagaucacugacucucccuccgugaugagccuucaucugcccgucucuguauaguucccaccacguguaccccaggguucuguuuccagagugaucuuuuuuacuccuaaauucaugcucugugccucccauuguuuuucccuaauccucuggaauauaaauuuagugcucaagaacaguggauuuuuuuuucccuguucuauuuaaaagauuaaacugaaauucaagacaguauguauguguguucucacugcuuuucuauuuagguuccccugugcagucgauucuucuucgaugaguaccacccacugcaguccagcuuggucgcucugccccaggcccaugugcugucuucagugagucaugguuuuuguuggcuugcugauggcucuucucagaagucacucccaucucaagaagggacugcuagguaucagaugcccacucaggaagcagauaugcugcagcagagaugcucuguggcccuaggauggggguucagucuuaccauccacagagcuccuccucgaguugcugggucagaagaaagaccagggucugaaauugguguuccuugagauaggcuuucaugucuguaaaucacagagauguugaagccugccagaggcucaagaagcccuaacccaguauacuacagggaaguucuuuagaccacuuuucuuguugcuccuccagaagcagggucaaguauaauucucuaagccauugucuuccacauacgauuauaugagaguaaauuucguuuacuguauugugggaugggaggcagaaaaauguacagauggcuacuugccauuggaugcugcauuuggaguaauggcacgcugauggagcacaguugcuuucaauuaagcuguagggaauugagugcuuauauaaagggagcaugacagcgcacgguucuccuucagaaaaggcuauuucuuaccaaccggcacuuucguccuuguuccaacaucacuccauauauacuaauauguucucucaauggaauaaucuuuguuaacagcauccauuauguguguguaggugugugcacacacacagggagagguggcauuuccuccuuucacagcuggaaaacaugaugcaaagugccuaaccagcuuggcccgaauuggagcauugucauuggcaucuugaugcagguguuugugacuuagagucaugcucuauuuauacagaguggcacucgggcacccuagaaaggacuggaguacuagccuaacucccuggauguucacugucauuuuaacgacagucuuauuucuguguauuauuugaauuguuuuguauauuuuccaauuucuugguagcugugggugcgcaugcaaaagcaccccugugauuuaguuugauguggcaaaauaccggaccccugugccaccguagaagccucccuucuuugucugacgcacacgucuucuauugcagugggauacuauagaaauagcucguguccuugcgaaauugccagcacaaauaaggaccuggaaauuguugcuaggcauguaugucaccagauucauuaaccacuuccaugacaacuacaauauuuaaauuuauucgacugacuuagugugcauguguuauguguauaugugugggcacacaugucagggcacacauguggagaauagaggacggucuguucacuccuuccacaaugugaagcugaagaauugaauuuagguuaucaggcuugguggcacuaucccaucagcccaaggcuuuaacuuucauuucucuuucuuucuuccuuucuuccuuucuuccuuucuuucuuccuuucuuccuuccuuccuuucucucucucucucucucucucucucucucucucucucucucucucccucucucucccucccucccucccucccucccucccucccuuccuuucuuucuguaaaacuuuuuugagugucugaaacaauguguugggucuaaaugaauauuuucaagcuacuucuaauuucuuguuacauucuuuguuuguaauauugugucaaaucuaaaauguauaagugccuacaaaugaaagaacgaucugcucuggcuaccugagguucagccacaguuggucugacagauuauucuaaccuugcuagcuucucauuuuuccagcagccuaacugccugccccacagugugugaagucuuacuuggcguccaggaugaccagugucugcaggcaggaccacugccuucgcugccaugcuuugcucggcuauugcaugggagcacuauugguuuuucucuuuaaaugaagcauuaagguccguuuacacagcgauaaauaaaguaauuacuguagcuguggcauucugccuaagucaucuugaaaacugaaugcaaaaaucuuuuuaauagcuccauaauggucucuugaaguguuacagauuuuuauaacgauagcuguaauauaagugccauuauuuacugcgagacuugaacauuuugaccauuuacaugguacuugucugucuccggcugagcugagugugugacgcuguggcacugcagacauguggugccugccaagggcagucuugaccagguguggaaggccacauagcaucacugugacaccagaguaugucagguccugcucccugguuccuuggagaaggguuuuuguuuguuuuuguuuuuguuuuuguuuuuuuuuuuuuuugcuuuuguuuuuuuaauuuuuuuuaagucuuuuuugcaaaauguagauucuguuuugggaaugcugagucccugcccaguuugauaguguuauguaagaaggcacauuucuuguguuuucugauuaccauucuuugaaacaguccaaacaaagaauacuacaguaagaaaaggggaaaggaagcugucacucagccuuucuugagagguguccuuugcuuuuuugaugaaacucaugaaagccucugacaguaguauccguucucaauggucuccucuccucggguguuagguaauggagagagaugagcguagaagaacaucacugggcagauucuuucuugguacccacucagacuagagagccuggcuuccaugcuaauggaaggggaacagaccuucuuacucauucugcagagcggugucucaggugagccuggcucuggcuuucuaugacuguguguguuucuagagcacacauguuuccugguuaugugugcauggucaagcuuguugacucuucuggagaaggcaaauguuggugagaacgcuuggugcauugcaugggauuuguucuccuugugucugcauuagcaauaaauagacacuccauuugcauauuuaacacccgucuuccuucagccuacaccucuucacucugggauuagcuguucacuacuugaagcuuuugugucuaugcugggauauaacuuuccuccuuauuaaucagcaaaagucauuuaaaauggugucauuuaaaaugaaauagagaaauauucauaguugagcuuugguggguauugccauaguuguuauucucuuuuuuuccuguuacaucaccuuuauucuuguguguguguauauacauacauauguauaggcauauauaugugugugcauauauauauuuauauacacacuuuuauauauauacacacacacauauauaugcuccuauaauuuuugaaaguaaaaauaaauuauucaugugcuaaaacuuuauuucuucacauacauggaauguuaguguauauauacaugggagugcugggggcuucuacugaacaagggucaucuggaccucauuacaaguagaguuguucaacacaagacguggugugaauguugcaaaguguuuuuagagauaacagauaaaugugaucauaagcagugugacccaucaccuacuguuuuuugccuuacccacacuauagcaggacuuaauugcuuuucaugacugaauaguauuccauugugugaacauaaugaauuuuuguuguuguuguuuauccagaacaucugcuuuuauugcauaaauccaggaccuuggacaucuccaucauuguucuaggauggcuaugaauguuguugcugugugaugagcucuucucugucccuaccucccucugaaacccacaaaucuugccaagacagagaagugggaaggaggcacuuggggauugaggugaaaguacuugagagaaacaucuaguguuagcgugugaucaucccuguggucuggacuggucuuacauucagccagagucuuugcaacaucccagccuuagagcaguuccuccccauauggagacaucucacucuuucugccugcacacacuggaacuuaguuguggacccaggaucacucucagugaccacccucgagaccuuggugauccaguuaggggccgucuaacaaguggauauugcugugcuacagagugugugauggacaggcaugugguacaccugggagagagggucuucggguucaguucaauggcuggggcggggaggaaggcaguuuguggugguucggaucuggagcagcauguuaggggaaaagagaggcuggacuaagggcaucuuuagucuuaaagacaaaccugaagagcuuucccuuuaaaccagaaguccccuaauccgcuauuucuuaggcuuaaauucaacaguaaugaacugucccaucacccaagugaugaauuuagucccaucgggcuuuccaaaucccuagaaaucccuuuccuagcccacgagcuucacugagcacagggcuccacuuccaguuaucuuuguucuaauuccuaccucucagcuccccucaauuuucugcuuacuggguuuaugcuuuaaccaaaugagggcgagguacgcguauuuugaaaauuccaauuuuaugaaugauuuagcgagaacuuagacucauugaaagaagagcaucauuucauccuuuuuuaucuuuucugcaguaaaaucacacgcuuacauauugucaguucauaugugcacaagucaucaugugacugaaacacuaugccuuucagcuguuccaacagccuagaaaaacuggcuucucacgggggcgugaacaggugacuccugcagccccaggaaccucuaaagacaaacuuuuucuuggaggaaagggggaauuuauuguccauuagcacaucaagagcugcauuuaggggaccauuagugcuuuuagcuccaaaugaaauugcccucuccuucucucuuccuugaaacagauggaaggagcucugacuuccuggcagaaagccucugcgauaccuugugcaaacugcuuaauuaacaucucugagcuuuggucacuaccagaacaggggagccagcaccagugugucaccggaggaucauacugaacauuguagugacucugaacuggcagacccagaagcaggccugcccuuguugauguguguaugauuugaguagacugggggaccgaauaauauaucgcuugacuagucaugucuuugggucgcaaggauccaaccggacaucccuguggcaccuucgucguucucuuuaagaucuucacagcguucacuuguaccugcuguggugggaagugagcauuuugauuauucuugaaggcauuaaagcaugaccaucuugaagugccgugaucauccucuaccuauaauucaucgucgccucaguuaacucuguuaauucaccuuacucugaaaaaagaaucucaacaggaaguuauuuacccaagucacaaauucauaauccuauuucuagaaagauucuaacagaucuagccagccacauuaucccagggccaccuggugugagaguagaaccgcuuggacacgcccuccacgccuccugccuaguaagcuguccacccuccuagugacaccuggccagcaauuagaaaaccagauaggaguuucucaugguucacugggauucauuuauuuucucauccauauuuguuuucuuugcauucucuggaucauuagcuauaaauagcuacguuuuacaugcauucuuaauguaaucgcuuaauagcugcucucugggaggaauggcucuggcaugauuguuuuucuuggguuagaugagauaccaguggguuuggggcauagauuuuuuuuuuuuccuucuugugugcacucuccugcccccacucugucccccucucccuuucuuucccucucccacuccuguucuugaccaugcuagcucugauuccaugcuuucucucccccucccccucccccucccguuccugaccaggcuccucugauuccaugccaugacucuguuugggguuacacccuggagaugaagcacgccucaguucaggagguauuuagcugguugggcuuuguuugaauuguuauucacaucuuccucagauuuuugagaaacugaaaccaaaaaguuuauuuuccuuccucaaaaggcucuuaaaaggaaaaauaugaugaguuuuaacaguugugaauaacucagaaaauacuuuuauuguugacagucaacugcuaccagcagagcggcccgcuugcauccucuucuugucucgguaaaacaaaucaauaggauuuaguguauuaauaccuuugauucuuacuuaaaauagguggcugccgagguagagacagugagcacuuuuccuuugagucuguuggguuugcugugguggugggcguggcgucccugaagguuagggugcccccuguuggugccauugggcuagggaagagguggggaaugcugggucucaccuccgaagucagaacccucagcaucgcuuguguggggugacguguucuggagagugcugccaaggaauagaaauucccagagugcuucagucuguggacagcagcucacacagcuagaugggugccuugugccuucuggcaaugagguaagcuuugaguugauaagaagacagaccagccagcuuuucaaacaucugcuagaggacacugggcuuugggggccaguugaggcauaaaagcuccugucugugccgucucucuccugcucauccuuuaguccguuaaccgagcuuguguguccaggaauuucuguuguuuuugcugcaccaucuuguuuccuuuuguuggcaugagguagaugcccucuauggguucaaacuccugggcuccagagaccugccucauccucuucaauagcugggacuagaaacauuagccaucaugccccucuuugagaucuuuaauaauuuugauuucuauugauuccaaaucccuuuucugagguaaacaguuugcugcccuuucuacacuguggcauuaugcaagaggaaucggauuuuaaagcaaaagcccacagcccaaccucucacagcucucagcaucaagacaucuagacaaggugaaguggcaguguuuguuacaaaauaaaacuauguuuacucgaucuccuguuauuuuaacucuuuuuaaaaaaugucuuauuauuugagauuauaauuaauuccacauuuccccuuacgccuuuucuccaaacccucccaucucucuucauugucuuuaaaauuuguggguuuuccagguggugcugguacacaccuuugaucccagcacuugagaggcagaggcagguggagcuccagguucaaggccagccuggucuacucagugaguuccaggauagccaggacuacacagaaaaacccuaucuuggguggcaggacagcaacaaaauauuuaugguuuuuuuuucauuaguuuuuuauaugugcaugaaagcauuugcaugaguguacgcauguguguguguuccuaaauacauauucauaguauucauaaauacaaucugcucagccuauaugauguuagcaguguguguauguuguuagggcugaccaucuaggcuuagucucuuugcuacagaagucuuuagauuauuuuuuuuuuaaaaaaaggcaaauuuaaauauguaaauccuucaguuuaguggagauuauuaacauuucguuuguaagcaaacagcuaucuguccugugcaucuuguagcugauacauccaugaagggacacacuggauauuacuaaaauugcuuagucccuccacacauuaccacacccacccguuuugcucucaugaguguaagaucuuuaagaggaagaaugaaugaaugaaugaaugaaugaaugaaugaaugaauguuacuuuguauccucacccugugcacuggcuuccuuugaugcuuuuucugggcaggcucggguugucugcccucaccugcacugaggggcccuuuaaguccccugucuggccacaguggcacaggggacaggagaggaagcacaugccauccucauuucucuguuuuaggcuuagaaagaaauauguccaacagaucagauccucucagagucacagcaugucgcacuucuaguaauuaaaacugaagcccaaauuggauaagaaauaauuuuuuuauugauggcuggcauuugugaaaaagguuuaauuagaccaagauacagcaggaacuuauuggcuauuucauuuaagagacacuguugacuugguuguuuucugugucucguuuugccugagaaucugacucuuuuucaccuuuuuccagauaugcuaguagcaagucuacauccauuagccauagugguuauguguuuuguuuuuuaaugguacauggcacauggucaaggguauuuucucacacgguuucuucacagugguauuugaggaguuucauccccuucugcuugguucauucuucuguguucccuucuggugucuguggucuugggguggccucagguucucaugggcucucaggauaacucagcaacugcugucagugugagcuguuuugcaacucacaucccgucccuaccagcuccgcccagaucuguaugcugguagaggucuaccugagagugccuuccucaugugaaaaaauccuggcccaaauccauguccucuuuagaauuaauggugggccagauugaggccucacugaaugucucuguagggauagaaagucagaggaagagauagguuggguauugauuuuguuuguuuuuugcuuuugaugcuuuuuugcuuuuuuaccuuugaugaugguaguccagaggcaauuucaaguaccaaauuauguacuacaugcauuaggguagagcaagagggcgaucaauugucacaugagaaguccuaguugugucaucccagccuccccccccccccgccagucuauuugagugauaaaaauuugagccuggcuaccagucacuuuauuuagagguugacacugagguggcauugcugguaagcacuagauuaucauugugugcagagguacccauggcacuguggugggucuuugcuccaucugucuguuuguuuucuguccacaugcugaguggggacaucagaaagaugacugacacauacugcagcagccucuguccugucuccagugggcugcaggugacagcuucugugagcaucuguggaauucuuuucugaaggcccccaguccccucucucccuguguguucuguccccagacacgcuauuucaauucaauucugagguuccucugacuagagaagacuccauguagaugugauguugaugaauacaugccauguuuacucaguaugaggaaagaaccaagaauagaguuuguaggagugagucaaagaaggauguauauugauguucaaaaacuaauguuacacauagaugcaggcccagagggaucaccugugggggcccuguguuucugggaaggugugaaucccaggcuugcuuggcaguucauuuaugaacaggcaacaauuuauguaagaaauuugagcauuuucaguaauaaaagaguagaaaaccuucaggucaaggccgagcuuggguuucuggcuucuuuguuuuuauuacuggcgguuguuaaagagugcaagguguucuuuguuuaccagccacaggcuaaucaaguugcugauguccaggccgucccacggacucccuccuuccuucuccugagauacuggcauuuaaaaacagaaaggcagggaagcauuuaauguuuuccaacaguaagagaguagcucaaguguuccccguccagugguaccuuugcagcaguuagggugagggagagaugggcuuacacggcugagcucagagagaauaaauguaccccuucugugcucauacacacagccccaguuccucuccagagaaaccuccagacugugaacaaacagaauuuuucuugcacuaagugcauggauuuuuguaagagcuggcugcacggcagcuauauaauaaucgaaagcuuuugaaaugcaaaggcuugcggguguucaucuauaaggaaucuuuugacuuaacaaauuugcaaaauaagucuaaugcaaacuuaagaaaugcuaaaucagauuuguaauuuucuuuuuaccguuguuaauuaauuucuagagucuuccugaaaaagaaaaacucucuaguuuucaaaaaaacauauuauggauauuuuauuuugccuguaugucugucuggugccaggaagucuaauagaaggugucagauucccugggacuguuaaaggcagugagcugccuugugggugcuguggaccaaaccuggguccucugcucuugaucagugagccaucucucuggcaauacccccugcacccuucccccaauccccaccccaccccccuuuuuuuuuuuuuuuuuuuuuuugagaaagagucucaccauguaauuucugucuguuguguaucuggcuuuauagaccaggcuggccucaaacucagaguuccuccugccucuaccucccagguuccuaaacccuggguuuaaagguguaaaucaccaugcccagcuaucauuuuugguguggauuaauauugaaaccaauaaggguuuauggagaaucagagugaagggagacuguucaaaaagguuacuuggugugguuuagacgggcagggauccaggacugacagugagcucucguaaguccugacaaaagucaaacacaugaugaugacaggugcucacacauccugugcuuuccacgaggaagauguugaaggcugagugccuagagucacucucucucccuggcuggauagcaccaucacgaauugugacauagcucgcuccuguuuaacuugcacauauguagacucauacaggaacaucagaauuacagaagccugucucacacuuaugggcucaucuauuggaaggaauacugaguuggauuuuuaaauuauuucuggucaucugaguagcugcgagaaauuggaaauuguuugcagcauuggaacuuuaaugauuuucccccaccccccaccccccaccccccacgucccccuggcuucuguaccccaugcauuuuauuguuguccuugauuuugcucagguuucagguguauuucaaugguucaugucuauguucccaucuagacaacgcugggggcugggcaaacaucuacccuaccaaaagaggaacaagggcugcuguuuucugggaagcucaacuuggugaccgucugccuagguaaagaagaacgaucgugugagacaagucaguuucccaaguaaaagggaaaucugaugacauauacauugcccauuucucuaauuaaaaugacagcccaagcaagcagcaugugggaacuugacacucagaucaacuugcaguauccccuaagccgugagauccuagaagggcauagaucgacauuuucuuuugcacguaguaccuagccuuuuuguuugagggcuccuguaccugugugguacagcaggcacacccugaaguugagguuaagguggcauaggcucaccaucagugcuuccuucuggcugaaguccacagcccagccaggcugaucugucagaacgcugguggcucuaagaagcagcauacuccucgcauauggauagagcagaggcauagggcucaaauggguaucugaagccaccuugagaucaggagggaagccagcccuguggcuguuacaguggggaauggggcagacuggagucacuggccgccagaguagaagcccagaaaccaguuuuggguuguguuuuguuuuccuccguuucagucaauaaaucccucacucuuaucgucuggcuugacucagucaggcugacuuuugaccagucucaggaggacugaagaauuuggcuguggguuggauggacaucaugcucacacacuccagcggagagaagagggucucagguggggagcaguaucugcugaagcucucagggugcuucuucagucucuucaggucagccgugugccuucucuuuacagcuuugaagugccuguuuagucugucuggcaccugcaccugggauucagguuauacacucggguuccacuggccuaaauuuggggccagaacaaaagacagagauugaaaaucaggacuaccuucgacgaugccgucauccuucacagaagaagcauaacaucucuguuugcaguuguaaaaauggcaaagacucgacuaguggguugggauuuuauacuugagaauaguuccguuuaaaauccagaauaucguucagcuguaagaauggggguggggauacuauguggauggaccuucuggucauuaugcuaauaaaauagccagucacccaaagacacagucagugguuuuacuaggacagagccagcagcugcagaauagugacugcuggaguuuggcaaagacagacaguguaguguugaguuucugcaaguuuuacaggaagaugguagugauacccacacacagugugaaccuauuuaauaucauuuaaacauauuuaauagcauuucguaucuaaauguaucaaaaugauugaccucauuaugcugcaauucaaauggguacauguaaaaaggagagaacaugggagcuccagcuggcuguuggcuauuggaccagggaagcugggucggggucucccuggcccacuucauacauacuaccucaacaaucugggcuaaaucccgucuccaucuggggcauguguaagggagaguaccaccugccuccgucccaaccugcgcccucuaaaaggaaccucucuaaugacuuaugccaggccuucccuggugcccacccuagcugggugauucccacauacacaccugacuuaggccagguuuucgcaggaggccucccucuccucguuccccucugugcccucgagcccugccugaucuguuugcacagugcuauagugacagaauguaacagaucuaaacuuguuuucacguuauaaucacuccagggguguuuccagugccaagauugggcugccucccucccuuccucucagacggacugaaucacucuuucuggggggugggacgcggcaugaguccuuggaaagccaguaaggaccuucugcaagcagguguggggucagggcaucauguucuccuguucuucuuccgucuuggccugggcuaccuaccacugcuacuaccacaauuaugucuccuucagggugcucaagagccguacaugugguagaaacucuuaggggaggccugcuuaguuggucuaauauaggaaagccucaggcagcacuggcuuggugaucaagggaagcuuucgggaugcuggcauggagcugaugcugugggcuuccacugagagucccuugagacuuagggucaccagauuagauuccagcccugagcuuugggugaauccgcagguuccgggcugcaggccugagaagcucccuagcaccccugcagcucugcaaauaacaccuggagagcugcuguccugcugaaccaccuagugcccaucagggagcugcgugccaggaggaagaggacggagaguugaaagagugcuugcuuaagcacaguuucaagccggugccaaguacucagccgucuuucugccuuuaaucaugcagagacuuucuaaaucacauguaauugcacaccccuuugggcagcucuugacuggcucuggcuuucgcuuuaggugauuuuccccuuaaacuccuagaaggauagggcuagugggcaagagagagguuucuuucaaaaggagagacugcaguuuguaguggaguuguguuugcguaauaucccacauuccauagagcuuuuaagagcugcuuaccccgcccauuccugagccuguagcugucgaagagcacauguaugugugugaauguccacccucacuuuaaccauuggcauuaucucccucaccugcacuugccuaaugccacauguauaaugugugcccauguguaaugacauggucugccucaguaaugauuugaaagcaguugucgucuugucauguuagucugccgaugaacccaguaggcuaacaucuuaaaccaucacgccuuagacuggucuuccuggaggagagccugguugguacucuugucguuucugguacgugccaagcugcccauuucagagcuggacacaggugcuuagaggaacuucucaccaaagggcuucugggauuucuaaguucuugcuguuuuugugaccuccugugguuucugguuucacagaaggcuuuguuucucgguuuuguugcugcuuucagccuugcccuauaaucacugggcgccagggagggcugcggucucuuucccagggugcugugccagcccacgugugccaccgcagcagcaggagggugggagggggccaggaggggccaguguuccaaaacacaccaaagugccuaucaggccuuuguuuggguucugagcuugcccccagaagggaggcaggcacuccuuggagcugcucccucugguuuguuuuaaguggaccauuccuuccuucaugugacucaagcuuaaagagacuagguaaaugugccuuacaagguuaaaaguggggaacaguaaggagccuuucucgauguuuaggggcaagggguagguuguggguggacacggucuuuagucuucaugacuuccugugcagccugaggaugaccggaacuucugauccuucgcuuucccccuccugagugcugagaucacaggcaggugccacucggcccaguuuauguguccuaaauccaggucuucaggcaagcauucuaccaucagagcuuaucgauagcccuauugcaaaccccagggagaaaagauucuuacuuugaacuuaguuuucaucgguuggaggacaggaggcuuugagcuucuagaggccucaagaaagaacgugaugcuuuaggauacagccuucugugugacccauaccagaauaccucagcaucccccugcagcgaggagagguggcagcaaaggucuagggugcagguggcuuuggaaucuugcgcugaacaucccagggaugggacaggcaguuucuccaggccauuguagcagucuggaugaagucgugcagggcagggguguagcuacccaggccuggggcauuagccguaaagcacaggcuggaggcacaaugcacgggaagaugggcccugugcaccgugacagcugauggagagaacaguauguuaguggaaggaagagagcuuaggggugcaccaggacugcagaugucugcucuggccacagagaaaagcggcuugggagcaccauguauguguucugagagacagccgacagcguucucuggaggcucucguguggccacaugugaagagacugguagccagaaaaugggagacaggaaguagacuuuccaauaugaacaugaaugaagccggaugcuacugcguugugugugcaggcauggauugagcaccugauucaugacagcuagguaugcuacaggaagagcacagaacgaggugagagcugguuccgggcucaucugguacagagaaccaggagcagaaaaacggguccugagaucacugcaugaguggaccgcauggccaguuucacgcaagagugacugaaagagacggagagcuacaggccuugcccaucugccuguguugacugcugcuuuuccacaauccuucuccaagcuguggacuuuguucauagucacucacuuguccuuguccagaaguugccugacuacagauccauuuuauggaugagaaaacugagacuuagagaggggcugguguuuacucaguguucauguuggcuguaugguacagaaacccagcuuggcuaguggcucauagacuauaacguguggguuccuugaugaggagcaggaagaugggccuucuggggggggggggaggagaaggacugacaugguccugcuuucugucugcaugcugucuuugccuggcuuucugucuguaagcaguguccuccuuuagccccguguguguccuauggcaugaggaaguuagcuugcccuguuguagcucaccucuccacucccacagcaccaggccuccuucccaggggccucaauaguggccuucaagugugagcgggugcgucacaugcagcaggucucugguagugaccccuuuucauaugacuggucuccguagccacuguggaaguuagcguauccguagcucccugucuuucacaaacaauggaaaaacccauuaccagcccccaaaccagcugucugucuucugaugaauagacagccaaccccgaagagcagaagaauaguuucucuuaaguacucugggagugcauaauauacuuuaaaugagauuaaaaaucaugcguucuucuuccuagcaucuccgucaggccauugaguaugagagcauucagugcugugugcucaguacgagguaguaacaucuauucagcguucaguacauccacucuguucaagaacaauguauucaaggucaguguguuuuggcucugugacagacuucuggaaauucccaagagaaugaguuuuucccccccacugguuauauaaucuagcacaagugacuguguggcagcaacaucauguaagugacuuguaaaaugcaguugauucuaaaauguugcuuugaaaagaguggcuugaaggauuuuuguguuuguuuuguuugugucccaccccccccaaguucuuuccagaguuuaaggcaccacuucuucuucuucuucuucuucuucuucuucuucuucuucuucuucuucuucuucuucuucuucuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccgucuccuccuccuccuccuccuccuccuccuccuccuccuccuccuccucuuccuccuucuuccuccuccucuucccuccuucuuccuccuucuucuucuuccuccuccuccuccucccuccuucuuccucccccuccuccuucuucuuccuccuccuccucuuccuccuccaaauuuguucuggaauuaucuguaagcaccgcuuuguaguaaguacccuucacuaccccucuucuuucgugguuaaauauugcuucucccucugcacagaggcugagccuggagaaguuucagguauaguccagguugcccuccuuguagauagcagcuuugggaguucaagaucugaccuacggcaaacuuuauugacuuggagaugcacauuucaaaaucuuugcuggugcuguuccagcacuuggucaacacuguccuccaggcucucucuaggcgguagugacacgugaucauuggaggagagccagucuguggaagaggacaucucuuccauaggagccagagcauaaaaccgugucugggagcaggaauaggccgaacaggccugagcgagcaagggauauggauccaagcaacuggagaugagcuagugagcaguggguuuucuuaccaggcuccacaggcagggacaucauggggaucugaacuuaauuuucagugugguuauuggagaguccuacaugggaaguucaggcucuguuguagccuuuuaacuugacuuguccagguagccagggaugaagucagauggaguuuugguuuuguuuuguuggguuuuuuuuguuuuguuguuuauuuguuuuuuuuuuuucagucugugguaacaagcauucaugugcauugaauguucacaugccagacacuucuccaagcguguucuaauguaguaucucauuuaacauugcucuguggucagaaucgguggucaaugagaugacaaaggugcugguguaaaccuccacguuaguacccucuucagcacccugaguuucauaauuuccuauuuacggacgaaauuaacaugcuaauuacaaaucauucccuacuacucacucaggcacgcuagcuccguaaggaucuccuuaagguuuagauggauaacuuaauugaauugcuuaauguauuuagaagugauaaaaagugcauuucuuuuuaauuauagaacccagauaacaaggaguaagucuaacaggaaagguccagggcgucuucacaggaaaucugcagucuuacugaacaauauagaaaggccugaagacacccuucuccccuagcauaagaagcugaaagagugcccuguacacagcgauguacaguuucaaaacaguguuagcauuugauuaaguaacuguaagguuuuuucgugaggcuauaauggcgagaaagguuuaaaaguuuacuagugguguuuugcuuuugcuuuuugcuuuuuuguuuuguuuaagacagucuuauauugucacccuggcuacuagggcucccuggguugacaagguuauccuggaacaaucaagagauuugcccaucugugccucuuaaaugcugggguaaaagcuugcaccaccggccccaaaacuuuauaguuuauuuuaaagaaaaaguaaugaguggccagggaguggguggacuugccugaucaccuuugcuagcagucaaugcccacacaagccuguuacaaauaccauacaacagaucauuuucaacuccaccggaggauuuauguuuuguggagaguuccugaguagaaaagucugcuuauaaugcuugaaacccagguuuucaguuuagauuuuguuguuguuuaucaaaugcuuuugcacagaagcaaugaguuaaucccaguuaauguuuguugguaaguuaagagagaaucagcagauuguagggcaaguuuguaaaucugccccaccuuacagguuuccucaccagaagcauguauaugucacaagcucagggguagaggagagcccugcauccucacugcacugcaugucucagggcaugugauggagacuguggaccacacuggcuguucccgugacgcaggugucagacgcugacauccacuugagcaucuuccugugcacuggccuacacaguucacaguuaggugaaaggccagucaaccaagggaaaagcugauggaucaccuuguguauguguguguggagggguggaagacucacacucacacacauuaacacacacacacacauauauauauuuuuaaugugguucguaggcuagcuguucacugucucaaagcucuuaguagagaaggcucaccguccaacccuccagaaggaaguucauaccacuuuucugucauacucuuucuccuaaugcauaguggaaauuuggagacuuuuaauucuucaagagucuaagcuggggcauuacugcuauaaauggggucuaccuaaccccccuaauucugaguuugacaucggccggcaaacugccuugugcacuuaaagucacaagcauaacuuuuccagaauuguagaccccuguucccuaaauaccaccaaaguccuagauguagcuaggaguacccacguguugcagggauccugagauaguugguaagcccccaagcaugccaagcaccuccagaaaagagccaagccaaaauaaagaaaacgcauuaguggaguguccuucugucuucuucuccauccaaacugguauaggagaccacaccaggcccauaccacaugccguaaagcaaucuccugcacugggggauuugagggggggagggggaggggaagagauugagauuaagauuguaaccuuccagagccucacuucaggaguggacagaggaguccaugcugcagugguucauacugguuugagcaaauaaccuuccuuuuacuccaaagaggucuuggacagauuucaguuugugaguugcugauucagccacuuuuuaagaagggacaaaacuugguacuagauuuaguuaaacugaaucaugcauuugggaugaaagggaauaaucuuuuuuuuuucuuuuaacaauuuaauuacaugaaaaaaaaaucuuccuuaacuacaacugauagaaaucuaaauuugugucgagcagugguggcacauacuuuuaaucccagcacuuaagaggcagaggcaggaggaucucugugaguuugaggccagccuggucugcagagggaguucuaggacagccagggcuacacagagaaauccugucugaaaauaaacaaaaaguggucuacauguauauguuaugguuguauuuuaaaguaaugaacugcauauacauucuccgccuccuugagucuuuauugcaggugauuuggacagcacuguuuacauuagacacgcacagagcauaugugcagcuccagagagucccaggguccuucuccgccuccuucuuuaccuuuuccagcuucauacuuuuccuugucauucacagccagaccacucugauuggccuggcuauuuuuaauuguugccugauguuaggaggacaaggcaacuguugcaagcaccagauuaaguguuuauguuacauuacaaacaagccuucaguagggaugucuugggugggcuugcuuugacuugcaaauaguccugucagaacuuagcucccuaaucggcuuagaaauguguuugugccaguaacuuugaugagauauuaugauuuuuuuuuuuuuuaguuuauugucuuguuuucaccguauguguuccuaagcuacuaugauuaaaauagcaacuugugcuaagaaugcagucuaacuuagagauggcguuucuacaugcacacuugagcuaaguccccuuuuggagcugugacuuccgaugaagugguagugcacgggcaguagauguccugagucuggaugauguccuguaaccaaggcagugugguuugcaagaagccaucugcuuagccugcuugaaggcaugaaauuaauuuacuuguuggaauauuuuuauguccauuaaaaagaaaacccccuucauucccgagagacuguagagucacagacucgagcaguuacaagaaauuacacuaucccaugcuaugucugcgccccccccccccacacuuuguaaaacuguaauacaguuuggcaaacagcaaauugcuguugcugcaucaggaagcauccggccagugcguggguccauaucucuuuaccuauuacccuccuuacuguaaaccuccuuucccaaggucacaaagaaucuguacucccucucaaaggcuuaucacuuuagggucauuuuauaauauuuguuccuuuuuaaacaucccauaguuuaccuauccaccccucucuguucaggucuuggcaaauguaagcuuucuuuucuuugggagaagugucacaaguuuaauuucuauuuuauagaauaauagcugcauguuuguuuguaaagacacccaaacaguccagaguagcugugccauuuuuuaaucuauucuccucaacgaagucugagugaccagggguccccuaacuuccuuguguguguguguguguguguguguguguguguguguguguguguguguguguugauaugaagugcuaucucauuugugguuuuaauuugcauuucccugguggcuaaugaugucacacaccuucucccguguuuguuuacuauuuauaugcccuccucuuuggugaagcaucuguucaucuuuugcucuaauuagauuguuuauuuuguaauguugaguuuucagaguucuuuauagaucccagacuccagcucuuugucaggcccgugguuuguaaauauuuucucccagucugugcuuuaucuuuuuaucuccuuaacagucuuucaccgagcaaaauuuuuuaauuuugugaaagccugguguccugguuuuucuuuuuaugauuuuuuuuuucucuuguaaccuaaaccaggaacucugugucuagugauagauuccagggauccccugccccccagucccugccaacuuuacuguuugaugacuuaaguugaauuugaauggcgugagcuguuuggguuguuuuguuuuaaguaaaguauaagaaugagguuggggugaauuuucuccccgcucccgggagcgccaucuguagacuagacugcucuuuccccauuggacugaguuugagccuugucagcucugucaugugcugcacuggcugugcgccagacucucugugcugcugcguuggaguguggcuuguuucuuugccagugucaggaaguuuugaauggucucaccgcauccuagauuuuaaaaucagauaaccugaccccaguucuuccuguugcuaacuuaguuaccaucaccuugucuauacuggaaacaauguugcugggauuuuacuaggaaaugcauuauaccuuuauacagguuuaaggagaaaggacuguguguguguguauguguaugugugugugugugugugagagagagagagagagagagagagagagagagagagagauaucaacauuagaagucacacuuagcuucucuucaccuugugugauuuuugaucuaggguuucacacugaaccuacuggugacugaaccagcuagaauggcugaccaccugucacuguccgccuucuucugacuuuucaguggguucuggggaucugaauucagguccucuugcuuuugugaccuuaccggugagccgccuccccugccucacaugucuaaggucuuuuguuuugauacuuuguaguaaaggagaaagaacacagacacacuuaagugccuuugccuguguguuuagaagauggccagcuuauaaagggggaaaaucgcucccaguucuuguaguuuauaauuaugauuucaaaauucaguuuugcagcugaaccuuucauuggauugguuggugucucccaguaauuaaccuccagcucaugagaaugacuuauuguuacaaggaguagaaucucauuuucuuaauguacagaguguuuuuagaaguaauacugugcauaucuaauuuguaccaggaauugguuguaccagacagguaccugaaguucuugugaguuugauucuugaucuuccuuuccaucaccugucacaguuccuguucccucauaaugguggaaguaccugccguugcuccaaauuugagagcacggaguggaaaguagucacugguuugaguguuaagucauccagaguuaacgugauacauucagggguagacgccuuuacuguuuaaggacuguuuguaggaggugguaucggucaguagccaggacauagacacuggaauucaauggacuguggcuuugaguuguucuguggaguuuguccugagcaucugucagcacuguggggauaacuagaaacccuugggggggagggggguauuuugaauuuugcauuugauaacucgagucuguuacgauuacgucgugcauacucacauguaaugcgucgugguaguuuuccugugaguuucuccuggaucccauccaucuauaguucagacauucagcucuucaggcaaagcaaggcgcguggucugacuaagaaggauagcaccaguaaucauuguagaccuggagaguucaugcuggguuuccuuaagccagcucuaccuacacagccuacaugcgggagcacggccuagauagaggcuggggcuguuggucuugcuuucugaucuagucgggguuguuggucuuucaguggucagccacacagcagacccuuuucguugccccuuccauccuccaucuccugcuuucuucugauguucggucucuggguacccuagaaugucagacauacuuagguuucugcaaguacagccacuuaaacgcagagccuacagauaagaguucucuuuccucucagguugaccuacgugagggcuuugacuccaacccuuuaggaccagcauguguuugaaccuuggacauuaaggguaaagugaggaaaccuugagccuguuuuccuuggcucauuuaacuggagugaugaaaaaauuaccaccauugcagagugucaucacuugguacucuaauuguuaaccacugaguuaaaaauuauuuucaaugaaaauagcucauccagucgcaagggaaguacugccugugaucuuuccgggucagugagagagucacuucguguuccuuuguaugcuugaggacaugcagagaauuuccauggucuccucagaaccugggaacauaaguguucgccauacuuacugaacauggaaccccucugcgccuuuuaccuugaaccccagaggaaagucgagcucugcauguauucuucauucaccgggcuuguuuggaauugcucuggaaggacauugucaccaggcuguggucacaagaugguagagcgggugucuguacuuuaaccuccugaaauggaaaugcucgcucuccuguugcugcucuaaccacuccugaggucagggagcccaggaagauggaaugacagccucucucacccacuugaggaguucuuggagcuggguuaaggauugaaauggcacuguuugguggugacauucccuaagccugcaguguaguguaaauacucacaggagcguccuccauccaucagcaagagacuaguuucccuggguccagaguccaggaguugagaagugccgcagccugccucccucccggagagcaguccugguguaggguaguuugcccuuuuuuaaguccugacacuuuccggacuacagaacagaauaaagucagccucugccaaccugccucuguauaugaaggacuuggcuacaaaguggccccauugugucccugaauaaaguacuuuuggaaaaauaccgaagucaugccuacagaacgaaccaccacuugaaagcgguggaauccauugaaacccacugccugacugaaugcugggaacagcgguguuggguuacaagcuaaggggaaauaacuuaguaaagccaugugacugugugacucucagucuaaucccuggugacacguccccuuugcugcacgugacacgugagccucaaguccacuguuuuguaggcagaucaacucaccccagguagauuucuaacuaaaaccaguuccacauuaucaauggaccuguccgucuggaagugguuggcuuggauacauggcagguuuuuugaaugguuuugccacaucuguuuauacauacaccuggaggcaggaaguuucuuuuggaggcaaggguaggguggggugguugacuggggcuggggaggcagacagaaauauguuuaugguucucaagacugcuuucuaccccggggaaggcagguugagaacagauugccucuggagucccugggcauauuccagugguauaugggaauucuguucuuuccgagcacuuacuguaaauuaauaaagaauuuccaugaaucuggauauauggcacgcuggauugaagggagcggacacaggauugagugcuugagacucacuccacguggcuggauuuuaaucugaaaggaucugauuuuguggcacuuccaaagguggaagagaaacccucuucaccaucccaggagauguaggguguuagaagaaaaaaagacguguccuucaagccacaagcuguguguccacccugagccugucccuagccugaggugcuuuggacucaaugguuugagugucuuugggaauguaauuccucucagaguaucucugaggcacuuggcaaagacggggcucccucuugggggaccuuucccugaugguguguggguaacgacugcgcuuucuguguuucuucagacugcuggcuuuucugaagcuccuuaagagcaccugucacaccgagcucugucagucuugaaggacagugacugaaggacacuugucccuggugugugaacaagggauugugcucagggcaaaggcaggagccacucuggucauuuuucugugugaggugucucccccucccccuuuuaagauagggccucucugcauagccauagaggccccucuucuuccuccacuucuguuucuuugcuuauuuuaucauuauuauuauuauuuuccuuuuaaguuuuaaaggcagaaugugggcucugagagcaagccgacuugcccuggcuggcuugcgcgcgcgcucucgcucucucucucucucucucucucucucucucugcucauuugccuuccuguaacauggaaagacaaauagacccuuaaaccugacucucaaagccacugccaacuuuuuccuuugugcguaaguaguuauauuauuucuagguuacgcucuuuaucuuugaaagggaaaagaaacuaccauggacuguuugcaggaacgcauuguuccaggcuugccuaguuguaccugugaugccauuuuccacuuggaaccacagggacgauaaggucguucucagacggugagccuuuuaaaauacaaaacacauaacuuuaauaugcaguggucauauuccucuugcauauggcaugucucucaaaaaaaaaaaaagaugucagaguccagcaucuacuauccaggugcuguuugcccccaccucucugaguccucacuugaggagauugagguagcuauuuaaagcaggcccaggacacacauagugaggucaccuugggcuacagagugagaccuugucuuaaaaacagcaacaaauagaaaaagaaauugauuauuuugugccuuuccaaagaggcagugugcaguuucuuuaaaugcaguuauguggagcugugacuuuuaaaguucuucauugcggugaucuugcucucuggggcgugucuugaguuggaggaugaucuuauaguuuaauaaggacugcagacaaacagcagugcagggcauaucuuucagaucccagcagguaacagaagggccaucucguggccugcagagcacuuggcauucuaggaagagcauguugaggagaggagcaggcuggaggaagauggucagugggaaagggaagccagggugcuggcugugacuggcuugauuugcuuggugugcuacauacaucacuggucaguacagacuaccugugacagccagggagaggaaaggcauguuugugucucuguuucugugaagucugugaccugggacuuugcucuggguggguuucaguccuucaguuccacuugggguuggggaggcccaggacacugaaggggagaaugucuccaaaaucaaguauguauauguuuaccuccauguccaagguggcccagcuucucacagugaugggggaucagcaagacggguguuuuaacaugaagagggucaccuuuguccuuauccagaauggauuuuuagagaaacaugugaacgagccauggggaauaauuucauccucccuguucuuacagaugcccggucccuucauaagacaguggcagacucugcccaugugagcaggaaguacagugacuucgacaugcaaacauuucuggaaugguuuaccucaaguccaguuaguacuuccugaaggguccuguggagcaggagcugggacaaagucagagucuacacucuagaagaaugcaggcugcgugcuauagguggcuuacagccuggagcaucugucccagaagagacauauagaaggcagagaauugguuccccagaguauaacucucacagaaguaaaacagaaaauauucaagccaagcaaaaacuaaugcucuuuuauaagaccuguuuuuuguuuguuuguuuuuucucuuucauguugagucguuucaagggacucacuggccgagguucugacccauuacaguaaauaacagauguucaguccguuuaucuuacaauacuuaaaauaaaagcagaacguuaucuuacucucacauaaaggagaaaagucacuauaagacucugguugccuuugaagaagucuuauaccuaggagacuuuacuccgcaugcugucaaaccaucuguaagccugcaguacacugacacucacccccaacuucuucuagggaacuuuuuguagcugcuaguuccuggcagggugguuugauaguagugauagauuguugauuaaaauauaugucacagugccugauggguuauugacauuaaguguuaacgcacuccuuuucacaaguuugugcagguguggauucagguguguagguggggugcagguggggguucagguguggagguggagugcggguggggguacagguggggaugcagguggggguucagguguggaggugaggugcagguggggaugcuggugggggugcgggcgggguuucagggugaaggucagaggacaaccugguaauguuccuuagaugucauucaccuccccacuuuuugagaggguguauguauguauguauguauuuuauguuuauggguauuuuauuugcauguauaucugcacaucagauuaaggcaucggaucacauucuagacaguugucaugugccaugugugagugcaggccgggaacuggacucaguaccuggggagaaacauccagggcucuugaccacugaaccaucucucuagcccccccuuagaggguuucuuauugaaaucaaauucagcagguaggcaaggcugguuagagagccucagggccccaugagccccuucaacacaaggauuacacguuuguaucaucacaccugccuuggccauauuaacucggggauugagcucagguccuggugcucacaaggaaauaaauacaccgauuaucccaucuccccagcccaaggcacaucuuuucccugcuuaaaucaucaucuucuggugcuccguagacaccauggguaccaugagccuuuccuuuaacauuuaauuuuauguugaauuuguuaagauguuuagcuuuuauuaaaguuuacucacaaaaggacgaagcaaggaagauuuaguggucugaugagaugacaguuccggucauuuacuuuguaaugugugauugauugacagacuggauaagagcgcuggacccccuuccccagauugcccgauuucaguguacugacucauagaagcgaaaaugcaggauggaguagagagcuaggcccaagggaaagaacccaucccaagagauaaggggcucauaccuucuuaaguuaaaauaaggcugugugaucgauaaagacugaauguguggugguuguucugugaucaaacacaguuggcagauaaaaaggauauagugaguucacaaucaccagugugauguguggcgcauuuguacaaacuggaggugugauuuagaggaggaguagaagguagaaggggagaggcugguagagcggaaauauccuaccuacgguguuguccacuuuccugucugguagaguacuggagcuauagagaacauggggucuucagucuuuaauucuaucugcucaucucaaugggaaaugacugauacccagaugaauauccaucaugaagggaacuuaaguguuugcaaagcauuuucauuuauaugagaggccugagcauccucaagucaaacuccauaaugagauuugucuuuagaaauuuaaaagacgggcuggugagauggcucaguggauaagaacacccgacugcucuuccgaagguccagaguucaaaucccagcaaccacaugguggcucacaaccauccguaacgagaucugacucccuuuucuggagugucugaagacagcuacaguguacuuacauauaaucaauaaauaaaucuuuaaaaaaaaaaaaaagaaauuuaaaagacaaagcauaaaucuaaauuuaaaauguuuuuggucugaugucaauucagaaagagacuuguuuuuaaaacaagucaguauugugugacgucuguauuguaaggacaaauggaggugggcaguguucccgggggcagcaguuuaagauggucauagcugcuccauuuauguacagucugucuuauguguaucugucuuauaguaauaucccuagggaacaaaggggaaggaaagaggagagcuccaacuucagagcucaaaucuuaaauacuauucuucauuguuacuggugguuuucuugugguaaguuggagugaaguuuuggaguguuuuguacagauacucguggguacgugaaaaacuuucggcucagugagagucgcuguuuucuuaggaguugacugcuugggaaauccaaauacagguuugagauuaacaggccuucgaaguggauguuucugugugccgaagcucuguaaacacguguagcuugcuucagcauuguauaacauguauugauuuuucuauuuccucuccagaaaaucucaggcccuucuuuucucugcagacacaaaggcuggacuguucuccagaaucaccacuggggaccucuagggccaggucacuacugucaaaggggucugaauucuccagguuuccccuucuccucacaaaacccccaccaggagcacagugugacaaugaagcugcuucuuacccagcacaagugcucguggaucugcagaucccacugucagaggugacaugugaacaccagcuguuaacaggaggucuccccucucggagaaacaagcacuuacaaaagaacguguaucaguaaacucauccauuucaaaagcauuuucagagcuugcuaaugaaaguggaggcuuaugcaaagucacuuucucccaccaaacccuucccuuccuuccagugaugauguaguguuagggcuguaucauacccuuugagucacagucucagguuaacucuggugguagugcuacgcagaauacauuucuagggaaaaaaaagagcgaugcuuagucaaugcuuucuuacaguaucacagagagaggcacaagccugccaaaaugacaguuaagauacugcuauuuugauagaaauauuaguaaaugucauauuacccucugcuaaauauuuauagcauagaauauaaacccuaaugcacaauauuuuauggaagaaaccuccuuugucucauauccauuacacugugcugacauuggucuguaguuucccuccagaggccugaaggaagaaaauguuauuaauacccucuuauuccagcggacauaaauuccauuccaagaaagcaccuuugagucuuugguucuucucaaaguggaauauuuuaaaauauacacauuuauucuuuccuggauucaaacaucaaugcuuuucuuuaaaggcacaaagaggguggugguagaagcaaauuuugaguuuuugagagaaggcagcauguucaggagugaggcauauggccuauguauauacgugaggcuccugucaggaaaggagagggcacucagaaauugcagugugcucugaguucagcucugugacugagcaguggugcccaguagcugugauuuauaagguaauaugugccagacacuuuucucugggucguuuacaaggaguagucuagaguuguacaggcuuugguucuuggucauaguuugggguuguaguagauagagccccaaggcauuucucaggcagguguagguuucaugccagcucugugaggcgauuccaccuaaaaauguauggguguaacuucuacucugugcuaugagaaguugucgguggugguccucagauuggucaugugugagaaagaacugugccugccacgaaacucugugaauggcuuaaugauucucuacagugagccuacgacuauuuuuauauacaaaguggacuugaagauuaacugguauagagacugccucccuccggcagcaggaaagugaccugucuguacaguuccaucuccacgguaaggugauccaaggccuguuuaccugcagccacuagaaacccuugugcaaauguuugcugcuguuugguaguugcgagaucaguaaccguuuuuuuuuucagaauggagugauuucagacacaguuugggaaacacuugaaauaccaagugaccuuaauucacuguaacucuccaacuggaaaaugugcccaguguguccuugaaucaagagcccucaccucuucacccuugcuggcucuguagcuaucagcacuccugcuguguggccagugggcucccgggcucccgccccugcagccuccuccccugcagccuccccugcuggucuuccaugcuuggagugggucacuugcccuaacaucguuuguaguuuggcagaaaccauguguguguguuuccuugaccuuaaccucacuguguacuugcucaaggaauaaucugaaucugcugaugucuuaacuacuaaaucauggugacauuucauaauaguuaaucuccagauccauaagcaaagaaagugggggagcuggaauauuggaaagacugauacugcagcaguaacagauuguuuggaaacaguaagguucaaauaaauauugugaaagagggcaggagaagaaaaacauacagcaaacagcaucucgugcugcuuuaacuuuguucuaggcuugaaguaaacaguuggaguuuuuuuuuuuuuuuuuuuuuuuuugucuuaaaggucauucacaugcgccaguagguaacaauaugcaaauccuuacguauuguguuauuacauauuaguauguguuucuuugaaaaaaauguuuuugucauuguuauuuuaauaugggaaucgggcugcccccuuaccucagcuuucugaguaccugggacugcagacaccaugccucacuaaucuaaagggaaagcuguguucuaugagcugucacuucuacagggaacgauccagauguuugauaauacuccaggaggacauagaaauagaggcaguacugaagucaguggcucugcagugugguuuauagccaaguuugucccacgaccugcagcagugagggggagacacauuggggcuuuacugcuuguuguagaagcacacugaaaugccacaauguugaaaugagaacgaagggaacaagcccuuccuuauuucaaccucugcuugccaaccuagccucugccaggugacuugacuugagagucccgccgguuucugucuccuggagacacuuguugaucacacugguugaucacuuugaugugugaacgucacaugcaugacuuagcugcgggaucucaugacuggugaaguaugaacgucacaugcaugacuuagcagugggaucucaugacuggugaaguaugaacgucacaugcaugacuuagcagugggaucucaugacuggugcagugugaacgucacaugcaugacuuagcagugggaucucaugacuggugaaguaugaaugucacaugcaugacuuagcagugggaucucaugacuggugcagugugaacgucacauguaugacuuagcugugggaucucaugacuggugcagugugaacaucacaugcaugacuuagcaguaggaucucacgacuggugcagugugaacgucacaugcaugacuuagcagugggaucucaugacuggugcagccaggugcuuguuccuccuggauguguuugcucacccucacagacagaguccugucugucgaaguucugaaaagcccgcuucugaggcaucuuugaggagacaccucuuuucuuccuguauauggggugcugguugguguuggaaugagucccacuuuuaauguuccccucauccugugugggucccaaagcucuguauguguauggucgccuuuguggucaguggacagcuuguaccacacaagcagugcuccuuuuuuuguggguggaggguugguuucaugacaggguuuuucuauguagcccuggaacuuauucuauagaccaggcuggccucaaacucagagagaucuuccugccucucaggugcugggaguaaaggccugugugaccaccucaggcccauuguuuucuuucaaaugaagugaccugauguuccuacugcgugggcuguguagccaaagccuacuaguccucaggcugcaaauggaguccuauuuuauagcuguguccuccaggcagcuguggugacuguuuacgcagagacugcuggcccucuguaaacuuggucaucugcagugacaguuguuaagcugcuaguuaguaacauauuuaauaacuugguuuuccuucugaacccuuccacuggguaugaccaaccaacaugugugguauucucaggagcccaggauggggcuauaguucaguguuggagcacuugccuagcaugugguagggccuggguucuacccguagggcaguaaaccugcugagaaacaaggucccucuaggccccucucccuuguaucggucauaauagcugaaagagcaucuguauguacaacacuacucuugacaaauacaucuauuugacugaauauucucuuuuacuaacccagccacugggcaaucagagaugaacaaagccaggugucugaaaacagucaccagaacaaaugacuaaacagaggagagcuaggaacugaaguaaauggaagcagcuuuuagggaugggggcuugugguuggguucuuagaggccuuuggaaauguagcuguuacuaacuuuauuccuugacaguguugugcaaguauguaaugcauuccgacuacucucuacccaucaucucugggcuccucguccucaucagccuuuuccugccuccuuucgcauucauuuccuuccccucuuauccccugugguccguccccccccgucccuccccccuaccucucucucucucucuccccacuuaauuuaacugagaaugucaaugucggugugaguggguuuggaccuauccguuggaaccuggugggcucagcagcagcuauucuccuauuccuuugcucuccgauguggguaagagccuugaggugagaagaucugagcucgcucgcucauuccacaaauauuuauugagcaccugucugcgccaggcacucuucccagugccagggacagugggguacguggcaggaggcgagcugcucauguauggaugauguuuagagagugucuagugucuguuuaggcagagacuucagagaagagacaaaggaucuuuagaagaggcauaggaaagggagauguuaaaaggccugugucccgagagucauggagaaggcaaagccaauuguguggagcccugauaugguggacuugccuuggccacugaagaggagauaguagguucugaguuauaccgugugcucccuggaaaagaaaacuguugaucuugggagggggcuucugggaggaggcugcagcccaccuguagggcagaaauaagucuuaggucagggugguaguucuaagaguuaggagaagaguguacuaacauguggaauggacccugaauaggccagggggaaguagauuuugcaugucccagucuggaugcuacuuuuuguuccugagggaaguuuuuauaucuucaggugacuguggccacacuccacacuguuuaaggaauguguugcucguuaacacaggauguuuaaccaggaguucagguuauuugugcuuuaaaaucugcugagccugaauccaaagaguaauucguagacaacaucauagguacuuguuuccuuuaccuagaaaguauguucauggccacagagucaacaggucuccacgagcacucuuaaaggacagccagcaggucagagacaaguuucaaaacaaaacuccaaacugcuucaggcucuggucuaguuccuuauaaaaccuggcauaauuccuguaagacuuguuuauuuuauuuuuccucagcucguuaucuugauauuuuugccuuugaagaaguuauagaauuauugcaauuuaaucacagacauguauucuacaagaucuauuugauaucuccugguuacuuucuuguugcuuaggccuucagucaggauagaaacauggggcugaggaguuaaucuccaugcuuugagaaacaugcccacuugaucccagcacuguggggcagaguggguuggcgguguuagagguagacuguucuggaaauguagcaugcuuuccuacacucauucauauucauucauucucauucucucucucucuccccccccccuccccccucucucucccucucucucccucucucuccucucucuccucucuucccucucucucucucuccuccccccccucucgugucuccuuccauuaacacgaauccagaaaauggguauuuguauuuaggccuguuucaagguaggacagaauacuagguuuaauuaauugauagacugauuaaccaugggaauuccugaccauccuuagggcuugguacuuccuagucaauacauacauacauauauacauacaugcauacauacauacaaaaaacaacagccuccccugguuguggaggaagcaaaagccaggcugugaggguuugccauauaaauaagcgugggcuuuggggguggaucuguaguccagagggaacauggugauugccauuagggggaaaaaaaauuaagaauugagauuacuccuuagcuucucagauuuuuaacagccuguagaagguuuagauguagugauaucaacauaaaaacagccaauauuuuaaaaauguaucuuuugggaaauauauugucuccuucaaugcaguuuggcaaccuguaauaagcugacagccccugucuuucuaagaauuuuuuaauaaaaugucagggaaggaaaaguguaucagcagauaggaguuccuuuaauaacacaguagguguugguguucguguuaguguuagaaccgcccagacaggcaagcagcucugagaaaugcccgaguagccugggcuuggcuugaguaagagaccagcugccccagaggccccugcaagcuucgcacaggacgcagaggccgagcuggugucugagcacuucucuuuguuucgcuuguuuucgaucugucuuagaaaauacggcggccacaaacccagucccagucccugcagcugcuuggucuuuuuaugaaugaggcccagaagggggaggagaaggcuugcauuacaccagccguuggguaauacaauucauucacuugcagccauccaguccaggcuuuuauuuuaaaggaaaugacuuguuuauuugacaguucagauuagccccccccccccgcccgccccccacuccuuccuggacuuaguguguucaaacacuaggcuucaacauuaaagcuuguguucugagcauuugcucaauuuaauugggugaaauaguaggaaagguugauuaagaaggggagcggccuugucaccuccugggaucuugguuacuccucugucccugugcuaucuaagaggagaagccuugcagucucuuuacucagccuucagaccuuugggagccacaagaguggagugcuuuuggcaaggugauaccucccugaggccugcccagaucugaaugugccuucuuacccugcauucuuggcuugcuucccuauccugcacuggcauuucuuuaucuguagcauuuaaggccccauuuuuuuuuuuuuguggcgacuaaaaucugaauuggaaagugugugacaagggcugguccucuccccaccaccacuuccugcuaggggaugaacaaaaagaccagccauuguccugagcauaagucaaaacaaacacccauaggaagcggcagccugcuuacagcugccugagugagcccaacacugggccgcauugccucacaaagagaccguccugggcauggagacagaccacuggcauucacggcacagaucugaugcugaccaucuuugccaugcucaggcagugaugucugguuuguguccaugaccacguguuugggaaagggcauucucuaugagauguuauuaccagcacugucuguguguauguauguguauguuagagagacuuacaguuguucaaucacaaguuaaggacuccauucuguaagacagauauuagaugcugguggaagaagugacccuggcuuugaccuuuucaagcccuuaaugccacaucuaaguuguucuuagguuuucuugugggaaaggugggguguauggugggguaguugugagccaucucacuauaggugcgggcugucugaaagggaaugauaugucgacuugauaaucuugagucuuccuggcuaguugaacuuucuggaaaaugugaguguguaugcccaccauucuugccaguguccuagcagggugaacuguaggcagacaguguauaugaacucuagcaugcugcugcugcugcuguuuucuuaagaguuacuuauuuuauguauucgaguauacuauugcugucuucagaaacaucagaagagagcauuggaucccauuacagaugguugugagccaccauuuggcuucugggaauugaacucaggacuucaggaagggcagucagugcucuuaaccacugagccaucucucuaguuccaugcuuccuaaaaccuagagugaacaucugggcuggaauagcuggaaugaguugacagcaggauguggcuggugauucuaauacaagguucuaacccuuacaacugacagagcaaguucaugaauacuuccccuaugguuucuuguaaguagucuuguaauuucuggucauaaauguuuugccuuugaauagguuauaaaaguguguguguaugugagugagugugugcguacauggauauccauauccauauccucagggcuuuuaucaaauacugguugauuggaaauauguugauuuuuuuuuucuuuucucuguuuauucuguaaccagucuaggugucuguuuuucugucaguaccauauucuuuagguuacuguagcauuguaacaaacaugcacuuguagaacuuucuuuuggggcacuuuuacaguuguuuuugagacugugucucauauagccuaggcuggccuuaaacucucuauuauccuccuggcuccaccuuugcaguguacuuugaagcugggugauguuuuuaagcuuuguacuuuuugcccaggauucuguuggcuaucagagguccuacagcagagcacugucauacaaggagaggaagugaaacaugcagaguggaaaagcugggcagaaggagaaggcccugcauugcccagcggucggggucucagcagaggucagcccacuguagcguggaagagggcugaugaggugggacugagaacugaagagcagagcuguguucacuugauuuugggggugauaucaagagagccagaauuguuaagaacugggaggguuucagagacguugugaccaacagcugcuuuguggauguggaguaagcaguauacacacuuuaaaucuagcuccauggaagucauugaguucacaucucaauuagcauccaguuguacgucagugugugcaaacaugcgcauguguauuguauuuauuuagcaucauugaaacaggcuuuggguuucuuuuuuuuuuuccccucgaguugauuuuuuccaaauaauugaagcuuacaucucaguuuaauaaauauaagccuuucuucucaacuguuaccgacagaucuucauuaauuaauaacgcaccauuuucuucguaauacagggcacuauuacaaagucugaagccguggaaccuguuggcacaugagaauugguuuuguuaaagaggauugggcaucugugugugcuuguauguaaugcauugugucuguuccuguggcauccuggcaccgugagucccgauccuaggcugucucucaguaaacuuguuuauagcauuuucacccaccaagggcagaagacucucauuguugcuuuuaagugggcaucaggugccaggcauuugguggcugagacacuagaacccuguccaucacuuggauauggacacaaaugggagauccugcuaacgguuaagucucuccuuguguguuagugcucuuucgugaguuguucaacuccuucagaauccuggcuccucugucuuacuuugccaccccaugacuccuuauguuuucccagauaggaauuguacuaaugaaaaugagaaguaaauguaauauguaauguucugucgguaauuguuuguuugcauuuuagcuugucauggagcuaaugauauuuuaauuguagcugacuugaaacacaaugaaaaaguggcuuccugcuguuuugggguuuuuuugaggauuuuuaaaagccggauucagaaacuugaagguaauuuaaaauguuugagccccagaaacauauuuauauucuacagccaugaacgaaccaggcagggcuuguauuuaaucauuggaagagauguaaguacaguaaggaaacaaacagccuggugcacacauccauuacauuauugcuuaugugcaggaaucuuacaaagccugccucacugaagcgcuagaaugucauacaugggcagcugggccaaugcuguuugauuuuguaagagagucuucuauuucugaaugcuguuccacacgccagcucucugaggcuaugugaggacuacagaaggaaacagaaggcccggauagagucgaaggagaaacacaggagcuuugcaggaaggacugugauuuucuugcugaaugagcgucaagacugaugcaggggugaaagcacuccagguuaaaccugggcuggggaggggaggcucggggagagguaggggucggggcacacauacagccacagaauuuugauugugguaugugauuugagacauuuagaguguaguuccuaauccaucuguuggaagaauuggugagcugcagagaacuuuugaaacaaauggcauucucagauaaauacaggauaaugcuuugucaacguuuaaaauuuacaugccgccacaaugugguggucccuggcagauuauaauccuugucccgaggaaacuggggcaggaaggauuacugugagccagccuggccuacaugaaugaauucaagcccagccugggcugcagaucaagaucacaucucaaaaaacaaacaaacaaacccaauucagcugccaguguugacaaacuaagcuagaaguucaaaaggagccuggauuggacaccugaguugaccucugaccuucaccacaggcaccuacacacacccacacggacagaguucugauggguugguuccuccucugcacgccaaccacgaguguggcuccagggcuauuugcugcaggcccagcaugugccucugugucugggcagggacauaguucagaauagugggcugauucguaucauuccuucuuucuacgggugccagugcuucgccaucguugaaagagggauuccagcuacccuagcuagagccuucuuaucugcacaccccacccugucauguucucgagagcccaacggagguauuugauccccuguccuguuuaaugaaucaaaugccuaaucuugguuccuuuuuuucuuuuuuuaaagauuuauuuauuuauuuauucuauguaaguacgccguagcugucuucagacaccccagaagagggagucagaucucauuacagaugguugugagccaccaugugguugcugggauuugaacucaggaccuucggaagagcagucgggugcucuuaaccucugagccaucucuccagccccuaaucuugguucuuaaaagaaacuucagaauaaaagcugcaguucugguaagucagagccugccuuguuccuaaacccccaccaagcacucucaacacucugaaauguuuguacucacaacgcuccugacucccaguacgugauuuucaauacccacaagcaggguuccagccccgcaaacaccauaugguaccugcaaaucgaauguaguucugacacccaccaugcagagccagcacauccuggugggauccucugagacuguccucucacugaggaaugcagagguuugagugaauagccaguuaccccuucaacaugaucauuugccucaguggcccccaaauggcagaaaauguagcauugcuauuuuagccaggcuguaacucaggagcagcugaguggaagggcaggggugagacagagccugcagggucauggucuggagcagguuuguaggaguuucuuagggaugcagcucugaaagcauguucaugucuuaagacgacccugggugcauggaauucucuguacucuccagucuugggggcggggacagcugguuuacgaacagcucaccagccuggcucaucuccugccagcacugcuacuguguuuggguuuagcaucucucccugauuuuucagccauuucuucagaggagcaucuagagcucaaacguuccggcugaguagugggaaccugucgccguaaugggcguuuauggggaugagcauuaacuaagcaccuuuaauaggugucacucaccuggacuccuucaaaaagcgucucauuaguuccugcauguucaaaggagaagcugguccccagagacauauccuucccuccauuccuucuugcagaucccucgaggccaagagcagcgcuguguccagagugccuguucucuggcacuucuaaaaggucagcagagcugucuauaugccaguauuaggagucaccauugaagagcaaugguacaguagucucucucccugugagggagauacuuucaaagaucuguaguagauuccugaaaccauaaauaccaccaaaccugauguaugcugcuaauuccuauaaauacguaucuauaacgaagcuuaauuauaaccagcaauuaacaguaucaauacagcagucauaaaaauacauuguaauaacauguuuuuggcuguaauaaguugccaacacuacucuuuuucccguuugggggucacuguuaaguaaagucagggguacuugaacaacagcacuuguucuacucagaucucuaugacgucgcuagccgaugguuggguauacagccuggauccguugcagaaagggaggacccuuacagagcaggacaacaagauggcuuccuguaacuuccaguggcaggcaacuugaggccaaggaacuacuuuauuucuguaauuuuccauuuaauauuguuaugucauaguugccuucagguaacuagaaccaaggaaagcaaacugugaacaagggagagcuguggcugcagcugcccuucacuugaugugauugucaguaguuuguaaacuggagaguauaucagaucagauagguugugcucuccgggcauugaagaugagcugccucccucacccagggucugucuuagcucauucccugugccugcugcaguuaccccaugaaaugaguccaaacagcaaggugguagccgucacauuccuagucgcuggcaacacacuaaugaagcagagcacaagccacaaccuggacguauuaacugcucgaccaggucuuggacacaugcacccaccugucccuugagacuuuucugugucucugcagcuuaugagagaccucacuuguguagcaccauacaguaagcacggugcuucagcaagcacgugggucacaccgaaccugugaguugaaaugaguccauucucugaacauuacaagaucaccaacuccaaggcggaugggauuccuuccugaucugccauuuacgagccccuagcccuguuuucucauccguauuauggcgcuucccucuuccagguuuucucugcucuauacaguuuaaguuucggggacugacaacagcuuucuguuuaugaauguuccuugcaaugggaguaguguuugauccauaggcuuuaucacaauuggcaauuuuucuaauaacauuucagugaacaguaacuuugaaaggcugaggugccaugcuagcuuuaccucauguugauggaagacugccauucuguuaucuuagucuacagacucauuaagagugguugagguacccauccccccccgcuccccaguugcauuggugaacugggagcuuccguuauguguucucauuaucucccugagcugagcagagggcuaauacaugggguuguggaaauuuuugagcuaauugguuugcgccacuauuccauauuaaucuugccuguuuccuguacuuagacaggcuugccguuuggggggccucgacugagccugaagagauucucguagauuccuagguaguaaagaagcacauaucucagcccccacacuuccuugauuggccucucacacucugcgucaauauucuucuguccuggucucccuagggccacaugccagggaagccguacacuacccaacuucacugccugccaagauaacuugaaccaguccauccucagccuacuuacucugcuucauucauucauuguuagucaacaguguauuacugauuuuaaaaagagaaaucuuaguuaauguccagaguuugguuuugaaguccaaacaucauagugcagcuaugguaaggguugcucuugcucgagucagugacaggaaccugagagcaaguaaacauaagaagcagauguggagagaggucacacuuggcccguuucucuagcccucuugugagaauuaccuuaaucucugaggacaggguacccaguggccuaagaaccuaucaccaggcccaccucuuaaaacuuguaucucccaccugggcgugguggcgcacgccuuuaaucccagcacucaggaggcagagacaggcggauuucugaguucgaggccagccuggucuacaaagugaguuccaggacagccagagcuacacagagaaacccugucuugaaacaaacaaacaaacaagcaaacaaacaaacaaaaaaacccaaaaaacuuguaucucccagcacugauaccuuggggacaacuuucucacacaagaacuccaaagggacacccagacuuucccuguagaaaccgccgugucuuccugacuaacccaguguuuccccauguggccccauacagcagucuuccagugauccgugucuccaucugucugucugucugacuaaauucuucaucugaaaaugcuuugagaauguuacccacugagaaacagguaggaacgauggauacagauugguccugcgcuguuuccagugucugcagagugguggcagacacaucagccucucucacacggauggcuccaugcagagccaguuacaauggauuuggcagcaaauauaguugacuuccaguacagauccagguacuguuuuguaucaaccuagcgcuaaagcccacacacaucagaaaguaccucuugaauguuuggugagguaacugaaguggaucagacggcaaaccaaccguuguccaggaguuuccugacagggagcccccgagugcagagugcuugcuauggaagauccuguggagacgccaugcuuaaacuugaaauugcguuuguguuucaguuccuccuccuggcauaagugauaaaucacuucaacguagcacuguacggugcagccagauucccuuuuccuugcccugugcagcguugcucucuguagccgucuguggucuguuuacauggcucuuuaaacaagaguggaugugcucacagaugacuuucaggggccuuauuagcaucucagccauggagggccuacauuucauuuuaauuaaaagaacaaagcagaaguggaugggagaaaggccauaaaauagaagggaaaggaacccuuuaguagcugacagaagccucuggcugggagagugaucagucugagucuuugaaaaugggaaggcagccuuuuaacaucuuuaauggaaauguuacaaauggcaacccaccacaacucccccaauaaacagagaguaccaccaauaaauaaauaaauaagugcaaaauccaaaaacucaacaccccugccugaguuccucuugcaccuaugugaggaagacaccaaagagccuguuugucaagccauggcugcaaagugauggguucuuuaaauauuuauuuuauguuuauuuauaugcaugcgaauaucucaggguggguauaucuauguguguggaggcccuuggaggccuggggugaacauggaauguugggaaccaaacaugggugcugagaacuaaacucgggccucaacuuaucccagcccacagccccagcagcaggcucucucaucucuccagccccuuaagugcugaaauugaauccuuuaguccagccuguccuuuuuaaccaagaaacacacuugauuaguguuacaaaaacaacuuaaguaauaaagggcuuauuuugacuuagaguuuccauggaauuaaucugggaugcugugguggcaggggcaggaagcuagaugaagcgcuuccuguacuuaggaaguggaguggggugaagaaacaggagagcggacaggaaguggggcccagcuaucagccuccgagucugcacccaguggcuuagcucacuucuuccagcaagacuccaccuccuaaagguuccauaaccuucccaaacugugccagccacggggaccagauguucacaugcaugagccugugugagcauccaguguuggcacuaccacagauacugaaugaaaauaucuguauucacuuuaucucaaauugugaaacugaagauguacacguaaaaugggacuauuuuauuaucuauuuauaauuuuuauuuacuuauguauuuuuuuuuugagacaggagcucacuacauaggccuggcugaccuaaacuugcaguguauaccagacuggccucaaauguggggcaauuguccagccucugccuccugaaugcuaggauuucaaauauuuuaaaaguuaauuaaugacaauuucaaauaaguuugaaaauuagaaaaaaaaauuauagauaucuccagccuaaaacuguauguguguguguguuggauuuuagagccaauaggugcucuucuguucaccagaacgaagaacuuucuagagguggccaaagggcaaucuaaaggcaggugaaugauagcuguccucugaugggaauuauuccugugguagcagccccuuccugauguccuuuccugguggagggcaguggacuugguacagaagagaagaaaggagguguacccccauucucuacagcagggcuucugaaagccacccuuugugugugcuggggcugggcccgugucggacagggcacaaucaggccauuguuucuuugaggaaagcaauggcauccuguugcaauuauuuauggaagaaaauauuugauguuuuuggaggagguuggauguggagggggugaggaagagaaggagggacuuagccagucccacccccuuuagacaucuuggaggaugggacagggccuccaucgagccaccauucuuaaaggcucuacccugucuacuaaacagugcguuaggaggucaugcugggccugggcuccugggguugaagcuggaugucccagugccagcacauguauuccuccagaaggaggaggaguccugcccugcuuucccaccacacacaucauggucugccuuuucaggccacccaagccugauuucucaggcuugccugcuuucucucuuuuccucuuucuuagaagcugccuccuuucuggggugugccuccuuucuggggugccccugacuuauaagccuugcccuuguuggccucaagcaaccagcuagcucucuuugggauucucucagaaauucccaccguuaaccucaaaagcuguuaagcacccgucacguaguaggucucagcauugcaagguuccuguuccauuaucuguauguccugcacaggcucguggccccucauucggccaucuguaucuggacuucccuuugcaaacagccagucauucaaaagcaccugccuggggccaguguagagaaauaacggacaguaauacugacugacgacugcuguuccucaccaguucagagagaccuuccuugcuuuuugccugaauuucccauggcuaacuccagucacucuuaguccccaugccaccuccuuagugaggcaucugugacugcucggcuguacacagcacaaacccacgugccucauaguccuuuacugcuugcuuuuguuuccucuguucagaguugaccucguaaaacuaacuggagcauacccuuaccugcucuguggcuagauaguuaacauuggggaguuccuuggugcuucaucauaucagggugaugcccccauaccuguacuuuaccguaaccuugaaccuuugcugcucccuaaagugaaagaauauaaggaaguacucauucuagauguuacauguaaugauucccuccugcccuggaugggcucuugggaaacuaagguaggcauaaguaugguagcucucuuuggagaagcggcagagggaacugggucauggggcaaagcauguucacagacccccuaccuuuccuuguuuugaguuuaagagauauaagccacacagauuaucuuauccugauucgacaaggggcaagacugagagguuucugcacugggucaaggagaccaguaagcaaagaggguaggcagcuugguuaaugccaaccauggggcuguccucaaaauccaggaaggauggaguaacacagucccuccuggggaggguggcauuuugacuagggguuauuaggggucagcuaauggcaguucagaagagggagggcaagggcugugguguaaguggacugauggccagugaacuggaacuuggcaagguagcaagguugaauguauuaguccaagcuuucacaacaaaguaccacagccuggguggcuuaagcugcugacguuucuuuucucaaaguccuagaacuaugaggccaagaucagaguuccagcaaggucaaauuccagugagguccuuuuucuguguggauggccaucuucucacagcagaguggaugggagagcaagcuucacagcagaguggaugagagagcaagcuuccgugugucuuucaugaaggcaccaaccauuacaaggcucaguuccuccuuacgggcucacuuaaccuucaguuacuaccguagagucugucucuagcagagucaccugagggcuuagggcucugacguaggaauuuggugggaugagaauguaggagcuggccgggggccaguggaguaggcaagggccuacaggccaugacacaagacaaagcacucuagugggucacacucuguauuucugcugauaacuuuaguuguuuucaucgagcagagcaauuaagagugaaaaaucagggaaaacaguuaggaaguuguuuugagaagguuuuuuuggagagauucuacuggcuuggaauagagcucaguuucucaaugccauugacauuuugagcuggacagucuuugaugauaggagcugcugugugcauuauagaaugucuaucaauaucccuggccucuuccugcuagauacuggugguacaucuaccccuugucuaugcaucuuccugcuagauacuggugguacaucuaccccuugucuacgcagacacaauugaaaaauguaucuagacauggcuggaugcagguagugccgggacagaagaguuccuuguugagaacugcacccaucaguuacaguaacuaagaguagauagauucaggaauauuuagggacuugugaaaucuugcagguggggcaaagagggauaaaggaugauucaggcauuuggcuuagaugaaacgagaagugaaguugcccguucccgagcuggcaggaggaagggaguagguuuguuugggaggugugugguggggauggcagauggagcuagaacucugccuugcaucucguuaagucggagaugccucuuugccacucagaggagagcuaagagggacgggggauauagauguauggaauacaggggaugagccaggaguagaggaaagcaugugggacugucugucugaagcauccuucuugggaugagaucacuuugguguuguauucucaggagcccuuggcaccaguaaagccuacagaccauaaucugccaugacuguguuggaaggucaucaagacauuguuuuggggcgaaggggagugauugggccauaaagauugaacccuccugagaaugcuuaguacccuuguaagagagacacagagaauugcccgauaaccuucuaacaaguaaaaucaguccuuuugugcaccaggaaaaugggacuggaacaagacagagacuaccugguugguugguugguugguugguugguugguugguugguugauugguugguuaguugguugguugauggauuugguuacagcaaccaaaauaggugaagacaaaucugaugaauuuuuauuuauauggaauauauccauugauauuuggcccuuaagaaguuaaaacuuuuaaagacuucuucauuuagaagcaaucauagauaugaugugugucauauuuuguuggggaaaaucucuacacgccuggugggagagcaguguggugcuauuuuauuuuugaaaaaaaaaauugcuuucauauuuggcuugcuuggagggcgacuggguguacaucauccacccguacauagccucugacuucuagacaauuucugugugccaucaagagaccacgaaaguuaagaccuaauccuggaacuagaaagguugcugggcuugcuguucuaccaugagggccagaguugugucccagcacccaaguaaggaagcccuugacugccuguagcuccaguuccaagggauaauggaaacaugcggcucguggauguccucuuuuugaaacaacacaauuuaaacagucauuuuagaggagacacuugugaaggccauucugcauugcuuguguuaaaggaacuaugauggguauaaaccaacuuccuccuggcgaugaggaucaucgccuugaaaguagcuucacaacaaggccuggugcucccagauuuucuauccgaguuuauugagcgcccucuuaaaguuaaaaaccauacacuugcugaccuguagugccgguaugaauugggacuuagacuuaaacaccuacaaauucgaagcuuggguaucggcuucuuacacuuguagaccguuuacaacuauaaauugaauacgucuacaugcuaaaugcauguaaaacaguugaaacugaaauauuacuuuaauggcaugagugaugguuggccaaucccaagucacuguuccaaauauaaacugaccuccaagcgaugaguaucuuugagugauggucucugccuucugcauuucaauggguuuuuucccccuuuuaaguaucacagaccuucaguuugaagaguggcaagaucugauuuggacucuacuugaccguuaacauguuuauaugcuuagcguguucccuuucuccucuucccggugcaaaucaggguacaauguuuucuuuccaguguaucuuguucuccaacugcugaugcuaacgucaccuguaagcauucguggaugagaacgcugaggagauacaugcaugagaggauacacaaacagaccacucuuaagaugugcaacauaaagauuagggaggauggcacaggagcaccuccacaggcaagcagugcugugcugugucaguggcuugggaaucacucuucccaauuccugugggguuuuuuuuucccuaacucuaauuuaaucuuuagaccauacacaagaacuacaccugugucacucccagcccuuucucugccccccacuuccaguugcucccaugagcaaacuccaaccucccaaacucaugaccucuuauuuuuaauuauuauccuagcaugugcauguacacacgcauacauaacccacugaguccacgcagcauugccaucuagacaagcgcccagagcugaccacuugagauugggcagccuuugugggagccaguccccggaggacucuucuuuccagcagcccuuacguaccaguagcccccaccuagcgccuaggaucuuguggccucuguuuacuuugucucuagcccugucccucacacuccuggaggucuuacuuguuuguguuugcugccucugucaucuccagcccuguaucagcugcucucgaucgacuguguuucgggaauauaaauauuuauucuugggcaaaguguauacaagucgaugcuaaguagucugugaauuggaugagugauacgcagucacaaaggcauagucacugcuagucacugcagcugcugcuuugcuccgagguggaguuggaacuucuucuggagacaggagaggaaggaaaacuggcuugcuagguacucggaugaggaagaggucggaugugugcucugaagugcucuccaggucuucgugugcaguuuggcuucucuugcacugaugaugauacuaagguggauagccuugguuagcaaugcaaauagaacuguuagggggggggggcucuaagccauuagcugacaucugagaggaccaagauugcuugauuugacaccuguagagagcuuuaguuauagauacucggccuacagagccaagacaugacucgugaaagagcgguagggaacggucaugugugcauuuacacgggcucacaugcgugugggucuguauuccagcuccaggcaacccagucuccuccacaagcgauuauaccguggaggguuuaugaagugcugaaacauaugcagaguaugcugccaauaggagcugcuuuauaaaugauaaauaauaguugacuuggcagaacacaucaguugagauuacaagaaaauagaugguaggucuccaggaaacuuucccugccugugcagggucugucugucguacagcccuugagccacccugauaguuaccuagugaacgcuccuugggcagagccugcuguguguuugcaagguguguagcccuggcccugccucacaggccugggcagaguucugagucuauacacuguuucguguugccucuggcaagaaccaaugaguguaggguuggagucaugggcacacuuuaggcuugaguuggcuuugugugcuugguuaaugccacugcauuucuacagaauaaaguucaaccauaaaaguuuccugucaagagccaaguaaggaugagagagcuuaaacaugcauuucaacccacugauacuagaaacuggugugcuuugugccuggaagcaacagggucucuaaccaguuggugugaaaaguccauuuucaucugucuacucgcccauccagucauucucucccaugaggaagccuuuuuccuuuguguugaggaaauggccccguuccuaacauguuugccaugcuagguggaggauccgaguucagaccaugagcggccauguucuuagaggcucagcaugauugcguguaaucuuaguacagaggagggcagaaacgggcugauccauggagcucgcuggccacuuggugaucucuagguugagcugcaaaauugagagacaggcacaguagaagagcuggauacagacccacaggugccaugaaugugugcacauaucaacaggcgaacacacaugacacuguaaugcuuuuuugaaguuaguuuauucucugguaacuuauugugugaagaugaaaaaaaucagaauaauugacuuucaccaucagaaaggggguuacuguagguucuagaggucacguugcuuaaugcagaaauaguaguuaggugacaugaauuaagacuaauugcucgaggaaagaagagugcgcuugacuaaauuagaaauguuuucugcauuuuuuuuuuuuuuuuuggaaguacaagugcuuuaaaugagguuccagcguaagcucgcaugcgguuuccauuuuauaguuuucuuacccaauugaaaacaaacucucagggauuuuauugaacuuggucaguugggaccuacccaaggccgaaccgccaccuucuacuggguucccaaucucccucucccgcugcgagggaagcagcacacccgggcgcuguugacagagcccuuuaugucaccaguucccggcuuacaaacuaggcuaggagacacaaaagacacuuggcacuucaugacuaccuaagacuggcuucuuucucuucuaaagugacuuggccaggauuggccucaagucccccgaaaaaggaggagacugaaaugcaaacagaguugaauaauaaagugaugucauugugaaccaauuggaacaguuggugucacgugccuggcagccacuucaaaugcccacagaauaaggguaauggcuuaagucauguuucuucccucacccuaagccugagcaguccaggggaccagaugcagaaugcagaauagccucuauagccagcuuaguugugcuuggaggaugcaucuuaacaaguugguugguuuuuguaaauuauuaugacaaauucaaaacuuauuuucugguucugcccuaccaauacagccaaaaucauuucuaacucacugaaaagcggaaguagacuccaguuucccuuugaagucgcagucuacaaagcuggcccguggcacauuuccaggugugucaggcggugcuuuucagcuaacauuacauucacugggcuucacaaccaggacgucuuggauucguuauuacaaagauugcugcguggccaccacacgcuuguuuaugauccaguaguuaaaaucuuuccagaaaauguuuuuuucucucuggaccacccugcuugaaauaacaagacaaccaccguacaaaacaaacucaguuaccuacuauuuucaagcauauugugggguagaggccgaggagaauggaggaagugggggagggcagaugagagcagacuggaaguguuugcuucuagagucagacuugucaaucucuuuaucagucucucauuugugagugauguaguucaaacaauacuaaaacaagcaucaguugucuccuuuuaaaagcaaaacaacaacaaaauauuucuugcauaaccagcuuugggagccaggguagguaaccugagaguauugagugauuuuuuuuuuuucugggcugacugcagcccauuuaggaguaguccguauugauagagcugccagcucuccucagguagaagagagccacugccuuugugcccacccuccuagcuucucugccuccuucccggugaauaucaaguggcuaguguaacuaggcccccucagaaggaauucuccccccugacaucucuggucuucugcaagggcccuuuguguuagucacuuggucagcacagaagccucugccuuaaugcagcccucugcuuggucuccuccauuacaaccugucuuucugucuaucccccgcuuccugcucuagaucacggcuugguuguuguguccgccccgcuaaguuaugauucucaccuguuggcuguaauucacaauggcucccuagugucuguaaugugaugucuuaacuguagguuauccccaccggauaccuaagcuugucugcggcugcuccacggaaguguagaccuuggacuggguuucugauccuucugccaagaugcucaauccuugucucccacucucaugccuucuugcaccugaaagaaauuccuucgcgugauuuccccccuugacugucacuccccagcuaagagcuggguuuuuuuuuuuucucccuaaguacucgguugugguugucugcauucucucuacuaaaacuugaucuuguacuguauuguuuuguucuuucauuucacaaacuugucauagccgaggggauuccaaauugauauaguaugccaguccacucugugucucugaggcuggagcaaauccuguuguugauuguguggccucaauggcccugcaccuuguuucccaccgccuuuccaaugagaugauggucuugauuucucaagaacaccauagaggcucuguguuugcggugucugccaggacagucauuguccuuaaacuagcugauggugacagaaguacagucagcacccugaaaucaauguggucccaauccuaccccaagucuugaaaacuaaauacuacaggagguuaggaaauacuugcugagccuaauaccugugugaaauauauagauauaacccaaauauuuuagaacaugaaaauauuguuguggcuuacucagggguuguugcuaaacucggacaagagggaaugauacaaugugugagcugcguucuuccugggagccugugugugcccuguccguguugcaaguuaaauuaaagauuuugaaaagcaauguaaaaaugauuuaccgcuccguaauugguuuccugaaagccaaaugauauuuaugugaacaaccaugaaagaugcagcuacuguaauuuaucgugcuagaguauuuucaaaauguauggaaugacuaaagcguaaguguauuaaauauucuagaggaagacauauuuaggccauaaaucuaggcuccccuuggaauuuguauuccuucuucugugccagguagaugaagauuuuuaaguuuuuaggccuccgugggaggaagauuuaggguuuggggaguacauuuguaucuccuuuaaauuucuauuguuuaucaguggcauguauaaauguuuuagggaaguguugacugcaacauuacccacuuuagcucugcccaauugucuggcaacuaugggguaaagauggaaggaagugcuguauuuuccugugacagguguaucucagaagugcucaggcaccugggcaggcaauaaaauauuaaggguuguucccagagcaguuugcccugcuugaugugugaacauauaugggguuuauaauuggccuggccauaugguugccuaggauuagacucuucauaucccacuaaacccucuucuuagaagcaagaacauggagagaauuuauuuuaaaauguaauugcuguguuacugagauuugaauuugaguacucagaauaaacugcauuucuguuuagaggcugguugcgcgaaaauuuucagucauaaccacuccccaucagagaaggaauaauaagugcaacagcagagguccaugucauuucgagaguuguggugaggaguugauucagggcaaauagcucaugggaaacaugcagaaagcuuggagucacuggucggaucugaaugcauucagacgggagucacguguauauacuuuggcgauuccuucaguucugauguuuuuguucuguuuagaugauguuugguucucagugaaccagagaggauaugggagagagaagagagccgagaguccucagugucauucuauugcuuacaagcaggaaucuaggcagcccucagacuugguaauucaggguauuuggagauagugugaauuagcuuuaaaaggccacuuaacacagauggaagagucauucuuacuuagcugauuuaacauggccacuaaaagugcuaggagcgaucagagaagcauuucuuaccacggguucugcaugcaguucagaguuaaaaggugcagagaaaugcuuucuggaucccccaugccaccugcugaaaucugauugggcagucagauguggacgguucccuguuggaagcaacggugaggauacaggauggagcugauaugggaaagcagggcucucugaaaugcccacuggaagaccagcccaguguauccuaaggagugaguuccuccuugcuauggacaugacaguuaacuuugacugcguuuuaagaucucucaaaauacugggguuauauugaaccuuuguagcucuaccuugggaugcacguuugagagcaguucuuuggugucauuuaguucaccuguagccagaaauguacuaggagaugcagagagcccucugcccacuugacauguuaacacuggcccugccccuguaacggucagcuagguggagcagaugcugggugcauacagaagggagacaaagagauuucauuugugaaucugaccuccuguguuucucagguuuguaguagaguggcuuuugaaaaucguggagaauaauaggggagaugaaaugggcucagaaagauugaggcuucuucaccucuccucucacgugcccauaagcuucaugguggccacucuugucaggcaaucucuguaccccaaacauuuugcaaagaaauuaauguucuguaaagaaaaaaacaaaaaugaauaauacccacuguuuaaaggaaaucuuaggcaaagguuuuucuaauacauauuuacccuaauguguuuuguguguguguguguuagagagagagagaaaaugagugugugugugugugugugugucuauaugaucuggcgguuuuagggugguuuuguuugucuaaaccuaggguaugccuaauauuugcuauuuaguguauuuuguaauuaccucagugccuugaaaagucaacccaguucacuuaaauuccuuugaaccuuuuauaugauuugaugcucuucgaacuaguacuugagaacgacuacuuuuaagcucucagacgcacuuaguuucaguuguuggccuaauugcacaauauuuuuacucauuuagacaagucccuaagggcuuuugggauaguggcccuuguuguaaguccuuccaacuagaaaaacuucauuaauugaaaaauaaucuccaauucacacuagguucaaaaugagucauuuuuaccaagcauggcuuaaagaauuuguuugcaguuuuugugugugaugcuagguacagaaucccagggccccucacacaccagucaagaguguguucccacuccgcuacacuuccuuauccugagaggucggucgguggguuuguuuuguuauuugagugacauuucacggaguggcagaaguguuugcuccuuccuuccucccggcaggcguuucugcauuauccucaucugagcuagcaugcaguugagugacuguagcccuaagcucauugaacugcucagcacuuucccauguuuacaacuguaaaauaauaauaauuauaaugaugcacccccuucuuauuauucagguaucauacaaaugugucguugucaugcuuaaggguuagauaugucugcuacguuguuuguuugagacguguugugauucugcaacgcagccuaucuuggagcucacuuuauagucccugcuggcuucgaacucaagacagcccuccugccuuuccccuuugagugcugggauugcaggcaugagccauccuuccugguucaacuaugugacucuuaaggggaaagaacugcacucguugguccauggaggcaggagaaucgggagcucaaggucauucucagucacacauaaaauacuaggccagccugggcuaccugagaccuugucuccagaaaagaaaaaggggaaaggaaaaaaaagaacuaauguauuuuaaaguuggagaacagccuuagaccugcaguggacugaugucuacuuuucauuuuguaaaauauuuugaacauuucuauuuagcauucauaaugcucuaaauagaagcagaacacuguagcucucagauccugggacaggcaggucaugagggcucugacuguuuggggacagucugugacucuugauguuuuaaauguagcaauuauggccuugaaaaacuguaacucuaauauuggcauuuguuggucaucucagaugaacccaaacugaccauugcuguguuugggugaaaccugaugcuuuugcuuuuuuuucucuguuugcuuuuuucucuaucauaaaaguauuuaauuauaaaaauaagugcuuuucagauuuccaccuucaauauauugacuguggguuucugaugcagcaucagacuggagcagccuguccuuugaggcccaguguuuccauggccuggaaggacccucuccugccgucaguaacuucuguagcuucuuuccuccuagauguucuucccuguccaccagugaccaccacuaccucuuccccuucuccuccuccuccuccuccccccucccccuucuccagauuucagguucccgaagaacgagggagccagaacucaucaucuucauggcuugccuuaccagguauagccauaaguccauuugguaccugcuguccacugaacuugaccugguuuugccccaccugugucuccacaagauguaugguuuugggaaauggcccugucaucuuauacuuaagacaaugaauaggguuuucaaagacagcaugcauucugguaucuuucaauguuauguuuauuuauuugguugcucuauguguggacgugccauagcacacguguggagauagagccuggaaugugacuccugaagauugaagucagagcaagcacccuuccucacucagccaucuaacuagcccugcuuucuggucuuuguaguugacacguuguccucaguuccacuaaguuucccauggaguuaauucugccaacucuuuucuacguaaaugcucccuuauuuaaguuccacccucauucucccucaugguugcuauggguuccuaaauccacuuccugugucuaccuccugccuacccagcaucaucucaccugcugggagacagcuccuugcgucaucucugcugugacauaauggagcucgcuguuagccauuuucaaaccccacaucccugacccaccuucuaugagaucugcaccccuugcacuggaaucugccauccacauuuucaucucaauaacauucucucuucucucugcugaaaauagucuucacugccuucuccauguuucuggcucccuuucuucagacucuuaagaaauugcucuugucaaccccacucuggcccuuuagucuuuaacuugaugcacaaguucugugugcccagggaucuuauaaacuucuaaagggcaagacagggauugugucuacacuacugagggacagacaugugucuuaacacauuccugcagcccagcagugaucaugcaugcaggaguugugcugucuuauuccauauggggucugcaguguguucuaggagucaguuacauaauucagugaaugacuuagaagaaagagaggaaaggaaggaaaauuuguaaaacugaccauuucaaguuccucauaggucagguuuuuaaaaugucaggccggacauuuuguuucuacuuuaaaaaaaaaaaacuggagaagcugaagauacuacuaguaugaacguauguugagucaucucagugacuguaaauuaacugcagaucucgauugccuuucuuaagugcauaguugucucuagaaaagcaaaggcaaguuaguuggggugucaauggaggcuuuccacaccuuccuauuuucccuugaaacacaagguuguuauuuaagcuggacuauaggaauuggcuuccuagguuguugaccuacagggucuaccagagggccugauguuauuauguaagccacaauuuagaaggccagguaccuucaaaccuuccuguagguuucguucagaucugguguugaccagaggaaguggggagcuaauagugggauugcgugguacaguggaacacacuaggaagucagccuaccuucccaagugcucuaagcucauuugguuccccucuacuuuacucuuugcaucugccaaacaaagcagcaaacuccauuuccccucuauggaaaauauggcugguugagccauacagugugauagagcuugccuauguugucugucagggcugucauggagcacaaaagguggcucaguguucuguuaacuugacugguucauuggguuccagugguugaguuugguggaugcccuguugugguuucaccucagaaggaguuugcagguugguagcuuccuaagaccuaggaagcugcuaggaugcaguacagcccuucaguacccuggaguucugcagauguagguccagccagugccauacuuacaaugggauucuagcugagcauggugccacacaccuuccauucccagcauuugagaagcagcguuaggaagguugagaaccacugcucuaagcagugccguacgguugacuguuuacgcagcguuugugcgcucucaaguauggcaaaccaucuagcucugauuucuaguaugcaggaagaaaaacuuaaaucauaugcagauuuaccaucuauaauaagaaacuugcucaucucagauuuucaugucugagggagggaucuugaacccaucccccauggauacugagagcugacuauuugucaucugccguuuuauggaaaugacucuucagaugauaaugcauucauaauuucauguggaugacuugacaauguuucuguauuuucaaugucccauugauaaauguagucuaacccccccccaaaaaauuauggagauauuaagaagguaggccccgccccacaccuuucaguuccaaaaguauccucggggcaauuacaagcuguuaggaguaucacacacuaguaacacggcggauacccaagcuuacagcacagaagucauuaaucaugccugcucuugacagggagacuguuuucuagguuuuaaaaaagaaaaucuuaaaagcuuaugcuguuuuguuuguuuguuuuuuuuauuaaggaguaauuuggagccaguaacuuaaccuguuuuucauaaaugugcuagcuagaggcagccaaaaaaaacaaaacaacaaaucucugcuuucagaguuaggguccuuauaugaacuucuguguaggaucaugauaacucuaguaacugccugaguuagucuuucugaguuuaguacagacccugauauaggauuugauuuacauggcccagcccugcucuucugaagucuucuaauuaaaaccugucaccauacuuacuguucaaccuguccccaagaaacaaaccauuuguuuccuuugcauaucaugguuuuguguuugagucgugcguuuagagcucgagacuuugccuuugaaaagaguguauauagccucaacuccuaucuuuguauccccacuaucacuacaaucccuggcacacaguaggaccucagaaauauuuaugguagaaauauccagaggaaucacucuggcugcucuugacaguuaucaccugugucuaaggcgaaaugcucuuaggaaaauggaagccaucaaacacuucagcuucaauaaugugcuuuuuccuguuuaugagaguuuucucaucaaagaaucauguuccagcuaaaacaaaacaacucuugucuuuacgcuuacuucagcuuuauuuucucuuacucagcauuuuaacuccaccagaauugauauaucgguucaauaagacuugagccgucuggggaccaauuguguaggaaagacauggaacucuuuagguuaccagaaaucccaggaguuagagucucuuucuccauuguggauucaugugacugcucaaagagaggaggccucaccaaaugaaccauuuaccuaagggcccuuugcccuuuaaacugaaaggguuuuaguuggagaugguauuuggggcaccccauaagguagcugguauaaaccuagcaguuaagaaggagucaaccucuacuucugcacacaugcauuuacuugggcucaaucugcuaaugaugguuuggguugagaauuugguucagagguuagaggucaugaccgucuagauacccagauacuugccuguguuuaugagggacaggauugaucuguucaccagguuuauauugaucuaaaaaucacauccuguguuacaauaacugcagacauuuuagauggccaggaggagagaccacgccgcacacugacugagcugccagggaagagcagcguaguaacugguaggcugauagggcaggacccgacaaguagccagccuuccccacucuggagacuauacacaccccaugcaccccaguucugacuuggagcuauuauucuaccgagcccauuggaacauuuuccaaguaguuuuucaguuuggcaauaagauagguaggaacccauccauagcugauacaagcaaagugugaguacacaucuuuuuuucauuacugcacuuucuacagaaggcuuggaggauggggaaagggaugauuuuaaggaacaauuuucucuuuaaugauuucuuucuccguacaaaggaaaaggacugaagguguagggucagugaaagccaggcaaacacaagaaguucacguaaguucaguccacagccccguugagagagagagagaaacagagaauaugaauuucuauaccgaggaaggacccaaacaaccaagaguaaauguuuugcaacuuaaggaaguuaaguuuagggaacaggaugaucaaagagccggaacagucgcagucccuguagacgagauguugccguacucuguagacagaagaagucuagagcaagucugagcagcuucagaccuggcugcuuucuggaaagaaagcuguuccacaaaaccucuggaaccagcuccuauagagcaaaggaugacaucauuccuuaggacgcuaaaaguugguuccaacuacaucuucuagagaaccacacagcuguguugucaaggguggugcacaaauggggggagugugugauguggaccuuuguggaagaauaauguguuuauaaauuugaaguuuguucucugucucucucugucuaucugucugucucucucucuuucucucucuaaucuccaaugacauugugacuucacucaucuucugucucaccugaguaacauccgauuccccaaaaguuaugaagacauggagggagcaaaaucggaagagcuguaacacaagccagcucuguaguauaaugacccuacuuaccagggacaaagugacaaagcaaacuaaagaguaagccagccucccaggcucucugcuuccuccucagcuucauuuaaaaaaaaaaaaaaaaaccuuagaaaaaguugaaaacggcacagagaguuccugaaaugucacccagcucuccucauguuaacaucuuacauaaucauaauccaguuaucacaaccaagacacuaacauuggcacaauauucuuagcaggcuuuauuuaaauuccaccaguuuucccacuaacgugcuuucuuucauucccaagucuuuggucguguggaugugucuuaucuguguggucuucucgaggcugugaugggucugcuugucuugcugauuuugcaugguguugucacuuuuaacgagcacucauccuaugaccccauaaccugcucuuaaacuggggucucucgugacauuagguuugugcauuugagugauuaacuccuucaggaaggguauacagugcccucggugugucacugugcccaggguggcaccaguacaucugugauggguggcguuacucuugauuacuuggaugagauguuaugucugagccuucacugucccaugcuuacugaugacuucagagguaagacuuggagcuuaccagccccagcuacuuauugcgaugccccagaggcaguuucguauuucucugguuguuucugaaaggaaggugguacccuugcuuaaguuugaacauucauucacauggcacacuauucuccagauaacuuuguaggagacugaaagugacuuugaaacaauggagaugucuuugucauggugaaagaaugacccuggguaugucuucaucaccuggccuggagacagagugucccccucccccccccccccaguucuaaauuggaucuguccuauuccugagccccuuggagcauuauccaaauaguuuccauagucggcaagucuucugacauggcuuauucauugaucuuacacaaacaucuuagacaguaggggacuguuaaugaauaggugugggauucaccuuuauuggaaagaauuuugauuuugugauuucagccuuuucauuaucugccacuagccauuuauuauaugcugcccagacuuggauuuacuuugccugcagcuuucuguaagugaccauccuugggaaagggugcuuaugagccucucagagagaggguugucagaucagugcgggaagugacauguaucucuuugaggcugcacaagggguacaaguuagagauuagaaacauauggagguuaacccggcugguugggagggauuccuaagcguaucugcagauuucaguuagccgggccccucagacuuuccaguggcuggcuguccugaaacgggagagaagaggcaaguuacacauccugcauggugauaugguuacugauacacucuugaugcauaacuguuagaaggaugagaugaagacagaguccuggucagggaugguggccacuguagcugcauccagaaagaugaaaguugaaaugccuguuuugcauccugcaugaaaauuaacacaugcuacuaagaucccuuugcucugcuucuggcuucacuguugaagaugcuaucuggagugucaguaacuaaaauuauuccaagauucauugggauugggauaacuagggaguagaagcaggagagaugcuuguguuugcuuucuugaauucuucacuuuucuaagagcugggcacaccuucugcgugacagucacaucuccgccccuugcuuuugcccaucagauucccccacccccacuccccaccagcacagugagggcaaagggcguugagaggcagacucaucugagcagaguguucccuucgcuccgcucaucccuguuuguucauggaucccagugcccagagcaucccuguagagccucagaagugggacagaggacaacuuaaauaaguuuccagccaagaagcagcuggcugcaacuucaggggaggugcugggcucccuugucgccgccugaggcggucuccuccugccccuccacucuccucuugugacgacucagcugauccuggaaaaauacaaguauccuccuuagugaccgugggagaagagggacucuuucuugcuggaaaaguuuccgucccugcagucuccacucaacuccaacucucgccaaggccaccgggacuggagcgcucacgaagccaugaacgaacggcauuaucagccaaguuauaguucguuagccuuccaggaagccuuugccuggauugcagugauagccagcacguagggccuugcuguaugcugagcuucccauauacaaacucagucuucacauagauacaguuacacuccagcucuaaccuacuuuagagcuaagugcucccagaugccgguaguaguuguagggggcacgggugcagcagcauugguucugggugccccauuaaugaaacaucuggaaagcuccagcuucauuuauucauuaaagggacuccuugcuaccaaccccggggugcuggauacccaaaguagcuuucaguaggaaccucuacccacccacccugcuucugcagcagagaccuccucuaaagcaacaagaagagugcacacuccccaguccuccgugagaggacugaggcugagguauuugcagguuuuagaguagaugccugugugcucaaauggucuuucauucugcauuucauuuugcaaacaauuuacuccccccuucccugaccuguuccugcugcugcccgucacccagacuuccaaaccacauuauugcaucucgugguuaccuuugacaggucugauucugaaaaccccauuuuucacuaggcuuugagauaguccuugugauuaacuuuuuaccucuguaagucacugccccucguaauuuuaauuacaugguccauuccuuuucuucuucuucuaagauaauuuugcuuuugcaguuggggugggucauugagccuucucuucuugacuggagccauucuaggaggauguaaugaacgaguaucauaacucaugaugugaagaucuuugaggggagaaacuggaaaagaaaaacaaacaaacaaaaacaaacaacaacaacaaaaacccaguauguucuaccugccuuagagcuugcaugcugugguggccaagucagguuuuuauaguaugcuauuccuucagaugucaccuaagccugugguagacugaguaagugagcuaacauuaggauggagugggagcgugggagugaggaugguaccggaggcccugcugugucauuaggucauuugcagugugagagugugagcuaaaaaacagucuuaccgccaugaugagcuuucaguuccauuucuacagggcacggggaaagccauuuccuaugcccccuagagcugugcgccaagacuucgauggugugguggguugcaccuguaguuccaagaguaguuggaacccaacuugauuaauacagcaaguugaagauuagucaggaguacaguuagacccuaccuaagagaggcaguggcaaacaacaguuucacugucuccaccaggguaaguuucccuccccauacccaaccccuggcccccgccccaccuucucccucucuucuucacccccuucuuuuguuuuuguuuguuuguguuguuuuuugaggcagggucucucuauacagccccugcuguccuggaacucacuguguaaagcagacuggccucaaauucacagggacccgccugccucugccucuaccucugcaccuccuggauuuuuguguugguuuguuuuuuacuuuuccugacaggacagucuccagcagcaaguucagcucuggaccacacacgguguuugucuccugcaccuacaccuugucuccuggcuccugguguguucccccuugcugaugucaggaaggagguggaguugcuagucuugacuagagauucugccagcauccaacaauacacugccagcggagugucuucagacuauagaaacaacgugcggaaacaucugcagagugcgcuggagaggcaagccgccuugccaugagcaggaguuggcuugccucucucuaguccugcucccugggcauggccgcugcuuuuucucgacaucuagaggauuccgucccccauugcguggcauuuuuuugucuucaucugcuccuugaaaaguucugaacaggggcuucuaccuugcuagcuuccccagcaaaggugcauuuugucacuuggaaacaagccacuuuuggcauccucucucuagauuaucuccucccuccagcucccuuagaagggguuuuucucuguguuguuuugcuuuuguuucauccaucucuguagagagaaguagaacucuggacuagaauacaugaacaaggauggccucucuggaaaguuccagaacguguuucuucugcucuguuccuugagugacgugguguagaagcgagguaggccucauaccugccaaguccgcacaacccaagcuuggcagcccuccccguauuacccugcugucuuugauaaggaaagggcauccauauuaaagcugguuuuacucccaggggcuaacagaaaagcaaucuauugucccauggagguaaaagcuguacuccucaguagggucauugugccugccuccuguugcuuuggggggacugagggaguguuuauaaaaacaaaccuguaaaguagagacaaaaaggcuuuucccccucagcuuagccuuucaaguuaagguacucacuuugccugacaauaauaaaauggagaguuguaauuagaaaagguuggugcaguugguacgccaacaaucauuauuuaagacuuguuuggccuuuccuuuuuuggucagucaugcaauuauuucuguugaagcacaaaccagaaccaucaguuaaaggcuaaaucagggcucaggaaaugcucacugugcuucggcagagcaagacaaaggcccuuguucucuagguccucucucucucucucucucucucucucucucucucucucucucucucucccucucugucucucucucucucucucucucucucucucucucucucucugugugucugugugugugcgcgugcacacacgcacgcacgcacaucaggacaacuuugucauuaaagucuuucagcauaaaucaggcuuguuuuuauggaagugcagcaggaucuaagcgcucugccuugagccugagcgucuagaguggaaauagagucauaaaggcacuugcaccuuacuucuucgugcaggaugaguauuuguagaaaauguuucagaaugcagucgcagucccacucuguuccuuuagcaacugguaguauccggagcgucgccaauaagacuucaaguuguguuugcaucaucaggcuugguaugggacuuugaaaguugugaguuugagucucuucucucagcacaccggugguggguguucagcuugcuuguugaugcguauguauugugucaguuuuggcuguugaaagugcuccaaaggaggccgggcuguagcuuagcuggcagugaguuguuagagugcuucucuggggugcguggaggcccugggauccaguacaacagaagcgguggaagggacugggucagcuguuaaaagucaucuucggcuacauacggguuagccugggauacaagagaccuugucaaagaaaagguuggagugcuccucuuguuuuuaaccuaagacaccaucugagagucuuacugcuauuuaguuucaugcugaauguuuucauuaaauuuguuaaaaacaaauuugguuauguauauaaguaucuuagaaaauaauuuauauauucaauauaaauggaguggacaagaacuauaaacugcacucuguucuucauacugaggaaaccgcagagauuauaagaauaaauggcacagggcuguuuuucuuuguuuuuguuucuuucuugauuuacauuuugucaguuugugugugugugugugugugugugugugugugugugugugugugggcagaugaccgugaaggcuagcucuccuaaaacuaacucuguagaccaggcuggccucaaacuccaagagaaccucugccucugccuucuaagugcuaggacuaaaggcaugcaccaccaugcccagccuuuuucuuugucuuuuaacugaccuagugaacaagagggaagaaggaaaacaugaccauuaacaacuuccuugacuuccagugggcgcccaagaugaaauucucugcugauccugagaggguuuagagauuuguuguuguuugugguccccagucccgucccgucucccccccccccccaauaaguaaaaaaucuuuuacucaacacuugcuggagaagaaacuccagucugggccuggaguccuguucuugucagugguccgcuuuccccuggggugaagggccccauucugcagccgcugaggcacuaggccugcaggaaugccugcgaaccgaggacucagugcucugcuccucuuuguuuguuuguuuucagagcagauggguuuguuugcuuuucgcuuaaacauuaaucaaaaaucaauuucuggcuauguaaguggcauuagauaauucucauucuggcuacaguaaauaauaucuauuuguucauguuagauaagucuagcuagugguaaaauguaaaauagaauuacaugagauaugacauacagcuauguguuuuauaaauuaaugcuuuuaugcaugugggaggagaagcaauuuaacuuacugacaaaaggaaaagcaagggagauuccaagagaaaggagaggauaccaaaugcaaacaaauugggacgauaaagggaagacgguaauuuaguccaaucuuuccaguaaaucguuacaguaaguuggggaaagaagcauuaggaaggaauauuguaagcccugaacauguuuauauccucucagugcuuuccuagcccuacuguguucaggagggauguagcaugucacauaguugaggguauuaucccuggugcagaugggaugucugcuuguaaauaaacugccagaauucauuguguguguggaaacauaacuaccauuuucaugaagccaaaauagaaguuuacguccugcuaaguauuuguguaucuguacgugugucuauagagagucuuaauuguuacgauuugaaauacacagagaaagcaggaaguuaacuaaaagugccguacguguuucucccuuucguagauuuagaucugcuaauugcaaaaaaaaaaaaaaaaaaaaaaagccuguuuuuaaaucaaucaacgggaacuuuuuauggcuuuucuuaagacucguuuagcuuugaaaaggccaaaaguuuaaugaagcuucuacaugccaaucuccuuuuccuucuccuagagaaugugcuucaacuguaauugcguuugcauuguuuaaaauacuagugauuccacagcaaaccucugagguagcugagacacagaagcaaagccgaaggauccacgugucucggccuggcgccauggcgcccaccguguagcuccagucgguguccugggucuguuccuuucucaguaaguccagaaggauuuggccagccccucaaacuugguaaacucugaagucugcacagucaauguucaauaacacugaggguaagaauaaauauaaagaaguuaaaaaucuagacacuuaagcccagcugguugauguaugucuuuaaucccagcacuccagaugaagaagcaaaaggguccccacgcgucaggggucagccuggucuacauaacuaguucuaggauagccagggcuacguagagagaccaugucucaaaacaaggggaaaaaaguguauuuagacacauauuuaagcggaauuuauaaaauuaaguaguagaaauuuaagucgguguguuuuauuuacaaaacaggcauuucaacuuuuccuaagaauugugcuaugggcuuuauucuuuguugaccccgauacaggaacacaucugucauggcggccuuugaggcccuucuaugcauacagucuggaaaguguucucuuuuccuccccacugccccgcugauauuccugcauuuuucucuaagguuuuguuguccaugagccaucuguuugcaguugguugacaagguuuuguucucccaugucacaagcauugauugcauauguccguuuuccgaaugccauacccagugguccugauagcaaauuacagugguuagugcucagggcuccaacucacaaugccugugaguguuucaaaguagcugcugcuauuacuguuguugucaucaucaucaucuaagcuccuauuucauaguagauauagugaauauuaaaagcacccuaauggacuacaaauuuuuuuuacuacacaauugaguugcagccucacaaaaccaaaaguuggagauaugagccuaaugaaaacucgacauuaguggcagcucccaacugccuucucugcauugucacaagacaucauaugcugcucacacuauuucuacuccaccuuuugcuucucgaaaagaaaugucaauuuuuccaaggagucucuguuaucagccaacagaaagauucuuugacucuguacauuucuuuuuaacccugaaaucaaaauuuacuccucaaaaugcuuuauaacauuuuuuagcuuaggccaguuugcauaaggcaugcauaaaaaaacagaucucuccgugugcugacagugcguuuguacuuugggguuuugaacuccuaaggucuuccuuaauucccccaugcuucagcuagcugcuucuccaguaguuacuaaagggaucauuggauacacuaauguuuuucugaguaguggccagggugcagguacaagagugacucuccuaaauugagaaguaauaaauggauucagagagaaaucgggguuaggcauaauuguucuuuacugcccugucuuucagugcaaccgcauuggggagaaucuuaucuucccauagcuccugagaacuugagugacuccugccaguucuuuagcaaugcuucgaggaauggcccagucucugauucuguaaacugggcuucucagagguuucuguguggaacaggagagcauucgguacuuagggauucaguucggggaacagcagaggcuaacuaguggaagauggugguguugggagcuuucuaaccaagauucugcaagcacagggacuguggccaugcuugucaucaucagagcaaagguguuuacucgaggagcuccuugaggacagauaugugugacuguguuguuguuacuagccaggcacuucccuaugccgacuaugaccucagcccaagaggucauagguuaagaggucuggaaugagaccaaggcugggcagcucugcucugauauuuaugcugggaccucuugguuuguaagaugauauuuuaguuacguuugucuguugagacaugguugcacuauuuauuccaagcuagucugaaguuaagacccuucuuccaugagcccucuuguucugggauuauugacaccaccacauacagcugguuguuuaauguucauaaagggacauaccuuuaaacacacagcucugaaacaggaaacuugguuuuaucucauaaaacguucagcagaacaucauggcuaucacguguaugaaugagcucaucagacaugaaugagcucaucuguauguccagcucugugggguuucucugguauagauagaugcauagcugcuauaguagccuagcugagauacuuuccuaaggcaugcacuaaggcacgcaguuagcuuuccaccucacccacacugccccaagcccucagucuuguucucccaacacuuuccacucuuggguuagaagcuccccauauccagucuugccucuaccagcuagugcuaugcccuacaucugaauugcuuacguuguaaaugucaagucaaaauuuauugguuugaauugaguugauuagaaccuugguauuuuagcccaaaaguugaggauacccaagauacaauucauaggccacaugaagcucaagaagaaggaagaccaaaguaugagugcuuugguccuucuuaguaagugguacaaaguacucaccgggacaaauguggagacagaguguggagcagagacugaaagaaaggccauccaaagacugccccaccuggggauccaucccauauacaaucaccaaacccagacacuauuguggaugccaaaaaguacuuucugccagagccugacaaauacagagguggaugcucgcagccaaccauuggacugaacaugugguccccaaugaggguccccaguggaggaguuagaaaaaagacugaaggaacugaagggguuugcaaccccauugaaagaacaaugacaucaagcaaccagaccccccagagcucccaaggacuaaaccaccaauacauggagggacccauggcucaagucacacauagcagaggaugaccugguugggcaucaaugggaggagaggaccuugguccugugaaggcucaauaccccagucuaggggaaugccaggccaccaggcaggagugagugggugggggaacacccucauagaagcagggggaggagggaugggacagaggguuuuugggagagcaggaaaggggacaacauuugaaauguaaauaaagaaaauauccaauaaaaaaaaauaauaaacuucauacuagugaggggaaaagaccuuuggugucguuuauuuauugagaguucuaagagcacagggaacuuggcaaauagcuccaucaauggcaugauugccacacaaauguggggaacugacuucaagucgaagaaucuaucuuaaaaaucacgggcacaguggcacaagcuugaaaucuccguuauguagaaacagagguagacagaccccuggggcuuguggccagccacuuguuugcuucauuggugugcuacagcccagcaagagaaccugucugaaauaggguggagggaggaacagcacccagaguugcccuguggguucacacaugugcauacaugcucagauucuaagggcauggaauuaagcaucuucuggaaauaacauaagccagacuuagucaugugauaacgcuacagugugcaaauaauuugcuauacaacaucauagaagaaaaguuuuucccagagaaaaaugcuuaaaaauuaauaagaaaaauaguacugaacaaaaugcugccaaauauaaauucaaauaaaugauagaaccauaccuuuaaugcgagucuaaccaauguuagcaagaugucaguucuuccuguguuuauaaaguuaauauacuucaaauacuaugugguuucuuuuaauuauacaaacugacucuacagucgucaauaauagcaacaauaauaauggugauaauaguaauagugcuaaacaagcccaacgaaauuaccagauaauuaaagcaucccauggugccuaaguaauuaaugauuaaauagcuagcaaggugccaguaugugaagggacagaauaugauauccagccguagaugugagaacauguggccguucguuguuuaauaagaugacguuuuauaucauuggagcaaauacgcucuuuacuuaacugauguuggaucauggguccauccuuguuagacucuaagugaauucauaauaaagguguaaacaacaacaaacaaacaaaagaaccagaaauguuguaguagaacacaucagaaaguccuuuuuaugaguauucagagcuccucccagccccccaugcuugaaaaucuaaaauguucagucacagauucugaugacagaucuauaggaaaacagccccacuuggcagagggggcuggaagaugguguguguguguguguguguguguguguguguguguguguguguguguguguguguguaauggaauguaauuugccagcauuucugauguaccagugccugugcccuuugacaugguaauucucccaggaugaucacccacagacacaccagcacaccggugaacugacagguguauuaggccacuuuacaugguguugucugaaaugacaaguucuaucaguagagggauaauaaauagguuuacuguuaucucucaaaccugccuccucauuagaaucaucugggacuuuguuucuacuguuucauuucaaggcucacgugauagccucuaaaccaacuaaauccgcuucuggggaaguaacagugauuuaaacacacaggcaagguuggggaccacucaggguuaucuauagagcagaaugcugucugugaagauaagauggcuguuuucuuguuuuaauacuuucauccauauacaaaaugugcuuugauuaccacccauuaucuucuguuugucccuucuuucccuucuguaucauuuccucccucuguacaaagccucccuuuuauuuucauuaaaaaaaaaaaauacacagaugagauaggcuuuggucuggccagcgucacuucagaugauuguccacuccuuaacuucccgccgauaguuugguuuuauccuugacaucugacacagcugugcgugugcaucacauuuccuucaucuuuuccuggucccauugcuuggcugauguggauaguaacguggaugugucgugugcugacuuagcaucacaucuguacaucccgaagugagguaguagcacauuuuuggccauauaggcuuccauaguaucuaaacuacuucauuuuuauuuccaccaacaauguguacaggcacauuucccccugcauccuugccaguguuuguugaugguugucuuaaugugcuccauugugaauggggugagauuugaaucucggugugguuuacauuugcauuucccugguggcuaaggguguugagcauuucucauguauguauuggucuuuugugcuucuuuugaaaacugcccauuugauuaauuugcccauuuauugguuugauuauuuguucuuuugacauuuaaauuuuguucuuuauauauucaguauauuaaucccuugucagaugaaaagcuaacagauugucucuucacugucuccuuugcuguucagcuuuuuaauuugaaauccuauuuguuaguagagaagacauaccguuuguaaacauagacagaucuagaauacauuaagcaacaaagaaaaaaaaauagcccacuuacugaaagccaauugaguguucuguguuauaguuuuuauauauguaauauaugugugguguuauuauuuaugguguuugauagggucuguaaucaccgaaaagucaagcuucaggcaugccugccaagggccguguuaacuuaaagacgggaagaccaagacuuaggcagcaccagccccuguccugggaaccaguucucucugcuucuugacugaggaugcagugugguaaugagcauccugaagcucaggccaucauguuugccucaccgugaugggcuuugagccagaauacagacucccagcuuuacauugcuuuaguuggcuauuuguucccagcuaauauacuguauauuuuguuaguuuugauuuuaaaccgugcauuugccuguaccagaacaaauucuauucacaaacaaguaucuguaaucuuaaggugaaaucugguaccacucuuuaucuacagguuuacucuuuuccaccauuaaaggcuuagaaagauggaggguugaugacagaugucacaugagggcguaagcagagacugagccccagcuguggaaccccacaauucuuagaacacuggauauggcuguauggcggacagacuaaacugugagcaagucagugacuggucagauagaaaaggagaugacaguucagugucaugguggaaaggaaucggggaugugcagaguugauagcauaagagccaggaggagaucucugauugagauggaggggggaguaagaauccaccucagagacagaggccuucagacagaaagcagggggagaccaucacagccacaaacggagcauggcgcugcuucaccccuacagauggcaauggguugguuaugcagauguacaggugauaccacuucugaaauuuugccucuccgcucuuccuuuaccaacaaaccaugcuaguucuaguuuuguagcuaauucuggccagagaaguaagaacggaaagagaccucucugcucuugguacacaguguaguuggugggagguugugaaagguaugccaagagaggaagugauuuuaggcagaguggaaauuugccaaguagagaaaacagaguuguugacccagcagagaaaacacauuaauugcacguguguaaggaaagauuuucagggguaggcauacucaggaugcuagggaagaauccuagaaauauuuggcaaguuugcagcgggcacuuuaguagaagcccaucuccacugaagacccaaaucugaagauaauaccauuccaggccucaggaaguucagggucuuaacguaggaguggagucuaaauacagcauuaaagcccuaucagagacuuagugcuaagaaaacaaauuucagucuucugcaagaagugggguagcugggccagggagaacgguggagaacaguggccucuccugggcaggcagagguaaagucuagaaagcauaaaaaccaacguugaguaaaaugauguguguggucugggcagggaccugggaacagaacaaaguguccagagggagggugccuacaaugaaaguagcuacugguuuggggucugaugccaggcugcaaggaccaaggaaagccuaaauccauguuuuauacagcaaaggugacuuggggugaacauuuacugggguugcuuguggcaggcuccauaggagauagcagaggugagggacuagaauggcaaaggagaaugccagguggccaguuugcacuguuaucuccuauaaaguacccguuaucgauauaucgugauaccgauauaucuugauugugaaaagugacaacguggucucuguauauucaacaagcauugaaguggagagagccggcuuggcuggccuccugguccccuuuuacauugaggaggcuugcucaggauagcgacuugugagcauguuuaugugcggggugagcagagccccccauccuaagagcagaugguuuccuccgccugggguccuguaaggauggugaagcuggagugagggaaugggagauucaagugagacugccagaaauacuaugggcaaggcaaguuaaccgcuuauuucuuaucaaguggucccaacgccgucauguguuguuucuuuuuguguauguucuccaucccagcugcucccaauaggcucagagcuccuaaaacuugcuaucaaaagauguagcugugugucuggugcaccagcaugccauuaauggcguauuguauagugcaacaauuuuagugugugauuuaaagcaacuuucguaaaagacaauuuuaaauuuuuauucgacggugaggaaggggcuucuggacaaaagcgacuaaaucgguuaucauuccauuggagacuucgucagccauacaagaagugaaaaugauggaaacaaaaccuuugagguucugcacaaaacaaaaaaacgauguguggcuuaaagucagcaguucuggcucgggggggggggggggggggcuccaaacgacgccuccaggugcugacuuuuggggccacccccuuccugcccuccccgcuguggcagccaggauuccuuuugucucgggugcuuccccaccccgcccugccagccagagggagcuggcaccgggcgcccuccccaccgccccuggaccaagguuguuuacuacuuucuacucggaauaacacgccaaucaccagggcccgcccucucucucagccaaucaguuuguugggaaauuccaccuuuccuaagggcccaaccagcgauuggcugcaggacuugucagucaagcuggcaucccgcaaggaugcagcuggaguauuagggacgcgaucaccagagccgaggaggaguaaccuucccauaaacaagauggggggccccccaagaaagcacggauugggguggggagcugaagcucagcccaaccccggggccccaccggagugaagagggccgagcgcagagccggggaaucccucccuccgccucccgcccuugcugcaguuguaaacacgcuucccuccaugucuguuuuucuuucucuaaccguggccauuacaggcugcuguuuacaaaaauccugcagggcagugcuguucucuaggauccuguccuccauucaccuugccucaggaccccuuuucaggcuuuuuuuuuuuuuuuuuuuaauuuucuccccgcugcuaggcacaaacugaaggaagcuauugggucgugcaagcuuguuuuccuuuuauugcagcacgcaaagcaagucacgcuguagcagcagcaccauuucccaggagaacaggcuggcuggccauuaagagcaccgcgcagccuaaacaggcguagcucuagaaggacuggcuggguuuuuguuguuguuauuauuauuacuggucugagucaagcuggaugcuauuuugauucugcauuuucuuccaaaauucgucuugaaaucuauccccacuuacagguuugggauuuacaccaccacccggcgcacgccccuuuucauaaaggcaguauuguguugaacuaaauguuuuucuaccuucucugaucugaaucagguuucccauuucuagcagcacaauguaguuguauucugugugguaggggcguaguggacaugaauuauuugcgacaggguugccuggaagauacggaguggaauuugcguggcacggaacaguucccagugcccaagguuucuguuacucuggcuccaagcaggaagcgcaggcaauauggcaaaacacagcacguggcaucccauucaaaaacgcucuuuucuagaagcugguauugcagaggauauccgaucuugacuaguuucaccaccaccaccaccccuuucacaagcagaaagaaaaacuaauguacggaaauuugguguagauauuuaguaggaagcuuuguuaaguguaaaggcaagguuuggaaguucuggcgagaagcugaaggaccuugugggcacgcuuuacaggauuuaagguuguaggaauuguaacccccacaugggaggccacggaccucugggcuccucuagacuuaacacccugcaaaguuacugagcuacagagcccuggaggaucuuaggguugaugcugagggagaaaggaagguugcugcagguaggaauguggguggcccuagcauguucuggccaggauuggauuuccaggaguagcuucuauggcuaccugugugaguuuguggaagacuccagucuuaaguuaugaaagccugguuaggaucucaguggaugguuggucuuuuuuccuacuuacucauuuguuugaucccaagccccaaaccaccccccccccuuuacacacacaagcagcuuuccccaaaaugaccaaguuaguauguaacacgcuaccguuauauacugagcugucgucaggauuugaguggagguggcugugucgcuuguaguaaggggagguuacgaaggccacagcuggggcagaguucugccucagggcuacaaaguuccuggcaucauuaccccaccuuaugaaguuacaaacugggcaagggguugaaggcagaaagagaccguaaugaagaauguugugaugauguguguaccagcuccugucccuuauuagcugccucauccaggccaaguaaguucaccuccguuagccuccuuguccacugccugaaaggaaagccgugaugucuguguauggcugugagggcucaaugaccuuugucaugcagugggcuugguaccagccugggacuccugacaaaugugucuuaccccuucuuuuuuccgugacccuucccucaaaccucccgcuugcucagggcucaucuuuuccuggugauuuguguuaaccguuccucccuggccaagucagccuguuaauuuuuccaugccaacagcuuccgagugccaggaagucacgucugaauagccaaaguauguuuuccuguaggagagugccagcgugccaaguggcacguccucaguugagcaugcagagcugggggggagggggagggguggugagaccuagcuguacuucccgccaugucuucagauaacuuuuugaaucacgagugaagucuugacuuaauccccuggcuuucauaagcagggcagagcaguggccccggccuggcucucaguucuucuugaccugauuucacccugccaccucugccugugucucccaccacaucaguacacacaugguaugugugcguaccacagugcuaccuggcuccuguggugaggaucugaggucucucuccaguuggggaaauggccuccuugaugccauuugcuagagcacuuccucaagcugaccucuccauauucugucccaguaguaccuuuguucuucucaguccugucucugcuuaagggacaguggcguccucuugugauggauccuucugugauuccugugguugacugacuuuucuucccacagaaaguaguaguuuucucugcacucuaggccagagugaaagcugucugucugucucucuucccucucaguagaauucugaugccuggaauucaggccugacccuucuuucuuaaucuggagcaaacaugguaauaccucuuccuuggggaguugugaggauuaacugugcccggcuucaaguuuauaccugacaggcacccaggaagggggaagaguuaucuuuuuaucauccguagauggaaauguuaguggcuguagaggucugccaaaagaauggcugagaauuauguaaaucagggacuugaucacugcucuuugaccauucccuguaaggaucauacgguuuuuauacuuccuauuugguaacccuuugauaaaucggaaaucagccuuuuguauaauacgcuaagcuaaagagcuaguguuucaucagugauuuuuuuuugaaagcuucuggaaacccuaaccugugggaauuggguccaagagggaaguucaagccaccagagggcagagggaguuuuugucuuuacuucugggguuauugguuugaaguucugacuagugaaugaacgaacgaaugaacgagugguacuugauauacaccuccuggucuucucaagcuggucuuuuugcagacacaggcccgacccugaugaagcuugugaagcugcgggauauggccacagaguggauguaugaugggcaggauccaaugauucugacagccacaguuaggugagcuggguugugcugagcucugcccaguucccucacccuggaaggggucuacuggcuggcagcaagccagcaggacuuaggagccuuacucagcacugacgugugggaugcuuacaaaucaugcccuuccuugaaagagauccauucagcuguccuacagccagcuaauagaaucagcauagucuguaaucuuuaccagagcuuuuccauuuauauaccuauaacucuaugugaucuggcaagucaguuucgcccaagccuugguuuccuccucuuuauuguauagacaauauccaggugaaggguaggugaaauaguauauggaaagugaaaagcucugggccauuuaaagacgaacagauagacauuagcucugacuguacagauauguagacaacgcuaaugccauuuggaaggagccauuguugagcauggaagagacugagcugugguauacuaccugaaucagucuucuggguugcucugagauugcauuugaaaguaaagagguugcuauccaauauaaagacuuguauccaggcucuauaaagacguguguccaggcucuagagggauguuggcuguuguuuaacagaauaccauucuucuuuuguuucauucagucauuucccaaacauccaaccaucuguuugguuacaagcauugugcuuauaauaggggggugcagcaucaaagaggggccuuacucucugcucacacagggcugaguguuggaaaggaaauagagaggcacggggauggagacaccugcccucucuacaaucugguacguguguugaccugggaugcucuuucccuguaaaagcagucauuugcccuuucuucuguaaauaucuccuuucucuguacguagggaccccacucaagucggguuguuagggaagaagcauuuuacgguagagaguaaggggccaggccuggggagagaaugcauacccaacuuagcuuuguacaugaaguugcuuagggaaaugcacacaaacacaaaggccugacaauuacguaaccuguguagaguaacacacaccuggcagucccaaagggagccggaagaucaguucaaggccaucuucagagacauggcgaaauugaggccagcaugagcuaugugagagcuggacugagaccacaccccugcucuucugucugaccugcacuguuacucuguagucuugugccucgacagauccccugugucugcccugcgugugguagccgggaguugaguaguugagaaacauuuaggauguggugagcucucuucguugcacuuuuuacuuaaucuuaacuguuucaaguuucagaggccuccuguggccuccuguggccccugagcagcacagaucaagaugcagauuaacaaaauaaucucuaaaggauguggauugggguuuuuuuguuuuguuuuuuagugguuuuuuugguuuggguuuggggaggggguuguuuuuguuuuuuguuuucuguuuguucuuugucuaaaguaauuaguaguuaaagucuguauauaucauuuucccuauccuauuuaagacuaauaaaaaaaaauacauacacuuaaaaauguguauuuuaaaaaugugccguccagccuagagccucugccugcucauacacacuaaggcuguagagugccccuaagaacuggguacugagagugaccugcugugcgugacugacuaacaagggguuaacaggcccagggaagaguuugagagaaagcaacuaggacaagcuccaugguucugccaaauggcuuuugauucauagguauucaaaagcuuuuguggcuaugaaaauaaacuagauuuuaaaacauuuugaaauaaaauugaaacucauuugagcugaaagcguugaguugcuucuuguuuuuuuuuuuuuuuguuuguuugguuuuuuuuuucuuuugguuuauuuguggcucugucccccucagcuuugcuauuucaugagauuuggagaauaaagccuagccggucaguuucaauuuuauuuaaauucauuuugccuucauucucccucauccagcucaguccugugauauauugggaucagagugcucgcaggaaacguugagauauaaaaacauuuucaugaaaacguuuccacuuacacuuaauuuuuucucaauagaaaaaaaacuauuuccagcuuaauccugccucuccccucuugaaaugaauugugugcuuuagaaauaacaucaauccacacaaggacagacucaaccauuuaauggaagguagaaaggcuggagaacacugccuucagaagcacacacucugccuuucuggauggucaacgcgagcgcguuucucaucugggccccgguuuguuccugaacaagacggcaagcgggcauagcacuaagcugaggcccgccacggggaaagccucuugcuccaucuuaagccgucaucccaucuuuaccgucaucgcccgaguuuuauuuuugaacgacuugggagcaucugccaaggcuagcugauguugaaacuuccuuucugcaaguccccuaugacaucuggguccagcuaugugggaagguguuggaacacgccguggauggagccuugcucacucuuuucuugagggaggaaagcaagccaucuccucucagugguggcauuccuccuucccuugacucuuggaagacacuguuuccuacagcaguguucugcucuugagaaguccagucccugagggacagaagccugucuucuaaauaagcuaggggaagccauaaagaaaauaaagaguccuagcaggaauauuggcagucccagcuuuacuguguucucauuccaaguauaaaacccacugacaccagggucccuggaaaaguugacccugaucaccugugggauauugagcccuguuuugagaguacauuuaucauuuaguuuuugcugcagauuuugguaaagucuaccaauguuauuuuccuggugagcaaauagaagucuagaacuaaaacuaaacucugucugucuuucuugugcacagacaccccugccccugguaaaacaggguuuaaacuaagccucaguuuuaaaugugugcacuagaaaaggauauuaguuccccuguaggucuucuccugaagaagaugcuucuaagccuccaugugugauaggaauugagccuggguccucuggaagagcagccagugcucuucacuaucaaaccaucccuccauucccaacuuaaaugugagcuuaaauauugaaaccuuuuuaauuacuuaguccaguuucaguuacagccaaaaauuuagugaagacuguuucagacucaagcuccugacacuauaggagacagguuagugguaagucagucuugagaaagucacuagguagcaggaaccucuccucucaugcccggggaccaauaucccucagugagaaagcgugaccaggugauacacagaccgagggcugagacuucugcucccguuuuccugcacugucccuugcuggagaucuuuccagcaugcauucagaaccgcugcacuuuuuacucuagugaacacugguuauuucuuacccgcucaggaacaucagcgagcauacauaacuuguauuaugcuuaauccagcagugcccuccggcgugagaaggaagcaguucgcucucugcugacaguuucuugcacucacuguguucugacggucuggguuuaucauuuuuaugccuccuuuucuguuuaauagacucaccccaguaagagaagucugucuccaucagcuccucugcagguguuuauuugcuuggagugcuuugaaaagagaugagcauugcuuguuaccacugugugagagagcaagcaagcagcagcucagagcuggcugcuuccugguucccagcuacacccuagaaguauguucuuuugaggguuggguucuggaaagugaacgacaagucugugaguuacccuucacgugagguugguuugcucuccugaccucccucuaccuaccugcuucuuucacagcauggcguuucuggagucauuaagauaaagacacauuuagcugcauuguagccuccagcagaggucaaacccaucuucacaaggaugcaguucucacuacugcgccuauccuggacaaguccucagguccuaauuucaugacuuccugugccuucucucagauaaccaccugaaaaggcuucucccaagcagcucgccguaagcgcuccuaguccuuaccaccagccaccgucaagagcccucuugguccgucucuguccucagauguucccugugaagaacacagccuguuacccucugggcuaccagacaccaugagucuaguguuggacucucugcaaaugaagugcauuauaauuuaggaggcaaccuugcauaauauacuagagucuggcuccuggccugggccaaccugaguaccuguucccuucagccauacccaggcuaucuaauccuacacauguugggcaggccuuugugucucugcugccugucucuaaagggggcucaagccugaaaccccagcuauucagaaggcugugcagaaggguuucuuuuuuuuuaauuuauuuauuucuauauaaguacacuauagcuaucuucagacacuuuuucgucucucuccccagccccguucgcuccaacccaaagauguauuuauuuauuauauguaaguacauguagcugucuucagacaccccagaagagggcaucggaucucauuagggaugguuugugagccauuucaacucaggaccugugggagagcagucagugcucuuauccgcugagccaucucuccaauccugcagaaggauuucuugagcucgggaguuagagaugagcacuggugaugaaguaagacaccagcucaacagagaacaaacuugugucauaccauugauucagaggacuuagcauagcucucggagccagccaagaaccuggaccagcuguauccacuccuuucugucucauuaccuggagggggcaccucgacuccaaagagacagugcaucccuuugcgguggaguacuccucuguugugcuauacacgccuuaacacucagcaucaccgaaguaaaaaugguagccuucuuacauucaccuggggccuuaguuuguucuucuuugccagugaauauaguuacauuuaaggcuacucccagaaugaagaaucucagguuguucuagucaaagcuugacaaggucuuuuuacugcccucacuaccaccacauagugauagaugaggaaacuaaggcuugugauacugggagcugucugcuuacacauuagucucccucucccccuuggaaagagugggaucaaucucauguuaaacuuuccaagcucagaggaugcuaucugugacagaagacagaacaaugucugcucccauaaacaaggacuccaaaggacccaaaaaggguguguguguguguguuuaguuuguauggauguuuugccuggguguguaucuguguaccacuugcgugcuugcagccuaggaaaagggcaugggacaugcgggacaagugcgacagaugguuauauucucguugagcaucucguuaacggcuuucucuucaugaacacucaguguacccuccacuuccguugcacuggaggguaacaugagauagauggggaauugugagaacguaaacgcccccacaccauccccauuggugaccagcucugccagccugaagaccuuccaaagaagcauauccuugaugugucccuacgcaaaguagagauuucucuccucccgaaggaagaguguugccuuauugucaaacugucggggacauuguguuccauaugucacuaaguugcuuuuauuuaccuuaggaacuuaaaaaaaaaacacuuuguuuuauaugaaauauuucugcuucaguuuugcacacgugggggugggaggugucugacaucuucuaauuagcaucuuacaaaaccccgaugaagcuguccgaaccaugaagguagcaccugcacuguacugccaccaucugccccuucuucccagugcccuuugaccucucuugugccauuugugguuccugauccaggagcggugcccacccagcucugauuccuguccuccuugauuucuccgauuccgggacacuuuucccacacuucaguagcucgauccagguacuucaugggaggucauuccuugcagccccacacacagccuccugugcucuuuccugcugugaagagucaguacgucagccugccagggcaccugaugccccaugcuuagguaauugugacacuugguuaaugcugucucugcaagguccucucgucacuuaacaucuuuauuuuuaucucuaauuaagaaguacuuugagacagaucucgggacucucuaaacacacuguucauuauuucuuccccuccucauucaacacccauugcuguggcauuggccaaauggugauuuccuauuuuuguuuuguuuuguuuuuguacuugguaauugacguucuccugcuaggacuuuguguauccuuuuaaaguguagaacacaaaacuuuuaaaauagcagugcuagguccacuuuuaucagggaggacaauuacacgugcuaugaaguagaaaaauacgcagagccagaaaauaucucaaauaugaauguuauuugaaauguuccuacuguuuuucccugcagaggaggcagagggcucagcugccaaaauagccccaguaguuuuggucccagacacagaagucuuacuuccaaggucucagagacaggaugcucagagagaggggcugacaucagagaauauucauuguggguugauugggagggaggacuuaccucaacacaaggcaucugauggaaccuuacuucuucucuccaugcucuucaagcuuuggugaagacuuccugaggcacggcuuccuuuuuguagauacuuuugcuguagaaaacagggugaguggaggaggggcacuaaaggucagcgucaccagauguauugguuuguuccaaaggaaacauucugaaggggaaggauugaaaccaggggauuucacaugccaagcacacacucugucacagugcuacacacacacacacacacacacauauaaaccauaccacauacacacacucacacacacauaaaucacaucacauacacacauaaacuauaccacauacuuucucucucuagcucgcucucucucucucugccuauuuugaaaacauuaaacaacucuccuuaucuuaaagaguuauuaaaaagcgggagcgaauuuuacucuaugcuuuuucuuuaguccuucuuacccagacuucaucugccccuuagaagacugagaauauuuauguucuuccucuguguuuaaucagguuuuaugcauguguuugguagagcuaugaaggcuuacacacuuacuuacucuugagcucccucccagaaaucuguaaggacggugagcuuccugcagcccccguguucccucacugauagugugcuaaccagucacaaaugaaauucuagggaguaugaaauggagcuguuauauuuggauggggggagaaaaaggaauccuaggcauuucagacaucaagcauucagugacaucagcugucagucacacauaccgacuagacgaggaggaaguuugacagugggacucaggauucugauuccauuuaauacacugaguauaacaucgagguauuggcagugagauugugcagaauuugugugucacauccuccguguucuguuguguuugcguuucuuggagaguauuugaaauuuggcagcaaaacagcagagauagguaaaauuucugaguguuauuucuacacccuaaguggaaaucaaugccauuguaugcuuaagaugauugcaggugccaaccugggcuuagagaaugcugugccgcuccugauugggugccagcugggcgguacuagaagugguauguuagguuccaggcauacccacuaccaccucacguggucuccagcaggccugggcucguugcagaggguggcuggauuucuagguuggaaggcaccuuccuugccuugguuggcuuuuaauucuacaguacauugagaaggcuuccaaaguuuguuguuccucucccaccaugcccucuuaauccuaaauuuuuggaagacccucuuuuugcauggccacagcacccaauaggacagggguuccacgccccagucagcaguauuuuauauagaaaaagauccuuccaaccugucucgcuacacauuagcaugucuuaaugaugaucugagguuuggguaggagaccaguaauucuggaacuauaggaaaaguguucccaacugccgugacccugcaacaguauugcccccuuucucuguugcuggaggcagcucauggaagaaagaacuugccuaggucacucagagagcugcugacucucguuagcacaccacacaguuuaaaaugaaaaguugcagagugugcuugcaaaagaggcagacuaacguggaguaaagaauaggcucacauggaauugaggcucaugggugagugcuguacucugguacucgcugugacagggguccaggcuucacaaaagagggggaguggucaagucuuccgaggaagcuuccucuauccccauccccaccucucacacuggacacaagcacccuccuuaacuuaacccugaagccuggggugugcccgauccuaauguuaagucuccagcacacuugaaucuucccagccgcucuguuuucuuuuuuuuuuuuuuuucuuccuucacuaaaacucaauacaaacaguuccguaauggagaucucagacgauagaagcaauuuguugaaaaugaaaaaagaaaagggaaaaaaaaaaagcccugaaagacuaagcuucuuuuuaaaagagccaaacacucuuguuaauacuuugggaaacagaaauguaacuuuggguaaauuaucucagagucauggcgguucggacuuagguggggaagucaucuuuuaggggucuccuugcaugagcaccacauaaucagcauauucauguguacccuggucuagcucagaccuucaggagcugugaagccuuccuguuggggugcucagaagcauaggagugaaaccagaaauugcuaagcaugagaggaagagggucgccauccacucuuggcucccuucuucuggcucuccaccuuguaggcguuaauguuuaaaaaacauucucaucaagcaugguccuuuuuagaauucacaggaucuauggggucagggaguaugagugaaugugaaaaugcucguuuguuuuaacaaacgacagagguuuggggguuuuuucccuccacugccugugcagccuuccacacuguuaggcagucaggaagcccagcccagcaaggccauuaagccauccuuccuuguaauaggaggagcaggaggcagguaccaguggcauggcaccucucacaauggagguugguugguugguugguugguugguuuuuaaauuuaaaugagggauuguagauaguuugaaaucuucuuguaccaggagaaacagaaugaaaaacuagcaucuucuagucaacucaggaaacuguguuguuuuaaacagauuggcuguguuuaguuauauaccuuuuaaacagaguauuacuaaguuaaacuuuuaaggcauuuuaguuaucaguaaagaugauaauuaggcuggagagauggcucagugguuaaaagcacugacugcucuuccagagguccugaguucaauucccagcaaccacaugguggcucacagccauuuguagugggaaucugaugcccccuucuagugugucugaagagugacaguguacucacaugcauaaaauaaauaaauaaagaugauaauugauaguuuucccuugaaaugcauggaucuaaggggcccacccccaccaucacuccagcagauucucaugcauacauggacccugccgggagcaccugcuuuacacaugccuuuccacgccauggucuuggcuggcagugcucuuggcuuccugauacgcaucuuuaugacauaagucugugccuuacucauuaucuaugugcacaucuccuuuccuggucuuuguguggaaggccuugugcacuucugugcucucccuuggcgccuggcaugccuugcaagugaacucgaguaguuaaugaacaaauauuuaauucauagaaacuuucagacgacaagcucuucaacaguguauaugugugugcacauauccauuauuaaauccuguguuuaauguucuucugcuucugugcucuaccaguuuguacgaauuacacuguuugaaguagaaauaauugaguauuuagauguccuaagcgucgccgccagguuugccaccaccuucugguuugcuuacguuguggaucugaaacaaggucuugauguguuuuccccugccagccuuugaacuccucuucccaaguccuccucuuccucagccaucuuaaguucugagacuacagaagagugcuacugugcccagcuuccauuuuuuuuuuaaaggcaaauuguuguccucuuuaucaucgggauggcucagaauaauccuuugcauuuuucaaccauggaaaugggcuucuuguaaugcuuacuggaaaaggcacaucagcugugccuucuagcaagacaugcccauuuagaacuacgucugcugucccugagaucuuccugcuugcuaugagaauauuuccagugacucuggaaccggggcagguccaccacaguguauuggucacaaacuuugagaccucaaggcucagccacuuagaauuccagcuuugccuccugcaggcugugugacucugaccauucaugacauuugcucuguguucuuggcucugguucugaaggugagaaggcugcaggucuuccugccauccuggggucccuguggaaaugaacacaggcagcacaggguaaacuaccaugaagccgcacacagcccaaauggaagaagguaccuuguuacuaauagcaauaggcacacauuguuucuguggccaugccuuugguuuuggcuuuuuuuuuuuuuuggaagauggauggauggauggauggauggauggauggauggauggauggauggauggauggauuuacugaugguugugaaccuucaugugguuguugggaauugaauuuuaggaacucugcuugcucuggcccagagacuuauuuauuauuauacugaguacacuguagcugacuucagaagcaccagaagagggcaucggaucucauuaugggugguuguaagccaccaugugguugcugggauuugaacuuggggcuuucagaaaagcagucagugcucuuacccgcugagccagaccagguuugagggugguuguuguuguuguuguuguuguuuuguuuuucuguuuguucguuauacccugcugccucccugccccacuuccuuccuggaaucuggcuccucugggauuccaagcaaaggcagaaaaaaggcagugcacucugcauccacucucucaggaccucccuggaccagugcauaaaauucaagggcucugauucuggccaguuccugugaguaguucauuaacaccgauccaagucucccuaaaagggaaacgaugacugaccuauccccagaacacuccacccuguacccgugaaacacuagcucuucuuucuugguugcucgguagaccuugaacaaaauaaagcuuucaagucagcugaagaggaagcugugacauaaaauguugggguggcaggaguugucaccaccucaaagacagggaaggcaggcggcaggcaggucacugggacaucugcaggaugucuguggagaacagaaagcggcauaugcugaaugagcagcaggucccaagguccugagucaggacuacacauguacagaaguaggguauauauguguguguuuauguguguuuguguaugcaugaguguguguacaugcauguguguguauaugugagcacguguguguuuguguuuaugugugugaguguguaugugugugugugagccuuugugcauguuuguguuuaugugugugugcgugucuauguauguguuccguuugugugugugcauauguguguguguguauuugccccuucccaugccuaccuccauguagccacacauuaucuguuggcaugccacagcccuuccauaaccuaaauagcaacucacaauuguauaccugcaacuacaggagauucuggcagucuuuguugacaggaugggugaauccaucuuccucgaucugggcuaugagaggggaagugagagaagcugagcaggcugucugugcauuccuggaauacugcccugacugugucgugcagcaagcauaaaaggcuaucucuggccacuggcuauagaugaccuuuuccugugacugaagaucagugaguccuagauaguagugguacaaauggaaggagaacuggauguucuagugaccagccaacaagcuggauacccuccccaucuugaugaucaggaguguguggacaguaccugugcuucuuaagccugcacuugcuccaucuaguccagcccauggauccuggaagaaaugccuuggaccuagaaaacgaauagcaaaugcuuucucagucucccaccaagccuccaacuugugggggccuccagcugcacaugcagcagggaacuaguugcagaaucauuucuaaucucccagguuagcauugucuguuucuuuugaguauuugggguacucaacccaguuuuggguguuaccauuauacaguucucuaacuaccucugucugaaucccguaauuaauauuaaggggcccugcuuccucacuugguuugguugugaguaaugauucaucaccacacaggaaagagcuucuguaucuaugcuaacaccagcguuuauaauguaagcugaagcaaaguugaguaaaguuauguauuggaaggauucuuccucccuuuuuaaaacagagucucauguagcccagucuagucugccuugcauucuucacuauauagccaggaguaacuuugaacuuggagucccccugccacuaucuccagggacugggauuagaggccucuauuaccaugccccauuuaaacggugcugggaauugaacccaggacuucucggauagagauaagcacuacacuaacugagccacagucccagucucucuuuguguuucaaaacagauuuuucgaaacacagaagucuccuuccuugucuuggaauagcuugcuaccuggcagacauguuauuuacguguuuucucuguuuuagcguuccuggggguuggaaccagggcugcaagcaugcuaggcaagcacacugccccugagcuacagcuccuguaccugaugaaguguuaauccccacaugaccucaguggucagccugugucucuguacauuccuagaacugcacaaaaccaaaccaccaucaccauugaaccuucagggaguucugggugagcccaggucuauuguggaucacacagagguuacucuaggacagaagggucugagaagaguacugaaauuaagaaaacggucuuuuaaaguuuauaaaaguuuuauuugaucagaagugagguuuaaguacuucagauuccugcccuuacgggccaguaagaggcuuagcagguaaaggcuagagaaagugacucccacacuuacccucugccuuucacugguauaccauggccugugcacacacacacacacacacacacacacauacucucacacacaccucugcccuucauguguacaccuuggccugugcacacaugcauacacacacacacacacacacgcacacacacacaauuucacauaauuuuuaaaauugaaaacauucuuuaguucucuuuuucuuucuuauucaucuaaccauccuuccaugaaaccagaucugcagcucuucagcacaugaagggaacuaacuagaagcucuucgucacguuccuuuuccaagcgugccguggcggaagguccuaggagccuccucaucucuucuauaccugugcaccaguuaguugcacuguuacauaguuggcaaagccaaggugagaauccaguccagagacuuacguggagacagcagcugauauugacagagcacugccgaugugcaggagacacuugcugucgcugugugccuugcugcguguguucaugggcuaacagugcgggguggugucugucaucugccuccgguggaacucugaggaggcagagucccuuugacuuacagcagcugacagggcuggacugugaacuucucccaagcccguguucuucuguaaccagacagcugcucgguaauauguuucuaacacagagcaugaaccucacucuccccgaaaccaauuuugaaaacuguaggcagagaagacagacagacagacauuccuugggccuuuucaaauguggccacagcggcaugcagaugggccucgucuguucuuaaguuguugcuuuaacugcugccaccauggcuuccgggcugguagguuuugguuuuuuguuuuguuuuguuuuuuaaugauauuuggcaugauuaaugugcagaggaaugcuaccccgugccauugugucccucuucccagaagaugagccuagccauucagggcccaccucagggaauguggauccacagaaugaagcaaucccauucaaagcaaaugaccauguuaccgggcuggcagauuguuuuuguuauugaauaaccugaaacacaucaacagguuccaauuaaauucuuucuguuucuaauuucacugaugauccucucaaauaauauuagugaguuaagggccaacuuaaaacuuaauguuuuauaaauugauuugagcuuuuuuuuuuuuuucaaaaacuguguauauguauaugugggugcgcuugcugccuauguguguaguauauggggugugcuugcugccuguguguguaguauauggggugcgcuugcugccuguguguguaguauauggggugcacuugcugccuauguguguaguauauggggugcgcuuucugccuguauguguaguauauggggugcacuuucugccuguguguguaguauauggggugcacuugcugccugugugugcaugugcacaggugaaggccacaguugacggugggugucgaccaucauccucuagccaucuccaccuugauuaucacuauuaucuuuacuacaacaucucccugaacccagagguugcuauuucaacgagggcgucuagccagggagaucccaggguccuguugccaaguccugugcuuuauuuggcugcuaggaaaccaaacgcaggcccuauguuuguggaacaccaggcacuuuaccuacugagccaucuccccagcccaggaugguguucuugguaccuauccuuguccaaggggaagcaccuauaggacucacaucaaugaaacacaauucauggacucucuuucucgauuaccuaagggauagacugauuuacaggugguuucuucagaaaucccaagcaucuuccaguggggcagaagauaugcaaccaguguacuuccgugcuccccuccacgugggccuugagacuugaacgugagacagaacuagaaaaauaccugaucaagaugauauuuucuuagcauguggcuaacuuaacauaaaauguuuaugcgucguugucucuggcaugggacuuucuguguaggugguggcagaguuccuguggguuucacaaacacuagagccaggagaguugcgauauguacccuccguggccacagcaacaggaaggaguuuccuaacccacaguguagguggaagguggaaguaucagagaggauguuuuuuucccacccccaaacuguuugaaguucccaaguguuccagugggacugcaugagagcggugcucuuaggaguucugaacgcugggcuuuggaggccaugaucucgugccgagaugugcucuggucggaauugcugccuacaauacccuguggguaaaacggauauuucgagcaugacugagcuuauuaagagcccuacagggcuuccucugcugggguuuagaaauuucaaaggguuggggaguggguggagggcaggauuacggacacgcaguguggagagggcaggaggacggaaguaucaggcuugggaugugucauuugugcuguugaauggcaccaggccagcgugccagugugggcugagaaugucaauuuaggaagauacagugcaggagaaaguucaggugcugccaaugcggauagacgggcaccaaggaaaccguaauuaggggacacucauccagccgaucuugcuuguuuacaaggugagagacgagugcaguuagagaaugcacguaguaaaacguuucaggguuggaaauuagaggugcuuaaauugauuucaaaauccccaguauuucuuuaaggaaggugugcgguucguguguucaaagggcuugugauuucaaagaugaagaaaagcugcuuuucuggugucccaaucccuguguucacuccuuggaagcuugaacaagcuccccccaaccccccuccagugagugagcgagcacuacaaccuuccucgcuuagauugcuugaacuucacuuucuccaucugccaagugaagauguccguccucuggguucauaguuccugaguugccuuugcuccagaauccaguagcucuuggggaguuuucucuugcaaaggugcucgcucccaggccccauggagaagcagaacagaggaaugcagcccagacuugugguggccauuccuccucucuccugcguuccuaggccgugggagagaggcccccgugggagaguggagaccaccaaaagccuuccccuuuucacaaagcauugcauaacagaaguugcaugucuggcucccauuacagggaguugagcacagcuucugccuuuaccugggucacugucauugccugcaaaguauguucuguuuguuccauccucuuaacccuuuuucacuucaacgcucgcucugucucuaaaucgggacaaagcacaccuugacauacgcugcagacuaggauacaggcuccacggcuucugcacccugaccucccugccuccuccugcuggaugaggaaacucuggggucugaagaaaggcagcagcuccuuugacaugaaugucaaggaaguugcuacagugcuuauugcccccaccuccaccucacccccgaguggaagagaugacucuggcuuuuucagacccucgcuuucagacugaguccagaauuuggaaaaccuggggauacuuucuuagaagaggaagacucugauaguuugggaguucgcagcauuuaaggcuucucugcuuaaaaguugauuuggaggaauggagagaugguucugcaagugugagaagcugaguucagauccccggcauccguguaaaaacuaaguggccuuaggaaacagaaaaggccugcugguuaccagcuuggccagucaguaagcuccugcuucagugagagccccugcuucacaagaccaggcagagagcaauaguggaaagcauacugcauugcccuuuugucuuccacgugcacuacaugugcacacacacaccugcacauuuaaguugauuuggaaaauaugguccuguaucuuaggcaucgcuguauaggcaccagucccuuuguguagcaacuaaacuucgcguguccuugacauugccaaacuucuguggggucacaggucccguuguaggaggcggagugcaguuuggcccuuucccauuucugaaugcuuccauuuuuauaccacggauaaagugauucuugaacaccauuccaaguuccagacucaucuaugcuuuacgggcuggcacugucugcuuacugggguucagguuuauagagauaguuaaucuaccuguuaauuccuucagcuuccaaugaaaauucccgugaaccguagaaaaccagccuagaggguauuccagaacaugucuggaggugaugaagggagaccugggcuaaagguucaaacgggaaggaagcagaaagcuaccuguaucucccucccucuguaugaccuucccugcucccagccccguggggucaggugacaucacaggacuaugcaggugcccuguacacagugucugaaaggauacccuggguucacccucgucuucagagguccaggaugcuucucauugcuucagucucuuacauccaagggugauaauggauaggucugagcaaucaaggaacacuugaugauuuggacagcaccuuagaguaaaccagauuaucugagaucaggagauaauaguucaaagaccaaauaaaaauuuacagacauacaguuccuaauuaauuggaaaaaacagaaggggccucucucuguuggcaucuucauccgaacuguucagucagcuggcgugcguucuacccacugugccuaggauggcucccagucuggacccaauuuuguaguuguuguuguggugguuuugauuuugguuuuauuuuuguguuuguuuauuuuucucuauguaccucuguccuggaacuugaucuguagacuaggcuggccucaagcucacauagauccaccugccucugccucccaagugcugcaauuguaggugcaugccaccgcugcccaccuaagugcucaacuauuaaucguuuuaaaaaaugguuuuaaaaaagagcguggcaucucgaacuuugaaugccuucagugaacuuuuuaacggugggcaguaccauuuuuaaaaacaaaacgaaaaaaccugguugaaacugagaagugaucauuuccagaauacucggauuccuauuggcacuauggggcaucaacacuugcgaugcguuuuagccaaguugguaccuuuuuccacccccucugcucacaaaauucaagcaaaguacaaugaaagccaacagaagucugugugugcgcacaugcacacucagaaaaagagagagauucuagaaaugguaucucaacaguugcauggucucuuuucuagguacuuuuuaacagugagauaggcugauuaugaauauuccauguauuuaugcuagugauaguauuuuucaggauguacaauuaucagggacaaugcuuuucuacccuccuagauaauuuaaaggucuagcugagcuuuuuuuuuuuuuuuaaugauugcuacuugguaaguaaaaguauguaguaggaugguccugggaauaccuaagucauguuuccagccaaguuacaggagcagagcagcaggaugaaggaaguggugagcagagaggcaggggccucagaggagcaggcugaaggucacuugaccagcuguugauauccgugcuguguuuagaaagugcgugcuucuucaagaacugcgacugauuuaaacgcagcugugcauccuggagguucagucacaucagugauccuguucaggucggggcuauaaugaugucacaguccuccuaguuccuguaaacuucacugugugcauacagugacugaguugccuuagacauguuucucagggauguuuuuagugguaauuuauuucauacauggacauaagagauggcuguaaugaaguuuaagauucuagaaaggaaugaaucuggagacauuaagaggugauauaaacuggaaaagaaaaggcuaugcaguaaaaauaaaccaccuucauaauuagucacaggauugaggugugaggugccuguuaccccuucugaucuuucccaaaaaggaagcguggacuguggacugccuuuuccuccuuuucauggggaguuccuccucuuggagcagcaugaagcgagacaacuacagucaccagagcauuguuuuagagaagauuccaggaguugguuuugauuuuuuucuuccaaacuaugacuaggcagccuuagagcagcuguucuuacaguugaugggagcagcugugaauaggggauucguguccauguacauguagccauccgaauuccauggguagucuaugugcgcguguaucuuucacauuuauuacucucuccaugaaccgucuugcuuuucguaacagaacuuaauccuaggccucaugugcucugcucugaguacuaguugucccaugggugacucuggucagucauuucaguuaucuucacauaaacauuuguguauggagagaggcuuaugcaugaccuguuaaagccuugcacccuuuggugacacaauuccacuaaaaucaaguggaagaggugacaugagcgggcacacagauuuaaggcacugaccugggaauguguguauugaugaauucacaccaucagaacagaucucucagccaucaccaggugugcgauugucccaaaacaggcucaaacacccguuuagagaggugcagucuagccggguggaggugguauaaacacucgguaggcagagaggcaaauggaucucugugaauuugaggcuagccuggucuacagaggaagucccaggacagccaggguuuacaaagcaacucugucuuuaaaauaaauaaauaaaauaaagcaaacaaacaaaaccaacagcaaaagaucugccugagcaaugaugggugcuugagaccuccccucugagccuggccuucacuuggucauugcaaccccucaccccgucucccacugauuugccccuauggaacacaggccugccuuguuaggaaguaaguagcauuucagagcccacacggcuucacauaacucugcguacaguaccagagaauggaaauagggcuggacgcacgcacaagcagagaaguuauaaauagagacuacucucucaauuccgcuucaguuagucauggagcgaccgugugaguuucauaaacuuauaaggaauauacaaacaguuccagauuuaaaauaacuuagaguaauuuuuaagugugugaaggguauuuuuuuuccccauccuguccauuugagcaucugugacaggcagucacaagugaucuuuaugugcucaagccugcugagaacggcugcaggggagucggcccucugcagggacuucuugcuucuuuuccuuuuuucagaacucuugaggacaaagugugugacuuuugugagacagagauucuccauccuugaagcagccaugaagcugcccuccccugcugaccaugccccaucagcuugagggcccugucuguccugacccccaugccagcucucuuuguuuguuuucuccccuguguuaaaaucugccugcaguuuuucaaauuuguauguggguuuuaaaauagguugaaaaucgcguuuucgacuauuuaaaaguacacgggaauuaagacagucugugagaacaauauagugcugguaaaaggacucuaagguugagcugcacccuucgucaccaucuuuuccauugacucucuccugcccuuccuuuucucucuccccaucuuagcagagcuucaguguugcagcuucagccauccauuugucaggcauuucuacagagcucaagcucaugugugugcacuugguuuuccauaaguggcacagguagcuugcugagcagaggggagacacaguccacacuguaggugacaauuccucuacagauuaugcccacugugacagcccugucuaucaaagaauggcccaaguuaguggauagaguuagccaaaaauacagagucugggaugcaaacagacccuucucagcaccuugccuggaccucagcauccaccauccuuugacauccuuaccccuuccgaguuugucaguguuucuagcauuucuacucccaauaccuacgauguuaucacuccacauuaauagaaaggcucgcuuucccacagugagaaucaguacagcccaaagccagaaggacuaguagacaccaugccaagggugaauauugaaagcauuguuuuaaauggaagacaguggcuacaggagaacacccuuuguuugauuccacuaaguaaaaugcuccuggcaggcgauucaguggagaaguggagacgaguaagauuagucauuccccagagcugggggaagcuuugcuauguaugggcuuuuugcuuugggaugaugaaaauauucuaacgucgauuguggcaguauuugcacaacucuacgaagacacugaaaaccaccagacuuucugcuuuuuuaaguguguguguguguguguguguguguguguuuguaaagcugauauuacaaaaugugcaggaagaagaaaggaaacucuuagcccaccgugggcagagcccucucuguucugccggccuuugucauuuauugaaauuuccugcucucccucuuugggucagcugcaccucgguccucacucuuuccacgcagcuuucuaguuauaauguugcuauuuauaacuucccuccgcaggcuucuuuguuaccccuuuugcaguguuuguuuuccuguuuucucaguacucugcccagcacugcuugguucccgaggccucagugaucccacaggcauugucaguaggcgauuguuucuuuugcucauuaaugaaauguucccagaugcuucagcagcugaacucuguggcuuaccuucuguccuggacugugcgaugcuacucgguuauuuucuccgagccuucaaacugugcucucccaaaaggaggacgcacugaacuguuccccaacuuagaaacauuauugggggaggagacuccuaccuacaccacagcauguauguggcagucagaaaacacuugguaggaauugauucugucccuccuccaugugacuuccagggugaggggggugggggucgaacaggccaucagaaggauagcuguuuuaucuacccacugagccaucucaacuggcccugacucagauuuucuuccacgacaaaguuuccaucuuacagaacuguauggcuugcuaaagagaaugccucugugcuguuagaguggguuuacaagcuugggaaggagcagcucuugagugaggcaugaguugugaccuagcaagguuccuggaaggaugcuaugaucaccucucagaguauugucucagggcauuugaaaaccuaagcaugcuuacugcauucagucgacuuauuugguccgagcugacucugaggagccuguagucuuuugggucuuguuggucugguuggucugaugucacagucauuuccuaucagguaagccauguugacugugcaucuuucagaagagaagcuucucuguuagugugcaacuuugcaguggcucuuagagauaccaacaagauccagccuggcggccaggcagggugguccacaucuuuaaucauaacacucugaaaauggaggcagguggaucccuaaguucaaggccagccuggucuguggaucgaguuccaaaacaaccaaggcuauacagagaaacccugucucaugaaaaaaaaaaaaaaucuagucuuuuaaauuuguggcagaaaaauguccaugagacuuccauuggcuacaacucaauagaggacacugaguugauacauauuauuucucuaguaucacuuguaugcacgaggcggggcucuucgguguguauguuacuuuguuuuguccucuagauuuagggauauaccucaagagaguagaaaaggguaguagggcuuuugguuuauuucuuccuuaugguugcaugcuuaaaaagaaaacuagcaugcaagcaacuccccugcagcaugccuuucagacagcagagaggcucagaagccguccacaccacgaugggaagauguguggagaggcugcugucaucuguuggggacucugagugugacacccaacaacggcacagcagccugauccucuugcaugaguucuuuaaucucuccgaugucuccaguuuguccaucucuaagugaaggaugccuacccuuugugauuaucaggaggauuaaauaaugcauauaaguaacacaccuaaagugucaucaggcauaugggaaauaacacugaaaguuaacuccguauuaauaagcagccuuguauuuugccuuugugguauaaauuggauuuauauaagagagacucagacagcuauuguggaaaggcugaccugggagaucucagugauuagaggcucagaaugagccugcagagugugggcauguccuuacuuuugagaucugagucugagcaaguuacccuagccguggcagaccacaucuuucagucucagcauauuccacacugauucaaaugauccugugcuguuagaauaggguugcaagcaugugggagagagcagccuugccccgcaugugccagaccuucauggagcccugaggagugaaugcugccggaaggucaccugggaaaccagauccaaaugagugcugucuccgcauugaggggcaccgccugcaaacagugggcuucccuugggcugcuuggaagacugucuagggguuuugcagauguauuuggaauuaagauggggaccugccugugacucuggccgucugugacuggaccaugcugccugcagagcagcccugcaacuuucaagguguggaaagcaaagggcaaagccaaaggggagcaacaauaugugacuuauagcccuuuauauacuccccaagaaucaagaaacugcccaagugcgggugcacuguucagggcucuucuuaggaagcaagcuaacccagagcaguugaaaauccuuugaaagucaauaaggagaaaaugacuuacagcaucagcugcuggaaaaguuaggagcucucaugacuagcgugccaacaggucaaaaaagcacgcgguccuguccucucucuguccagcuugcugugcuccaggaguguucugcucaggguccgcuuuucucuguggaaguucuccaucuguaacagccuuucuguucaaacagaaacugaaauagcuuuggauucuggcuuaaaaugacgucuccucuggaucugccuaccgccccgccacaaaaggagauugcuuucguuugguucggauugguuugguauggugugguuugguuugguuuuuggcauuaggcagagaauacuuuuaccaaugugauuuuucggccugggcuuuuaagacacuguuugccacgugaaguugccuuugcugugugacagacuaugcaguggcuacagucuuccaggcagacaugcuuagacacuguuuuaaacucuggaugcuugcucaguagugaggcaguagaguucuccuuuugacguugcaaagaccauaaguauguuuuagguccuugucuuccuuuuggagaaagcauucuccuuucuccucauucuuacucugucucugacucucccacccucgaucccucccccuggggggggggggcgggggggagaagcacuauuuaguuugacuuugugaguugagccacagauuuugcuaggauguaacccagugacugacugaguccaagaagcaacacucaccaucuauuccuuaugagguauacuuaucuuaccugaugcugguuaguuuauaaagaaaauacuuuuucauaguucuggagacagagaaguccaaggauguagugucagucucuaaggagggcauuccuauugcauuauggcauggccaaggcaugacuugcugagcuugccugcuugcucugucugucucugucucugucucucucuauauauaagauaaaggcacuacuaccacaaugaugucccacccuagugacaccauacaauccuaauucucucccaaaggccuuaccuccaacauagauuagauuugguuugguuagauuuaguuagucuuaccaccacaccauaaugacaauagucaaauugcaacauguaauuuuuguuucagagguacagugaagucauaguaguaccuuuauaugaggagauuggaguggggaaagguaugugaagagagauaguggagggguacauugaagacuaauaaacugaaagcauugugaugcuuguaagguggacacagcacagacccccagcugggcuuuuucuccuuguucuugccauugguccccugcuccuccucagucaggcacaguuccugccaacagagauacucauucuuugaaaacuggaacuuccauccaaacuaugaggaguccugaguucccuggccuaucuuugccuuuccugaaagguagcaaggcaugggagcaucaugagcauccuccuugcugguuaaccugaggacaaaacagaaggcauggccagccuuggugauacucugcccuugggcuccugguaccaugguugugucuggaaagucuuacaaguacauuaucaggaaaccggggagguggcucagugguuauucacacguguugcucuuacaggggacccagguuagguucccagcgcaaacauaauguuucacaaucaucuguaacuccaguuucccagaaaucugacauccucuucuaaccucuggguaccagacguaaaagugguacauacacacacacauaaaguagaauguauaaaucuuuauaaacaaauacaugugacggcccugaguauuacauguccucuugccuuggaaagggccaaauugaggaggaggaggaggaggaggagcagcaggaggaggagcagcaggaggaggaggagcaggaggaggaggagcaggaggaggaggaggagcaggagcaggaggaggagcaggagcaggagaaacaggaggaggaggaggaaagaaaaagaagaggaggggcaggacggaggaggcuucugcauguuuaaguacugggcaggaugcucccaagauuagccacgagucuauuucaaggcuuauccacacacuccuccauagagugcuugguuggguuaaugaaaugagaaagguuccuuuggagguaggccacuagagccugaagacaggucuuguuggcuuaguuucgaacuggggaagcccauggaaauccuaggugugguguuucaaauaauaugaagauucuugccagagagacuuacggacugauagcaaauggcuuuuuaacucuguucuagaguuuggacuacaguugaauacgauguucggaaccuuacuccccaugggcucugacagucacccagagcaccuguuaccucccccuucccucacuggccucuguguucccaccaguguuuuccacugccuugucuaaugcuuccauccuucucuucugcggucucguuacuucuucuucccacguuggacucggaagcuuuagcuugcucgcuucucggagcuuucgaucaugaaaggauucacugacagaagcaaucacgggcuaaagggaaauuagaaagaacuuacuaaaugcaaggaccaagcugaugugcgaggcuuguuuguccucucuuaaagaaaugaagaggaguuuuaaaacguguggccuccguaugcacgcugacccuggaccuguccuucugauggcugacacaggacauguuguagcuuuucugacuguuucaauaagguuuuguuuuuauugucuucgcugauuaauggcaaggaauagaacggucucaugggcaaaaucaauuugcuuuccuucgugcccuaguucacagcuuccguuuccucuuuuuaagguuggacugcccuuuaaccaugccugugugccccuccucuggaguggcgggggagguccccuccuuuccccccauggugcuguaauuggaaauuugguuacugcacuaaauuuuaaguuuuggcacucauggagagcagccauccaucugcuggcgagacgcacugcccggggcuuuucaagaaaucccuuaauaguccugaacacuaauaauauuuauauacaucgagaugagacaaaauuuacagcaggcuucugaagcuggcuccaggacugucuaaucccagcccugcguucuccugcuuccuccuggaauccucugugcuggagagagagccacaccccuuuccucccuguagccacacacagaucucuagagucaguccccuagcaagcaggucggccuuccuccaucuucucucucccucucugcauaccccuuuuuuguccucuuccacccacagaauaucagaugcgcauuuguucacaguuggcaucacugaguguuaagggacucauggaucugguauaugccuuaaaagaaccguucuaucuguaaagacaguguuuuuaacuuuaugguucuuaguugagaagaaguucccaucacaggccuggaacagggcucaacaugucucaaauuuagcaaauccuuugucaaggauuucuauuucucuuucucauccuggaaagauguagcauuugcauuugggggguaacugauucaagacaguguacaagguuauuucccccugcuuuuauaugguaugggcuuugacuacuauguagcuauuugacuucaucaucuauugugauguaucauuuucuuuccuauguaaguaaguaaagggcuccaaaguuggcaucuaguccucauugauaaucucugcugauaacgucgagcuaacgaaucacagagcaaugguguuggcggauggcugggacagcugcaccagggagccuuuagcgaguuacauugaacuuuauguaucugugugagccauagauggacaguguaaucaguagcagauuccucuccucuggcuguucuucugcccuucugcccacucugguuaucaugccuucgcuauacagcaugcugaccuuucuagugugagaaccuaacccuugccuaaagcagggugauuuccugcuguccgucaaucggugugccugugguaccucccugagcugguccauuuuguuuccagcaacaucucagccuguauuuacaucugaggaccucugugacgggugguccugaugccccuccccaucggccuuccuuuuucagugccaaucucacugucucugaagacccuuccaggaacccacaguacuaggaacacccugugcguggucuuuccugcuucccuggugugguauccuuuccuugaggucagggacugccaccguacaauuguacaggauguccaguugccuggcacacaggugcagcguuuauccaguaaauucuggguggguacguaaaugccaacagaucguugacuucugucauugacagauuuaaaaaaaaaaaaauuaacacaaauaacuucagugcucauuuagaccccaaaccuugauguaacccgugcagugcauauguuuaauuaagucaucagacuaucaucuucaacugugucauauauugauguguuugagugaaaaaagaaucagugguagugugugaagcuaaaaacaugguaggcuguuaaaucagugaacuccauuuuacugucuuugagguaauugcugugguagacagugucugaauucugauauuaggggcuccugcagguuuuuguuuguuugguuugauuuuugguguuuuuguuguuguuuuauguuuuuuguuuguuuguuuguuuguuuuuuggugugaccagagauaauuaacuucugcuuguuccugagcuagaauggguguccaaaaacagccugaagcuaguuauaauaaaugaaggucauaaaccagcugagaaggcuuuccgucuucacuuguguguggcucugaagauaggucuucuguguggaugguucaguugcauagauaaaaguugguuucucuucaccugaagaaguucaaaggucagcagcugcaguguuagucuagagcagugguuucagccuucuucaugcugugacuauuuaauacaguuccuuauguuguggugaccccaaccauaaaauuauuuuguugcuacuucauaauuauaacuuugguacuauuaugaaucauaauguacguaucugauacccauggugucugauaugucaccccucaagaggaucacgacccacaggcugagaaccacuggucuagagacaccagccaucuugagaggccaaguugaacucacuauguugccucauguuccaucugagauggcugcgugaauaucugugcaucauuucuauguuucagccagcaagaaaaaaggagacacacacuguauuuuuaaaggaguguuccaggaagcucuaguaaaacuuuugcuuuauagcccaugggaugaacgaacuucaaacacagagcagccacgcucuagccacaguggaggcuaggaggccuuggagccaaagagcauacccagcagaacaccuaaaacuccuacagggggagauaaccagggaggggaaaugccccgauguuucuguggagggaugacuuuagagucaaaugcaagauuaugucgauuuggcagugucacgagaacuccggucuccuuacugggucaugcugcugauuuaacuguuuuuaagggcagugacacaggaauucuuggaugugacuuagagcuguguagacagacugguguaaggcuccagagcacauacugacuccgugcagucaguucugaaaacugaucccaguggcgugcagaggugcccacaaagauggccguacucauggaacaguaaugugugggcauggagggcgcguuugaugcuggggcacagcuguaacggugagacguagcgagauugcuguauggugguauccacuccaagucuauccagugcuuucuccguaguccaagguuuaacauucagguauguguagucauacaccugugcacaggaagaacccgggaaagaccacgucaugaaggguugacaaagcggcuguuuugggugcagaugaacuuguguguucuuuauguuaaccugugguuacuggggcuuauuuggcuuaguuuugguuuuagaguaguuuuuuuuuuuuuuaauaaaacauggaaucuugacucuuugguacaucacaguuaaaauauacauauuuauguaguucuguaguauuuccaaacaaucccuucccccaauuggguacauguacuguuagccagauuuguuuguuuguuuguuuguuuguuuguuuuauauguuguucacaaguaaggaucauaggcguguguucaucaugacauauuuacagaagugcauagcagaguaccuguucagggugugauuuuagaucugugauuacuggaccuggccuuuaacuuaacaaggcuuauagcagguggccccuggguacagaaacccuguguacuaccauccuguaccguccagcagcuugcuugugaucugaagguuguguugugaagagacguugcagaugcgggcauuaccaaagaccuucuauaagcacugggcacuucgauuguagcuuguuccucuuuagagaccauaauuacuucugugcccauggcaaagaguagucccuccguagccuggauuucuuuuucuggaguuugagaagagagaggccacagucacgcagugcuuuuguaaaggguaugguuaacauuugcugcaguaaccuagagguuuugacuaguucccuguuuuauuuggaacuuuccuguugcugugauaaaauaccuugacagaaaaauggagccagagauagagguuuaucuugguguacaguccuagaggggacagaguccuugugguggccggggggaggggggaaggaauggcuuuagucuugucaggcaggaaacacaaagugaucgcauuccacccacacacaggaaauagagaagugggccaggcuguaaaaccccaaacaaacucuacccccagcaaaggacuuccuccagcucccugcuaaaggcucuguaaccuucccaaacagaccaccaccaccggccugguguucacauccaugaaccuguguaggacauuucuccuucaaaccaccguacuuguuaugccuccucucuucaucacuuuguaugcaugagggagaagggggugugcacaggccaguguucugugcgugguucaggcauccacuggggucuuagaauggaauucucauacagaaggagagcugaggagcacagugccuuguauaguccuagaggcccauauugucuguauuucucucuguucaccaguaccaugggcucccuuuuaauggguguggccacugcauuuugaagaguccauggguguuaaauguuaauggcucaucccauagcaaaccaggagucuaaaggagagaauggacuuggguuggguugugucuuuacccaaguggaauucacagacgguaagaucuacgcagauuucagaggaggugugcuuuucuagccagucuccgguacgccacgcuggugguggcagcggaugacccaggggaggcuguguagcccaucauccuuaccacccucucucccucuguccucacagugugcccaagugugugcgggaagcgagccugcaccgagaacaacgagugcugccacccggagugccugggcagcugccacacaccggacgacaacacaaccugcguggccugcagacacuacuacuacaaaggcgugugugugccugccugcccgccuggcaccuacagguucgagggcuggcgcuguguggaucgcgauuucugcgccaacauccccaacgcugagagcagugacucggauggcuucguuauccacgacgaugagugcaugcaggagugucccucaggcuucauccgcaacagcacccagaggucagcggcucuugucccuaggcccaggaggguucucugcugcauagccccuaaguguaggaccucccagggguucacccagaugggucugucagagggugauggcugagcuuguuuuaaugcgaaucuuggaguggugggucuguuucagcuugcuuuuuuauuucuaaacuuugagggugccuugcuagcacuagagcguaagaauuagcuugcuggccaggugcucccgagccuugcuccccgugcaccugcaaagcugaagcaugagcgguggagacuuuaacuacagauacuccuucccagcuugcuacucuaggccagugaaagcuuugccucucagucugagagagagugaagacaacccucaccagcauucaugaggccuggaaacaggucucccaugucucauugcaagccugggcucugggcaugaacuaguagucugaucugccauguuuucugccagaaccuccuuucucuaagccuuccaccaucuuuguggccucugguuuuccuuccuggacucugaggcuucacuguggaagcagagcuguuucugacugaacaagcuguacuuccacaaacucgucaugggugauguucgugaagacaggauuuuauaacucuggaaacacaggacagucagaggucugagguuguuguuuccuccccugaacagagcagaggacuuugggggaagguuccauuguaauucauucccugccuccgguacuguacacacauacacauuucugagccucugaaaauacaacuaggaaguucugaauacugcccacacuugugagaugcccuggauccaguccccaccuuguagaagguccuagauccaaucucuggcacauagaaggaccuagguccagucuccagcauugcuaacaauucuguaaguauauaaaauguauaguuuugcuacagucacucucuauaaaagauguucaguacaucuucaaaaagaaauuccauugcugcuauaguauuuggagaugucucuaacuguaagcugacugcuggaucaaaccaaagauuacauuuucuuucauaauacuaagaugaaaaguaaauuccuaccuguuuaauuucugcaccauuaucacaguaaaaaggaaaagaucaaauauuuuuaaaugauuugguaagccagggacuacaaugacucagaauuguauaauacagucuacuaaaaauaagucugccauuuuuuuauucauguguuggcagucucuguuagucaacucucgguuacuguaacaaaauacuuagggugaucaguuuaugaagaagaggaagaggaggaggaggaggaugaagaagaggaggggggagguugguuuuagcucuuggguccauugcuuuuggcaugugccaaggacagacaggccuucuaguaaacccuaccuuguugagcuguugacuaagcuguuacuagauaagccuuuagaggcccuuuacaucuaaauaaucacuuuuagcauagaaaagggguguauguaccccucuacaucuugagccaaagaccuuugucuggcagugugaaguugcuuacccacaguccagacaaugccuuccuucuggggcugggagcagcaagggagagcuggcugguaagagggagagcuggucucuugugagacuaugccaggggccuagcaaacacagaaguggaugcucagagucagcuguuggauggaucacagggcccccaauggaggagcuagagaaaauacccaaggagcuuaaggggucugcaacccuauagguggaacaacauuaugaacuaaccaguaccccggagcucuugacucuagcugcauauguaucaaaagauggccuagucggccaucacuggaaagagaggcccauuggacuugcaaacuuuauaugccccaguacaggggaacgccagggccaaaaagggggagugggugaauaggggaguggggggguggguaugggggacuuuugagauagcauuggaaauguaaaugaggaaaauaccuaauaaaaauuaaaaaaaaaaaagagggagagcuggccaucaaacucacuauaucauauuugaccugcaaguuuauuuccucucccuacugaaaggcauucaacuguccuguaacacacagugaggaugcugugucuucauaggaguugggucuccuucccuccagugugcucuuaaagcacugggcugcugcucccugcccguucucacagucucucccauuuuaaauuaaaauacuaucaagaaauaauagcugucccucugcuggccuuugaagccuauuuagcacuugcuugaaaguauuuugaaaauacuguuugugcucugucuauacaagaguggguuuuaggaaacuuaagcuauaaucagaacacacccuuauagacauguuuucaauugcuaaaugauuccuagacauuuuaacaaagcgggagguggcuccagguuuuccuauuuggauaaaaaaaaaauggggaaagaauaaacauagucauguugacccugaacguuuauuucauguacuugucuguagccucuuuguuuguaauaccaggaagugaggacaacucagauaucugguacaauaaguaggaaagcaggccuccccacagaacaucaccaggagagguaaaggaagguuuaacuucaaggguguuguacauugggaagcacaucagccucagaagccaugugcuauaugacugccuuucuguaacauuucccaagguggcaguagaagacaccuuggcaguuaccgggaguuagggauagugaagucuggggcaggucagagggcagcuacaaacaggcaacacacaggaggacuuuguugaaguuguccucgaacucgauugcaguagggaauuuacaggucuauguagacagauggagaaaugcacagaaccugacacgcgugccaggucacuguguuaucguuauguuggauguagcagcaguugggagcguuggguggaaaguacacgggugcucuguacugucugcacgggucuguguaugaagcugcaguuauuccaaguauguuuuuguuuguuuguuuguuuuuagagagagcuggguuuuaugcgucauguaguuaaaugagaaaaacacaaacagagcacaaagaaaguucagaaggaaaccccucuccaggcuagaaaugagagcugucuuaguuucuucucuagugcugugauaaaaugucaugaccuuagcugcguauacagaaguaugucuaauuuggcuugugauuucaaagggcaggaucccagaugguggagugaaggaaauaacugagagcucagcaccagacgccuccuaauccuucccaagcaguucuguuagcuagggacugagccuucaaaugcaugagucuauggggccauucucguuccaacaccacaagcauguugcaugugguauuauaggaagccagaugucccccacuuuggcuagcuagguccacuucccaugggagccugugaaaaccucagccccacucuccuaauaggaaauaggaagauaacagagaacuauuaagguuuuuaaacaaaacagacuauagauaguauuuugggaacggauggaagacuuuaguaaaggcagcucuugcuuuacccugauuuucuuucuuuucgugagguuucacggacucauuuaagagcaguaauuugaauauaacacugucccacccauuccagaagauugggucauuuuucucauucagaaaucgacccagcuucucggcccuuauucuguauacaggcuaaggucucagaagguauagccccaggcuuagcaucuucucugccguuuccuaaaugaugggcaggaagcaggaagcaugccacugcuucuggcuccagguuguguguggcacugaggguagcauucggacaaggaccucauuagagagcugcggagguuccuggcuuuuauuguaugugcagcaaaacaacauuuggaucaauuuacaaguuucugcaaagcacugucaagauauaaauucacuugugcuuuagcaagaaaauaauggaccugcacugcgccagguaccuguuggaaucucucccugggcuuugggaauuagacuccuguuagugacaaagaugcggcugucccuuccccagcgcugccagcuugcccaaccuccucuggcaugcaggcaggcgagggucucaucagugagcagcuccauuuauucagagccccagagugccugugagucugugucucccagguagaccagcuggcuccccagccacaagccuaugauacccacaugcuucuugcaugggaaguguauucugucuaaaaacaagcgacaugcuuuccucuucugcagucuguguucccucuguguguuugcagcuuggauggcuugcccuggguaggagauuauacugugugauuguuuggauguuucagccugguucuuucaugaaaugcugcuguaauaacaaacaaaaagccuccuuacuuuucuguuuuguuuucuuuuuuguuuguuuguuuuaaugcaagaagauaaacucacuuuugugguuuugguccacucuuuaucuucaccagcauguacuguauccccugcgaaggccccugccccaaagucugcggcgaugaagagaagaaaacgaaaaccaucgauucggugacuucugcucaaaugcuccaaggaugcaccauccugaagggcaaucugcuuauuaacauccggagaggcaguaaguacuccaccccaccagaccaguggcuggaccgcuucuugguuuacuugcgucgaugcucuuccuggcucugucccuuuagucacaagcagaauacaggcuuagaaaagcagcacgggauguaaguaagccucuugugugacgccuccccugugaguuucucggaaacauaaaauccagauagaaagacagucgauguuugagccauuagcccagaauauacuccuguaaagaggaucagcccucgucuuucuuuaagucacaucuuacgcaggaaaggccuguucucucucucucucucucucucucucucucucucucucucucucucucucucucucucucacacucucucacacacacacacacucucacacucucucucacacacacacacauacacacacucacccucucacacucucucucacacacacacacacacaccucugauggcucagacccauggcuggcucaugcuagcugcugcagaguccacacuucuguaaggccagaguuuggguugcuugccuccguugaggagacugagcaaaggaaagauuaaagagugaucuccuguuuuaccucucagagccagaaagaugugccauccacaccucaagcuguggucugagccugcagacucccuuucuucacuugguguagacagcgcuccugggauguugcuucagaauuguauucaugaacaacaucucccaugguggcagcagagcccuguaaucuuaucuucucuagucuuggacugacagagaaaguccccuagauagaugcccuucaguuccugccacuagaacuucuagguugagcuacuaguaguuucaugagguaaaauacuauaggcagaagacuauuauuuuaaucuuuacugguaaaucuuuagggaaagaaaguuuuucuuuacuucagagacaaaguguccucuuuauuuauaguggauugcuugccccuaaguauuuguuaaauaagugaauuauauucuuagucuguagagguaauagaaacaagguggguuuuuuuguuguuuuuuuuuuuuuuuuuuuugguuuaggguuucuuuuuguauguaugguuuuggauuuuuguuuguuuguuuuuuucuuuaugggguuuuuugugguagugaguuuuugaggcuugggcauuugucuguuuguuuguuuguuucuuuaagauugauugauugauugauugauugauuuauuauauguaagugcacuguagcugucuucagacaccccagaauagggcaucagaucucauuauggauaguugugagccaccauguaguugcugugauuugaacucaggaccuuuggaagagcagucagugcucuuaacugcugagccaucucucgagcccccaaguccuuaguuuuuauugcccauucucuacccuuccacaauggagggcccuguuccccacacaagaacgcugacccuuauguuaauaaccaaauuguaguuuugcucauaccagaucuauuaauuuucuuugaguuuauugaucccaagacaugccuuuuaaaauucauaaaccuuacuguuuuuauaucuuccugucaugggagaucaaugugauugggaaauucagcccaugaagaagaauuacuuacuggguguggugacagacaacuuucauccuagugcuucugaggcagaggcaggcagaucucugaauuugaggcuagccuggucuccacagugaagacaccuuucauccuagugcuucugaggcagaggcaggcagaucucugaacuugaggcuagccuggucuacacagugaagacaccuuucauccuagugcuucugaggcagaggcaggcagaucucugaacucgaggcuagccuggucuacacagugaagacaccuuucauccuagugcuucugaggcagaggcaggcagaucucugaacucgaggcuagccuggucuacacagugaagacaccuuucauccuagugcuucugaggcagaggcaggcagaucucugaauucgagacuagccuggucuacagagugaguucagggcggccagagcacuugucuugcacacagggguuauagauucaauucuuggggaacaaaacacaggcuuagccgcagccacucuuuuuuucagguugaauucccuguagcccuuacauacaacuagcacuguauguauuuugcaagugaggggacucugugaggcucagacuuaguauaaggcuuuuguccucuucuuuauaucaaaccauaggagaaacuuucaccaaaucaaccuucaagaaucagauauaauaaaaaucccauucaccuaauuuauuauagucuuagaauuuugucaugaaccaaaguuuauguuacuugcuaugugaaagguggguaagcacgauaaaagaaauucacuggcucucgguccuguuacauuagcaacuuuuccuggcaacuuucugguuacagaaguaauuaugagcaggauagaaaacuuagagaugcagaaauuauuuagagagagagagagagagagagagagagagagagagagagagagagaacaaaacaaaacugccugcaggccaggaauagggaucagggagaggaagcaggaagaucaggaguucagccucaucuuaagucuagcauacaugaaacccugucucgauccaggguggggaaagauagaucaacuaccugcaugcaucauugcugugauauuggaguguuuuccugcagcccuaaauggagucuuuaaauauggaacuccagguccagcaaagaccauucuuaccaggcugggacagguuugcccaguccugccauggcacuguggagccaggacugccugucacugagcauaucuaagagauguugccuccauuugucagcuggggcuaauuagcagccuggcauuucugauuucacguucuguuaaucagcuuggcaacugcagcagccagccuccuagaagucugcuuucccgccucagaggccuugucccgguguggcuugcggagaguggagacagggacgguuggugcuaugccagccuucucacugcaauucccccacgcaagaccugcuuccccuucgcauccacaccagugugugugaaucugaguauagugcgccaccugaccagaggaagacucggugacauggacuccucuuucucuagauaacauugccucggaguuggagaacuucauggggcucaucgagguggugaccggcuacgugaagauccgccauucucaugccuuggucuccuuguccuuccugaagaaccuucgucucaucuuaggagaggagcagcuggaaggguaaacacuccauucuccuuucacagaacuguggcgugcugcgucuuaauaguguuuguguguguguguguguguguguguguguguguguguguguguguguaugugugucagaauacaacuugugggagucagucucuccuuuugucaaguggcuccuggggguucaacuccacucguuguaggcaccugacagcagcugcccuuacccuuaggggcugagccagcucccagccccgauuaguguacuuuucaaauauccuuggguuuguuacgcagaaugaaggugaaacccugggccugcuccugcugccuagguggucacccaccuuccugcucuaaguccuguggaguugucacaggauacuaacaauuuggcaaaugggugucuucauucuuaaggugcagucaucaaggguugcauaucguaguaguuacacuuuuuguugccgugaugagacaccaugaccaaaaugccuuagggaaggaggagcuuauaauggggagcauccguaacggugggagaggcauggcaauaagcaggcaagacaaaagguuagagcucacaucucaaacugcaaacaugagacaggaaaugagguaaggcccugaacccccaaagcccacuccuggugcacuuccuccagcaaggcagcaccucccagagguuccacagccuccccaaguagcaccaacuccuggggccguucguucaaaugugugaccccaugggugacauuucucauccaaaccaccacacgagucuaagcuagggcgcugaguucuagcaguccaagguauucccagggaaccuuuccugcaggagugacagcagccugccuguggugcuuaacucccagggaaauugugauucaucugacacuuaaccugccucagccuacugugcucuggggugugugugugugugugugugugugugugugugugugugugagagagagagagaaugcauuuguaugcauguauauauuugugcacacccucuggagguucaaggagacacagggugucuuuuuucucuaucuuaucuuuugaguaugucucucaaugaacguggagcucaccaguuuguagacuaacuggcugacaagccucagagaugucccuguguccacuuucuaagugcugagauuucaggcacauguuacguggguucucuuguacagcaagcacuugagcaccugacacccaagccaucuccuuuucaaacagagaagcagaaagaauugcaaaguacggacaguucauuuuauuacagagauauuucagcuugcagagcuuguacauugauuagcuuacagcgucuguguauugaucagcuuucaggauuuggaguauugauagggguugugccuucugcacagaaaugcuuugcaagcuggguuuuaaagcagccguggguuucucagcagagaguaaagcuggugcuuacugcaugugcacacagcuucuuuccagacucuggccugugugcccuugcuggccccuucagacauuugcuacggcucugguguagcucuguguuaaugcuuugaaguuuuauacguguauuaacuaagcaaucagggcccuuagaaagacagugacgggaagauccggagaaggcuuguccccaggcugguaugucuggaugagguuucuuuacaaccuccaguuuuucucacaccaacucuggccugggucuuccccugguacauacagccagaaacagagcugcucaccccguccaucuucccauugcgagcagagaagcuucagaaaaaccuccuucuccuugcgaauccuucugcaugugccagguacccugcccagagugucgcaaucauucuggggccucccguacaugaggccguggucacccuuaauucauuguugcuuguauuaaauuuuaaagugaacuguaacuccaucucguuucauuauguccccccaguagaucugugcccuauacucccugacaucgggaagcacguuuuccuuggcggauuaguagcugucagaucuguuaguuacuggaggauaagcucccccaccccuuuuuuccacacugagcaagcgauaggcauagaaagucaaaaggaggcuuugauuauuucuuaucaggauuauuacaugguaugauuaucuuaucauuaugccuuaacuaaaaguaucauacacuuagauguugcugaaaauugaaggcugguuuuuauuuccaagaauauuuauagccuauuuuuucauuauucaaaacuuagguaugaaguaccagccaagucuuuuuuuuuuuuaaaugaguauuuuauuuguuuacauuucaaauguuauccuuuuuccugguuuccccucugcaaacccucuaucccaucccaccuuacccugcuucuaugcgggugcucccccacccacccagucccaccucacugcccuagcauuccucuacacuagggcaucaagccuuuacaggaccaagggccuccccucccauugaugccagauaaggccccuucagcuccuucaguucuuccucuaacuucuccauuggggucccugugcuuagucugauauuuggcugccagccucuucaucuguauuggucaggaucuggcagagccucucaggagggagcuguaucaggcuccugucagcaagcacuucuuggcaucagcaauaaauagugucuggguuuggugucugcgugugagauggauccccagguaggacagucucuggauggacuuuccuucagucucugcuccacucuuugucccuguauuuccuuuagacaggagcaauucugaguuaaaacuuugaagauggguggguugccccauccuucaacggggguggggggcagucuaaccucuggauauggucuugacagguucuccuuccccuuuguggguuauuucagcuaaugucaucuccaugggguccugggaggcucuugcuuuccucgcaucugggacuuugugguugcuaccuccaguuccccauccccucuguucaauuuccugacccucuguacaucuccucuagcuccuucaauaccugacucugcacccucuuuuccccucccccuccuuucuucuucccaaaucccucccacccucuacuucccuugauuauauuguucucccuucuaaguaggaugaagcauccacucuuuggucuuccucuugagcuucaugugguccaugaguuguauuguggguauuccaugcuuucugccuaguacccacuuaucagugaguccauaccauaucuguucuuuugugacuugaguuaccucacucaggaugauauuuucuagauccauccauuugccugcaaauuucaagaagucauuguuuuuaauagcugaguaguacuccauuguguaaauguaccacauuuucuguauccauuccucuguugagggacaucuagguuguuuccagcuucuggcuacuauaaauaucagccaaguauuguuaaggauucugguauuggggaagcuucccuggaaagcugacgccagcccugcuguuagcauuugagaagggaguggagggcaggugaggccuggagacuuguguuaaaaaacaguguuucucagccuuccaguacugccacccuuuaauacaguuccucauguaguggugacccccaaccauaaucuauucauugcuacgucauaucuguaauuuuacuacuguuaugaauuguaauguaaaugcaugauaugaaggaugucugauauuugaccucaaaggaaucuaaacccacagguugagagccucuugcuucaaggauaucucuggccaggacauuugagacucuuuaguaguagcuuucucugguaacugugaugaaauccaaagcuuugaggggccacccauagcaacaacucaccuuugucucucguuguauaguauuagggcucagcugguucacuucuuccucacuuauuuaauaaaggagagaaagauuuguaauaagcagaugaacacagguagugcaaagcacaggcuucagagagccccagaggagaggacagaaggugcucuggguaccaaaaggaagacucugguggagaaggccacacaggcuucugagcaaagcuggccuggaaggguuugggggacuagaaagcacagggacagaagaggagagagcacagaaugacauuugggccugucuuguguucagcuccugggggagguaggcaguacuaggauuauaggaggcacuguugcaugcagauguagagguuaucauuuagguaagccuugggacgcacuggagauuuugaggagggguguauuagcagaguuaucugacauuuaauuucagggugcugucguuuauacugauagccuccucccccuccccccaguguuucccagaauguguggauacaucacaguuacagggaaaggggagcccuguggaacuucaccagguucaccucaccccaagucagacagaaaacuuggggugggggaguugccagcauaagcucgaguaacuuucugaguauuucuguguauguuuggcacauggcaaagauuagaaaugacuucgcuaucccugugauccuucaaauguauauagucccaggccacuucugaguuuuuauuuuauuuuauauuuuauuuuauuuuuaagcaaucuugccucaacucaguguugaaggaaucuauuucuugagcuuuuuguauggcuacugaaaauggcauaaaugcuuccgugcggcucaggaggauucugaagacuucugucuugauggaaagaggaauauuuccccccaccccaccccccacccccaugaagguauccuucagccuuagcuauccaggaaagcacugcaguugaucuuggccuucucgguagccccccgugggaacacaaguguuuugccuggcguguaguuccuguguuuucuuucugggccugcuuaccugggucaugcaugcucaucaggccacauuucuguacacugauuuccaggccgacgacaggugaagcagaaucccagcagagcagacaucagggugcacagccacagaacgguacuuggguagcagcaggacccuuuggucucagccaucacucucucuguaguguggcauagcuguagaaucccaacuucagauaagaucauaggaguuggagagaugacucccuagcuaaguguacuugcuuggcaaucaugaggccucguguuugaauccucggcgugacugagccuagcugcacccaggaguagcuccagguggugagcugagacagacugaucccaagaacuugcuagucagaugaccugccugaccugagccagacuccgugagacagccuguuucaggacagugggguagagaguaacaggaggaugcccagugucucucuccuguguccagaagccugcacgucuguguacucaaggacagacacagaaaggaaaggguuuucucagaaguaguggugugguguagugauagagcacuuaaccuagaguguguggugcuugcuaccugaucucuagcaaagugugggggucaugggggggauuaagaaggaaaaucaaguuuugucuggggauagggauaugugguucuccuugaauaagagagaaaauauuuccauuaucugaaaaaaaaaaugcucugcuuuggacaacuuugguuugggagcaaucaaauaaaugaaaaguucaagcucuuaggugcugccaaagauuauugucuugaacagaacaaaaauacuggaagggggccaguauaaaguuagaauucuuagucuguuuaggcaucucuacccuuugcagacucaggguuuuguaaugugcccugcaucucuggaacuagacccuaacauaaccacauuuuagcacauacuugggacuuuuaaaauacauacaauuaguuacuuugccuagcaagucuaggcuguuccuagagauauggaagcauguguaugcaaauaucacaugugaaugcucuuagcaacauuuuccauaguauuuucucaaaauggugcguuagauauaaucuagggguuccucaguauaagcgcaaaacacacaguaagauacuagccaaugguacauguagcauccugggugaacagacaggggaaaugccuuggaugggagaagaaugggggggggggcuucaguuugauauaaauguucugaaucuggaugauugaaagaugauuggccaucuguauaaauuuauugaagcccauggagcuguauauuuauagugggaacaauuuuagaagguaaaacguaccucagcaaagcuguuuuuaaaaagcacucaggaacaaacggccuauuuugucaaucuauguggugcuugguuuaguuuugccuggguauauauuuccauacuaacugagccuuuguagaugguauaacuguggaccugaagugaaccaauauucuacagaugggcuaaguaguguuauaaaugacuguacuggugacagcuucaguguacuggcuucugaugcccucuagagacagcugucacaggcaguaguagugucuccuugcaaaaauggauaugaguuauugguugucugugcuuccaggaugccaguaagagcuugaaagagggguccuguguaggcuggagaccuugagcucagcccugccuguaucaaggugcaggacuuaccuauuuucugugacuuuguucugggggacuuuugacaguucagagaguagcacaggucauccugugccuuugugaggugauucaaagcuuauaacguccuuuuauauuuagcauccaguucuucucaauuggccucggggcccgaagagaccagaaaagauagcuccaugggcagcugagaaccagcagcccuagagaagcugaguaaaccauucaggugccacuucauaagcaguggagaaggugcuugggccugguuaucaguuccuacauggaagacucuacacucgguccccugcagucuucacuuaaaagggaggccuagaaaugguagccacagaucauagcuaaguguuggcugugagcuuaucaugugacagggcccccaaauuguugacuaaccauccuaguaggucuaugcauuggcaggugaaacccauccaauagaggggauuuuuuuuucuaauguugaaaaagcuacaagcuaccaggcagugguggcacauuucuuuagucccagcacuugggaggcagaggcagguggauuucugaguucuaggccagccuggucuacagaguaaguuccaggacagccagggcuacacagagaaacccugucuugaggggguggggggggugcagaaaggaagguaggaaagaaggaaggaucgaacuaagagccaaaauaccacucaauaaaacuccgggagaucauacagcguguaggagccaaaggaaaaaaaaugaacaguuugguuuuuaaaaauauucuguggauguaaaaaggcagugagcuuagaaacgauuuaugaagucgcauuuauugagugguucccuuaacuagucaucucccugagaaaacaaugaccauucaaggacauuaguaucuugaagguguguagacaaaucuccaccuggggauaucucuuaacucucacuauugcagaagguguugaggaggcaggccucggguggggguugggaagcaggcacuguguggacgggcccuccccagcagguugauuauuauuuuggugaagguuuuuauuuuucuuuaccuucuguaggcuccacaaugccuggauuuuauugauauugguauucuggcucccagccuucucugcauuguuuaaagagagaaaguuuguguuuacugugaaaagauaaucuugcuuuucaaagugauuagucaaauacccugaguuucuaugugccugccauucauuugucaaauuccugguuucuaauucaugcucccucccuggggagaagaauguguggcucagaaggaagguauuuucaguacaauucuguuuccugcuugagaaauuaguuuacuaagaggccuuggccuagauggagaugggaguuugaccugauuaguuggcccuuguauccggccuggaggugucuucaauaacaggagauuuuugucuccugggacucucaagacuugggagcagccagaccggugagguuagcguugaggcagcaguuuaagaauggcccaugguuaggcaagacaccuaaugggacccaaucuuuccaccauuacaccuauccuucaguugucugccuauccugaccacccccauaucaauaagagugaacauuggugggucccguagguggcaguucugacugacagguauccaaggaccucccuaggacauacacucuuagguacuacgaucuggauuccuuugaucagggucuuuguuuccuacuccaauaaacaagcaugguaggggaacacuccuuaccaaaggcuagcggcucauugagcccgugcgugugcagacccugcgcugaagccugcgcagaagugcucaaggaggguuggggcuuccauucaacugcuuagcucacacuugagcuccgacuccuccaugugaggacucuuaccuaugagagggauguaugugcagaggucagaggacagccuuacacaguaacuguucuuccuucucgggguccugaucaccagacuugugauguaaguacucuugcacgcaugagccaucucacuggcucucauaaggaaucuuaaaaccaacgagaccucagacuucaccuacgcacaugaacgcugcucuucauagcaccgaggaaacugccuguggcuuguccuguggggaauucauggcucuuccgguccuggguccuggccucugagcucccuaaugaguucuccaggaagugucgggagaggcuuggcaacccugcagcuguaacucauuucucaguaugugaaggucauguugaaagcagacccccuaggcaguaguucuaaugugggugaggacucucagcagguggugccuagguggacacagccuuuagggcagaacaggacuuugggacauguuugucuggucuguggguggauuuagaaauaacuguuuaaaaaaaaaaaaaaaacuuaugcagacacccaaguagaauccuugcucuccccuuggcccccuaagauagcuaucuucccuuuggccaugcccauaucuccccucuaguggaaguuaggccuuggaaacagugccguggccggccugguaguuucuggguggacccaggacugguguuuaucagcauuaccugcuagacaucgagauuccuggugcacucuggaccucugcaccagaagcucuagcgguaggggauacugagaacaagcuguguacauacuaaauguggaaagccaccauguuacacgcugcaucuagcuacccugaugugagagcccagggagacacuggaugucuguccucucccacguacucagggacugaaaugaaggcuucuugcagcgagaggcaaauguacagagagccaggcugucucccaucccaucaugcacugcugauugggcauggguaggauuuauuccuagggauaauggcagccuuugcugcuaguauguaagcuguuccgguugaguagcggagcaugucuguucgccuguaggcugauuucaagcacauuguccauaccuggcucugagagaaauaaccaaaggcauuuucccagggaaugaaucaaggaacauccuuuggugggagaagcuuuguguguugguaauagaggucaugaaauuaauuaguguccagucgauuucaaaacauuguccuuggcacaucuuuuugccaguggcuaccgccacugucugcuguuauaaagccccaguaagcaagcaaaccccuuguugguauggaacuacacuggccgcagagaggcucucugucgccugagggggcugugggcucagugcguugcuaaugcgcauuucugugcuuccaggaacuacuccuucuauguccuagacaaccagaacuugcagcagcugugggacuggaaccaccggaaccugaccgucagguccggaaagauguacuuugcuuucaaucccaagcugugugucuccgaaauuuaccgcauggaggaagugaccggaaccaagggacgccagagcaaaggggacauaaacaccaggaacaacggagagcgagcuuccugugagugacagcaucucagaccccugggacugccacaguccagauaacagucuuuggcauccgugggcgggcucuuuguuucaccauggacugucaaaccacugcagccagugccuggccucugcauauuagugggcgggugccugauacacucauacugauauauuuuucuaaggguccauuugagucuauuaaacauccaagcagguucuuagagcuugcacaguuaaauaccuuuucaauaugagcaaacaauauuuaccgaagagccaguccacuccaggucagcucugccuuucucuccugugccauagaaggaucaggguagaugcuccacuauaauacuuccguggacguccaguguccuuguccucacacuuggccuccuuucucugcccugcuccuucuagaacaaagugagcccaugucuuugaaucggaaugcuuuucacauguuggacaaaguaauaauuccauccuggugaugagaguuuucacccuaagaucucauagccuagaguucaaccuguuaacccagccccucuccaaauguggucccagaccuggaugucagucucuccucuagcacuguauggagcuaggcaugaugguacacuccuauaaucucaccacuuaacaggcugaggcaggaggauugugaguuugaagccagcuugggcuacaucuaaaacccuguuuuaaggaaacaaaaacaaacaaacagaaauacuaaagcucuauuugacccuccgucauuauauagcauuaguggggaaucaggagcugugugaccaacagcuagucagacgugugcauacauguggggggagggcuagccuugucuuuugaguauccagauuuaucugauacucuacggauccaggaggcaucuugagaagaguaguuaggcagaggugguaaguguguacacagccagcacccucaccuuucugcagagcccccugaccuguuccccaucaagaacauagcagaagccugugaucggagcauuucaaagggcuucucccuuaggggcagccagccugaccugacaggucaugagugcgccagccauagauuugccuuuggaagcacagucaggguuuucucucagagugacaucacagagacggauggguuucugucacucauggaugugccucugugccccaggugaaagugauguucuccguuucaccuccaccacgaccuggaagaaccgaaucaucauaacguggcaccgguaccggccgccggacuaccgggaucucaucagcuucacaguuuacuacaaggaggcgugaguuugggccucucacucugaugucaagcuugaggguggggacggccagguggcagugugacuuggcugaauagagagucuuugguguaccuauaaagaaucaagucaggcgaccgucaccucauccucaugugaccucucuaguugucauauuaaacugucccaaccugagacagcagcuagucaggagagugucccgccucagcccuuucauuguuuauaugguguuugaguaaguucaccccaaggggaaaggggaugaauuuuaagagaacugaaugccuccaaacugucauaagccauuauguggacuugguuaaauauugucuuagccucugucccccaaaauaccccauggggugcucuguucucaccaaggcuacccugaacugacccauugucuuccagucacuugaugcaugcauggccuugccaagacuuugcucugggccaugagcccucuagcauuaaagaauagugagggacgaaccuaggugucagcaguuccugauaggaccauccugcuuacuccacaucacagcuuccugagcugucccauuuuccuacucagccuccuguggccaggugguuuccccagucuguguggucauccguuuucccaggcacugaucuuuccagaagcaaaggugcugguggcagugccugguaucuucgcugccacuugaccuaggguccugggaacuguuauagcccagggaaaauagaaagcucaaaaucacucaguguuuguguaaaugggggccaccccucucccaucgugaucgaacacaagucaugucagcauaauuucagaagccaguagcuagcagcccuugcaucucgucaaaguagacaccccgccuaccaugcaucugugcagagcccucccuucccuuugaaagugcugccagugcacuggcgaugcuaacuggugguaucaccaaugccacucucugagacaaucaggaaacaaaguguuggaauauuaugagauaguuaagcaucgaaaauagcuauuaucucagccaccaaacgcagacacuauugcauacaccagcaagauuuugcugacaugacccagauauagcugucucuugugaggcuaugccagugccuggcaaauacagaagugaaugcucacauucaucuauuggauggaacacagggcccccaauggaggagcuagagaaaguauccaaggagcugaaggggucugcaacccuauaggaggaacagcaauaugaacuaaccaauacccccugagcucguguuucuagcugcauauguagcaaaggauggccuagucggccaucguugggaggagaggcccuuggucuugugaagauuauaugccccaguacaggggaaugccagggcuaggaagugggaguggguggguuggggagcagggcggggggaggguauaggagacuuucaggauagcauuugaaauguaaaugaagaaaauaucuacuaaaaaaauuguuuaaaaaaaauagcuauuaugagccaggcagugguggugcacaucuuugaucccagcacuugggaggcaguucgaggucagccuggucuacagagugaguuccaggacagccagggcuucacagagaaaccuugucucgaaaaaccaaaaaaguaaaaauaaaaauaaauaaaaauggcuauuaucgaauuacauuuuagaguucuagggggauaggaaaguuaguuuuguccaaaaguuguguuuuauuaguuuauuguuugcauuaaacagcucugcuuguuuuuuguuuuuuuuuuuuucauuaguuggguuuuuguugauguuguuguuguuguuuuuaacucucacuuaagaagacaaugagcauccgcaugucuuagacgcagcauuuucagucccugugaaugagggacuugcugucucuaaggcugcuugucaguucugcgguucauagcugucgagcucccgaguccagaugcuugauuuuauuuuuguauagaaaucuaauugaugaugaguuuuauuuggaguucccaauagaaauagaaagugugacacguucagccccuggggaagguucuggggaguuuugaugccagagcccuucaacguucucuggccuguguugacugucuuucagaccauuuaaaaacguuacggaauaugacgggcaggaugccuguggcuccaacagcuggaacaugguggauguagaccugccuccgaacaaggagggcgagccuggcauuuuacugcaugggcugaagcccuggacccaguaugcugucuaugucaaggcugugacccucaccaugguggaaaacgaccauauccguggggccaaaagugaaaucuuguacauucgcaccaaugcuucagguauccacgcaccggaggaacaaccuccaaccccuguucccugaauuuuuauaagcuugcuuuauuuacauaggcacaguauggcuggagggcuagcaaugagaugcuuguuguugcugcuuaacacuguauuaacauucucacugccaacaccuuaaguucuccugagccauuuccuagacuugguaccaucuuaaaugucaacaucucugcucuacgcaauugaaucgguguccuccagagcaguaggaugguuucucugaaugcccaggauguagccacuuguggcuggucuccucucucucagugcagacuuccagggacugagacgacaaugaccggugcaccccuugccucuaguggcuugcuggcuuuccaccuuuauuccguagccaccagcuuucucaacaggcgaacgcaggcuuagaguacuaugauaucggauuauugacuaaucccuucucaucuucuucauguguuuacguacuaguuccccagcuccagaaccuagaaguggggaaaagcaaaggugugaguuuguauccaaagacgagagagguagaaagauaugcuucacuguaaagauaaugacugaccucuuacaacaaaaaauuccaucgacuugaguggcuuacaacacaaugaaacauauucaccguuccaagagcaaagcaacugaauacauuucucaucuuaaaguuugggaguaaugacucccagugaaucauugcagcagaucugagaggaaaaaaaaaaaaacuaagcaggaauuucuuaucauuauagcagauucuuaagaaauccuauucuucuuccuaaauauuaaaaacugcauuuggucccugaccucaaaagugcuugggaccgauagugacguacuuaguccaucaugugccucugcuucaucugggaaacuugucauugaaauaccuaguaagaaacuguuuuggaaauacuuauugaaaacgcucacgggaccaggcaucaagugcuugucuucucugcaucagucuuggucuuccaacguguugucccucagugguucucagagccuugagcaccgcauacauccuaacagcccucuguccauucgcuuccuguugguguggugguauaugaccuggcaaggaaaggauuugacuuccacaucaggaucacagucugccguuaaggaagccaggguagaaacuccagcagagacaggaacuuuggagaagcacuggcuugcucccaguggcuugcucagccugcuuucuuagagaccccaggaccaccagcccagaggccuccucaccacaaugagcugggcauuuccuccaccaaccauuaguuaagaagaugcccugcaggccugccuuacagccugaucauacugagccauccucucaguugagguuuuuuucugucagauagguugugccaaguugucauaagacugaccgguacaagcuuguuuucaccuuucagauucaaaaacagcuugguuggaccuuauucuuaagugucauaaccacgguucugucucuugcacuuuggaaacugccaaaaccagugggccucauucuuugccaugugcauguguguguguuggggauggggugcgcuucggcugugguaucucuuuugcuauggugaggacacagcagugguccugggauguuuuccuuuuuacguaaguuaguucuacuuuugagccugggcaucaguaguauguaagccuccgucguuuuguuaaacucauuugcuuguaacaggacuuugcauagaaucagggcucaggcguacuggcuuuccugaaucaugacuugcuuacaagaucugugagucccugcuccuuguuucacaguccuuucacccaggcacauaaccaccccacacacuguccaucccccacucccacucuucauuuuggcucccugucauguuuaucaaguuuuuaucagagauuaaaacuugcaaucacaggugaaguacuaagccguccaauuugccauuuccuaauacacaccggagaaugacaguugucauaacugaaucaacucuagguuuuuuuuuagaguccccuuuaaccccagcuaugcccucguagccccuucagucccaggucagugagccauguguguuugcacauagauuaucuaagagcaagugcucugagagagggcuggccucccaguugguaaucuuuccaaagcucugguucaccucaugcucugguugguccguugcuaucucugugcccaggucaagccugcagcuuccuguugguuugcaucgagccccugauaaccucaaccucggauuccggucuauucucugaaauguucuuuguucuucuuuccagucccuuccauuccccuagauguccucucagcaucaaacucuuccucucagcugauugugaaguggaauccuccaacucugcccaaugguaacuugaguuacuacauugugagguggcagcggcagccccaggaugguuaccuguaccggcacaacuacugcuccaaaggugagcugggggcuggcaggcagcaggcaggcagugccacuggccuugucuguugucugagagaaccugagccccagggucacaccugucacguugcagggcuugcuucucagcagugcacaccagcaccccuccccuccaccagcaaugcuaacaggcacuuccugcauggcuuucauucccaucucuggucuuccccaagcagacaaaauacccaucagaaaguacgccgaugguaccaucgacguggaggaggugacggaaaaucccaagacagaagugugugguggugauaaagggccaugcugcgcuugcccuaaaacugaagcugagaagcaggcugagaaggaggaggcugaguaccguaaagucuuugagaauuuccuucacaauuccaucuuugugcccaggugagugugcccuuuggaaaggcuacauuugaugccuuaggcugugcaugcucccaucugccccacgcggagcagcuccuguugguuggcaggcugcugggcugcuauugcagucagcugacaggaggcgcugcuguuuuggcuuuuacccauguuccccucugugucaugucuguuucuuugaauuuaaagaccugaagacaggaaacaaaucaaaaggugcuuuaaaaacuggaugcagugaccucuauccucacuaacuuacugucuguuugagucuugggucucagaccuacauucuccaacaccaaaccuccgucccuucauuggguuaucuauguggagcauuccaccugaaccaacacucaguaagaguagccaugagaguggccagguauggagcgucccaaagaggccaggcagagguccucccauacccaccccuauacugggugucagucaaauccaggacuccuguaggcauggccagagguuuaggucguucuuucauuguugcuaacaaauugcgugaugcuuaguggugugcauagcucaacaguuuuaaaguuagaagaacaaggagccaguguggcuuuuguugaugaaggcaucuuugggugugucgcauggccaaaguacuuauggcacagcagcgauuucagggcagacaggaagcugaacagacguugagcacuuagcuuguuugcuacaucaggaucucccccuaacaggaccauucccuaaagguuccuccugcagcugccccacuagugaccaaacaucuaacaauacagcaugagaaccaaggguagaccgaccauagcagaaagcccuugguguuuaguuauacucagaugacaucacuuugugacugcuguuaucaucagcuguguaacgcuaggcuaagugauugggcggcaaggcugugguugacccagaugggaccgugcagggcuuguacuguggguuugaaacgaauuuucucucggucacauuccuucguguaaguguccucaccucaguguccuaaaacagacccagcaugcagauaggggucaccacaccuggccauuaggguuugggggguuguuuuuuaccuccuaccgaggcaaggaucugacaucuauacgaggucucgcaaggucccauaaaggagcacccuagaugacaggagcaacucugucaucauacaaccgaguuuaccuaaaaccuauuccuaccuucaugucauucuaggugcacguuuaucugggggcugaaggcaaauauaucagauuuagucuuucugcauugucugacuuugccugugaguuuauaguagaguggaggcuacuauuuauaaaguuacuuccuaaacuugguaucaguaaauggcuuucauuggccgccaucuucauuuuugaagacgcuucaaaaauguuucugucacuaaaacauucucagauguuaaacaguacaaguuuuuccaguagcaucaggauacuuuauggaguaaggaaagcugauagugugcuguuugccacccccuggaccacucuguuugaaucaucccuagccuucugaugccuauauugccucccuucaugguccugacucuguguccacaguaacuguugaauaauaugcaagagugcaguguuuauaaguaaggaggccacugagucugcuuggugcuauagcccaguuuguugggggugggucaaggcaagaaguggaccaguaucauuuugcaauaaaucaaacacaagcaacuucuuacaugaaggcacacguuuguguugcucugguuugaaagggaggcaggaaauuuaauaauaauguuuugaacaucugccuagccgccacacacacacacacacacacacacacacacacacacacgcacgcacacaugcaugcacgcacacacauaccugaaaaaguaguuuccuuuaucuuuccuuccaugguuuguugauuggucgguuuaugguuugcugggugugagcaugguagaauaguacccucauuuccuaucucuuuccccagcauuaugauaacaaauccccauuccuaacuuuugagaugggcccugguauggcaguugauauacuuucaauggaaacuggcaugucaguacccgacaaagaacuaugguuuugguagcagauccaucugcugaagaccagggagcaugcggcccuuucccccaacucccuacuguacucucccagauguuggccuagggagcauccauaggccuugggcauggcuuccaaggcgccucgagcaccguacucuaggcucccuuuugucuuacucugucauguucuuaccagacgcagugcagucccaccuguuccucucauccuuuguccugucacaagcaaugccagcaacagccucaauacccagcuugcccacuguucaccugcagacaaccugaggguugcuuccagcccauagggcugcuuaucugaugucauauuuuuauuuauuuuuuuuuucaguuuuuaugaauguuagaaguuuuuucuggaagagagggagccccagacucuguuccuguugcuuuucuguaguuucuuaagcuaacacaagucagugaguaacagaggcuccgcuccuaucacagacaagcucacugccaaggaggaugcaaagccagguuugaugaaccuccaagaccaugcuguguacuagggacugggggcauucaucaauaggagacccuguuccucaggaaaagcgcugggauuuagguacuugcuagcugcuuaaacuagggcaucuucauuucagagaagaucaaagaagccacuacuguuggacuuugggucucuucuaccuugugugucuuaggccucaccuuucccaaccagucuuaugaggcugaugguuugucguguugaaugcucaguuaucaggccugaccaaguagcacugucugguaaaacagagcacugucuggcuaaaaauggcuggcacacuguuuccuagaaccaugugugcacauguuucucugaggaugucucaagagaguacaggauggguugugaaggcgaaaauccugguuauuuguugguucuuauccaaggagccuaaguaguuucuuuuaguucaaggcuaggacuuuccuauuacuucuacccuagccauggaaaagacaaagaaaacuaaagaacuuagcagcugaccuucuuucuccuccuugcaggcccgaaaggaggcggagagacgucaugcaaguggccaacacgaccauguccagccgaagcaggaacaccacgguagcugacaccuacaauaucacagacccggaggaguucgagacagaguacccuuucuuugagagcagaguggauaacaaggagaggacugucaucuccaaccuccggccuuucacucuguaccgcaucgauauccacagcugcaaccacgaggcugagaagcugggcugcagcgccuccaacuucgucuuugcgagaaccaugccagcagguacggcagguagccccgccgccaacuuacagccaaggcgggggaggcugacagcccuuagauucaggccuacgaaugugugguuguugguacacaacgucguccgucaggugccuaaggaacagagaauguauuccuagugccagcucccauccagacuuaaccauagacacucuuuacaagccccuuucagggcucucacuccuuggcuugguucacgaugcacaugcucacacccaccccugugcccuucugugcacagcugaaugaguuagcuuucuguugcuauuacaaaauacccaaggcaguugucuuaccagaaggaaagguuuauuuuggucucaguguuucaggaguuuuagaccacaggcacuugccucucacugcuuuggggcuugcaaugaagcaacacaucguauuucaucacuucuuucauugaagcccaaucuccuaaaguccugucuucucucagugccagaggcuacagacugagagcacaaaggccuuagcacaccacagaccugugaggggcccuccaggucucaaagcuugaugcagaggaagcguuguccucguggucagcuagaucagccugugggccuccuccuacaguuagauacugccugucacccugccagccauuugccacuucucauucguggaggaggugucagucaguggggagaacaaagcaugcugggaacuggggcaguaagagcuucugagaucggcuuuggcacucccguguagcccucagccacccgugccucaguuucccaauccuagaagagacagagaacagcuuaucuccccaggccucucucggcugucaucagcugucacccaacagcugugguucaccaccagaagugaggccagcgguggcuggaagagacaguggccggaacagcugccucagaggccagccucggaacuggcccuuccucccucccgugugagggugugggcugugaaugugucagugccacagcuggaggcucagcacgcugucgcucacugcccuuccccagggccgcucuguuugaaggguucuuuuuuuuuuuuuuuaacuuuuuagguaggaaaauggaccuggagaauguuacauagguuuuucaggcgugaucacuuguacuuggccacagguuuuuucagucagaggggauggaggcgcugugccagcagccaucucaggaaagaacuccuacaagguccccuguccagaguccuguauauacaaggauugggggaacaguuguucucaaguuagcacaccguuuaucauucuuucuggggaccuaaacccaauuugacugcuuguuuacauuaauuaugcagaaggagcagaugauaucccugguccggugaccugggagccaagacccgaaaacuccaucuuuuuaaaguggccagaacccgagaaccccaacggauugauccuaauguaugaaauuaaauacgggucgcaagucgagguaagagggauaccauggccugcagcugcauguguuucagcgcugagagcacgugcuauggcauacugguugucugcugacugcuaagcagacaggggagaaagaugggcagucgggaaggauaaaggucuuccuagcaacgccaucuuuauugaguaguaacuugggugcauggagcuggcuggacuucauacaaacaaugaaacuguagcuaggccuccagccgcagacuagacacgucuugaugaucuuuuauuccucuggaguuaccaacauauuugauuuaauuaccaacauauuugauuaccauuuuccaugugccaaccugaaaaccacuuuuccgguauccuugcuuccuuuauguugauacucuggacaauguaaggagagguugggcagcuggagucacagcaugaugacuugaguugacagaugucagaucucacccaugcuuguaggaaauuaacgccuuauauuuccauaggaucagcgggaauguguguccagacaggaguacaggaaguacggaggggccaaacucaaccgucuaaacccagggaacuauacagcccggauucaggcuaccucccucucugggaaugggucauggacagauccuguguucuucuauguccccgccaaaaguaagucuuauugagggagacgcacgguaaauuucaaagcuggcugggccagaacucagaagcccugagcuucuggggcucucugguuuucuguuagaacagagcuggcuggguugaggagguggcuuacuagggaaagugccugcuuaaagaucuaaguucaaguccuugacggaaaccaggggcgguagugugcuuccucggugcucaggagaucgacagucaaaguuuugcagaucccuagcuagccagaaugguccauuggugaccuuugcuuucagcgagaagccguaucuagaaaacggaggugucacgccagaaaggaagacacuugguauuuacucacaguggacacacaucugugccaccaucaccuuccccccaccccaacacucgcacgcacgugcacucgcacgcacaucccagagcugggaaggugcugagccuuggagccuucucuugugaguaacagaagaguaucguacaaccuagaagauaucuuguucucaucguggcucagguguggaggcauuuugcaaagcauugaguugaguaucaggucuccugccuggucggugagggugacccagcgcucagcgucuccccagggaucgucuggugucacugcuccgggacaggaaucugcaggacaacaucccagucagagucuuccccuccucugugcucuucaccauccaccaggaugcauugaaagauacucugugcguuauuuugcacagacccacccuaguggauaauguuucacaguucacagaaaccacugagugagcuguuaggauucagauuuaaaaguaaauguugugaaauguuaaaugcaagggcugcaugcuuguuugaccgaaaaaaaaaaaaaauugagucuuuuuggugaaauaauacauagugaauuuuuacgugucuuaugagaagccaaauuuuuuuagauuauuucguguucauguaauauccaaacaaauacaggaucaaaugugaauuccuuuugcacuccccaccccccaaaaucucagcucagcuuugaggcuagaaucuaggguguggggaacuguuguuuccuaaugucuuauguucuucguggucucuucuggauucuugauucagacaaggucucaacagauccagcaaucccaguccaaaagaaauggaaguuaguuguguugaaaucuacaccccccuuguuuuuuuggcccacuagucacaguagccaaacaaugaaguauccuccagcaggugccuggguaaaaaugugguccauauauguaauggaauacuguuaauagaaggugcagaaagggaaacaccacgugaucucacguauauaugaaauaaaucuaaaagggugaacucagagucuugcagguuaccaggggaacauaacuuaggggguguugcucaaaagguacacaauuuuagguagauagaagagugagcuuuauaacacacuagcuaugguuaauaaagcauuauugaauauugcuaagaaaguguuaccaccacagaaaugguaacaaugcgacuuaaugcugaugcugauuggguuaauguacacaugcuuuaagauauguuguaugugguaaauauguauacauguauaacuuuaugucaguucacacuucgauagcccaccuagccaguuccagauauucaaagauacgcaagacauucgaaaauccucaucgugacugcacaaagacagaaguaaauagaaccguaagcaggaagcuaggauucccuguaucugcugcuacugugucuagauugagagaugaugagacugagaguucugucagguagacucugaauuuucucauuuuuuucuggguagccuagcgucaucaguuagcuuaugugcuaacucuccauugugauguuacuguagcucuccgauguggcaaaacccagagaugauuagagggguggcccccacaguuucggggguugucgugcucugucuguugauucuauuacuuuugggcuguucugagacaaaaugucagaagcaggaagcacaugauggaaccaagcugguuaccuccaaaaggcagaaagggcccggguuucacaguucucucacaggacaccugcuuccagugaccugacuuccucuagaacccagcuccuaagguuaccugccacuacuucccaauaacgucacaggccggcaacgaagcccugagcaucucugccuugggguacauuuccgcuuaucuguagcacgucgugcuacuaagccaacacuggaguucuggaaauugggugguguucucugaaggagcagucuugacuucugaagcuaagugagucuggcuuuucuuaggagagggcauguuuguagcugccuuuguaaagcuaagacugcaaugccacuggggacucuuaagagguccucuaaugggguuucuccaguggaaguuggcacaucccacagggggauugaagcugcgugcuagcgcucuuggcuucugggaaauuuucccgguguccgacaagacgcaguuuagcacaguuuucuugggucuaauccucagagggggacauugaaagcucggcaucaccugcuguuuuuaaggaaaucuuggugcgugaauucuauuaaacuccucuucagacuucuucccucccgauuaaauauucucaggucuuugggcccuuucuugaaagccaguugcauagacaauuuucugucaguuuuguccuucuggauguguuccaguuccucugugucccuguugaaaugugaaacucaaaaagaacacagaacaaccugacccguagaaucaggaacacaaaaccacgaauucuccuaggggaaaaggaaagcucggagcuucucucuggcagggaggcgcacgugggaguacuuuuagaaacuggaaggugcugaaucccaucgauuuugaaaaagacuuaauuuuggcuuuuguaguauuucaggauuaagaauagaguuuagagguagaccaaccauuggugaguggcucgcgguccaggaacaugucuccacugaguccccagcuccuuuccaaggagacaucucuauacuguugguguguacuuggugugcacaugugcagaggucagaggacaacauugaagaguugauucucagguuccagggauugaauucugguugccaggguaacauagcaaguguuuuuacccacaacgccauccuuauuguguagacaugucaacuuggguguccaauaguugcuauagacuccuuauaagccugaaaucuaaagugcuuucauggaggcacuucgguccguuucauucccugaucugcauuccguugggcucucagaugaaagcucacagcccuucgcuucuucuucuccgcauacucauuuuuguuuguuuguuuucccauauuaacuggagucuuacugauucuuucugguacaugacgggaauccagccucccaguuacuggguugcggcuguucugagccagggcugcaggaaagccaggcucugacuuuggaacuugucaguuauccgugcaacccuggcaaaguuaggacgccucucugaucuugcuuauggaaaaggauuucuuccugaggucugacuggagcgaugcauagcaugccacaggagacugguacguucccuuaacuccucuagaccuggcagugugcagaggcccccaguguguccucagacacacucaucuucccaguacaugaauccguuuucagucuggccuuggaagaguucacugaugcuucuucuucauuguuuuaguuuuagccuuuuagaacuucugacaugaguacuguauuuacaccaucuggcuccucccucucccagcuucuuccaugcccaccucucucaguuccaugacuacuuuaauuauuguugcuaagcaacuugugcgcacauugauacauauaugucuauauacauauaugcauauacaccuacauacauauacacacaugcucugccaagcucauuuaguguuacugguacauguauguguuuagggaugaccacgugggauuggcuaaccuaucagcaagcuuaugccugauaaagacugauccuccuucucucucagcagccauuaacugcugguaacuucucaucuagggguggggcuucagagauuccccacacuucaaagcaugugaacugguauugucauuacgcaaguuuagguaaccgcguuguugggauucacgcaugcggguggugucuuacauaaaagguggcaucccucagcagacacccugggcuucuggaucuuagaaucguaccacgcacuuauuuugcaguguuccaugagcauuuguuguggggguuguggugugggucuaucaucaguugggcauggguaccccauggucagugguucccugcauuuugaccagucaugguuuucucuaauccuuuccaucugcugcagaaagaggcuucucuggcgaggccugagagcuaguuaucuguggguagaagcucacugcuucagaaaagugcuaguagcagguucuucucuaguguccacgacacuacagagagucagcuagguuuacagaaucgggcaagaauuuccucccagugcucaggccuucagugcacuuagacagcuguugguuguccccagaucaaggugccaguguuacauacugaggaacaucucaauauccuggucacugcugcaguucauaggcuuaacugcugaccacugacuccucucaaucugaagaauggggcggaaaccacuuagcuggaaccaaaccccuucaucauucaauacacucugcaagacauuccucugcacgggaagccguuucccuaggggaagcaacccucgcucccccaucucuucuucccccuaugcccagcguacauccauguuaauccaccuguccacagacugaguucuugaaucuggcagaauucucaggauuuucagagguguagaccugaaccccuggaggccauccugugguacuuaccacccagguacugguagcaaguucagacuugaauugguuuuacauauuuguagaacacucagagcaacauuggcagggagugucauccagugcuuuggggggacgggaguggcgagcaagcugucugugggacuuucuuaaaagauaagaauagcgugagcaacuaguaagugugugagugucugcucauuuuccuucagcuaaacuuccacaaaacuacacacaggaagggcuugccuucagaauuacuugcuguauucagaauaugcagugcuuuaaaggagugugugcuucagucuguauuuauuuaccuuucuccaaacaauucaguuugucugcuggucuugucccagcacuagaagacuccucgaagacuccucuugugagaugagggaguaaaggcuauuccagaggcgguuuuaucauccuuccaaccauacacagaaaugaagugagccaguuauucaccucgugcgugacgucuuccuguuucuuccuugucucugcagcgacguaugagaacuucaugcaucugaucauugcucugccgguugccauccugcugaucguuggggggcugguuaucaugcuguaugucuuccauagaaagaggugagugccugggccagcggaagacaguacuuguggcgcauuggcuugaugauuugaacuugaacauagcucgucugugggggaaaauaccaugcagacuggacagccagaguuccuagucagacauucuucagaggggaaaaaaggacauuuccuaaugacuaacagcaacaggagagggguugcuuccuucucuguacccgucgucugcuuucuggcuguucuagcacacagauugcugccuuguaagagcuucuccaagcaugccaguuuagcuucccauggagugggccuuguuauuuccagugaagcaaagaaacaaauguuucuuuagaagcucuaaucugaggccagggcaaaaguggaaagauuuguccucagauaccggggccuggaucaggagugcaggcaagggucccgucagcagugaucaugguuugcgucccuugcucaagauaacucgugagaaagaaaaaaaggaaaagaaaagguauuuacagaaauguauagagaugggauuuguugaccugguuuucaucuuuuuuuuuuugacagaaauaacagcagguugggcaauggagugcuguaugcuucugugaaccccgaguauuucagcgcagcugaugguaagcguccuggccaaggugugggaauaugggagcugucaggugcugacuggagaaaagcguugcguaauuuugagauaccuuugucccaggaucugccuuugguaccauuuccuucuugucuuuuaauaacaucuuuagcacucagugacugucagacauucugggacucucagaugccccaguagaaaccaggcucuggagaugccgguggccggucugcuaagcaguucaguuagccgcuugaaguguggcaucagagugaaaggagcauucuaauuacuaccgucuagucagaggacugcuguagccagccaggcauccugaguggguaucaacucaggguggggcugcaggcguucccuggccagugagggcuauauagcguuguaugaucuuggaaucccucugcuguucuauccugauuagggucauacagccuaugcacccauuuacauucccuuuggcaguaacuaaugaaagucauuuaauuaaauggcucagaaguucugacucggaaccuguguuuuagcuacuggucucuuuuuuuccccuagcgcuuaugcuuggcuucagaccuucuaaguaagcuggggagggguccucuccucgauuagcccuuggagcuuucucaugucuaucuagaugcaggcaaaaaaagaaucucugagaaggacuuguucaggcucccacagcugagccgugggaagucugcacaagggacaucccaagccuuccuccugaauccucaugaugugguguauggaagagcuagcugugagguugcugggcuauguagggaaucugguuagaugggggucugugcagcgcaggaguuuguucaggaggaauguuucuuugcuccagaaguguaaguagaugcggcccagauaagacacaguccgauugauuauccugcucacaugggaaaaaaaaaaaaaagagaaaacccuuuguaauuuaaaagcaccauguaagugcguaugguuuuacuaugguuucuuuaaucauuuauaacuggauuauguguauaguaaagccagucaagaacagccucuucugaauuugaaucaggugcagaauaaugauguuauuucuguuugcaaaaggucuugcagaguuauuuuuuaaguaggcauaugugcauacguuugugccuauaaagcauagaaaauacacuagaaggguaagcaccacacuugaaagcauaguuacauaguuacuuacggagacuaucuuucuccuaaaaacaaacaaacaaaugaagugaguuuggauauguaguuuagugauagagcauuugccuacgguguuccagaacggguucuguccucacaccaccaaaacaaacaagaaagcaaacgggcaaaaaucaagaaacuaaauaugcauuguuuauacaggccagccucaaacuccuggccucagaugaucugaacaccuugccuccguccccuaacuagccagaaccgugcagccauugugucuaggucaauaauuauaaaagagaaaagaggugccagagaaauagucucccuccccccuucaaaacaaagcaagaacaaacuugucacuacccaggucaacaggugagaacacugucaccucaucugcacuugguuuguuuggccuuuugacaagcacagcagcagcacaagccuuuugccucaaagagcuacaaagugacauugcaucugaaaggugcuuuaaaaacgucuuucucccagaguuaaucugcauguugcuguugucaagagugcacugagaaugcccuacaggaaagugcugauaacauuguacgaaguuuaugaacagcucuggcuggcaaagcugagguacucuggcuaaagucggcagcuggauugaguuuagaaaaaggguugagaccacuaacuucagggaccucccagggaauggaugugaugggcuuuuaacuccaugcucugcagcaagcaagccguguaguugauucucauuaaaagccagccuggauccuuagagguaauaaauggagacagugguccccauccuuacagagagguguuauaaagaccuuucccccucugcucuccucagcaagcucagccucugcagggucacaaguugucugaggcccauggaagacagaauucuaguugagaaauuaccagacauacauauuccaugaaauacaaaaacaugcacaggagccaaauguggccacacaaaccuggaauccacguacuggggacacugaggcagaaaaguugucaauucagggcuagcuuggauuacauagcaaguucaaggcaaguaugaacaagauagagcaguccuguccccaaaucagccaguaaguaagaguaagugaguagacagauaaguaugugucuuaguguucugcugcugugaagagacaccguugaccacagcagcucuucucauggaaaguggcuggcuuaaaggagcuuacagguucagggguuuaggcccauguuguaaugguagcaaacaugaugguauguaggcagacauggugcuauggugcuggagagggguuaagaguucuacaucuggaucaggcagcaaaaauagagcaagacauaggccugguauuugaaaccucaaagcccacccucggugccacacuuccuccaacaaggccacaccuccuaaucucugucagguaucacugcucccuaaugaccaagcauucaaaugugugagucugugggggccacuccuauucaaaccaccacaagauguauguuccauucuucaaaauacaagucaaugggguccccagccccgaauuuauaauaaacacccuucccuuaagacaucacuuagaaguaagggcuugugcucugagggugacugauaaccgugaugaccugcugguggggucucccaccuccaacugcagcucggcaucuaaaagcauaaaaacaaacacagccgugauuccccucccaggccugucucuaagcuagggcuuccuucuugccaugccugcuggccauccucuguuagacagggcugucaguaacucuguuagguuaugguucucauggagcagguauucucuuuccagaucuuacguauuaauuugauaugauuucaguucucgcuguacccacuggcguuaugggauggagccuguguuuggucuuucuuacuugccucucuuauuuucuuuccuucucuucccccuuccuucugagaacuauucguuuauuuauuuuucucaaaccagaucaagcauaaccaaaaauggaagcuggagaaggaauucuguucagguccgugucagggagguuccuggcauugcagagugcaggccaaagccguggggucacuacugagucccccuccaucccagcgcucacuucccucacuagagauccccuggaagggggcuccuaggcuucaccuguguuaggcaagaguuuggcuucuuguguuaaguuuuaauacuuucaugcauuccggggcuagagagauggcucagcaguuaaacacacuggcugcuuuucuagaaggacccugauuugauucccagaacccacgugccaguggcacccaggugcuaugugcguacagugcagaugcaugcagggaaaacagccauucacaaaauugaugguuuuaaaacaguaugcauuccacuaagucaaaucacuugaaaaacaacacagcacagcccugggauuaaacugcauuuuacagccuguagagcaccuugaaucaucugggauuugaacccuggguuucaucucccaacccugcuuuuuucuucaucaacgugugaguucuccuuccucucagguggaaaaggcaggcagucuguaucgucacuagaucucggugaaaggggcagcaggguguguuaaacuggauccaaccucugcagcuuccagaguuaaacagcuguauggaggaauauagggagacagugcuuguagugcacaagaccuaccucagcgcucugcgggggugggggugggggcuggccucucaucuccuuuucugcgguuucuuuugauggcugaggacucuucucuugagucucugccuuuaguguugacugaguuucucccucucagccaccuugagcuuguugucggacauggcuauggaagaaguggaaugaagugcgugaacugauagacaucccaggcggcugacacauugucuugguguuuugaaacacaaucugaagaugccuuuaguucagcagaccccaucuccaaccuccaugcccagugggcuggggugggacugcaguuuccuguugccacacccagcuaguagccauguuuuuuuaaguguaaaagcugaugagauaaaucuguuagaauuuucauuuagcccacaacauccaacaguuaauauaaaagcuaucuuuuuaaacuugcuuuaaccaagucuuuggaauacaaagcuggaaaaaaaaaugggcccagcaguugagagccuugcugaccuucuggagaacucuaauucaguucccagcaccucugugaagagaccucccgccaucuguaacuauagguccgagaagccaacacugucuucuggguuucccaggcacccaaacacggguggugccucacaucugugcaugugugugugcucauacacacacacacacacacacacagagagagagagagagagagagagagagagagagagagagauuuucacauguauacguaaauuuuaaaaucuuuuaaaaguuaucuuuuuuuacuuguuuuaagcaagucuuuaaaaugcaguauaugucuuacuuccagcacgacuucaagcgcugaaggccuacaguggggcuggguggccuguaaacuggcacccaggccaugcagaggauguuucucaccucuggcuucauccagggaggaggagauuugacccccuuugguccuuuccccucccacuguucuccccuucugaccuacauuuccaucccuugaugaagacaggcaaaacagaagucccacuuucuuugucucuuagggcuaauuugcuuuuuuuauuuuguuggguugggguuuugccaaggauaugaaaaaggaaccacuguuguuugguuugauuugguuuuccuaucuuagguuucuugguuuccuucugguucuuagcuacgaguaccacccucaaagugucauggaguccucagagauugaguacccgugcuggacuguuuguaccuugauguucuccuuggugggucuuagggaacagcaucuuguaaucucugucuaagggccguuuccauccugucuguuacuaguguacgugccugaugaaugggagguagcucgagagaagaucaccaugaaccgggagcucggacaaggguccuuugggauggucuaugaaggaguggccaaggguguggucaaggaugaacccgaaaccagaguggccaucaagacgguaaacgaggcugcaaguaugcgugaaagaaucgaguuucucaacgaggccucggugaugaaggaguucaauugucaccaugugguaagaagccaagaugagacauggacagaaaguauggacagaaaggaccacccuguauguccuuggccagcuacgaauuguugccuugcccucuucccaguggguaguuuccccguugcauucuugccacccacagacccuugaggugggagccucgcccucgcccucccaccagaacucugcuccuggcuacaggccccagcaccacccaguuccgagaggcguaggucaucaugugggaugccccccucccccucugaguccuuuucuugauuccuccagguccgguugcugggugugguaucccaaggccagcccacccuggucaucauggaacuaaugacacgcggugaucucaaaaguuaucuccggucucugaggccagaaguggaggucaguuuuguuccucgcuguguuaucuugcuugguccacuuuuuucaggagcuggcuuguaggaaacgugucuuuaaguccauuugcuucucagccuugagugccuugagauaugcuuucuugucaguucccucuauauaggauuguccaaguguaggcagacugggaucuuuggaaggucugucucugcaucccacccauucaaccuccagcaucucugugcucuuguuucugcauccccgcuaccccugccuacaucuuacaccaaccccagcugcucuaccacgugucauggccaacccuucccacagcuucccacucaggccgggcuggccucccccacugacuuuccaguacacuugacugccuagcauacguuuacucucgagguccucggggugagccucuucuuuaccucagggucaugaccguggcugguaaccuuuucaguaaguacucaauaaaggucacucuucagguugucagagguuuuggccagagugacucgcagcccggucugugcacgagaccacuguuuccucaggagcccauuacacacacacacacacacacacacucacacacacucucacacucgcauacacacucacaaacacacucacacacacacacacacacacacacacacacacacguguacaugugagcaugcuauccuuaccuugauggcacacacugcucuccccuugccccgacacugcuucagacacuucucaaacccugaaccuacuccccaggcuaggcaauaagccaguauugugccugcgcuuuuaaaugauaaccauuccagcugcaugauucugcuuaaggcuagugagauuuucaaacugugaaccugaguagguccuguguaauuuuuugauuagucacuguggaguguccccuucuguuguguuagcccacagccagcuuuuuagcauaugugagucugacuucuuuuuuguuguuguuauuuuuguguuuguuuguuuguuguuuuuugagacagcauuuuguuuuguuuuuuuuucugugcagccccggcuguccuggaacucgcuucguagaccaggcuggccucgaacucucagagauucgcuugccucugucucccaagugcuggcauuaaagguaugcaccacaagcaccuggcuuaaguuuggcuucuaaguccucacuaagaguuaacugauggggguguugagaaauauugcuggaccaaaugccuuucauggggcugccucaggcucugaggcucucacuucggcccuggcuuugauaccuguggcuaacuaagcagcuugucucugcauucgcuguaaggggaacuuccucuucucgggcccuuucuggguuugcuccccuucucuguagaagcuuucguuuucuuuuccuccacaacguaaucaucuaccaagugauggaugguuccuucauuuuaguucugaguaccuguucacaaauguccucauguguguuucugaaguuucaggagagagccacaaggcgguguaugcauugauagcagagccacaaagcuaugccuguuucucccagcagcagcauccuaccccaguaauacccagucuacagaaggagacuggagagugguccuuuaaggcaccuccuaacaucagaaugugcuuaaugccuuugacacaugcccagaguaaacccguaacuugugcucucggggcuguuuuugccauugguuaccuccaguccucaguuaacagaugccucugggccuccgcuuccucauguagagagagaaagggcuauagagauggcucagcaguuaagagcacuggcugcucuuccaaagaacccuggguggauucccagcacccacguggcggcucauaacugucgguauucacuguucugcuggccuccaugggccuccgugggcagguagugcacaaacacacaugcaggcaaaacacccacaaacauaaaacaaaauuuuaauucaauguaaagagacagguuggauuacgaaagucucuuucggaaguaaaacuuaaucuuuaaauucaucagaucuaaauuuugucuaacucaugucagaauuuuuuaaaaaauaacuuacauauaucuuagcaucaauguauacuccacaguucaguguauauacccuagcuccaguauauauacccagcuucaguguauacaccccggcuucagcguauucuaccuccccccauugcuguuugcuuauuuacuuagauaaguguauggaugugugcucaccuuaagaggcucuaacaaaacuaaagauuucuucuuucucgagaugaagaaaagaaugacaacauauuaccaugaacugacaaaaugucagcccagcccuuuccugcacauaauuaaguccccauuguugguuguuuuucacauguuaagugacagcucuuuguugaacaguuacacaacauuacacacauacacugcaguaugugucaugagccuauaaguacaugucacggaacugcagagguccugcuuugccauguguauguaagacccuaacggugcuaaaggucagcgugacaaggaagcaccugugauggcacauccucugaggacauccccuagauuauaggaagagacccuggaucagagugaaaaugguuaaauagauaaaugagcucaacuugguccucacaugccaugucgucuggagaguacuccuggacgugcuagagggcuguugcuggccuccuagagucuggcaucugcugagaacuuagcaacccuggccaagagccagaaugcucuugaguguucaucguggucagagcacaaagggccuauauacuagcccaaauagugugaucuccaagccuggucaugcucuccugugacuugagauacauuaggaaaugagauggcuucauaguguuguaugagaagguuuucaguuagggaaacugaggcauaagggucaugguugguuuugcacaugggaguggggugacggagcuuugggaauuuuuuauguuuguauguguguaguguguguguguguguguguguguguguguguucaugcauaugcaugugcauaccuacuuagaccuugagggaguugguuuucaucuuuuaccauaccugucuugggacaugaacauaggcccccugucuugacagcagguaccuuucccacuaagccauucucaucagccucuuagacauaaaucuuaucuuauuuuguuuguuuguuuguuuguuuaugauuuuaccacuucuuagguuaauucuuuucaguuccuaaggcagcaucuugcccuccucuucagacaugauauugguccucauugcugcucaguguccuugguccccuccaaggugaacuccaccugaacugugguuauccucagugcccguagaaaacaguaauccaagaggaaagcauuagucuuccuaucuuuguaccuuagaagaagggaaugaagacgaauaaguccuggcagcuugcacgggaagcaaagcucgugguaauccacuuaggaagugugucuguuucacguggccuuuguacggguucucuguccuuccucuuacucacacuuggugauggcggaagccaaaggaacauggaaacuagcuggagcugagaaugcuuaaugccuaaacuugcugauucacuucaaaucauuuuuguccugcuccaaauagaaaagacuaggggggaggggguggucacaggcauaaggaccagaguucaggucgucagaagccagguaaaggcugggcugguguggcagcacaccugugauuccagccuuggaaggaugaguugggauccccagagcaaucuauguugaccagguuggguuugauagggacacccugccucaaccaguggguagaagguagcucccaacauaagcuucaggcccccacauccaugcacaugcaugcaugggagggggugggaaaagagauugcuggucccuagaagugcuaguccuucuuagcaaguccugacucccugcaggugaccugugguacucagacuaaguaaauaugcauuuacgacuccuaguguagaccuacaggagguuaggggggaaaggucuccguugcucauggcuuugucuuguuuugaaucugcagcagaauaaucuaguccucauuccuccgagcuuaagcaagaugauccagauggcuggagagauugcagauggcauggccuaccucaaugccaacaaguucguccacagagaccuugcugcuaggaacugcaugguagccgaagauuucacagucaaaauuggagguguguccuuugcuuuccagauuggagcacaggcuaaacugaacucacaggugcugaggggacuuugcagucauuagucugccacuggagagauuuucauuauguccgagaggagcagugccucgcccuugagugcaaagauguauguagucggugugacugucuauuccuggcuguaacccggagagcaccuuaacaugguaguccagauuggcgcccugcuccccaggucaaacguuacagaaauaaucggggcagcuugcuuccugaagugguuuuggcuugaggagaaugucaccauccaguccaccccucaaguuucucagcuuacaaagagcauugucccugaauaggcccaugggguuccuaagaggccaggugccccuauggugaaacccugcauaguguaacaggaaggguauaugguggucaugucaguccgcgggagaucacugcugacugcuuuucacucauaggacuggucggcucuaaguucucuccuccucuccugcugccaggaauugaaccgagggccugauguaugcugcugguuaagccacugaggugcauccuucagugguagcuccaagcacuuggccguucugucgugcauagcuuccugccaugaccuuagcugcucagccuaccuuguugcugccaacacauugugauccuaaaacacugauugcauuacaucucuggucauuggcuagaaauucuccccagccuuacagcuuguauauuggcuuuguuuuuuugucuuuuacuucaaaaaaaaaaaaaaaaaaaaguaguaacaagguugcucagaaaaccauccugcauauacuuuaccuuccuacugcgauaggccagcaggucagaaacauaacaaguguccauccugagaacaagcagagggacagacgauguagcagaagcgaucagccacuaaccuuuggccgccucuugagcuuguguccuggagauguucugcuugccucaacccuagaagugguuuuugcaugagccauuccggccucuuaguaagcgaugggugucaucucuagagagguauccaaagucgggcucucuucuuugcugauugcaggaguuagggguguuggcaugcagcuguguuacagaacagaugucagucauuggaguuacugaagauacccccagccugucucuggguuuguacacucauauuuggagcccugggagccuagcuuggugggcagcccuuaagaggauaccccgccccagaguuucuagauaagaggcgcauccucuuaaccagccuuugugguccuuccugccucccaucccucccuuauguguggggaucuagauuuuaguccucagaggaaacugugcuccugaguggccugaggcaggugccuucccucccugugccaucuuuccccaccuguggagugagaguggauugggacagagcuggaggaggaggcgggcugggacagcaagccugugccccuguccucaucuuacccugcugugcacccuucucagcacagccaggaacuccgagaggcugcuuuggucccauuuugcauuacaguuggaaaaaugcuuuugugugugcgugugcuuuuugccauuuuaaauccaaaucaguaaggauuauauuuucugcuuaaccauguggcgcauuuaugaggauauuuucuauuauaauuaugauuuuucuuuuuagaauuaaauugugugugcccguuugggaagaggggguuguucuauuuuucuuuugcauuuagggagagagauuguuuucuagaauuccccuuuuaugcaagucaaagcagauccucucauuugcaugucucuggauuaauucagagaugagauuuaagcacuuccuuuuuccuccucgggcgaguucugcauuccucagugucccccagugcccccaucucagggauuacacacccuaaaucaguucaagagaggcagccaguagcucagacagcggugcaagucaauuguguuggguuaacauccaugcagagcaaacccuacauggguuugcucugccuuuuuuguaccucaccucuuuguggcaccacuuagaggugcgaggggacauuuuaaagguugagcagcucuucccuccagggaaggagaaugcaagaguuuaugugagggaaagguggugcgguugaguggaaaaucaaaaauggauaaagacacaguaaugugagauuauaaaaaagcaagccugccauucaccaugaugaaacucagaaaauggaaaacauuuucaaaacugagugagaguauuguguugggaaaggguguuggguaguagcuccaggagccuggugaagaacaucucagcuguuugcuguccuuuuaucuuccugaguucuuacuucguacauuguccucuguggaguggcaaaaggccuuuuccucagcaguagagacacacuaccaaguaaauggggucuucauccucccguguauuggaccaaacuuuaaaacuauauccucacccugugcggcguauauuuucuugaaaaaucaugguacucaaugauuuugcaaacugccucucgcuuuaaauguuauaagggaguuaauuucuuaaaggagccugaugaagaccagagaugucuuguauucuccugugaaguggcugugaugcuagagcccucucagaguggagcaagaacaugucucaccuugaauauggggggaaggacagggcucugccccaagaccugguccagccgaguaacugugcaucuucccuccagauuucgguaugacacgagacaucuacgagacggacuacuaccggaaaggcgggaagggguugcugccugugcgcuggaugucucccgagucccucaaggauggugucuucacuacucauucugaugucugguaugagaguuucccuccauggccagcuuggaccuucucacucguggcucauucuccuccuuguuuuguucacugugaccaacugccagccuugaguucagcucucagugccguuuagcccuuugucuuuuagauauuccuguguggaguccauuaaagcaaaaaagguaucugugggaagccaaggaguagguagaaccaacauuuccuuccauuuuuagcaaauauugauuauauuuccaaagacuggggaaaugccuucgccucugccuguucccccgucucucuuccccacucucagugaguugguacuggguauguaugugcuccugccgcagcucacgaaaccuucagauugaaggcagugcuuuauuuaaacccaaaacuugagucuuggugguugugguuuucuguuggucucaucuguucacacacacacacacacacacacacacacacacacacacacacacacacacacgauguccauuauuccugacccaaagcaucuuccuuaauaauaagugucuugcgguaguagcacacugaccagagggugcaaagacuucucuguaguaauguuuacugcaguuccuuggaaacaccguguggaggucaucggguuccaaaauacaacuggaguucuuggcaggcaggagcccuggcacgucgucccccuccucgaaugucagcaagugucuuggcugucuccucgggagaucccguugcuguugugucacagaagaagcggugguugguuuauucaaagggcggaugaccacacagagaaacuaucucaguagugacugacaucaguucuuuagccucgugaaccuuucccggucaagagccuuggaucuuguuuggaagacaggugcaaauuggaaauagccuuugaauaugacccagcgcggccugguuguuucccgacucuaggaugaggucugcucugcaauuagccucuccgagguuacaucuucucugucgaaucaaagaacucuguuccauguguagaugaggucgcaggagagggcacaccuagggccacacuuccaucuguuuguucuaagcuucauuuuucuggaagcuuggagaucaccuuacaggauagggaaagagugagcacagacucauucucccccgacucuggguaacaacugcaugccacagccagaggcgcacagggugcuuccugcagguuuccuccacuuggauuacguagccauuacaaaccaauaagaaaaugcgugaagagaaaaggccaagugcugggguguuugagcacacagcuggggacaucaaggacacuagaacguauaaacggaugcucagcucugccugaaccucugcuugcuagaggaauugcagucauuuuagaaugaauucacagucagaaguagguaaaaauccaaagaaaaguuggaaggauuuuguuugacuugguaggagaccuuaggaacauggugaggggagguguccucaggucaagccacacccugaccaucugcauuuaucacagcuguuauuugagcuucuggggagaugucccagggacuguccccucccucacaagggcaggaaggccagcccuuacacgucuucguucuuucugauuuauacucucuaucuuccuguccguccuaugagcagacuggcugcugagauggggugggauggaaugggaaguuggccugcagggaguccaggaggagaacagggugccagcaagaguuacacuggagcugacaugcugagucuguagagucaaguaaccagcaaucuagacauggcagucaagagcugggggccaggauugugacugaaugccugaaagccuguggugcaccagggaaagcaugaaagacaaggggagucggcuuggaagggaaccuggucaagaccgguugauaaaaagagaaaaccacauacaucacugcuugucucaggccggauucagacaugagggugagcacugcagccucuaaagaaugccuccgaguguccacaaaggcucugcaaggcagaacccaggccugaaacacacaggaaaccugcuucucuagggccaggucuuugaaaaccguaacugcacugucugucuuagugacugccgguucccaaggaacuugggucugauugcugagguucuguuccugucugacauugcuuagcaucaguugggacaaaacccuuuuguuccuagaaggaaacugaagcugcgaaccaaaaguuaagaugcagucagaggcuguugcuccagcuuaggccaggauccucagagugcuaaguggaaaauggccgccucaggcucuucuguggggcucagcccugcuaggguuccauccgaagccuuguguuggcuugccaugggcagccuucuucauucuagccauacagccugaccauaagagcagacaggccaggaagaauuuugugaaagcaaggguucucccugagaagguguguucacacugagcgacagugugaccauugucugucugaagugucugcaugcauggaucuccuuuaguuccaucuucugggcugacaggccauaccucacgcaguagaauccucgcugcuucgccugaugaguucauaccucagccagccucuagaccaagggacucuuuguuauugcgacacacccccuggccaguguauccuaccccaguucccuuccugacacagccaccucugcagccauggcuccugaguucugcaggggacgaguuuucaucuuccuugacccaagucaagauccuacagaacuuugagacauuccaggcccagcucccuacccuacaaccagcaggucagaauugcuuuggagagcccaagauacccauuguuuuaagaacccugaucagauucuucuugcggaggcguggagaaccauuagcaucaguauuucuaagcuggcaugaaagaaaucccugcaggagauaguugagaugcuuagcugucucaggucaguggccaggcugggaccugguccucugcauuccuugcugaacuagagcuaauuuggcuuauguccaaguaauggcugggaccagacacugaauguguccgcuguagaucgggcucuuaaaacugugagagauguuagaagccccuaacauuaauuaccucagcccuggguugcaguagcccuauaggaagccuuagcagugacaaaggggaacagaugucccacacguagcaagcuggcugguuugauguccacaaagugcagucgucacauugaggacacuuuuuuucaggacccagagucuaagaaaugcuggcaaggaggggacauggcccuucccaucccuuucugagcuguuccuguucuguuccaccuguagguccuucggggucguccucugggagaucgccacgcuggcugagcagcccuaccagggcuuguccaacgagcaaguucuucguuucgucauggaggguggccuucuggacaagccggacaacugcccugauaugcuguauguauuuccagagccacccacuccguuguguguggguacaggagaggauuagaaaggcucuauccugcugcugcugagcuuguuggaucugugacuuugugcugcuccuuaaucucauccugugcccccuugguccccccagugcuaauuggcacuuugcaccauggcgugcgucucagccaccacuacccccccccccccaucucccaucucugaaauacaugagcaauccuggcucaucuuuuucaugcaaaauuuaauuuuuaagacaaaaaugcaaguuaguuacuacugcugagccagauuugaaagcucuccccaagccccuggaaggucuauacagcaugcucacacagagcucuguggucaggagucacucucuugcacggguagacuaaagcucagagagccccagcacaaggucacagaccaucugcugucuucuuaaucccuucgagcugcauggaccuacagcacgguugagcucaucccucuuuggacaugcuuguaggcacacccuaggggggguuggugagaugguugccucgcuccacuucuguuaaaaauaacauccugcaucgauugguugugagaauugucacucgauggcaguacacacguggugucacguccaccuccgugcucagccagugugacucgagaaacucccugagauaaacagcuuacaaggagaagcauuucacauuggcucccagugugggagcggcagugggguccauuggauuuguggcgagguaacuguuacgguagaaaaggugugucagagcgcacagucucacuuuguggcuugaaagugaaagggagccauuagagaagccguucucuaccugugagucgugaccccuugccccuucacaggaguuaccugagaccguuagaaagcacagauguuuccauuuugccucauaacaguagcagauuacaauuauaaaguaguguuauaguugggggucacaacgacaugaggaacugugucaaggggacacagcauuaggaagguugagaaccccugcauuaaagggguucacaaucuuccugcuguaguccuaaaucuugaagauaacuuucuaaugaccuggcagccuccuaggcuccaccccucagaaguuaccugguguugccaaaauuggggaagaaucuuuccacaugugggccuuuuauuuguacucucuugaguagaggucuuucuuugucaucugauguugguggcucagugggucuggagaaugacacuucuuuuuuuuuuuuuuaaaagauuuauuuauuuuauguauaugaguacacuguagcuguacugaugguugugagccuuaaugugguugcugggaacaaagguugcccacuccggucggccccacucacucuggccuaaagauuuauucauuauuaaaucuaaguacacuguagcugucuucagacagcaccagaagagggcgucagaucucauuaaggaugguugugagccaccaugugguugccgggauuugaacucaggaccuucagaagagcagucagugcucuuacccgcugagccaucucuccagccccgagaauggcacuucuuggagugagguuucaaggaagacaugaagguauuccgauuggcucaucgaguacagguugagagcaguggacuugcauuugaugugcacacguuaagguggggcucggcuguugcucugcaucucgggguuaagcaucaaagcagguucccacugauaugucaggacccauacaguuucccagaaacacuucaaaacagguucagcuccacuagugaaagaaucccagggggguugucaagauuucuucacuucuacacaaaagacucugccuaccccuggccuucucuuccccagcgcagcgcucacucucguggcgccuuggauggugaggcaauguacagauggagagguugggcgugcagugcagguggugggcagagcacagagaggugcuagugacuguacucugaaucuugagaugucaaggugugggcuagcaucgucccccgugaggcuccaacaguugaaaaugucaucucacaggcuuucuaaugaaaccuaggaggagcucgaugaggugacacuagcuagcucagggucuccagaagauagcugcuggucagaggcagggcuucccgcagaugaagauacuccgguacguggggugauuguaaggagaucggauuuacuacagggcgguaggaacagugaugguucuguguagugggagaggccguggcuucucuguggaccacuccauagacugagaggauuucucuaauacacuggagaggauugguggugcuggggaccgcacgcucacucuuccuuccagccccucugcucugccacuaugauucaggaaucaacaaggauggagucaguguagcccagguauuuaggauaaucuuccugccucaaacuccccuagugcuuggauugcagccaguguuacugcuggugcccaacuaaaacuuuauauuggaauuugaauuccucucguuuucuucuuauaaaauacuccuauuuggggguggggcgugggggacuuguuaauuuguuuguuuuugccccagcuguuggcaaguguaaaaaaaaaaaacccucuugcuugggagggccuuacaaaacugaauagacagcaggccauauugagccacugacugguccguggccugcugugcccugcagcaucuucacggagaacacugccacuguggccuuucuaaacugaccuccgaaggcguacaggaugcagggggccugccuagagaagcucuggguucugagugcuguuauagcuuuacuuugaccucaguggugcagggcaguccuacucguccauugcgagaauagucaguaugugggcaaaggugaaaggauggaguaggagcauggcugccucugagucuguguaagggugugccccaccagccuugguuaggauaccaggaucagcacugucucacgagcugagaaaccguucaaaagagcaggugugaguuuuguuccugugguuugggccuggucacaggagagguauuguugguuuuuuucuuuucuuuuaugcuggagcaaacauuugucugagaaacucauggaacuccugaaguugauccauccccagcugccuggauuuuuuuuuuuuuuuuugguaugaauuuaauaugcuugggaaggagccaccugcuaugggaaaggcaguggacuuccuguucccagcauagagaggaggaagcuuacacacggaggccgcucuuggaugcgaaaugauugauucaggaggccuuuuugcuuugccauucagaacccccuuggcagaucggucuccuuucuaagaaaagaacagagugaagggaagggagccgggcugcuccaguagggaguguggugcccugauuuggcugagacgcugaugagaggaagauguguucugugaaaggauuuuuuuuuuuuuuuuuuggcacaguaagcaaacacucuugggaguagucugaagccuguugggucucacacguagaggaaggacuuccauggugugguucugaggcaggaacagcccuuucucuggccaugcuuuggucucgucgucccuacacaugaaccagucugcuucaggaguagcuaaguauccagccuuguguauuacaaaguguucuagcuuuagaggaaaggcugccaccaaacaccaggguauccaggucugacugucagugcaauagcucaguuugaauugaucuagcaaauucugugaggcugggucaggggagccuaucauucccaucuuuaccccuggguuucagggcuuuggacacagauuugucagugaacccugcugaggucaggggccagucccagaguucacggaaccuggagauccugaaacagguuccagcccucgugcugcagaaugggacgacgauguaagcucagccacagaauugauccauuugauccauuaacaucuccagagcucacaugccaagucuucgggaugcgggauucaggaaggaacuugaacguuuuacuagccgagcgucaccagcucagaugcagcugagacauacucaguccaaucugacuacuucuguacuuuuccucuccacccccaggaggcugggaaucccagucugguuuugucgagauaaauugaauagagucaucacaggcaggugacagugucugcuggacggucccuggcaucgacugugugccagcaacugggcuauauagcauccccgucuagguccuggcccuaaaacaaccuuaguugcuugagaugcuagaggaggacccacucagucccguaggcccuucugaaagucugaucccugcuaagagucacuacuaccugguacaguacuaacaggcggcagcagggguacuguauacaugagguccugggcauauuucaguuugccagugccucacauagauggcagccuguccagcugaagacacggggugugcuugggggcucagaagccaagugaggaaugggcauagcggugggcguacaccccaggauagcacucacuucuagagggauaggugugcaccuucacagagggacauauucuguaaaucgcggcuccagcucaucagagcuguccagugguuuuaaagugugcuuuuuagagggagcauuuuaucagcuuauuaaucccagagucuacuggagaguuuucuuguggaaagaguauuuaaaaaaaacaaaacaaaaaaaaaacaaggucuuaaaucgcacagagcaaaaaagacuuccuuuuaugggcagcccuggaagggcugacucugggaugauuuaaaagaggcaucacauggcuuguuuuuacugaugucaccucaucccuacccugcccguggcaccuccucagccccaccccccaccccuggccacggggcuuggggccagacacaucucauguucuugcccccgguugcacuuuucuauucagggcuaggccugucagccagagaggaaauugcagccuggccacggagcuaagcuccuugugucugcuucccauuccgauuaauccuucgggaaaugauggggaccggggagaacaagcuucugcagcagcuaaccagagcaagccggcucaggagaucugacugucuguagacagucgggagagcgccgucugcuagcaagaccaugguuacuuacaguaaagcugcauugucugacagccucacgccguuccagcucacucccugugugacuucagacaaaugaucaaaugcugugguuggugcuuuucccuuaugcauacaaugaggauguguuguaaucauuggaguaaagagacaucucuggcucucggggacugacgugacucccgggccuagagcuuuuaguaccuaccugcaaccugucaugugccacuaggaccagucacuuagagccagugagaauaccuaguuagccuggucuuugguccaguuuguuuuccuccgucgagacauuggccacuuaauugggauuuuucuuuaccuccagaggaguaggcaguaaauauuguaagguuccuagcuaaacagccgcugucucaacuacucagccuacaaaggagcuuagaaacagccacaggugcuguguaaccagcucugcucugguacaauuccgcuaacaacaggcuccaagcugcaccuggcuccgcuguaauugguuggcuucacccugggccuccagagugcuuaauucuuggagguggaucuccaaugcaccuuuuuucaguuuuaagauaacuaccuuccaccuggccugacuugauccuacagaguccaaggaagcuggccagaugggcaagaguggcuuucucugcacaggcaacuucaugccuaccaauagguugcuuucacacgccuuuaccccugugggauuauuugcuuuguaaagaaguguccugguggcccagugaucagccugguagaauguuagaagccuguucagggugcuuugagauuccuauauguucgaacuuccauuuguggguuuuaguguaaagcgucuguugagccaggaguuuuuauaaaacacaguuuccuggaggagcauagguggagagugcuuuggucucacacgccugugauugagagcugcuagguaccccuuucccucagaaucaugaccacccuguccuuguuuucugucgggccugugugucuguccauccgucagagcccaggugugguucacugcauggccuggguugcagaacuaugacuugacgagggcaucaagggaaugaacaaagagugugcacuuggguauagagaaacggggacugcguggacugggcucuggaagcucaguauguuuagcguauauauuugaacagagaggcagauuacugcaugcagauaaacaaggaagcaggauuauuauauacagcugaacauggaggcagguuuagccaucucugcagggaagccgucuugaggcuguaaacuuccaggggaaggacgugacaguggacauauucugcacacacugucagcacuugcaacucggaccucaggggaaggcuuuaccaucucucuaagcaagcaucacugggguagacuuugccacucccaugggacuggggcauugggguccuugacauggccuugcacgugucagcaauacacaccuucacuugcuuagggucuccuccacugucuacucccaggccuuugcuggucaggacgguggcugcaugagcagccuuucucuucuguccugugugccagcuggcccauguaacucucgaggacgaggaagcuuugcaaagguuugugaccuugugggagugauggagguacgucaugggcuuuauacuguuuuuaccuuggccuuguuuguagaagaaaaugaugcuuaggacuucccuugguucguuggcauccgacuugaaguuucuauuagaacucugcuccugggcauccuacaucuucaagacagggaucuuccuucaugggacauccucagugagcaggugcuggcgugagauagcaagcuugggauaugugcuccgucugucuagcaccccugccgccuccucccucaggcccacugccaggggcgcccuggugccaggaagaaacuuagaaauagcccuggugugagauacagagaauggugccugucaggaaagcugugauucucauuagugagagagagagguuuccucuucugguuaauguguggccagaagaggugcuuagacaggaaguggguuuuaucucuuagcagugcuaucauuaauacaaccguccaugguggaaucggugaaccaagacuugaagugagucugggcuuggcacuguggcugggccuggguucugggcaagauacauggcaggaugccagaggcauccagaugggaagcagagagugcagaggugguacaguucuucugggucucucuggcagcucauuccuuucuuccccaucacucccuuagguuugaacuuaugcgcaugugcuggcaguauaaccccaagaugcggcccuccuuccuggagaucaucggcagcaucaaggaugagauggagcccagcuuccaggaggucuccuucuacuacagcgaggagaacaagccucccgagccagaggagcuggagauggagccugagaacauggagagcgucccacuggacccuucggccuccucagccucccugccucugccugaaagacacucaggacacaaggcugagaauggcccgggcccuggcgugcucguucuccgcgccaguuuugaugagagacagccuuacgcucacaugaacgggggacgcgccaacgagagggccuugccucugccccaguccucgaccugcugauccucggacacaccgaagcacgcgccaacaguaacgugugugcgcccacucggugggcgggggggcggggaggggagagcagguuguaacaaucuauucacaagccuccuguaccucaguggaucuucagaccugccauugcugcccacgggagacggcuucucugcaguaaacacauuugggaccuuccuuuuuucaauaugcaagcagcuuuuuauuuccuuuacccgaacccuuaacugacaugggccucugcaaaccuuaaugacaacacuuaauagcaacaggacacucgagaauugagucucuucguucucugccuuuuucucuccucugccuucccucucugcccucuccccuuccacuuccacgcucuccuuucucucuuuucugcuuuacaguggaaaaauguuugugaacgcccaucugggaagccuucuuuuuuaaaaaaaaaaaaaaaaucagauugacuuaauggcugccccuggggcuccucaucaccccgcauacaccugccugacaccguaggucuuuuaaaaaaaagaaaaggaaagaaaaagaaaaaaaauucacacacugagauggaauuuuuuuuaaccuuuuuuagggucaccccaaaauuuaaaagggccauuguucauccguggcuaucauuuuucacgcugccauuuuugccaaaauccuguuuucgguuugguuuuucucacacgcauauacucccugcgcugauuucccuuuguccagaggcgugggaugaaccauggugucugguugaugauaacauuugagagacacgugcugaggccccccacugugcccggcucucccagcccacaucuccugggucucguugcaugguuaccguuugggagaacuggacaagauggaacucgcccuccuugaagaaggggaaagcagaacugguucuccaccccucccccacccacagcaccccaagaauucuggaggaaguggccaugggcaagcuugaaggucagguugugggucaaggugguccucacaccagccucgucccccuccccgaccucccuccugccccuccccugagggccacacacucgaaaggguuccggggacucggccuggcuguugguuauggauguucgaggaagggauucagagccacagcagccuggagccgcccgcccaggcaguggauccaagcagugugagcuuucacauggucuguuacuaggacuucuucaugggucucucaguucuauguuagaccgugaaacauuugcauacacaucgucuuuaaugucaguuuuauaacuuuuuuacaguucagauauucaucuauacaucuguacaggaaaagaaaagcugcuauuuuuuuuuuguucuuuaucuuuguggauuuaaucuaugaaacuuucaggucuaccccuucuuccuuucugcucacuccaagaaacuuccucugcuuaucacuagagugugguuuuucuuccucuucuccggcaacugaugcuucuaggacauaacuugccgugaacuguuugaugccuuuuuuauaaauacaucucccuuccccugcucccugcagccccauucauuacccucuaacccauaggcucugugagcacagucacaggugagggaguggggagggugggaguccagagcccacagacuccugggcccuacucucuccuuuccuugcuuccccgcacacagcaucugcuccagggcaaggcaugccacaaacucaggucagaaacaaaaagguuaaaaaucccacacauccugguuuaguguuucuagucccuguuguugaaagucacacuuugcuuucucuccuugcuuugguucacacacacacacacacacacacacacacacacacacacacaccccaauuugggaauacaauagcaguuuuaacugcagacaauagucauuggauuauuauuuaaaugaauauuugaucuuucacacacacacacacacacacaauagcugcugaguccccaggaugcagcagagcugguccaguggcccaucugccaccuccuucacaagcaggcccaccugucuuuagaaccagcuugucugaagggguggccucccugggagcaagauguaagacaccaacuccccauggccaggagcagcaacuuuagugggugugcuauaaagcccacucccgggccggaaaucccaaaguggaguagagcugacccuacaguggcccuagagccccuugcuguuccuccuuaaccagaaucccggagcucugggcuuggaggccccucccccuggagugggguugggggagggguccugucuuguuucgauuuagcacuucuuaccagagcagugacagcgcgagagaugcuucuggguggaaauauuuaaauuaggaguaggaaaacuguuggaugaugaugguugcaguugugacuggagauuagaugcaggaaggaaagcuggaguugucuggcuugucuguagguucaggcuuguggcucuuccuagccucugcccuuaaagggaaaaggaggggggaagcuuauuaagaagguauuucauguaggaguuuuaauuuauuuugugauaccuguuuuaaucacuguagaaaagccccuguuauggauuuaaaugcugaggaaaggguacauguaucucuguguauguguguauuagaugggacaguuuugggggguuuuuuugggggggcuuguuuuucaaacauuuaucuaccucacucuuguuuuucaugugugugugugcauauauauauaucacauauauauauauauauauaauacaucucacacuucucaguaccugacaguaggccaaugauccugguaaccucagccacuccgcaggccacauacccaggugaagcagagaggggccaggcuggauucugggguuaaagcaacgcuaacucaaaugagcagccucuuccugcucugucuccaaaagcccacuuuuccuagggcaacucuggucuuucuccucaccugguccccuacuuuucaacccagcagucaccaugagcacagcacgccaguggaggggggcuccccggcccauccucagcuggcugacuuuggaacagaacuuucucuacagauugaaugacugacaaauucuaucccuaagagagcagguacucccagguuuugagggcaggaggcacccacacguagguugucuugagagucccaaugugugcacaugucagggugcccugucagcccccucagcugcuccucugagaccugcaccgaggcaggggcaugccaccauugcucuccuggcauugguuccucuuggagguacagcggucagggagcucccccuucugcuucugacagaaggccaguauaaaaaagggggcaagacgaagccugugcccccugcaggcugcuguccuucccucuucuucccucccuuccccccccccccccgcaacccccagggcuaaacaaggacugaccaaaucuugaggcuggaaggccagugguuggcgccuagccuuccccgugcucugccucuguccacccauccgucugcugcucacagguggacagugcaauccucaacuccagcagcugcucuuacaggcccuggggacuucagcuggggaccgcgguggcuaaucuuuucccccaguauggagaaacugccuaacaguucgguuaagcucaggagcccuucgccuccugcuggaaugcugcccuucucuggguuccuagaugcucacagggucacugggagauacuguuugaucaggguuuucuucuacacuguaggugacacucugggauaguggccuauccucucgcacauaccugccgguuuuccacaacuggauuucuacaguucauucaauugauuuuaaggguuuuuuuuuuuccuuauuauuauuauuuuugaaacuguccgaguuguugguguuuuguuuuugcguggguguuauuuuuuuuuuuccuuuaaguagagagacggcaccaacagcguaguggccgucauaaacuaaugcuccagaaacacuucaauaaaaagaaaagguuggcuuguacgagggugcagucguucugcuggacugacgcgccccgacuauugcaaggcaucauauccacaguucuagccugaucucaugcugauguuccccgccucuuccugauuuuucucuuuacaagcuucaaguacuccuaccaagcugagucguggccuuuuucacucgagcccacccccacccaacccccccuucugauaggagcucacacugcuugaagucacaugaaccacugaggcacagcaugcaggugacgugaacauccaggugugcccccacacagcccuuccugaggcguggagauagagcugaaccugagcuggguggggcccacgcuucgccaucuccuuucaggaauguccuaacauuggauucagagaugggaugaggcucccuccuugagauauaaaagacuguucaagguugcucuuuuuccuaccugccuguuucuuaugacucgggacuguucaacgguaggaaaagcagcuucauaaacuagaaaagcgaucacggugagacgagcagauggcggagugguauacaggaguuuuuagggugggcugacagauggaugagcucuguaugaugccaaguccuaagccagccugagcucccggagccucggccuuagcagcccaccucuuuuggcagugccugugccugagguaagcaagcagugguggcaaggucacacugagcucaugugggugaggagucuaggaugcuuacccaaggcccucuguugucaucguuggguccucugagaguggccacagagugcugaaagcaucuccuuuccuaaacacuggcauccaggaggagacaggaccacuccaucaaaaugcuuuggcccauuuuagcaguaaugaauuuacgguuugggauuuuuuuuuucccuuugguuuuuguuuuuaauguuacuuuuauguuugucugaugucuuuucauuuccugggcuaagcagcugcauugggagaccuggaccagagagauccaccccuuaagaaccagugaugauggucaaacuuuuaacaguccacuuugaacuagguggugguacaaaugagaacuucaagacaggaugucuguguaaaauugaaccucucuugccagagaugcugaagauacagaccuuggacaggccaggggucuuugcuuugggcuuccagcuuggaugaccaguuggcgauuuagagaaacgaacauuccuugaugggaugacagagugacggugcaguaggcacccuugguaaccggcaucgugacaugacgggaauugcugacagaggguuaaagggccuggaagaagcauggaccauauuuggacuugauggugucugaaggugucagagcauguggaggcuggggagucaacugugggcauuugguuucagauaagacacuuggcauccugcucuggaaacuucuccuuagagcuaagucacgugcggaaggacucagacuccaucacacucaucagaugaguugucggucuggggcaugacguuagggauugauuugauuuugguuucugugagaacuucauaaucacugauuuguguguccacauuugugucugcaucuuuccaguaaaccauucuuuaaauuacucauuauccuuucaauagggcuucuaaguccaguagauuacggguagucguugacgaagcucugguuuacaagaacuaauucaauguuucauugcauuuuuguaagaacauagaauaauuuuauaaaauguuuguaguuuauaauugccgaaaauaauuuaaaaacacuuuuuuuuucucucugugugugcaaaaauauguguuuguggucuuuuuucccccucuuuguuuccuuuuucuuuuuugacacuuguuuacuagcuagcuuuacaauaugccaaaaauaaaaaauaaaaacuuaaaaaaauuaauuaaaaagaaauucuccccaggaccaauugugguucacccucuuucccacaugcuuucugcucuaguuuguaaaaaaauaaauaauaaauaaauaaaacaaaaaaaaauaaaacagauaaaaauaaaaacaaaacaaaaggaaugccagugguuuaaaaaguacuucuguauucuucaguaucuugaucuuggaacccuuugcuggggaaaggaauuaucugggacucacuguucccuguggaguguagcagcccaaacagauggaaagaacugcuggccauggaaauagcaguguguggccacccagcaaagagauggcacuccauggugacaucuggcugguauggcugguccuagcucugcaacacuauggagaugggaggguuucaggacacuggaauggcuucacagugaucacaugacucugaugugcagcccgugggcacaugugccucagauccuaacgaaugcugugccuaccuguaucuaauggcgaacgccgaagguccauuguuuucuaauacagaacaaacugguaacaaaaaccacaauguguguccccucgcccccuuuuuucaaauuaagauccauguccuuuggcuccccgugcauuauuggccaugucucucugguuccacaagauaccguuguugaaaacacauggaacuuucuaacacugcaggaaaaaggucugggaaccauuuguggguuugguuuggucuuucaguuucuuguggguguugggcagugugcagacacauguacagguggaguaggugccugccuggugacaaccccugucugcuuccuaugccagugagguugaaguaagaguuuugccagaguucaucuaccucugggauuuaaaaaaacaaaacaaaagucaaaaggcucgauggagcggacacaucgccaauaaugcauuucugaguuuucuuguuaaauuuuuucuuaaaaaaagaaaaaaaaagucuaaaaaagauaauaauauggccaauuuguuacauaaaauaacuuucuguguauaaauuauuccuaaaaaaaaaaacccucuguuuauauauaaaagaaaaucaguagaugaaaaaaaauucaauguuuuuguauauucuguuguaagaauuuauuccuguuacugcgacauacucgggauucuuuacauuaugaaaaaagaaacuuugucuauuuugaauggcuaaagcuaaggccacuugagucuauuacucugcuuuuuucuaguaguuaaaguaccacauggauuaaguuaaauaaaagaauucuguaugcac

SEQ ID NO: 3867 - RNA, 1377 nt, Mus musculus
caaaaacuguguauauguauaugugggugcgcuugcugccuauguguguaguauauggggugugcuugcugccuguguguguaguauauggggugcgcuugcugccuguguguguaguauauggggugcacuugcugccuauguguguaguauauggggugcgcuuucugccuguauguguaguauauggggugcacuuucugccuguguguguaguauauggggugcacuugcugccugugugugcaugugcacaggugaaggccacaguugacggugggugucgaccaucauccucuagccaucuccaccuugauuaucacuauuaucuuuacuacaacaucucccugaacccagagguugcuauuucaacgagggcgucuagccagggagaucccaggguccuguugccaaguccugugcuuuauuuggcugcuaggaaaccaaacgcaggcccuauguuuguggaacaccaggcacuuuaccuacugagccaucuccccagcccaggaugguguucuugguaccuauccuuguccaaggggaagcaccuauaggacucacaucaaugaaacacaauucauggacucucuuucucgauuaccuaagggauagacugauuuacaggugguuucuucagaaaucccaagcaucuuccaguggggcagaagauaugcaaccaguguacuuccgugcuccccuccacgugggccuugagacuugaacgugagacagaacuagaaaaauaccugaucaagaugauauuuucuuagcauguggcuaacuuaacauaaaauguuuaugcgucguugucucuggcaugggacuuucuguguaggugguggcagaguuccuguggguuucacaaacacuagagccaggagaguugcgauauguacccuccguggccacagcaacaggaaggaguuuccuaacccacaguguagguggaagguggaaguaucagagaggauguuuuuuucccacccccaaacuguuugaaguucccaaguguuccagugggacugcaugagagcggugcucuuaggaguucugaacgcugggcuuuggaggccaugaucucgugccgagaugugcucuggucggaauugcugccuacaauacccuguggguaaaacggauauuucgagcaugacugagcuuauuaagagcccuacagggcuuccucugcugggguuuagaaauuucaaaggguuggggaguggguggagggcaggauuacggacacgcaguguggagagggcaggaggacggaaguaucaggcuugggaugugucauuugugcuguugaauggcaccaggccagcgugccagugugggcugagaaugucaauuuaggaagauacagugcaggag

SEQ ID NO: 3868 - RNA, 1377 nt, Mus musculus
cuccugcacuguaucuuccuaaauugacauucucagcccacacuggcacgcuggccuggugccauucaacagcacaaaugacacaucccaagccugauacuuccguccuccugcccucuccacacugcguguccguaauccugcccuccacccacuccccaacccuuugaaauuucuaaaccccagcagaggaagcccuguagggcucuuaauaagcucagucaugcucgaaauauccguuuuacccacaggguauuguaggcagcaauuccgaccagagcacaucucggcacgagaucauggccuccaaagcccagcguucagaacuccuaagagcaccgcucucaugcagucccacuggaacacuugggaacuucaaacaguuugggggugggaaaaaaacauccucucugauacuuccaccuuccaccuacacuguggguuaggaaacuccuuccuguugcuguggccacggaggguacauaucgcaacucuccuggcucuaguguuugugaaacccacaggaacucugccaccaccuacacagaaagucccaugccagagacaacgacgcauaaacauuuuauguuaaguuagccacaugcuaagaaaauaucaucuugaucagguauuuuucuaguucugucucacguucaagucucaaggcccacguggaggggagcacggaaguacacugguugcauaucuucugccccacuggaagaugcuugggauuucugaagaaaccaccuguaaaucagucuaucccuuagguaaucgagaaagagaguccaugaauuguguuucauugaugugaguccuauaggugcuuccccuuggacaaggauagguaccaagaacaccauccugggcuggggagauggcucaguagguaaagugccugguguuccacaaacauagggccugcguuugguuuccuagcagccaaauaaagcacaggacuuggcaacaggacccugggaucucccuggcuagacgcccucguugaaauagcaaccucuggguucagggagauguuguaguaaagauaauagugauaaucaagguggagauggcuagaggaugauggucgacacccaccgucaacuguggccuucaccugugcacaugcacacacaggcagcaagugcaccccauauacuacacacacaggcagaaagugcaccccauauacuacacauacaggcagaaagcgcaccccauauacuacacacauaggcagcaagugcaccccauauacuacacacacaggcagcaagcgcaccccauauacuacacacacaggcagcaagcacaccccauauacuacacacauaggcagcaagcgcacccacauauacauauacacaguuuuug

SEQ ID NO: 3869 - RNA, 12251 nt, Mus musculus
aucauuaguauaaccauuuuauuaacaaaaaggaacccaugggguucaaagaagaauacaaaauacaaucuuuauuuuccccuugguuaaauuauuacauuuuuaauaaaaauuuuaaaaagcaagugaacuuaccaaaaaaaaaaacacaaccuuugccuacugaguuucuuauugugcaaaacagagacacagaaaguaaaguugugcuccaggggaagggaagggucugugugcaccaaaagaugcucacuuugaaucgcaagcuuugugcauccaaaagaaaauccuaagggcacuuuucguuuuucccaaacuaaaugagagcaagaggggacuagacaggcaaguguuagcagcuaaaagucugaucuucagucacaggguuucagauguaguuuucuacauuccuguuauccuggguauaagcuucaggccagacagacagguauaaaguuauaucuuugcacucuucaaugccacuguuagcugugcuuccguucugugggggacuucaugauuucucuaaccaacccgacugccagggcuuaucuacagugagccacggcgcuccauuuucucucuguccacuccguacuguugcuuucuuucccuccauuuugguuuuauggauggaccaugacuugacauagcacguaaacuacaggcuggaagcuaaaaaaaggacagcucaccaucuuuuccauggcaaaaauaaaagcaguuuagauggaaugugaacaauccuaacuguuuacagacacauaacagaaaagaaaagaaagaaaucucuaaaaaaccaaaacaagaaauaggguuccguggugauucucacacaccacaguuacuggcaauaccauuuggcauuuuugaaaauggcauacagugacauacaugugacugacgcuaggaugaccacaggagagguaugcucagcggggagaaguacacauuuacuggacauugguacaaaaaucccugaacgaaugcuccacugacuuuugauauaaaauuucacacuaggagaaugucucuaaggaaacauggugacugaaagguaaguccaucuccacgauggguguggcacaacacucugccugggaagcaccaggguuucuaaaucaaacccuuagaauuuggcuuguccagcucuuaacugugagaggcucccucccaccuggugucagaaaauuuucucaguucaugggagcaacagacuggaggcugagcaugugacugugaacagagggaggaggcugguagagacauggcugacucugccagcaacaacacaguccuuaggucuuaauauccugaggcucaaagacaacaaaauauugcaccaaaacaauuaaaaaaaaucacaguaucaauguaauuacuaauguacuggaacacaaaugcacuacacggaaacugucacccacccacuggggccucuucacaggaaccaaguuuaggcacgcuccuguccucuuuugauuugggauuucuuaagaucuuagguguuuauauuuauuucuauuuaaugcugagcucguggacauuucccuuggucuaguuuucaggucaagugacagguugagaggagucugcuaacugcauagagcagaaaccccagaggucagccaggccuggacuuuugagagcaggucugacaaagccacuagagguaggauaagagaacacucuguucugugucaguaucagguaucccaaagaugucccgccuacuccuccuuuuucuaauauucccuagguaaauaagggacgaggaaaaucaaacauagacccugcaagcaguucuuaaaaguguaaguacagcccuucacaacacacacuuucaugaacaguuccucuuuuccuuuugauauggcaagcuguuaaggaaucccuucuagcuuccucacgaaagccuggagccacugucaguuccaucaggaugucacaugaccacugacuccagcaaggaccuggauccuugcuaugguaacaugauaagaaaucaugaagaccccaaggucuggggaguucaacugcauugaaaguagaccacucgcucauucucacucauuucaaagcugucuuguuccccaaaucaugucuuccuaccaaguccauaaguucacaacugugugugagcccuggucaaagcacacuccaguaacauucaguaacaucccagguccuaagacgccucugcucaacagucugggcacucuuucacuuccucucucaccaccaggacuucccguuuuccaauuccuauuuucauccacuuuuaaagcgugcaagggagcccacccuagaauccguguaaccauuccccuggcccacuaaacguucucaucuucuuucauuucucucaucuucggacuugaaguucaccgauguucugaaguuaacuuucucuuucauccaacaaggcaggcgaaagaaccgauauucuaaguugguaacaacacagugaagucuggagucuguucagagaaugaaggauacaggcugggucucuugggcaucaccaggauguggaucaaccuacagagacagaagagagaggugacggccauagcaccuugguucuccuaccuacuucuaacuacaugauagcuguaagccugagucgguaaccaccugucaugaaguuccuccacuggugacggaauucucuaucuucuguggcaaaauaaaacaucaucaaggcaauccacaaugcugcaugacauagcucacaagcaagucaccagaaaacgcgguaaguggcugugauaaucuaacacuguaaggacaaguuuauacgcauacccuaccaacuaggagucagcagcagcacacuaaugaguggaggggagugucugcagacagcguaaugagucuaauuuucuuuaccucugaauaaagggggggaggcuggaaacggaauucuuguaugcaggcaaacauugaguagcaggcuuccccgucacagucagagggcugaggguacggaggaacgugucgggagaauucuucuuccgauaccacaucugcauaauuugguggugcugaaacgggaauggaguuugagcuaagagagccauguaaaaaugcaaaaaucacuacuuugugucuucugaacccuuauaaaagcaagagauggagucaaacaagagauauuauggccaccacaagacaaguuuugguucccuuaauacacagcuacuaauauugauuauucuauuuuuaauuacauucuacuuuuuuugugaucuacauguuauaaccuaggcaagcaaauaccucugagauauagcuauagaaaauaugcagucuauacuucuacuuuaacuaucuuucauuguuuuaauauuacaaauuagccuuaggagauagauggccauuuuauuccugugcaugucacuggcuuuguguccuagcuaaaguaaacauucaagguuccuuucccaggaauguuguauaauucuucguaguacaaaacaauugaguaguugugauauucaucuucauugucuaccugacaggauuuagaaucacccaggagacagaacacaggccaugacugucagggagcuuccagagacuggacugaaggaggaagaaccauuuggaugugggcagcacuguccacuggccaggaccucugcucagcuaagagaggcauccugggcaccagcacccauuacccucugcucccagauuguggauacaaugugaccagcugccucucaccccugcagccaaagcuaaaacuuuccacacggccauaccaagcugcaccuuuaaacucuaagacaaacaagcccuucucccuugcugugcccucugucaggcauuggucacagccauguagacagugauguggugggggagagcugacacguguacaccuacuccuggcgugcucuguugucagcuagucucucucuaacacuucaucaccuaugacuugaauguuuuaccuucaggcugcuccgguagggccagugccaaccagcacauguccauacugaacuggcuugcgacacugcuguuucugcggccaaagccacuguauggaauuguaccaauaaccaaaggcagcuccagcaucaaucuuuuagcaccagggauaugaauguauaccugauauguacaaaagaagaagcaugcgugagggcuaggaagguacagguuuaggguaaaucuuacgggaacuaagcuaauucaauguccuucucauagaaacaaaugucuuuguaucccaccaagccaccuugaggacaaauguaaauuguccugacuaagcauaaaugaagaacagacaaaaugaagaguucacuaacuauaggacaggcuugugacagggaacuguggccuucauguguuucacuguaaguuggcacgacucguaacauuccuggaaaaauuaaccuacgcgccauguaacaaacacuccucauaucaucucacuuccuuuaagguuauugcauuaaauugccccagguaaagauaggguuuuaacagugaaggccagucuucauguaccccaaaaugguagcaauguuaacauuuuuccaaguauugaugcaauaauuagagaucacauuugcaaucgcauggcuugcugcucuguuuuauguauuuuuaaugauucaagaagcuuggauuacagcuaaggaguaguccacucugaugaugcagcaauccaggauggauggggugacaggugggaucuucagcaucuucccauuccagguguccguacucccagaaccaaugugguuuccucgaacauuggcaaccaugugccggacugucuuugucuuuccacuagccaaguacgucuggguuuggaauauggcugccuugggaacaaccagccgagaugaacaauuuucuauuucugcauagauagggauagcuucuccuaaagagagaaaagaaaugagaaggacucagggaugguuccgaagaauuucaaggcauugcuaaaaucugcaccagccuggcacuacugaagcuucuguggggaaucuucgagagaggaagagacauucaaggcagaggcugacauuuaauaccaacugcacuccucacuuuuccaguguaaaaagacaccaaugcuaugucaagauguguaaauaagcaguaugcauaaauuaagcuaaggcacaugcagaaaugaugcuguaggaggcuaaguagaaagcuaccuagagcccaggaauaaaaaccggccccgcagugagcgaagccuuugcuucucgggaacucacaggguuaaggcacaaacaacgaaggggcagacaaguuaguccacaacauuacacaucuauacuauaacuccccgagagcccugugaaaaguaaagucccagcauuuucccacucuccuuagguuuacucagugacugaagccaccagauuagagucagaaaagcagaauuauuauuggugacucuuauucauggucuuuuaacaugugaauguuaauuacuuguauuuuaaaauacaauguccuucauagguuguaaagcuugcuguuuaaaaucauuuugaucaugcaucuguucugaggacuuccuaucuguugcuuaccguuacaguagcccuuucucucgaucuugacgcucagugacacaggaccagaggugaaaagccaacagccaaccauuuucuccugcgucuucagcauaggagucuuggaaguuacaaacaaaaggacugucauuaaaccaccccagaaaacuuaucuuccuuugaagaauaauuauaaagaaauauccauccuucacauucucaugugauaccaagugcugaaagccauuuccuucucaugaaaacuagaaugaagucucagauucaagcuugugugacaucauccaacuuuauccuuuagaaaagugaccaaggguccuauucauacuguaaauauuacagaucugccauuauauacaugguggguaugguguagcauaugcacagugugugcacacggggguguguacauccaugucgggacaugcagaaggcagaggaaaagguccagaguuuuuuucuaucacuuucuucuuuucuuuuuuuuugagacauggucucucagugaacccgaagcuugccuuuuaaucuaggcuggcuacccuaucagugagcccuugggauccaccggcuuccauccccaaauucuaggguuaaaggcauguguguucacuccuggcuuccgcauggguccugagaaucucaagucuaguuuucuugcuuucagagcaagcauccuuacaccccuggccuuucuuaauagugugacagaauuguguuuuaaggcaaugcaaagaaccagaaaucuuuacccuguuucaagcaaaauguuacacugccuggcuaaacuccacgggauaagaagacagucuuuuugcuuacauaucagacagaacuuucaggucuccugggacuagccugggggcuuuaaagguauccacauaccuugugucagcaggccugaaaauguggggaagcccauucccgcccacuauaggauucuacucuucaaagugagcaaaacaacucagcuguucuggucacaaaacuucaagcuuucuauaaaaugcggcggcaggcuagcuuuuauuauucauuuauuuuagauguuauacuaaagucaaguaucucuuuuugacaaaaagcaaaccucaauaagugauuuucuguaaaaacuguggcaauuuuagagacaguuuuaaaacucuacacaagcuuaaaaagauauaagcuacuaaugccacugcuuuuccaaaugggauuuuaagaagccguucaagggggccugugccagggagcagggagcagggaggagcgaggagcagggagcagggagcugccuaacccaugcaugcacgucuuucaucugucaucacaguuauucuacuucuugugaaaauaagaacuaacaaacuuuuagcucccagcuuuucccuugucuuuaaaaauauuaguuagaaaaagaaacaucuaaucguaaaacccacaucuuucccacaucagugucuugaugggacgaugggaaguuuaagugaucccagcauuauuaucuaugaaguaaaaaauaacaccauucauucauauuuaaaugaagacccauuugguccuagcagcuuucaugaaaguagaagguauaauuuuauauuauuuugauaauaugggugcagauaaaagaauguagcucauuaguccccaucuugccuauucuguuguuccuuauagccugauccuccuuaccagccuacaguauuccugaugauuauuagaaguucaaugccuuaauguggccaaaucugucauaaggaaugguaagugaaagggcuguggcagcagcugcacacacuuacuuaauguuagaaaaugacaugcagaauggagggauacauagcauaauggccugggcuucaauaauaggcugagugugauuaauacucuuucguaauuacugcuccucaaccugcuauuauuggagaguuuagaaugccacaguccugagaauauggccgugcugguaaaguaaccccucucuucuuugcauuauuguuauuaaggcucauuaaugcauuucaagccuguguaacuuuuuggcaaaagcagcccugaacagcagggauauaaucaauagcauuaauacacacaauuuguaauuugcccaaccuagaaucauaucuuuauagggaacgccuauggguugcauugugcuuccugaacuggcggacagugacuaaaugcaggcaucauuauugaaaggagggaagggcagagcuuaccaauaagggcgguguguugacauccacgugacugacaaccuggagcucucgucugacgcucugaucuggaacuuggggucguuccaaaacagcccucacacaguacugaauacugccauacuucccaguaaacgauguugccaaaggucugaaauaaaccaaagauauugcucuaugagcuuauuuucagcuauucagagccaggaaaagcacccguuaaaaugugggcuaaggaggaaaagaacaauaagcacagggagggucccacagauuggcacacacacuucaguguuggggaacaccgggugcucaaauaauggauguaaggcagggggaggaaauggaaaacauagcaucacuuacucagacggaagcugaaagcgaaagggaaacucguguuuuccugguuguaacaaggugacaccuucaccugaaaaagaccauacugcauuuuaacgaaggccagcaguaaaucacgaguucucacaaucuaagccauuuuuaaaaggugguuuuccugccaauacacucuaaguacauuaagcagacugagagaauuaaauuagaauuugucuuuuaccaagaaacaacacacacacacacacacacacacacacacacacacaccccuuuuaucuacaaaaugaccaauuauacaauuaucauaaaguauuaucuagggccaaaaguucgugugcguguguaaaauguacauaugauauauauauauauuguauuguaauauauaauauauaaauaaauacaguauaugugcauauacagacacauguauacacacauacauuaauuuuacuaacaugagauaucaacauuaaauuguaccuacaacaaauugacaaguuacaugucuuuaguuacacuacaauauucauucuauguauucuuugaacagagguagaaaacuuguuaacaguguuaguaauaguuauaaacaaaacagccaaaguagcaagggccagcucuucacccguuagcucuacugagagugaugggguuucccuucuccuguuccugauagcauccuucaacuucaugcacggauuuguuacugaacaauggccaaaguccaggaauggauggcguaagaccagaagcaccagcagaagcuaugaugaaucuccauagucaaucuguuuaauguggauucagaguggagcccguggcugccacucuggucaguggcucccuauggcaugugacagacuuucccuucaagaucauaaaagcuauacauuauggguggagguaauccgaugagaaaagauggcagacaacuugauccggaauuugucuugcuaccugaauuuguuucuacuuuauguggucaaaaccauuaacaagauggguuucuuugguugacuuaucaacaacgcaguauuucaguccugugccuuuagagaauaagaaugcaucacugacucaacgagucuccuaaaccuuucucucuacuuuucacauuaaggagaaacaaggaacucggguccacuuuguaaagaaagacaucacaggcuggugaccugaaggcaacgugaacaauaacuagucagaagaacacagguucagauuacauggugugaugcagugugcaucccagaggcucccuacgugcaggaguggacggccacacaagccucaggagggucucagcagagcuagaggccuggagucaagggacacuucuguaccuuaucgcuuccaaggggcucauuaggcccgcagagcugagauagagugugaucgccaugugacacaugacaaagugcacacaaauguuuagcaguguggauuuacuggacuuaaauggcaagcucgggugauaaugaggaugaauacuucgguccucaaaagaacaauuggaggaaaggggaauggauaucugcaucaaguaaagacuacagaguccugaaguccugagacuucauggugggccugggagcugaggaccagaauacagaugagcggguagaguuuggaugaagggaacgggcauguagaguugcuagcauacuaaaaagugaucaagagagaugaagagccccucaagaagcaagccaacccaggccuuacaggacuucaaaugagaaaaccaauuugaggaaacggacaaacgcuguaauaccgaguaaaaagguuucuuucucuuuuuaauuuuuauguuuaauuagaaacauucagaagauguaagguguggccauuucugcuucuguuuuauggcucucacuguuuccaccuguccacugagggcuacaauguuaaaggaagcugcuuuauccaccaaagcccuuccaaccagagcuuuucaugaaaccuuuucaugagcccugggaucuagaaacauuguagaggggacgagaggggcuguguaaggucacacucuggugggugccuaugaacugaagcuaauucucugcuuuggucccugggacuuucuuauauccuuggcuaugagccuagccuuuaauggcugagccaucucuucggccgaggugucuaggucuuucuaucacgaucuuuuuucauaaggacuugaagugguucaggcacaaugauaguaaguggcucaauaagaauaauaauuuuaaagaauauucugggaagauuuuuaaaacauagauccaacaguuuaaaauagauccuaggggucaacaguuauuuaaaaaaaaaaaagaucacccuaggucauugaaugauaacuaguuuaugaaguuaaugacccugagaaucugugucaaguugcuaaguucuuccaaguuguaaguaugugggggaaauguucccccacuccuuaaauaaaagcugacuuuaagcaaacuauaaccauugcuaacacauucuaggaaaacuggcagcugucuagauguagcuguuucauuagaacaaagcaacaagaucuuacuugugagucaaaaccuauuuguuagcccagauguuaccaaagcagcguucaguucucauccuuacaggcgcaggggccgaaucuuaaacagaaaccugguuaccucucgcugccacggccuucccuccagucagccaccuuuaacauccuuguugguuauuaaucacugggagaaaagacuccuggaauccacagugaggaaaggacauuaaagcagguagagcucucaccugccacaccccauuauccaaaauacagcucucguuaggcacauauuugaggauuuaucuggacaccauuguacuucuccacaggaggauacgaugcacuagguaguaagcuuaaggcauuugauagguccaagaugaugaggcagacagauagaaguuuacaauaguuuccacugagagaagacugacucacgguuacuagcauuuucaugaugaaaugcaaucacaugaacccaacauacauaugcaugggcacuucuggaaaagucagaaauggcccagauggcaggcauugucugcaaaggccuuucugaauggggagagguaagaggaaggggagcuacagcaauggauggcucuuagugagauucauguuccccagugaggagacacuucucucgaacuacccaaguaccacuucccuuuucccaagauuuaguuuucuguaaaucaucaugaacccgggagugucuagggccaggacaggcaggagcagcaggccaucaaacucugggcaccacauaacagaaugucaccaauuccaccuuccaugccuccaggugaggaaggaccuagaacccagacagucagauggcggguuuccauggcaacgauucuguaauagguuacuagaagaucgcaggaagcuaaguucaaagguacacaccaacacaaaagggucuggccuccuccuagaagccagguaggggcacaggcuuggccuccugcccuucccccgugacagcagaugacuccccuuccagaagcuucccucagugccacccagcacccagggacgcgccccuucccgccccccucccuggggaucuccaagcucaccagcuggggccuccagcagacucaaccgcagguucaaguauuccacuucugaggaggcugcgggagagcccccaccgaugcagacccuggccccagcgcucgggccccaggcagagguggcacggcccugggccuccaggcgcaguccgcgcagggccaccggcucugccgccuccagcagcacgugcccggccacugucucgccgcuugaguagcagcccuugcucucaucuucgaacacuagccccaagcucuugacacggccccgaggaccaucggcucccgccucgccucccauuccgccaggcgaugcggcucugccaccaagauccgcaguggccccaggucgggguagccggcuccgcgacgcugcugucacgggcgccggccgcacacccagggccacuacggccacagcgcccagccgggugaaacacccgcacuggggcccugucucuuuaacacaccccacugg

SEQ ID NO: 3870 - RNA, 12251 nt, Mus musculus
ccagugggguguguuaaagagacagggccccagugcggguguuucacccggcugggcgcuguggccguaguggcccugggugugcggccggcgcccgugacagcagcgucgcggagccggcuaccccgaccuggggccacugcggaucuugguggcagagccgcaucgccuggcggaaugggaggcgaggcgggagccgaugguccucggggccgugucaagagcuuggggcuaguguucgaagaugagagcaagggcugcuacucaagcggcgagacaguggccgggcacgugcugcuggaggcggcagagccgguggcccugcgcggacugcgccuggaggcccagggccgugccaccucugccuggggcccgagcgcuggggccagggucugcaucggugggggcucucccgcagccuccucagaaguggaauacuugaaccugcgguugagucugcuggaggccccagcuggugagcuuggagauccccagggaggggggcgggaaggggcgcgucccugggugcuggguggcacugagggaagcuucuggaaggggagucaucugcugucacgggggaagggcaggaggccaagccugugccccuaccuggcuucuaggaggaggccagacccuuuuguguugguguguaccuuugaacuuagcuuccugcgaucuucuaguaaccuauuacagaaucguugccauggaaacccgccaucugacugucuggguucuagguccuuccucaccuggaggcauggaagguggaauuggugacauucuguuauguggugcccagaguuugauggccugcugcuccugccuguccuggcccuagacacucccggguucaugaugauuuacagaaaacuaaaucuugggaaaagggaagugguacuuggguaguucgagagaagugucuccucacuggggaacaugaaucucacuaagagccauccauugcuguagcuccccuuccucuuaccucuccccauucagaaaggccuuugcagacaaugccugccaucugggccauuucugacuuuuccagaagugcccaugcauauguauguuggguucaugugauugcauuucaucaugaaaaugcuaguaaccgugagucagucuucucucaguggaaacuauuguaaacuucuaucugucugccucaucaucuuggaccuaucaaaugccuuaagcuuacuaccuagugcaucguauccuccuguggagaaguacaaugguguccagauaaauccucaaauaugugccuaacgagagcuguauuuuggauaaugggguguggcaggugagagcucuaccugcuuuaauguccuuuccucacuguggauuccaggagucuuuucucccagugauuaauaaccaacaaggauguuaaagguggcugacuggagggaaggccguggcagcgagagguaaccagguuucuguuuaagauucggccccugcgccuguaaggaugagaacugaacgcugcuuugguaacaucugggcuaacaaauagguuuugacucacaaguaagaucuuguugcuuuguucuaaugaaacagcuacaucuagacagcugccaguuuuccuagaauguguuagcaaugguuauaguuugcuuaaagucagcuuuuauuuaaggagugggggaacauuucccccacauacuuacaacuuggaagaacuuagcaacuugacacagauucucagggucauuaacuucauaaacuaguuaucauucaaugaccuagggugaucuuuuuuuuuuuuaaauaacuguugaccccuaggaucuauuuuaaacuguuggaucuauguuuuaaaaaucuucccagaauauucuuuaaaauuauuauucuuauugagccacuuacuaucauugugccugaaccacuucaaguccuuaugaaaaaagaucgugauagaaagaccuagacaccucggccgaagagauggcucagccauuaaaggcuaggcucauagccaaggauauaagaaagucccagggaccaaagcagagaauuagcuucaguucauaggcacccaccagagugugaccuuacacagccccucucguccccucuacaauguuucuagaucccagggcucaugaaaagguuucaugaaaagcucugguuggaagggcuuugguggauaaagcagcuuccuuuaacauuguagcccucaguggacagguggaaacagugagagccauaaaacagaagcagaaauggccacaccuuacaucuucugaauguuucuaauuaaacauaaaaauuaaaaagagaaagaaaccuuuuuacucgguauuacagcguuuguccguuuccucaaauugguuuucucauuugaaguccuguaaggccuggguuggcuugcuucuugaggggcucuucaucucucuugaucacuuuuuaguaugcuagcaacucuacaugcccguucccuucauccaaacucuacccgcucaucuguauucugguccucagcucccaggcccaccaugaagucucaggacuucaggacucuguagucuuuacuugaugcagauauccauuccccuuuccuccaauuguucuuuugaggaccgaaguauucauccucauuaucacccgagcuugccauuuaaguccaguaaauccacacugcuaaacauuugugugcacuuugucaugugucacauggcgaucacacucuaucucagcucugcgggccuaaugagccccuuggaagcgauaagguacagaagugucccuugacuccaggccucuagcucugcugagacccuccugaggcuuguguggccguccacuccugcacguagggagccucugggaugcacacugcaucacaccauguaaucugaaccuguguucuucugacuaguuauuguucacguugccuucaggucaccagccugugaugucuuucuuuacaaaguggacccgaguuccuuguuucuccuuaaugugaaaaguagagagaaagguuuaggagacucguugagucagugaugcauucuuauucucuaaaggcacaggacugaaauacugcguuguugauaagucaaccaaagaaacccaucuuguuaaugguuuugaccacauaaaguagaaacaaauucagguagcaagacaaauuccggaucaaguugucugccaucuuuucucaucggauuaccuccacccauaauguauagcuuuuaugaucuugaagggaaagucugucacaugccauagggagccacugaccagaguggcagccacgggcuccacucugaauccacauuaaacagauugacuauggagauucaucauagcuucugcuggugcuucuggucuuacgccauccauuccuggacuuuggccauuguucaguaacaaauccgugcaugaaguugaaggaugcuaucaggaacaggagaagggaaaccccaucacucucaguagagcuaacgggugaagagcuggcccuugcuacuuuggcuguuuuguuuauaacuauuacuaacacuguuaacaaguuuucuaccucuguucaaagaauacauagaaugaauauuguaguguaacuaaagacauguaacuugucaauuuguuguagguacaauuuaauguugauaucucauguuaguaaaauuaauguauguguguauacaugugucuguauaugcacauauacuguauuuauuuauauauuauauauuacaauacaauauauauauauaucauauguacauuuuacacacgcacacgaacuuuuggcccuagauaauacuuuaugauaauuguauaauuggucauuuuguagauaaaagggguguguguguguguguguguguguguguguguguguguuguuucuugguaaaagacaaauucuaauuuaauucucucagucugcuuaauguacuuagaguguauuggcaggaaaaccaccuuuuaaaaauggcuuagauugugagaacucgugauuuacugcuggccuucguuaaaaugcaguauggucuuuuucaggugaaggugucaccuuguuacaaccaggaaaacacgaguuucccuuucgcuuucagcuuccgucugaguaagugaugcuauguuuuccauuuccucccccugccuuacauccauuauuugagcacccgguguuccccaacacugaagugugugugccaaucugugggacccucccugugcuuauuguucuuuuccuccuuagcccacauuuuaacgggugcuuuuccuggcucugaauagcugaaaauaagcucauagagcaauaucuuugguuuauuucagaccuuuggcaacaucguuuacugggaaguauggcaguauucaguacugugugagggcuguuuuggaacgaccccaaguuccagaucagagcgucagacgagagcuccagguugucagucacguggaugucaacacaccgcccuuauugguaagcucugcccuucccuccuuucaauaaugaugccugcauuuagucacuguccgccaguucaggaagcacaaugcaacccauaggcguucccuauaaagauaugauucuagguugggcaaauuacaaauuguguguauuaaugcuauugauuauaucccugcuguucagggcugcuuuugccaaaaaguuacacaggcuugaaaugcauuaaugagccuuaauaacaauaaugcaaagaagagagggguuacuuuaccagcacggccauauucucaggacuguggcauucuaaacucuccaauaauagcagguugaggagcaguaauuacgaaagaguauuaaucacacucagccuauuauugaagcccaggccauuaugcuauguaucccuccauucugcaugucauuuucuaacauuaaguaagugugugcagcugcugccacagcccuuucacuuaccauuccuuaugacagauuuggccacauuaaggcauugaacuucuaauaaucaucaggaauacuguaggcugguaaggaggaucaggcuauaaggaacaacagaauaggcaagauggggacuaaugagcuacauucuuuuaucugcacccauauuaucaaaauaauauaaaauuauaccuucuacuuucaugaaagcugcuaggaccaaaugggucuucauuuaaauaugaaugaaugguguuauuuuuuacuucauagauaauaaugcugggaucacuuaaacuucccaucgucccaucaagacacugaugugggaaagauguggguuuuacgauuagauguuucuuuuucuaacuaauauuuuuaaagacaagggaaaagcugggagcuaaaaguuuguuaguucuuauuuucacaagaaguagaauaacugugaugacagaugaaagacgugcaugcauggguuaggcagcucccugcucccugcuccucgcuccucccugcucccugcucccuggcacaggcccccuugaacggcuucuuaaaaucccauuuggaaaagcaguggcauuaguagcuuauaucuuuuuaagcuuguguagaguuuuaaaacugucucuaaaauugccacaguuuuuacagaaaaucacuuauugagguuugcuuuuugucaaaaagagauacuugacuuuaguauaacaucuaaaauaaaugaauaauaaaagcuagccugccgccgcauuuuauagaaagcuugaaguuuugugaccagaacagcugaguuguuuugcucacuuugaagaguagaauccuauagugggcgggaaugggcuuccccacauuuucaggccugcugacacaagguauguggauaccuuuaaagcccccaggcuagucccaggagaccugaaaguucugucugauauguaagcaaaaagacugucuucuuaucccguggaguuuagccaggcaguguaacauuuugcuugaaacaggguaaagauuucugguucuuugcauugccuuaaaacacaauucugucacacuauuaagaaaggccagggguguaaggaugcuugcucugaaagcaagaaaacuagacuugagauucucaggacccaugcggaagccaggagugaacacacaugccuuuaacccuagaauuuggggauggaagccgguggaucccaagggcucacugauaggguagccagccuagauuaaaaggcaagcuucggguucacugagagaccaugucucaaaaaaaaagaaaagaagaaagugauagaaaaaaacucuggaccuuuuccucugccuucugcaugucccgacauggauguacacacccccgugugcacacacugugcauaugcuacaccauacccaccauguauauaauggcagaucuguaauauuuacaguaugaauaggacccuuggucacuuuucuaaaggauaaaguuggaugaugucacacaagcuugaaucugagacuucauucuaguuuucaugagaaggaaauggcuuucagcacuugguaucacaugagaaugugaaggauggauauuucuuuauaauuauucuucaaaggaagauaaguuuucuggggugguuuaaugacaguccuuuuguuuguaacuuccaagacuccuaugcugaagacgcaggagaaaaugguuggcuguuggcuuuucaccucugguccugugucacugagcgucaagaucgagagaaagggcuacuguaacgguaagcaacagauaggaaguccucagaacagaugcaugaucaaaaugauuuuaaacagcaagcuuuacaaccuaugaaggacauuguauuuuaaaauacaaguaauuaacauucacauguuaaaagaccaugaauaagagucaccaauaauaauucugcuuuucugacucuaaucugguggcuucagucacugaguaaaccuaaggagagugggaaaaugcugggacuuuacuuuucacagggcucucggggaguuauaguauagauguguaauguuguggacuaacuugucugccccuucguuguuugugccuuaacccugugaguucccgagaagcaaaggcuucgcucacugcggggccgguuuuuauuccugggcucuagguagcuuucuacuuagccuccuacagcaucauuucugcaugugccuuagcuuaauuuaugcauacugcuuauuuacacaucuugacauagcauuggugucuuuuuacacuggaaaagugaggagugcaguugguauuaaaugucagccucugccuugaaugucucuuccucucucgaagauuccccacagaagcuucaguagugccaggcuggugcagauuuuagcaaugccuugaaauucuucggaaccaucccugaguccuucucauuucuuuucucucuuuaggagaagcuaucccuaucuaugcagaaauagaaaauuguucaucucggcugguuguucccaaggcagccauauuccaaacccagacguacuuggcuaguggaaagacaaagacaguccggcacaugguugccaauguucgaggaaaccacauugguucugggaguacggacaccuggaaugggaagaugcugaagaucccaccugucaccccauccauccuggauugcugcaucaucagaguggacuacuccuuagcuguaauccaagcuucuugaaucauuaaaaauacauaaaacagagcagcaagccaugcgauugcaaaugugaucucuaauuauugcaucaauacuuggaaaaauguuaacauugcuaccauuuugggguacaugaagacuggccuucacuguuaaaacccuaucuuuaccuggggcaauuuaaugcaauaaccuuaaaggaagugagaugauaugaggaguguuuguuacauggcgcguagguuaauuuuuccaggaauguuacgagucgugccaacuuacagugaaacacaugaaggccacaguucccugucacaagccuguccuauaguuagugaacucuucauuuugucuguucuucauuuaugcuuagucaggacaauuuacauuuguccucaagguggcuuggugggauacaaagacauuuguuucuaugagaaggacauugaauuagcuuaguucccguaagauuuacccuaaaccuguaccuuccuagcccucacgcaugcuucuucuuuuguacauaucagguauacauucauaucccuggugcuaaaagauugaugcuggagcugccuuugguuauugguacaauuccauacaguggcuuuggccgcagaaacagcagugucgcaagccaguucaguauggacaugugcugguuggcacuggcccuaccggagcagccugaagguaaaacauucaagucauaggugaugaaguguuagagagagacuagcugacaacagagcacgccaggaguagguguacacgugucagcucucccccaccacaucacugucuacauggcugugaccaaugccugacagagggcacagcaagggagaagggcuuguuugucuuagaguuuaaaggugcagcuugguauggccguguggaaaguuuuagcuuuggcugcaggggugagaggcagcuggucacauuguauccacaaucugggagcagaggguaaugggugcuggugcccaggaugccucucuuagcugagcagagguccuggccaguggacagugcugcccacauccaaaugguucuuccuccuucaguccagucucuggaagcucccugacagucauggccuguguucugucuccugggugauucuaaauccugucagguagacaaugaagaugaauaucacaacuacucaauuguuuuguacuacgaagaauuauacaacauuccugggaaaggaaccuugaauguuuacuuuagcuaggacacaaagccagugacaugcacaggaauaaaauggccaucuaucuccuaaggcuaauuuguaauauuaaaacaaugaaagauaguuaaaguagaaguauagacugcauauuuucuauagcuauaucucagagguauuugcuugccuagguuauaacauguagaucacaaaaaaaguagaauguaauuaaaaauagaauaaucaauauuaguagcuguguauuaagggaaccaaaacuugucuugugguggccauaauaucucuuguuugacuccaucucuugcuuuuauaaggguucagaagacacaaaguagugauuuuugcauuuuuacauggcucucuuagcucaaacuccauucccguuucagcaccaccaaauuaugcagaugugguaucggaagaagaauucucccgacacguuccuccguacccucagcccucugacugugacggggaagccugcuacucaauguuugccugcauacaagaauuccguuuccagccucccccccuuuauucagagguaaagaaaauuagacucauuacgcugucugcagacacuccccuccacucauuagugugcugcugcugacuccuaguugguaggguaugcguauaaacuuguccuuacaguguuagauuaucacagccacuuaccgcguuuucuggugacuugcuugugagcuaugucaugcagcauuguggauugccuugaugauguuuuauuuugccacagaagauagagaauuccgucaccaguggaggaacuucaugacaggugguuaccgacucaggcuuacagcuaucauguaguuagaaguagguaggagaaccaaggugcuauggccgucaccucucucuucugucucuguagguugauccacauccuggugaugcccaagagacccagccuguauccuucauucucugaacagacuccagacuucacuguguuguuaccaacuuagaauaucgguucuuucgccugccuuguuggaugaaagagaaaguuaacuucagaacaucggugaacuucaaguccgaagaugagagaaaugaaagaagaugagaacguuuagugggccaggggaaugguuacacggauucuagggugggcucccuugcacgcuuuaaaaguggaugaaaauaggaauuggaaaacgggaaguccugguggugagagaggaagugaaagagugcccagacuguugagcagaggcgucuuaggaccugggauguuacugaauguuacuggagugugcuuugaccagggcucacacacaguugugaacuuauggacuugguaggaagacaugauuuggggaacaagacagcuuugaaaugagugagaaugagcgaguggucuacuuucaaugcaguugaacuccccagaccuuggggucuucaugauuucuuaucauguuaccauagcaaggauccagguccuugcuggagucaguggucaugugacauccugauggaacugacaguggcuccaggcuuucgugaggaagcuagaagggauuccuuaacagcuugccauaucaaaaggaaaagaggaacuguucaugaaaguguguguugugaagggcuguacuuacacuuuuaagaacugcuugcagggucuauguuugauuuuccucgucccuuauuuaccuagggaauauuagaaaaaggaggaguaggcgggacaucuuugggauaccugauacugacacagaacagaguguucucuuauccuaccucuaguggcuuugucagaccugcucucaaaaguccaggccuggcugaccucugggguuucugcucuaugcaguuagcagacuccucucaaccugucacuugaccugaaaacuagaccaagggaaauguccacgagcucagcauuaaauagaaauaaauauaaacaccuaagaucuuaagaaaucccaaaucaaaagaggacaggagcgugccuaaacuugguuccugugaagaggccccagugggugggugacaguuuccguguagugcauuuguguuccaguacauuaguaauuacauugauacugugauuuuuuuuaauuguuuuggugcaauauuuuguugucuuugagccucaggauauuaagaccuaaggacuguguuguugcuggcagagucagccaugucucuaccagccuccucccucuguucacagucacaugcucagccuccagucuguugcucccaugaacugagaaaauuuucugacaccaggugggagggagccucucacaguuaagagcuggacaagccaaauucuaaggguuugauuuagaaacccuggugcuucccaggcagaguguugugccacacccaucguggagauggacuuaccuuucagucaccauguuuccuuagagacauucuccuagugugaaauuuuauaucaaaagucaguggagcauucguucagggauuuuuguaccaauguccaguaaauguguacuucuccccgcugagcauaccucuccuguggucauccuagcgucagucacauguaugucacuguaugccauuuucaaaaaugccaaaugguauugccaguaacuguggugugugagaaucaccacggaacccuauuucuuguuuugguuuuuuagagauuucuuucuuuucuuuucuguuaugugucuguaaacaguuaggauuguucacauuccaucuaaacugcuuuuauuuuugccauggaaaagauggugagcuguccuuuuuuuagcuuccagccuguaguuuacgugcuaugucaagucaugguccauccauaaaaccaaaauggagggaaagaaagcaacaguacggaguggacagagagaaaauggagcgccguggcucacuguagauaagcccuggcagucggguugguuagagaaaucaugaagucccccacagaacggaagcacagcuaacaguggcauugaagagugcaaagauauaacuuuauaccugucugucuggccugaagcuuauacccaggauaacaggaauguagaaaacuacaucugaaacccugugacugaagaucagacuuuuagcugcuaacacuugccugucuaguccccucuugcucucauuuaguuugggaaaaacgaaaagugcccuuaggauuuucuuuuggaugcacaaagcuugcgauucaaagugagcaucuuuuggugcacacagacccuucccuuccccuggagcacaacuuuacuuucugugucucuguuuugcacaauaagaaacucaguaggcaaagguuguguuuuuuuuuuugguaaguucacuugcuuuuuaaaauuuuuauuaaaaauguaauaauuuaaccaaggggaaaauaaagauuguauuuuguauucuucuuugaaccccauggguuccuuuuuguuaauaaaaugguuauacuaaugau

SEQ ID NO: 3871 - RNA, 1750 nt, Mus musculus
gcuacaacugguggggagucuuuaucacgcugggacugagagggugagcaggauuaggguccagagccaggagaaaccaggcagagcuguuggagacacuccaguagcaagacugauggaugcuacuuagcauggagguagccaugggaaagcagagggccaagggaaucggccuugauucaggaagaugaauccucagagcacggagaaggaggggaggaggcagacuuugaagaagcugaaggaaauuuucugaaauuaauggaggaagggaaggagaguuagagaaaggaggaaaaaggagggaagaggucagacggggagagggaagaggaagcgagugagaaagagagaggaagaauccggagagaggcagaagagguacagcagaaagggggggggagggagggagggagggggagaauuugcucucuguuucuuuacccauucacauuuagagcugaguggagcugaggugacuuucucgggcuccucgggugaagagagugucuuucugguccacuugggucugaugggccuugcuuccauuuccugugaccugccgcuauucacagaagccagaacucccauuacuuaaacucuuccagucaggaguccgcuuguggcccaaaacaucuuaaugggugcagcuuacugaaaggaaaugaagaguuucaaguuuccugagugcauauugcaugcuagagccucuucacacaggcucuauuuaguucuucucuggugacaaucggcguugccaguuccauuucccacaccaggaagccgagcuugagagugccgugggacagcauggugccugcuaugucagcuaguccaccacagcuuucucagcgcucacaccccggggugucuuccuuucuuucgcagaggaagucacucgaacaugaacacggacagguuuaaguuuugaucuuagaggagucuauuuggauccccaccacucccucucagaacguucuggaaucuucacuauccucaugagguauagauaccagauguuacacuauuugcuuacuuaauuuuucauaacauagagcugcuuguguguauguguuguauauguguaugagugugugcauguuugcguguguguguguguguguuugggucuggguauguguagguuuauauguguguguaugaguccauguguaugaguguguguguguaugacuguauauguguauguguguuguauaugugugagaauaagguugugucagagaacaacuugcaagaauugguucucuucucucaaaacauagguuccagggaucaaacucaggaccuuaguucuggcaucaggugccauuacccacugaggagucuuaaugguccuugaguauucauguuauuucaaggugaucuugaguaaggcuaucauuuaaacuccucauguccaucagguuccaacucaccucaacgagcccauugugccuuugacaguuauuuguugaacagugaggaugcccuggcaguguucugagcagccagagaugagaggcagcuugcauacugcuggaagguuaaaggcaaacacaacguaagacaauuuauucuauuuguguauguacauguucaugugugugaguacacacguguacagaagugcauaucaugaaacaacuugccauguuauuccccagaaaucauucaccuucuuuccuuuuuacccauuaauuaauuaauuaauuaauuaacucacuuuacaucccaaucacagccuucu

SEQ ID NO: 3872 - RNA, 2111 nt, Mus musculus
cuuuuuuuuuuuugauagcauuuuaacauuuaauagaaacuauauacaguaauuucacuacauauuacauggagucaccacaggaacuuacauaaguuaaaagcaagaauaacuaaguaaggagagcccagaccugugagcugcuuuucucaguuacaguucacaaggaaacgaaugggcuuuguauugcccaacuauguagagcagaggaaaggcuuagauacaggccuuuagauacagcuagccagacacuaagggccaacgccugccgagcaccgucucgagcacagcccgccuggacauccaugugggguucuguccguggcuuaggagucccauuacagaaugucucucucccaggcagucuccaauaugcauuguaucccaaaggcagggauuaccucacauucuuccuugaaaaaaaaaaucccaaaacuuauauacuaaauauucauuccacacaaacuuggauuauguuugucuauagcgcucuaaagccccaaaggaagcaauguggucugaguugucccuguucagggagagaugaucagagauacacuugucugaagaauggaaaguucaaauccaaaggcaaacaauucccagaaugaaugucaacugauagaaguggguucugguuuuccauucgcaguagccaauccacgcugagggaaugcugcuuucucuacacuucgagcucccugggaucugcacccauccccagccgccugcaucuguccugcgucuccggcacuuucugugacugaaugaucuucaagaguuagcgaaggaucaaagagcaacggcgacggcgggcauggcaugccaucacccacaacauccaagucaucacugaacuccagugguaaacucucagugggcugaagcucggcagcacucaaguacagauccauggggccggcuuccagaucgucuggcacagacaguaccuacucgggcuuauacaucugaggaggcaacuggaaaugcagagggcagcagggauccucagaaaggcuuacaggaacugguuuguugcaggggaccucuucagaucccuggcagcauuugaagagaaccugauuuguauccugacagauauggguaaggcagugucuggucauugggagagacugauuggagcagcgcacaucauccacaaaggcuaagcaccucugacuggaacgaguggugugagccuguugagcagccccaucgguggccagcauucugcguuccuucagcugccuguguaguaaggcuucuacuccauagcguugacgguaucgccuaagacauuuuagucgcuuuaaauucucucucucuuuggccaaaagucccucagggccagucaggagacuacuaccuaaagccucgugcuccacuuuccgguuguguaaauagcggcgcuucuucucuuugagcagguguuggagucuuuuaaacugaucaauguacaaagacugcaaacgaauuagcuuuucucucauaauaagagccacuucuucagcuguauagacaccagcauguuucaggggaucuucuugaucacugucuaugcuaucggcuucacugucagggucaccucuccaugucugauccacagugauggguuccugguccccaucacuccagcugucuucauccaguauccggcuggcuucacugcggcugcucucuggggucugcgagcccagcucuguuuuagcguaugagcucaacuggcacaagaggguuucacccauagggccuggguugcucuucuucauuugagcaugaagugcuagggcauuucuucgagcauguucggcacagaaagacaccccaucuuucuucucgggcuuuggggcagcacuggggcaccuuuuuccauucuucgucgagacguaacuacauuguuugaagggugcauucuugucuucaagaaugugcuuaaugcagaacuccugccccuccagccgcggcugagagcacgggcggugagugaacgaacaggaaaggggcuccugcgaccugggcacuggggugauccucccccgauucguuggcaagacgugaauccgaauccuguucaugccaaaaccacguuggccgaaucuccgcagcagcag

SEQ ID NO: 3873 - RNA, 1666 nt, Mus musculus
gguaaaaggcaugugugacuaacucaccacacgaguuucuggagcaaggcaugucagaagguggagaaagcauucuacaaagagcagaguaugcgggggugugugugugugugugugugacgaccuggagcagcccagcccagagcucauaagaccuugaucccucucgcugccauagaccugagaacccugagcaguggcugaagaagguagggaagcauauagcugcucucaguccccucucauuccuccuucaggaacaggauggcuccaauccucuggacucugguggcaaaaaaaaaaaaaaaaaaaaaaaaaaaaaaaaaaaagagagagaucuaaacauuggaagaaccgggcagcauguggguuaucugcgguuaggcuggagucugugugcgccugcugcccucugcaggacaguucuagaauuacacuuacucugggaugcuaugucagauacagagauggucccaccuagggaggcaugcuagugaguuuucugucagccugagucaccugggaagaggaaaccuuaauuaagaaaacgccuccaucagauuagcuuauaggcaagucuguaggggcauuuucuugauuaaugaugauguaggagggccaaggcaacgguggguggaagggaccaccagggcugagugugccacggagggcaagccaguaggcaccauuccuguggcuucugcuucaguuccugccucaaauucccgcccugacuucucugcauguuuggaagggcuaaaaugaaacaaacccuuuuauuccccaaguugcuuuuggucaaugaagugaaacaugaagacucuuuggaaagacaguuggaggguguuuuguuaggacaaacacgugaaggaauguuucauuaaaguggacacagguguaaaaagcuaaggcggauucgugaaggaaugcuuagcugaagcagacacaggagaaaugauguucuacuaaagcaagcacgugaaaggacgugugaugaaggauucuuggcuaaugacaggcaucguccaccucacauugcauuugucgggaaaccauggagagaaaugcaccaaaaacuuguggcggugugcuguaguuuguugccacuuucaaggacucgggcugacuggaugcaugugcugaggcaggacacguggaggacacgugaugcuuggaggguagaaauaggacuccacagaaugacgaagagagcuuggcuugcugguacagcuggcuguguaacgcuugugggucucucgucuucacugaucuucgcuucccugagagaugcacagcugagaacuucucccggggccccuucugcugucuggagcugaggcugaggcccggcugucucugcuagguagugucacugcuguugcuaaccugauucuucugaacugggcuccuggugcaucugugagguaguuuaucugugagguguuugcgaguggauggagcugccacugccugcuaaccugugaacugaacugcagauuuccagacaacagacaggaguugcuccaaauaaccuuucuaaacaaguccacuucccucuacccccacccccauauccuuuuuacuaacucugaagggggggggggcuacaagaaagguuaaagcguuuaagaaccaucauuaaaaacaggauuugaaaaaauuaaag

SEQ ID NO: 3874 - RNA, 129118 nt, Mus musculus
cauggaagcgguggguucagaacugaccaauaguaugcaguuggggcgggaggaagguacgaacgaagugcgugaugccgcuccgggaagcgagggcaggaagcuagcccagccaauggccgccgcgggcgggugucggcgcgcgugcgcacugggggucccggagcugcaggcgggagguugggggaggggagcgagcuggagcgccgcggagcucuagccgccgccgcagcucccgccgcagcgaagaggccauguugugugguguguggggcggggggaggaggaggagggaggaaagccgagcgaggagacgggagagacaccacacacggcacaagauggccggagaggcagcagcaagcccagcugucaggcggucugccgcggcccgugggcucgccgcugcgcugggagcgcuaccccggcguccuggagggcucugggagagcggggaggccgcggcuggggcgaggcggccgcgcgcgaugugggagcucgcggccggagcgcccggggaggccgggcccacgacgcccguggcuccgcugcggcagcggcggugcuggugucgcgcgcggccgggaggcggcuucgcgccgcgggcgggaggcugcggcgggcgacccguccuggacacgcgaggaagagcgagccgauggcggcaggggccgcgcuucgacccggugaguagcuccccugcucccuuuauuguccuuuguccuugggaggaaaagcacgacguccuugagcgcgggcgggaggggcggcggguggcugccggcuggcucugcacacgcagccccgggcacugccgcggagggccgaugccacgggagcacggggucgggccaccgcguucccgcugcauacccagccgggcgccgcgcugcgguccgagccagcggggagagggcggcggccgcgccguggaaccccugcuugcucuggugaguuacuucgauacuuagcgagaaauaacaacaauccuccguugaugggcuuuuaaaaaucuuuuccagugaggugggaacccaucuuuggggucggaucuaaaagaacaauggaaccucucacuucgcuuaaaccaaaauaaaacuugucuuuuuccccccuucucccuguuggguguuggcuuuuaacucuuucuaagcugcuuuugagaacggcuguuaguguucuagaugcaaagguaccuuucagcuuguuaaacguccgugacguuuguugucuuuuagaaaaggcaaguuacaggagugcaucuaguauuucaaaaaugacgacggcaacaaggcaguuuaaaggaaguagauuugauaauuauggugcaagaugauggcguuugaugaauacagcuuauuuuuaccgagaacuuucguuaagaccauuugacauccugauacuugaacauaaccguacuguuugauacuuuuuuaaaugaguagguaaagccguuaucagcaacuucucacuugaauguuaaaucuaacuugaggcgguuccgacccuuuacaaguuaaaauucaucuuguuuaaaagagaguguauacuauuagaaaccuuggccguaaaaguuaagaaauauucuaaaagcagagcucuuuaaguuacuuaguguaaauccugaaguaagacugccauugaugggcgaugaagaggggccauauuuguugcauuuguugcacguauaaaagucgaggugugcuuagaaacggaacaguauggaaacaacaguuuuaaaaaauuuguuucugcauacucauuuaaaaauuauuugagguaauuuaggaucagucguuggaagacuaggaguguucagaccuuuguguauuuuugaauauauuugucuucauucugcggagcucuugugcuguaaaggugaauaacugcguaaagacaguguuggggagacuuacguagcucaucuaaaaucaaaggugcggguugauuggaccuuauuucaucggguauuuacaguagaaaacaauuggaauaccuuuuaugggguagacauagucuaucaguugcccauaccuugauuucucagaauuucucaguacuaauuuuguuuuuucaaaagaaugcuguggaauauuuuaucacugaaagugguuuuaaagcgauugagaauguaguucagaauccuuuuugaguuauaaaaugugaaaauaauuguuagcagaucuaugaucuuacaugauaaauuugguaggagaaagacaauauucuggacccugguuugguauugaaugaaggucauuagauaccacaaguuuuagagcugcuuaaaagacaaugcuaauaccccauuuggugagaucaaauagcuucuaguuuaaaauuuacaguaaccaguggccauuuuaaguucacuaauuucuccuggaggaguugauuuuuaauacucauaaauauaagagcuauuugaagaugcuaaaaaaauuuaagaucguggcauuuuuuaaaaacauugucaauguuuccuuuguuuuuguuuaccugacuuaauggaaaaaggaaagcaaagggauagucauuuguauuuucugugugucuuuucggauuccaguguuuuaaucccuaguaugugucaguacauuccaaaugaggaaaacaaagacugauaggcauagacauuugagauaaggaauaacuguaggcagaaauguucagguuguaucaccccacguuuuuacaugaaucuugucuuuggaauauuuuucucauuuuaucacacugagucuuuggucaagaaaacguuaaaaaucaaaacauuuaaauauuuuuucuuauuuucuuuaaagguaacuuagaagaugauaauuaaugugguugcugauaauucugaauaaauacagcuuuuaucccagguaagauugguaaauuuauugguuuaaacauaaaauuaacuuaauagacuuuuguuuugccuuuuuggugauguauuucaaacauucaguuaguauuuaugauuuuaaaaagugauuaugaaugaauacaugaaauuaaaaaacauuuaaaagccucuuucgcugaguaagugguuaaaggaauauucauauggccauuguaauauaauguaccuuugaauaguauaaauacugcaggucuuuaaggcuuuguuuaauuuugguaagaagguuuuagagccaggcauggaccaaaaugguccuccccccccccccacuuuaauaucaaacuguuuuuacauuuuaaauacuugagacuuaauaggacauuaaaauuuuuuuuuuugccauuuagacuaauagauuuuagggagcaauaugucaaaaguuaguuucuguucuguauaaaguuuuaaaacauucuauuuguuacugauuucuucaguaaguuguuuagaauguuguuuuguuuucuccaaaaggugugccauuuugaagacugagaccauagaguucuaagaauaaaggaaagagcccuugggaaauuauuauauauagcaaguaaguuuuuuuaauuguuauauuugaauauuugccaacauuuggguaggaauauaucauuaaagcuugucaauaaaaaaauacuguuugaccguguauauauaaaaaaaaaugagaaaauacccaaauaguuuuaccuuaaaccaaaauccuuuugucuuaacuauuaaaacaguugauagcuguaacacauaucaaugcauacaacuguauccaguagcaagacauuugaucuucccaauaaaaugauacuugccuuuucccgaggguuaaaucugcaguguuaaauuaguguugucuuuauauauauauagucugaaagauauauuguuuaguucccuucccacucugucauaaaacaguguccugaaaauuuauaauuauuauucccuugcuucuugaacuauauuucaaaaaacuaaaaacaaacuuugauggcuuuauaauuauauaguuaaaauacucauauuuaguaguucuuuaaacaacuacaaaaauaaauagauuccaccaaacuaaaugcacugcucuuagaggcuucugucaguguccugguguuuuugaaccuaaaagagaaauaguuuuuggguucagcauaccaugaaaugauuaucuuaauaggugaauauuaaggugaaugcagaaaaugugacuccucauguauguaaagaaauaaaucugcccauauaagcuugaauccagaaguaauauucaauuauuguuuguaagugauuggccacagaaaauaugaaauuauaagugaugccuugggaaauuaaaaaaaaaacaccaagugaauaguuaauuaaaaugagagagcauauuuacuuauaucuugggaauauauggaaaaucaacuuguguuuaccuacuuuugggucaaauaaggggaauagacuaauuuuauugccuuuguguuagcuuagugaaauuuuguuuugcaguuuagguuuguguuauaaaaaagaaaaugauacacuuuuaaauucuauaaucuuucaaagauagaauauauacaaaaggaucuuuaauccuauauuccuauaacaugugcuaagacuaggguuuccuuucugcagcugauagaguguguaguugcuauuuguugaacaguuauaaaaauugagaaugaucuguuuccuaugauacuaucagaacguauguauaaauuggcaauaugcuuuaucugaggucuuauuuggacagaaaaauaaacagcuggagguuagaaauauuaaauaauuuuaauuuuuuaauuuaauaagagauguaguaacugcuaaauuucuagucuuuuagaggcaguuuuuauaaccagauaaauguuuagaguaaauuguuuuuuugaaaaauaacauauuaucuuuaugauacugcuauauucagugugaauaguuauuauuugagcuaauuuaauggaaagguuuacugucaugagauuagucaucagauauaucuuagauaguauuauguggccuacaaugguauaugcuuuacuauauaugaucaagguaaguuuuugucacguauuuucuauuuauggauuaaaguaacgaaugcuuaaauauuugguuuuaucuuagcauuuuggacaauuucuuuaauucuuaaaaauuuccuuauucuaguuguguuuauguuggaauauauuugauguuuuuauagcuuuaaaggauuaacaugaccaaagauguugcagcuagucaccaguguuuuuggaucauaacaugacauagauuuuuagcauauaaaauagguaauuauaaugugaauuuucuuuaacuuucaguuucugaucauaguuucuugaguauuuagaaauuuaggcuguuuuugaguuaaaaaauuauguuuuuuucucuuacauuuguauuguuacaucagguguaugugaugacuaagcagucacgggcgcugccugcaaucuaauguaaugcuuucacugcuuuaaagaugaugagagguuuaaagauuuguagucuguauaccuuacauacuuuauugcuuuuaauagacauaauuauuuuaaguaaauauauuucugcauuucacagauaaaaucauuucaugaaguucuaaguuggaugugauguuauuuucaaauuggcuauucuugauguaaucgacuuaaaaaauuuuuuuaaaaacuuguuucugcauuuuuuauuauuuugugguauuggagauugaacucagccuuugcacaugguagaaaaauacugucacugucaucucagccucgcuuuccauccuaaaaaauuacauuuauguacuugugugaaaauaaauggaggucaggaccagccuuuaggaauuguccugcccccaccuauggguuaucaggauuggcauuaaagcaguguugguagcauacuuuugacuuuuugaaacaggauuuuacuguguagcauaggcugggcuucaguuuaagguaguaauucugcauuauccucaaaaagugcugggauuacagaugcuagccaucguguuuguuacccuaaauuuaagacuauuaggaauuuuuuaagguaggugaccugguuuuuacaaacuguguuucugaugauaggauuuauacauuaucuaaugauguucccuaggacugugcgucaugaaacaguuuuuaccuuaagcuuuaauuucauuuguuuguaugugugugugcuugcaaauucaaauuugaaggucagagaaguugaguaggaaucuuguggauuguuuuaggagauagacuuacuuacguuuucaggcauguugggaagucccuuuacauauugcacagucucacaggccccauuuuaauaauuuaaagauguauuucuaaacaugaaugaaauaauuguuuuuaagauuuaaaaaauuuuacgggaaugaguauucugccuacauguauguauuugcacuaccaugugagccuagaacauucagaguucaggagaggugguuggauucuuuggaaguggaguuaaagaaggaugguugugagccaccauugggcacugagaaccacacccguauaacugcgagggcguaagugcuuuaaccacugagucaucccuucagccccaagaauuaagugguuaauguaaccguaaccauagugcuuuuaauucagaucaucaaggagguuuuaaaauagaaucuuugugguuuuuuuuuuuuuuuuuucucuccuuuuucuuuuuagagauaguguccuugguccugaguuguggaauuauagcugucaaccaucaugccuaccuuaaugauuuauuuuaaagaaauucucuguaagaaaugucuguuuaucugggacugcucaggcugcacaaggaugaccaugaaaagcuugucucagaaauggcuuggauuaacauaguugcaccuuuauuuaugccuugcagaugacuaucacuaaccuaucuuuguaaacauuuucuuauucaguguuguuaaauuuucauauuagaguuuaaaaguuuaagggauuuaagaaccaacaaaaguucuugacuuuuacugccaaagagccagcaucauaugcucauuuauauucccuaaaguuuauuuuuacaucacagaauacauguuauaguauaugagauggguaggaguuugaggaaaaucagauuuagucuacuuaaacugaacuaagugggcucuggugcuuuaggaaaggaggaccugugauggaugucaccaaugucauuaaugucauugugaugcauggugagaucaaaagacuuuuuggugguuuuagaaccuaaauuuuuugggcugguagggugacugacucauaaucacauuaucaaaccacugugagggguuucucuuagagaaucccuuuuaccaagauuucuuaaacauuuucuacucuuauaaaugauucucaaucaguuucuuuaauuuugaaucaaggaccucauagauacuaaggaaacacucugucauagaagacugguaucccuuccccuaagucaauuuaguuuccuucugugguuaacaaaaucuuccuauuaaggucagauuacacuuaacuuuaaaauuuucaagguuuaaaaauuuuaagaucauugcuuuccauuguuucuuauuaggaagauauuuuagaaccuacuuuaaugguaauuuuuaaacagaucuugcuauauuucuuguuuaugauuuaaaaaaauaaauuuagauuugccacauaaacaggaaauugcuuuuuauacuuacaaaugaugcuuuuuuuaaaauuagguauuuauuucauuuacauuucuuagcaaacaauucuuaagaaguuaguuugauugauaucuuaaaaucuuaaaacuuuuaaguuuuuaaccuuuuucuuucacauggucucauguagguaacccaagcugauuuugaacucucacaugaaauuuucaaaacaguuuuauuuugcuguuguuguuuuaaauucggggcgucacauauguuaaguguuauauaccaccuaauuauaccaccuagcuuuauuucccuccucacccccccccccuuuuuguggggagaaggucugucuguauagcccaggauguccugggauucacuuuuuagaccaggcuagccucaaacucagagaucugccugccucugcuuccugugaucugggaugaaagguguccaccaccacagcccuuuccuauuuugcgauuauuguaauuauacaaaaccaagguaaauggaaaacucauccaugucucagaaaguacuugaaaugggaagcauuucucauuuaguuuugaggaacuuaagucagaaauuagugaaaacucccgaaauugcauagauaaguguauauuuuuauuaguguuagucuuggagcgauggcucagcauuuaagauccuguauauuggaaggaccuagugcgguucuugacacucauacuccuguaacucuagauccagaauagccagugcugucuucugaacuugugcacgccgcgcgcgcgcgcgcacacacacacacacacacacacacacacacacacacacacacacacacacacacacaaguauuaaaaagaaaucuuaaagccggguguggugguauaugccuuuaaucccagcacucaggaggcagaggcaggcagauuucugaguucgaggccagccuggucuacagagugaguuccaagacagccagggcuacacagagaaacccugucucaaaaaaccaaaaaaaaaaagaaaaaaaacccaaagauugauuauauaugggauuauacuaugcugcugcuagcauaugauggauacugaauauaguaguaauagggagaaggaucuugcagaugguaggguuuuagaaauguaucagaugggagaccaguguauggauuaaugugguguucacuuguuuucaacaucgcauagccagucaaguuaaggcaggagcucaguuauuacucauauggaguucuuggugaaugaaugaugucuaggcuuuuaauuuuaguaacuuguucuagaguucagcucuggcaucggcaaaaauuuaaggucuugucacaauuuuccugucuuuugcuuggaguaguuuggaagguauugaaguuguacuguaagucauaggaguuaauacaaucuauucugguuuuugcagaaaugugaauccucagauggaaugaaaggccugcaccauagacaucgaagcauuuaguaagucuuuacuuguuggguuuauuuuuuaauuuuauguguaacuaggaauuuuaaguuacugacuuggaauuguaagugcauagcuuuaucaaaccuguaaacaguguuuuaagaguagauauuuuaaacauaauuauucauaauaauuaaaugugaaguuuauuucuuuuuuuuuaaagguuuaucauuccuaauuuuaaagauuuauuuauuuauuauauguaaguacacuguagcugucuucagacacuccagaagagggagucagaucucguuacggaugguugugagccaccaugugguugcugggauuugaacucuggaccuuuggaagagcagucgggugcucuuacccacugagccaccucgccagcccgugaaguauuucuuaagacagaguuucaaacacuauacuugaaggucuugaaauucuuaauauagaucaggcuggcuuugaacucaaaagagauuugccugccucugccuccugagaucuuggauuaaagacaguggcaccauguccagccuagauauguaaaguuuauuaaucacauguugccuuucucccuuuguuuagauauugaaacauauuuacccaccuauccacccacccauucacccuucuauuugagacagggucuaacuaugggccaaccaagaacucagaucaggccagccuggaauucagagauuuaccuaccuggcucugguuucggagugcugagauuaaaggcauauguccaccacaaauggggucagaaaauaaaagaccaaaaacucccauuuggacuuguuucuagugcccuggguuuauugauugauugauugcgcauuuaccuguauuguuuagauucuguugugcuuucucauugcaguuucagggcugagaguacuuguacugaaauggauacacagcuuagaacauucacugaaaacaggccaugguccuagagucugaacuugcuacuuugguucuuucuagauaauagaaauuaauucuaauuaauuucuaauuguaauuaguucugauaaauuaacugaacuuaaaacuucaagacugaaaguuuagccuuauugacauagaaauugcucuuugaaagauaauauuaccaccucugugaaauaguuuuguuuuguuuuauuuuuaaauuccaaacuagacaaguagugggaaagaguaaaaugggaagguuguuauaaaucauuuugggugaauugccaaaaggauuuauuuguucauuggcaacaaacuuaagauaauugucuauagcugcuucauagcaauaaagacacuugggaauccagauucugcaggaucccccucuccccuuuccaguuauugccacugagacugcacuggcuggcuaucaauggccuacgaagcaagguuuguguguuuccugagggagagugaggaaggagaccccaaauuugucuacuacaggugucuaguucccugugugguuacaguuaagaccauagaugccuggcacuagcuacuccguaaauauuuguugguuuguuguguuaauuuagcuuuuauuaaacauuauuaacuagugcuuugagaauaaugaaaggcaaaauaaaauuauuaaaauauguuuuuaauguaaaauauuauagcuguguuugaaagcuaaauuuggucauaauaaaaauuagaaguaaucuauguaccuccccuaacuuggucuuuuaaacuugguuuguaauuagauuagauuguaaacucaggaaaguuuacuuuuaucaguaauugaccuuaucccuucauugaugaacauuagcuagucuuucuguaauaauuuuacuguuacuuuaagguccagacuuguuaauauagucuguugagcauucaaucuauuuuagcauuagaccaaauaggugucaggguuucuuuuauaauguauuaaaauuucaagacaaaagcaaaagacagaacuaagucauaaguguuaaauauacaauuacaugacagaaaggaugguauuuuuguacuaacugaacauuuuauguuaaucuuuaguuguaaaacaagcauuuaacuucugaaaaauaaauuucauuaauaguaguacccuuacagccauuuauuuaaaaaaauuaggaagcauuaauuucuuuuuaacuuucuuuguucccuauauuuuucuuugcuguuaaaacugguaaagauaagcugaacgugguggcacagaccuauaauuguagcucuugggugggcaggaagcagauguucaaggccauccuuagucccugacugaggcuguucuuuaucuuagauguaaagcugcuugagauagagggaaagagguguuuuauuccgagagccugcuuacacuccucaagagucaguggccugcgcuuuaguuaauaacgucuaaccuauuugaagauagucauaaucaauuuucuguuccuaaguuaugaaugagucuagugacuggauuuccagagauaauuuauuaacuaucuuggugacauaaaaacuuaagauuugaacagaaaguuggucuuagaauaaauauauguacuuagaaguacaaacuagaaaauuacaaaauagcauucuaaucauacuaaguuugaaucuuaaucaggugacagguucuugaucugucugaguaagcagagaauacuagagcacaggaacgccugugcagugugugugcgcggucacacguuaauguagaaagagauguacuuaucuauauccauuccuagugaacaucccccucccccacuauaacacuagaggcagaacuguuccuaaauaagugacuccgugaccuguguucucagcgaugcuguugcuguuggaauagaaaguguucuaacucuugaguuugagguccuuaugcuuggauuacugugaugcaguggaauacuuugcacuucaucuccuguugugugccagcucaucuaaccucaguagugucacaagagguagucauuaggcucuuuguugguauccacugagcugugcauuuuguuaacauuugcauguuucaagugcucauguuugauuccuucuucaagugaaacuuauacuuguaaauacaauuuuuguuguauuugaaauuucaugagugcaaaugacuuacuuccuaguaauuuuuaaaagaucuuuuuauuagcuuucauacuuauuugcuucuaacaacauucuuacuuuuggcuuugggucuuaggcuuugcaugagugcauuuugaucauggauuuauaauguaaaaguugucgguuuucucucauaguuuuaaauuacaacacuugacgacaugacugcuaugggagugcagauuuugaguagguuucuaaugauaauaucauuaguuuuuguuauuuaugagacuguguccuacuccagcuuuaaacucggcacaauccucuuccuucagcuucuccugagugcugggaucucauguggaagccaccguaucuggccuuuucuuuuuucuuuucuuucuuucuuuuuuuuuuuuuuuuuuuuuugagguuagucccaccuauccaagaaugaccuugaauguuugguccuucaucucccagacugagauuacagacaagggcugccaccaugcccaguuuuaugugguucuggggcucaaguccagaaauuuaugcacgcuaugaguauacuacucuuccuucugaaagauacuaugcuuuucucaucccccuccuuuaaaaaauuguuuuagaaguaaauuguauagccauuacuuaauuuuaaggaaagaacaaggcaaaugguaguucauugauacacacauacaaggaguuauauuucauuuuguaggauuugagaaauuuuuaaaaucuacuagagaauaucuugauguauggauucuuaacugaugcugugacacuccuuacuccuuuaaagaauuguuuuuuaauaggaggcaccacugucuuuugauugucuaguuuuuuuuuuuuugguauuguuuuacaauguguguauugaagaacacaccuuaauuuuaguuaggaagacagaaaauuagccaagaaguaacauuuucauauuguuuuauuacuguaaucacugacuagcucuacaaguugaguuggaaaguuguagaauguauaugaaagaccagaaauuaaaauuaaaaugucuuuuccagcucaggagauggcucagcauuuaagcauuaagcucuugcuugagaauuugugucccccaaaaugcaaguaaaugcccagauaccaccggccuguaauuccagguggagaugggucccagaggaaacugguuaucuagauaagccaaacugaugagcucuggguaugaccgaggugucuugcuucaacaauuacgguuaugaugauuuucauucucagcagcaguauuauccucaggucuacacauguucuugccccacauacaagugcaccccccacuacacagacagguacauacauacacauggacucaacauaacaugaaaauuguaaaaaauguuuuucaaguuuugugugaguaugauccuccggagacaaggaguaaaauccccuggauucucaucuuuuccuuccuucagucuaaacuguuaagcaauagauuaauuuuuccaggaggaacauaaugauguuuuugaagugaaauuuaguuguuuaugauuugagaagagauagcauuuuuguggcaaauuccaaguaagccaagcugaaauguuucugauuuuuuucaugugacuuacauucacuccacuuucagauaugaagcuauaaaggugcuucuaaguaaaauuaauaucuauaagacuguuaaaguaugccaugcaguuagcuauugcuuuuuuuaaaaaucuaagauuauauaauuaguuuucuuugaaagagcuuggaaacuuuuugcauugaaauuguccacaugugguuguaauuuagucucccaccauucuugaauuuuaauauuugguuuuacuuuucauauaugcacuaugauacucauguuaaguucuuaagaauuugacccuuggcuguuaacuauuuuuaauggauacaaauguaucugugacaggagaacuuaaaauaugugaauucauugauucugucuuugagagguuguuacaauagugcuguuucauuaaagacuuguguaugguagagaauaucuucaaaguggauagaauuuucuguuugaauaagaugacuguuacuccaacagaauuuuuuucuucuaauuuuuuaugaagcaccccgcuugaagaguuugaaauggacuuuaccacugagaaaucaagauggcagcccauuauggggaauugaggaaaauggauuaaugcaagaaugcuguaauauuauacaaccaacacaggauucuuuuaauguggauuccaugaaaugaaugauucuuacccaacacaaauggacaguggaauuuacuuccuaaagacuuguuacaugucauguacauuuuugacaucuggagaagacucuacaauucuacaaaugguaguuuguauuccuggaauuucuugcaguuugaucugaagugaccuuauggaauguuaacuuuaauaaaaucucuaaaacuuaaaaauuucucaguuugggccuuuuauaaauuuuuucaguggacguuuucauuaaauguucauuuuaccuugauaacauuuugaccuuuauagcugcugcuuuucauuaaaguauacuaaauaaagcugguaaaauggaaugguuuuguuuguuugggauuuauguguauuagaaaaccuggauuuuucccgugauuaaguggaaugguccuuugguuaaaauagauauauucucucucccccuucccccuuucuucuauuuaaaaaaaaaauuauuuuuauuuauuuuuuauuuuuucaggacaggguuucucuguguauccuuggcuguccugcaacucugucuguagaccagccaggccuggaauuugcagugaucuuccugccucugccuccugagugcugggauuaaagcuauauacacccaguuuggcuggcuuuuuauuauaggguuugaauaaauuccuuugaguuugggucauuucaaaauaucuugcauuuuaaucauuggguaaugguaacuuugaaugugucaggagauuauagugaauauauaauauaaaacaaagugcuggucucauuuccuguauaguccaagacagucucagugucuuucaauuuuuguugaugaaagucguccuuugccaugugaaaugcucaucugaauauuugaguuauacuaauuuguauuguauugucuuauauuagagguguauuuuuaaagucuuuggguauacauuaaagggcuuaccuaauaugacaguguaauuuauuuacauuugaaaaaaauucuuguuuuucuuguuuugugcaguugggaguuuaaaugaauuauaccaugcuuuagauugguuacccaugguugaaaucaaaugccagauuuucauugauugcuacuuugguaauaaauuugauaaagcagugauggggacuuuguugaccaaaugacgauuggugguguuuuucucaguauauagaacaaagaaugaaauagucuguuauuaauguaaacuaccuuagaauacacaucugugguuaauacagaugcaguguuuguucuuuggaugaugugaggugguugauauuuguaaauugaaaacuugaguuuuuggauuuugauggaaauauguuuguagacuugaaacugauuuuuuacauuuucuuagauuuaacauaauuacguuugguagugaaacuaaaaugaauucguuugcuggagugucaugguuuugaccaguaggguucaguaaaggaauguuuuuaguuuuuucggcauuuguaugugguugguuacuugugugcaugggagagaauacuuuguugcauuuguaauuuuguuucuauagaccucgugcuuccaucuggaggggguuugucuuugacaguugauaauuggcugguagauguggccuauuuaaguggcggugauugaugaaaugugaguguacuuagaauucgauuucaaacaugagugaaaggguucuuuugauuuuggaguugagguugaguguuugauuuaaaggugaccaagguugguguaauuucuugaauucgaaguuauuaauuaugcccaaauauauguaagaaguaaauauguuugauguguggcacuuccaagauuaaugguuuacaaagaaguuuguuucuucugggggggaaaaugguuguauuaacuuuugcucuacugcaguugaacacuagggaggcgcucuugaguuguaaaaaauuaccccuuccuuccaguugagguggaaaauucccccuuaaucuuuagauguuuuuaggcaccauaaagaaggcaagaguugauuuaauuuaugguguugaaauguugcuucuauuuacaagccauuuuacccauggugggguguuaauuauuuuaaagauuaguucuuaaacugagcuuuagagucucuugaaauuaucuuuauuucaaaauggcuugauaaaacuccacuuccuguccagggaggaaguuauuuuagcucaaggacugaaauauuuagcagaucuuuagacaaaaggaacaaauuacauuucucucuggcuuaaaaagggugcuugagccagaggggguuaagaagcccuucccccucccucugauggaguggucuggaggggcagggagguguggaguugggggucuucuggcucucuuggauggagaaucugguucuuuuucuuucuuucuuucuuuuuuuuuuuuuuuugguggagaugaaggggugggucuaugguacaucaccugaguugugggguaaauguagagagugucaaucaaaggcagagcucucagagcugggaaggaggcucuagauggcggcugugccuuagagagagcgcgcuuugcucccugcuucgguucacuuuacgcaacuuucccuaacuuucgggcagccucagggggcccccgcagcccccugccucuucuagugacuuacuggggucgauccgaaccuuuuuuugggagaaaagcugcuuuuaggagcuuucuuuucgugccuuguuggaagaagcugccguauugagagcccaggucguuguuuuuuccagcuuagaagccauggcgcaccuccauuuuugugcgcucuccuaaugagguuuuuuuuuccccuuccggaccuguuuuaguauuaauuauugcuuuauuuuuugacaagucaacauauuugaggauuauuucauuuacuuuuuguuuuuuaacggagaauuuugcguuuuuaaaaauuauuuuggaucggauauuuuucuacuacuagauaggacucuugcuuuggaccuacuacauggaucagguaaguccaugauaaucagugauaauuuuaaaaaaauuaauguugaacuuggcuuuauuuacuguaaauaugagaaauuccuggaugacgcaauaagauagagagauuguuauuuguauccaguguguuacuuuugagaaacuuuccuuauugauagugaugcuucugucguucaguuuaucccccucucauuuuaaaacggaaaaauagaaauauuuuguuuuucugguguuuaucguuguugcauuacaugaauaucgcuaacaucgucaggacuuuguuccugauaauaaaaccauccgcagaagcugggaccucaccuuucuuucaacuuuugacaguaaauaccugggcacaggacuucaaagcaaacacagauucccccucccccuuaauauuuaagaauuaaaagaugaugagaaauaaggacaaaagccaagaggaggacaguucgcuacacagcaaugcaucgagguaugagcuaucaacuuucuuucuuucuuucuuuuuuuuuuuuuuucgggaaaccucagcuuacacuuguuuacuuugacagacauggauugcugucuguauuucaagaauuuucuaacuuggguugguuuuuaaagcgugaccuugagauugcuaacaugccacacccugauuuuuugguaucaauuuaugaaaguugaguugugacuuaaggccucuuacagcauucagaagguaauguacuuuucuccggaggggccuuuccuagaaacuguaguuuuucugucaguaaauuuucagguuuuagguuuucaugcugcagaaaaaugaccuugucuguuuagccauugcugcauugcaccauuuuacauacaaggcaaauuuuuuucuuugaagaaucugggauauucaaacuuguaaccgagggccauagagcagccugguaguaguaaauuauaguaaauagacauuugagaaaguuauaugaaugaaaaaauguacauuuaaaaacacaaucacaaauaggaccccuugacugaugccuuucaguuuauauuuuugauuguuucuuuugauacacgugacaauuaaaauuuuuuuuaugacuuaucaaaaccuuaauaaauaguuccugagaucauuaaaucuguaaccacaaaaauuuuggaaugcuauuaauacuuaagcuuuguguuuguuacuauggcaauguaauuguauuuuuuaugcuuaaaauauuacaagguuuauguuuguguauauuaagacaguucuuucugguugauaauaauuguauuuuauuuuauccuuauguuuuaguuggugcugcuuuaaauguauccauuuauuuugacaguguccuguaaugcuuucucuucugaagcuuuuuaaugugcuguuuguuuaaaucaugauuucuccuucauucuuugaaguagcuuaucaguggcugaaguaauaaagcauauaagauauuuuuuguuguaugacuguaucuuuauguuaauuuaaaaaugugaaugcauuucuggauguguucuuaagaauugucaugucauaguuuuaaaaucaugcagcuaacaagaaugugauugguauaugauccaauuuugauuuuacuuuauaauuuuacauaaaauucuuguuuaaauuagcuuuuaaauuuugaaguguggaauauaguuuuuuacaaauugaugaguuuacucuuuacuaaaaauauuuugagccuugcguuaaaaaauacauuuccaaauuucuauacaaauugaguaguuacaauuuuggaucucuuuuaaguugcuuuugucauuacugggucaaggacagaaagcuucuaaugcaagacgaauucucuggaaagccacagugugaaggcauaggaagcuucaaugcauuugacagucaggaaagacccagaguuagacuuguuacccccuugaguauaugauuugcauauucucaccaggguuuuggcuuucuuaugcaagguuuuuuguuucauugaucagacugcucuaacucuugaagugaugucuuugaauaaacuuaguauuauuuggguaauaacuugggcauugugaugcauuuaauuccuuuagucaaaacaagaagcagguuuuuacuguuuuugccaaguauacuuuaaaucauauauuugaugaauguccagaauacuccagacuuguugaagauggaguuacuuuuaaauuacuguuacucuuaaguuauauacauuauuaaugcauguauacaguuaugacaucacuuccuuuaaagauuguaaaguuuaaagaauguuuguguuuugugugaugauauuucuccggaguugaaauuuauguugcccuuguguagcuagguguuccugugucauccaguagguugacacuguagagaauuaauuuuugaaaaaauaguguuuagggaacacaacuaaaaccaccaccuuugcagccugauacugcagggauugaaaggaauugcuuucagaucaaauacacuugagagacugcgaucagcaaaaguuuuaaguuuuccuguuuuugaaacaagcacuauacuuuuaaaauagugauuauguguauugcauuuuuuaaaguuaaugcagaagucuaaugugcuuuguauaucacgauuuuuggagauaaguuuuuacuuuuuaagaaugcaauuuuaaacaguucauauuuguaaauuuuuaaauacaguagucuuagugauggacauaaaaaguaugccaaacacuuaaguuauauccaggaacggaaggaaaccaggggggaaggaaugcacauguucuagcacauggcauuucuaaauugaaaauuaaauaucuaucuaaaaauugucuugccuuugagccauauuuugguauccagagguguggguaaaucuuaacguuuuucgcuagccuuguaaggcagggaugauuagaaaaggcaugagcaguguuuguguacugggacaggcaguuuuaaguggcagccauuuuaugacgcugauaauaauacuuuuaaaaaaucgaauuuuuaagaacgcugaaaacaaaccuaauaucagaacauccuuuuccccacguucccauaaguacucugaugaugaaauaaaaggcagcucgguaguuggcgcaggcagcaguucucggaggcccuggcaucuuggugcaaguccagcucagucacaaaauggcuguuccuuugugccgcagcgcugacagacauacugcauugcacuguguacucgccaaacagcaggaaguugcugugcggaguucaaaggccggccggcgcuugcggcgagugcugauuggcugugugagcgccugguaacagcagggucaacgguggcgccgucgggcuggucccgccccuugacgucagacggagugggcgggagaacgcggugacgcguggccucgugcgucggucugcugcuuccucuaugggcucggcuagcgccgggggcggggcagaggaagggaauuuuggucgggacuuuccggugggcggcuucuuuccggaccgauuuggauccuugcugucuuuaggccuggcguguugugguccacaccacacccuaguguguucccgagcccguccuuggaauguuuauccucuuuuggagaaaagacacaguaaucguaaaucuccaaguaguaguacgcuaggucuuuuuauuuacaguuucgccuuaaaaaaaauuuuuuuuuaauguuccggugcguuuucucccguuuagucccucguucuguguaaggagauuagugaguuucauuuuguucccauugguugaaagcaguucagugugaguguaauguuuuuaauucaauggccuuaacggguguuuaagcucugucauacauggcucauaaaccaagggaagaacauuugagcuuguccccgugcauuuucacuugguaucaaacauuuucucaauugacauuugaggaagaaaaacucaggucaguaucucuagugguuuguaagaaucgcagugggguaguuaaagaaauguucuagggacguuuacuuauauuauaacuacaaguaucagugcauuaggcaauacaaaacuguucaguguccgcaaacuacuaaaguguuaggggcacuggcuaagacucaaccuuaauugguaguagaaauuacuugguaaggucuugaaaugccuuggcuguagucucccuuuaguucauuucugguaaacuucuguguggcugcucauuuccugccuuguuuggggucccuuguaagaauuuauuuuuaaaaauaguuuaccaacuauggcuccaaauuaacucaugaauaaugaauuugaccucgaagaaaaagcaguguuaguacaucucuuuguuuacuuaaauauucuucauuccaguauaguuuagaacuauuaaacuauuccuuaggagacaccauuagcaauucaguagauuauacuuuaaauaugggcaacagagugugguggcauguaccuuucacgcaguaaguggcagagggaggcagaccugugaguucaaagccagucugucuggucugcaaacagcuccaggacaaccagggcuauacagugaagacaguuuuaaaaaugguaugggcuucaauguaccuagaaauguuuuuauggguguuuaugaaaggaccaauucccuguaauggauuuuauagauuuuccuuaaucuugguuguuuaggcgaaauucuuaguaaauuagggauuuuaagauuguuacgcaaaagaacuacgcagaaaaauuuauucauggcuauugugcacaaaaugcuuaauguccuuagagaucuauguuuuguaaagugauucuguauuuccugguuucaauacauuuuaaagggauuacuaaauaacagcaacaaaaauaaaaguauguugacacuagaaggaagguaguaauuccaucuugcauuuugguguauuagaauuaaauuauauuaguauuagguuuuaguguuugcuuguagccaacauugcauuguguuuaugagagagaauaaacagcuuuauggaagauaucuucagccuagguacugcacugaacagguuuguguguauuaucaucacuggucugcugauuuaggagcugauuccaaguggagccagugaauguagcaaaauauuacuuuaggucugcccuuugacccuuuuuuuuuuuuuuaacacccugcguaaauacgucaggauaugccaagaaaugugugugugauuugacuaauaaaauuuggacuuuggugagcuuuggugacacuugacuuuaguuccagcuucucaggaggcaaagguaggcagauaucugaguuugaggacagccuggucuaccgagggaguuccaggacauugaaaagcccugucuugaagaaccaaaacaagucccggcaaaacaaaacaaaacccuuguacuuuguaauguuuuuuugggcucuauuauagauuaagucaguggggguugggagagguggcuaacuugauagucuguaugaagccccuggguuugaguccuaauuucccacacuggcugugacauaccugaaauguuuguaucugguugggauguggauccuggagaauaagaaguucaaggccauccucagcuguguagaguuucagacugggccuccauaccugagauuccaaacucagauacaaaggugcaguuaauagagguuugcaaacaauauuugauauguuuugcaagcuaauuguuugaggacuaaauguauaauuuuauuugaacugugcauacuuuacugcgguguucagcccagcugucuaacuuggcaccacauaguuacuaagaucaccugagguccacauucauaccaucucaaaauuuggcagcuacuacugaagaucuuuagugcuuuagcuuugccugacuacuuuagagcuccuuucuugaguuguaaagcuuucuugaggagcauuacuugaacaaagaaacuguuuaaacacuugcccuacacccaaguuagaguuacuuuugcauaccaauagaaaccacuuguagcuugcuuaucuucagugauugucacgcugcuguguauuaccucauccuuuccagcaugaucaggcagucucuccaaugguaccaacuauuacuuguuuuggaacuuuaaagacauuauuaaggggaaaaagaaaagccagacuaaaacuauuugacccaagcaucaaaugcccugaggcugcuuuccuuuuuaaaaucagcaguuuagcacugugguuaccuuuguuuaugugcaugcugugaccucugaucccuaauccuuaguugauuaggugacacugggccaggcacuucugcaaagcuaugcuggaaauauuugagcucaaauuaugacaugaggauuaggccuuucugaaauacauaaccagcauggaagaaagguggcguugaugcuguguuuucugaagcaguuugaacacuucauuucugggcuugcuuaaggauggaucaccuugguuugauguuucagauguaugucuuccuggcuagcuauuauauauauauauguuuaagauuuauuuauuuauuuauuuauuuauuuauuauauguaaguacacuguagcugaauucagacacaccagaagaaggcaucagaucucauuacgggugguugugagccaccaugugguugcugggauuugaacuuuggaccuucggaagagcaguugggugcucuuacccacugagccaucucaccagcccgcuauuauauuuuuaaaaagguuguggauucucuuguaguuuggggaaaguaggcuccacugcuguuuguuuuuaaaaauguauccuuucuaaguguaauaguguuuggcuguauacauguauacauguauguauguauguauguauguauacuaugugauugugccuggggcccuggaggccaggagagggcauuauccccugggacuggaguuacucaaaauugugagcugccauguggaugcuaagaacuacaaaccauccucugcaagaguagcaagugcucuccuaggcuuagccaucuuucccuuccugccccuuuaaggagcuggguaaagguuaggcuuauuaguuuuaugguuuaauucucaguccuguucuuaugagucaagagcuauguauguaguggcuaucaauucaguuuuuacuuuaguacugaaagccuccauuguacauuauuggggggcaugaguguagaccuuguuaauuauuacugggcugugaggaugaauuauuagaaugccucugaagguccuuaggaaagaaccuagcacacugaaagcacccagugaaugcaagcugcuacuaacacuguuuucuucuauuacggcuccccuaacccuuccccugcaguuguaagugccuucugaugagacagguucugcuuaaguguccugccuggucuggugguugcuggguuaucagaaguccuuuuuagacaaguuaggagagagauuuucgagaaugaccucaggaggcaagucccccuuuaaaaucuugagugcauuauguauuguaaagucaguuuuaauuuuuuucuuccucagaagagcuagccccuucgggagccugauuauucuuccuguugucugagucacagcccugcccuuuggcaguauagcugaguaauuacugccugucuuccuuaacuccugccccaguuugcuuuucaagcuguccuaggagagcugacuagugagcuuuucuaguaguagaaaguaguaguaaguuaguugcagcccaucuaguugacugcaguuagccugcccuaguacuauacccugauuugccugcccaugucugcuguacacuguauucccuuggaacuauagugccaagacuugugacuugugaucucucucucucuucucucucucugucucuucugucucucucugucucucuccacuucaguuuguuugucucagacagugaaggucuuuuaaaauauccuagucuagcccuaccuuucagacuuacuuuguagaaagcucucccugugguucagacuucccagugguuuguuuccuaguuguagugucuccauguguuccagagcuuccgaugggacgaacauguucuuauuauuuucuucacuuguaacugcuggccugucacaugcuccuuguugacacuuugaggccaguguuuuuaguuugcuguugaggaaguggguggauggaauucugagagaagaaguuggagguuuaguggagaggacuugugucugugcuugcugaguguucuccagcuccaggcauuugugucagacagggagugaggacuuuucuacugaggcagggguccuccucuggcuccaugugcuguauguucugcuggucucgucuguaguguauuucauacucacacucuuuugauggauucaggaguuuguuugggcauuaaucucuuuuuuuuauauauuuuuuuauuacguauuuuccucaauuacauuuccaaugcuaucccaaaagucccccauacccuacccccucacuccccuacccacccauucccacuuuuuggcccuggcguuccccuguacuggggcauauaaaguuugcguguccaaugggccucucuuuccagugacggccuaggcauuaaucucuuuaaguuuacuuaguuaguaccuucucaaaucuuaaaaagagcuacuuaauuucaauacauuuauauuccaaucugacuucaccuucccccauguggcuuauagagguauuaucuuaccagauuauccaggaguggaguauaaauugcaacuggcaucaacauuuuaaaaauugaucaagaaaaauccuuagggaaucucauucauguagucugucuuuuugaagcaguuuuacgcuauaucccugguuggcuuauagcucacucuguaggucgggcuggccuuugagcucugccucugguacugugguuaagaagggcaugugccaccagccaugcugcuuugcuuuuuuuuuuuuuuuuuuuuuuuuuuuuuuuuuagacucggucucuuuguagcccuggcugucccagaaugcuguauagaucaggcuauccucaacugagguccaccugccucuguuucagaguccugggccuaaagacacauaccaccugggcuccaaauggcccugugucugugaucuuuguauuuuaauagguaucaagucuguagaugaaaugggugugagagacugcuuaaaagaaacgagaaggcucgggaacagcugccguucauugggccugcugugaaugaacccagccuuguuccugaagagguaugauuauuuucccuguuuuggaaaugaagauugaaguauaaugaagucauuaguggaauucugacucagguuuuugguagcuggcuuuuggaugguuguugauucagaaaaagcuguagaagaaauuagguggcgucauccucuucugcuccuaaaguuuuuauauuuuugucucgcuuccucccuccuuccuuuuuccuuccuuccuuuuguucgugguguauguaguucauguacauacugagaccagaugaggaaguggggugaccucugucgucacugucugcccuauuccuucuagacagguucucacugaaucugcagcuaggcuggcaggcuccacuguauuuuuagaccauaccugccuuuauuuuguuuuauuuuacuuuuaaagacagucuucacuauguaguucuggcuaccuuaaauuaaauuuguauuuuguguaggacuguuucuuguaugcaccucaugugcuuauuagugcccuuguagaccagaaaaugguaucagauccccauggagcuagaguucuagacaguugugagcugccaggagggugcugggaauggaaucuggaaggacagcaagugcucuuuagcccugagcauugccggccccacaguuggcuuuuuaugaagauucuccuccccagccaccuuuuacauuuuauucuacuuuuuugagacuaguucucugcauagcccuggcuguccugguccucacucuuuagaucagccuggccucccagagugugggguuaaaggcuguaccacacacagccaccuuuuuucauuuuaagaaauaaaaaaacucgagaauacugugcauuguggaugugauuuuuuuuuucaaaaggccauuauuuuacauaaaaaacucuagugaaaguguggcauuugaagugguuuccuuggcuguaguuaaaacggaagaguguagguggauaugcggccauugaagugguuuccuuuggggcagcugcguccugauaguguuagguggaugaggaggggaaccuuagacuugcacguuuguuguuuggcuuauugcuacacaugcacuuugggcauguccaguuugugcuuguggucccuccucuguaucccaauuuuaauuuuugugcacauuuugcuuugagaauuaccuggauaaugaaaccaagguaacugacgguaucuuaaugauuaguguguccccugcucagauucagauacaugcugguugacauccacauaggcaguauguggaggaugcugagggcaaaguuggaacccauggaccaaaaguuccguucacucuuucucuuuaacaaaaguuugucuuuugaguuuagcuuuguuaugucuauauguuuuacauuuuguguauauauguauggauguguguguauauauacacacacacauuuuacguauguauguauguauguaugcauguauguaacaguccuccgguggcuacagguuucagaguuuuggcaacaggauaggguugugugacaggcguauagaggcuaucaacaguuuggaucucuguucuuuuucucucuuuuuggagaugguuucacccaggcuggauuguaauuugagacaguucagccuugguuuccugagugauguuuuuggugugugauccaccaccaucugccauuuugcuuauuuuuagcuuauuuuugggcaagaacucgggagguuuuaaaaaaaucuuuagugggggcuggugagauggcucagcgggguaagagcacugacugcucuuccgaagguccugaguucaaaucccaccaaccacaugguggcucacaaccaucaguaaagagaucugacacccucuuuggugcaucugaagacagcuacacuguacuuaugaauaauaauaaauaaaucuuuaaaaaaaaucuuuagugaagcaggggucggacaauggcagcuuuuacccuugaugcugugugguuucucaccaucauuuuaucuuacuugggaauauauagguuauuacuaggugcugagguguugcugacaucuagugcauaggcaugugggaugcuaaacagccuacagaggugcucccucaacaguccagcuccagcucugucaaagauggcccuagauagaaagcauuuaugacgagaaaugaguuuguuggugagugcuaaaccgagaccuccuuaccuuguuuguuuucuuagcuagcuccaaggacucuugaggacgugggaauacauuaaacauuuauuauugggauugguaacuggggcuuuuaaucuccuuugaucuuauaaaagucuuuaagagucuaugaguuagcuaguaagaaaauagacuugguuuaaaagaaacuccuggccauuuauucguagugcucaggauguaaucguccccuuugauggguggucacaccuuguucaugaguucagggagguuuccuuggagcuucuguagcuuggccuggccagucuuguuuuuaccugcguggaaagccuucuuuuuuccuuuaguguguuacugcugccagauccugaguaugcauaucguucuccguguagaucauuucuagcuucuuugauguaauucacacccacauuugccagggccaauagagugaguacaagguaagccaucuaaguugaugaaaugucaauuaguuauuggggaguagaaguaguaucagaaagcuuaagauggcuucugccuggucccagaugaguuucagaaacacgggauaaaugcuggguauuuucccuggcccagccuccagaguagcuagggggguauaggcuuguaccaccaacucuguuacucucacacauaccgggauugaacccagagaggccuuaugaguggugggaaagcccuccgcugcucuaaacugcaaaccauuggcugccuuaauuugagaaauauggacaggauuuagcuuucucauuccaugaaauuguaaguaccauuuuguauauuuuucuuuaaagugaaagugaauuuuccuauagagaaauggcaguuuuuaacagaaacuugaagaucuaguuggguuuuuauuagugauugaggaaugggcagcauuucaucuguaaguaggaaggcaucuguaaguaggaagaaaacaggauuuucuuuucuuuuccuuuuuuuuuucuuuuuguuuuuuuuuguuuuuguuuuuguuuuugagacaggguuucucuguguagcccuggcuguccuggaacucacuuuauagaccaggcuggucucaaacucagaaauucgccugccucugccucccgagugcugggacuaaaggcgugugccaccacgcccggcgagaaacuguauuuucaagcagucaguuagaaccaggaaacaacaaacaggcaguucccuuugcuagacagacaacuugauugugccaauguaaauggcccuggagguaagguaaacaguuuagaaguuuauccucagugacuccaguuugauuuuguuuuguuuuguuuuuuugguugacugguauauuagcccacuccaaaucaguggccuucuguagauuaauagugagacggaugucaguggaagagggagcagggacacacucaguuccuguugcugccacuaccuagagaaaugcuuuguaguugcagcaggacucaugacuucacuacagaaaagaauuccauuucagggggauucaguauauauauauuaauaauauauaguuauacauauaaaauauauuauauaauaauauauuuauauaauauauaacaacauauauaauaguacuauguuucguuuuuguuuuuuuuauuuauuuacuuauuuaauguaugugaguauacuguagcuguacagauggcugggagccuucauguaauugguaauugaauuuuuaggaucuuugcucgcuccggucagccccgguugcucagucccugcuuucuccagcucaaagauuuauuaguuauuauacauaagugcacuguagcugacuucagauacaccagaagaaggcaucagaucucauuuuaggugguugugagccaccaugugguuggugggauuugaacucaggaccuucggaagagcagucagugauuuuuaacugcugagccaucucgccagcccuauaauguuuuuaauaauugauauuaauuauaauauaguaauauauaacaaagauuucuuauauugguccaguauacuuguuuuuauuuuauuuguuuauuuuuuuguauuuugaggcaggguuucucuguguagguagcucuggcuguccuagaacucacucauagugaucagccuccuuccaccucccaaguguugggugggcacucagggaaguugugagcuugggucccucaaaggaguugagauuaaggucuuuuuagcuauaaguaaguacugcuuuuuauggcuacuaaaguuauauuuugaagggccaccaaaggaaccuuuuaagaauauccuucgacaguguggugucuuaguugucauccuccauuggucuuccaucucucccucccuuuucugcugaaacccucuuuugaggaacuuuuuccuuuuggggaaguagacggugggcuggauucuaauguguguuaguuaugaugacauuugauaaaguagacgucuagggcacugacuuucaggggaacuugagaugugcagcgaacagccugccauuagaucugugaguucagggccagccuggucuucuuagaguucuagccagccagccagggcuauggagagagagagaaaaaaaaagggcuuaaaaacaaaaucaagggcuggagagauggcucagugguuaagagccauaaaaacaagacuguucuucuguagguccuggguucaaaucccaguaaccacaugguggcucacaaccauccauaaugagaucugauguccucuucuggugugucugaagacagcuacacuguacuuaccuauaauaauaaauaagucuuuaaaaaaaaacaaaaaaaaacccccacaaaaucaagguguguguuggggguugugguggugugcgaagggcuggauuuagucuuguucugagaaaaaaugucugaaugcagugaagucauauuuggagcuccuuugggcaaaucugcugucacugugguagccggguuggaauuauuuauucucauuggugagaaucuuuagcuagauuccaccuuucccugccacuuccuaauuuucccugucuguuuugacuaagaaagugaguucaugaacggaauccuaggaaaggauccuauaugauucagagaaaacuugguggccauagugguguuccuuuaguucuagugcguguaagguagaaguauuuagaucuuuugaguucuugagucgcuguuucaauaacaaaaaccagauaaaccuuuuugaaaaauuaugaagaaagcagagagguucagagaguuaguuuuacuaacaguuaagacauaccuacaaucccaucacaucucuuuuacgacugucauuuuguguuuaacuuggcagacaaaaaauuuuaaaaauguuuauaguuuguauaguuuuguuuuaaaacuuauauuuuuagaauugucacuuguauuuauagaugugauuaagcccuaauuuuauuuguguaauauggaguuauuuguguaauaugaauaauucacaccuuauauuuuauacguggauaugaagauccauccuucucuuucuuccuuccuuccuuccuuccuuccuuccuuccuuccuuccuuccuuccuuuccuuccuuccuuccuuccuuccuuccuuucuuccuuucuuccuuucuuccuuucuuccuuucuuccuuucuuccuuucuuccuuucuuccuuucuuccuuucuuccuuucuuccuuucuuccuuucuucuucugccuuugaacaguuuggcucuaacuguugcuuugguuuauccagguagcauacaugcaccuauguguugauuugcaggguuaggguugguuuuuuuuuuuuuuuuaaaaaacucaggguuucucuguguauccuagcugucuuagaauucacucuguugaccaggcuggccuugaacauagagauccaccugcuucugccucccaguugcugggauuaaaggugugcaccaccacugccugaggcuuaaacauguguguguguguguguguguauuuuuauuuuuuuauuuuuuuuuuuauuauuauuuuuuuuuuugguuuuuuugagacaggguuucucuguguagcccuggcuguccuggaacucacuuuguagaccaggcuggccucgaacucagaaaaacauguauuuuuaagaaccauuucuggaacaggcaagauaagcugucaguuugaccuucacauguguguccuggucuaucauauaugugaacacaguaaguaaagacuggggggaaauagaaaaagaagagaaagaaauguuacugguuaauaccuuuucucuaaaccugucuaaacuuuuguuagugguaucacuacuuaccagcuuauaauugcauaauauuuuuauuaguuuuggcaaaauauguaaaauuaucucccacauuacaaugaaguuuaauuuuuugauguaaugucuuaauuauauauauauuuuuauuauauuuuaaaaaguuuauuggccauuuuaguuucuuuucucugaucauguuugcuguuuuugccuaauuuccuacugcauuuuaaaaaauuuauguacauugguguuuuuaccugcaugugugucugugugaaggugucaccucuuguaguuacagacaacuaugagccaacaugcagacauugggaauugaacccggguccucucgaggagaagucggugcccuuaaccacugagccaucucuccagcccuccucccagacuugugauaugccagucuucauauguugaauauuuuuucuuacccauaccuucaacuugguuuuccuaauuuacuuggcuuagccaugcuuauaacauaauccucagaguccuaagauuugaccucagaaguauaagggaucuuaaagcuugaggaguuguccaaagucagugauucaaguagcucucucucccuuugcauuuccaccacgccagagccuaaaaggagcagucucagggcagggcagcuugguugauuugauaauguguuugacuuaagagcgugcagugcaaagccagccguaccucaggaggggaagugcagauucuguaguucucaguuguuaacacucguggacuacauagacgcauuuaaggauuaggcuuuuugcuauuucugacacuuagugucuauaaugugaacuuuguguggauagcucuucuuggaacuuccuuguguucuucagauuugcguuuaccagcuguuaacugccaagcuuugucaaguaguaagaaguucagccauuuugugaguuaggggaauaaaucacagugugcugaaauggacgccuuuggaccgagaacccgcaggcuuucucuuaagugcaguguuguugugcuguccucuuguggccauuuugaaaaugauacuucaagaaauggaagugacccuguuguuuuuaaagucuaguuuaagaaagacugcuucauuuccuaaaaaccuuaguaaagcuguuuuuucccuuuucuucucucuuuuucucuuuugacacacuuuuuuuuuuuuuuggguccaguagaaaguauacauuuuguuuuaucgcguuugaauaauuuucaaaugaauaggcuuuuuaugaggcuguggugcauaauucaugugaauauaauuuuugacugccuuguaacuauuacaccuuggaaguuagauuauuauuaucauagcagaaaguccuuuuauuugaggauugucacauauaaauugaauuugccccuccacccccacuccauuuggauauaggacacaggcugugcccuaauuuucagcuucucaagugcugcuauuaaagcauguagcacaugccaggcugcccuuuuuauuuagucuuagaaaaccucugaguccaugugaaaguuccuguguagagcugacauucaggauuccucgguguuagggaugccaugucacuucagcuguugcuucucuccuguuagaggguuuaaaggaccauguuccuucaacaguaaggaccucauccucugcuuauuaucuuagcaccagugaggcagaggcaguguggcuggccaaaaaaaaaaaaaaaaaaaaaaaaaaaaagaagaaaaaucaaaacaacaaccucuucucccaauaugaaaaucauuccuucucuuggaguauguuaucuuaacaucuagcuugcuuguuccaaaauaaagcucuuuguuuuagaugagggucucugcauaucuuucaugcuuuccuuaauuuugugaugauagaccugucccuuaauacauggguuuaaaaaaaaguccuuccuuccucccucccucccucccucccucccucccucccucccucccuuccuuccuuccugauuuuuggagacagugucuuuuguauaggguugagugcguguucucuugccuuguuugcauuuuucuggauguguuuguuuaguuagucaacuaguuuguacacugaaaauauugaagccuuagaagcagcugcggaguucaucacuaaagccacaaacacgcccaugucuucucuggugacgucuguuuuccucagcugcacaggugccuaacuuuauuuuccucgguuuuguuuuuguaguauuuuuuuuuuuuacuuuuuauuuuauaaguauggaaucuaguagcauggcccuuuccacagaacgagccacucuucacccauuuguggacuagcauuuacacacauaaaugugugcugaugggaauguggguguuuugugauaguuguaugcaguguuacauuucuuuuuuuuuuuaauauuuuuuauuauauauuuuccucaauuacauuuccaaugcuaucccaaaaguuccgcagcaguguuacauuucuaguggucacuuguacacaagcagaaacacagcuuuccaagaagguauauacaaaauauuacagcuuuauugguuauacuaaacaaugggaaaagaaccacuuuauuuagaaauaaagauaaaacagaaaugaaucacggauauuuauagauuauuaguuaagagaacaauuugaauauaaccagaguggacauugaaauacagugcacuauguggcaauucauagggacuuguucuuacacugcauugcuauauuauguuacaucugcugugagcccugcuuuucagcauaagacgaagccuuuguaguuaacuuugcugcuuucugcaguacacugaaacugucucuuguagcuucuucugggucauuaaaacugguaguuuagcauuugucagcuacacuggaauauuucuuugcucagagaauauguugauuauacuguguugcucugauaaugauugucaugugauuucacacacaaauucuuguuugucuggaguucagcuggaaaaggaagucauuucuuuuuuuuuuuuuuuuuguuuguuuuuuuuucgagacaggguuucucuguguagcccuggcuguccuggaacucacuuuguagaccaggcuggccucgaacucagaaauccgccugccucugccucugccucccaagugcugggauuaaaggugugcgccaccacuaccuggcaaaugaagucauuucagucacuaaucacuaauacgcuaggcacaaggaauauugaaaagauggccuuagguuucaagccuguuuggagguugacaaguaaccacauuauuuuuauaggaugggacaaaugggagacaagguaaugugucaaauaaauagcugggcuuuacaaaaacugagauuuauuguucucuaauugguguuggaaucaaaccucagcuuuguacacaaauagacaacacuguaccacugacccacacuccuaacucaacugcuggguuugccuucauuuuccuccgggcaggaaucgcugugcaaagugagagguagcacaaguugagaggugcagcugaugcccagguggggcugccaguuuucauuucucauggcaggaauugcagugguaggucagcauuuggaagugucuaaagcugagcucagcaccugagacagcaaagcaugcguuccuacagaagaugauacucaagcucuugaaguuagauacuuaguuugcugcauaagcacuguacagggguuggaggugaauguacugcgauuuaugccuugccucacaacagguguuacacagagcaaauggggaugagggaaggaauggugaagagagcgcagcggcuuggagagggguccuagcagcuaagagggcuuacugacuggucuuuguagacaaucugggcuucaguuccugcaaccaugugauggcuuucaacugucuuaguccaguucuaggccaucugauacccucuucuggccaggauacauagacauacauggaagcaaaacacuccuccacaagacuugucagagccuuuguuuuucuagcucacacugagaugggcacagagagcaggccaggcugugucaucagggcuggaagcgaaggccuuuguuaaguacucaguuccccagcuuccagauuauucccuugccuccgucuuagggagggcgccuggucugaaucuaugauuuauguaguucucucuguaaauggcggggcagaacuaacaguccuuuaguguucugaguuucaugguauuguuggcugggagagcuuucucguagacauccaguuccgagacgucugagaugucagacucucauagcauuuauguagaaauacugcugcuuucauagcuuccaagugaugcccaugauucuuuaggaggcuggaccuaguuaaaagggggcuggagagagagauaagagccuuagcugcucuuucagaggacccaagcuugauucuuaauagucucgggaacuccagugcuagaggauccaacuggccucuguggguauuguacagaccuagugcacagacaugcaugcagccagaauggcgauaugcauaaaaugaaaagaaaagaaaagaaaagaaaagaaaagaggugaaacuagaaagugagagaugugauaaagaacagaugcccaagcaaaagggaaaggcaagacccuuaaaucugucaccauaggugacaggaucaggagaaaaacguuuauaaaguauuuagcauuuuacccgacuuuaagaggugauaaggaaggcaguuuguguuucuauugucuuuccuccuuagagaauaauuuuuccacuuucaucuugacguaaaggccuuuguaguguaaugugcuuuuuuguagauuugggucaaugaaaguuuccaguaauuuauuuucuuucuuucccucucucuuguuuugucagggacucauauuccaggcuggcuuccaacuuguuauguagcaaaggcugacugaacuuuuaauccuucugagcauguaccacugcacaugcaugcaugcauacauacuacacauacucccaggggccccugcugucuuugaaugcacacuaucaacccagauaccccgacggcccaguuuccauagacguuucuuaagugaccucaguucuagucuggcagacaguggcgcuaccagggcauuucccucucagcggcaugcuacugugccuaccucucaaccuacgaaaccuauguuuuguggcucgcaagagugucguuuuuaaaaaaaagauuuauuuauuuuacuuaugaauacacugucgcugccuucagacacaccagaagagggcaucggaucccauuacagaugguuguaagccaccaugugguugcugggaauugaacucaggaccucuggaagagcagucagugcucuuaaccgcugagccaucucucuagcucuguuuuugucauuuuugaaauuacuaccuuuuauuuagaagggggcauuugguacuuauuaaacaggugugacuuaguagacaguucguaguguuccagugaggucagagaguuccuuaaauacucggagcuauacaguuuuaccucauuugaaugaagggaccuaugucaagggacccuugauuaugugaaaauauguaaaacacuugguauauguaugguaccaaaaaauacagaaguaaagguugacaguuauaggaaaguaaagcaugaucugcagcacaagaauaaagugaauuugaagaugugaaugcuaacuugccgaaauuauggugugaagacauaucaccagaagaauuaacaaaacaauuucuguggcaguuuucaguguucuaagucugucuuugcuuuucucucuguuaagucguucagcuucugaagaagugucggggucagacucaggcagucagucggaaagugagcagggcagcgagcccggaaguggacauggcagcgaguccaauagcaguucggagucuucugagagccaaucagagucugagagugaaucggcagguuccaaaucccagccaguccuuccggaagccaaagagaagccugccucuaagaaggaacggauagcugaugugaagaagguaucauacucucgagcuggauauugcaaauuugcuacuaucuaggacccgcuagcagaguauuuccauagaagguugaauacuaugcccuuuugucuguuucugcagauagguacucauagaccuugggcuagccuggaacuugcuugcaguacagccaaggcuggcuuuccacccuugacccuccugcaccaguccuugacgugcugagaguguaggcgugcacuaucaugagcuggccaguucuucccucccuaccuuguccuuuguuuccagacagggccuuacuguggagucuaguguggccuggaacuccuccguccuugcgcugggauuauaggccugggcuauaaucacugcuguagcauuuuccuuguuugaguaauagaaaacaaaccaugcaacagccugaacaaaggcaauuguaguuaucuuuuugcuuauuaaaaaaguaucuugacgcaaagaauucaaaagacaaaaauuaaggugcauaacauuuucacauugauuccaaaccuuggaauacauuucuuuuuuuggugaaaaagaauuaugugauugugugacuucaucagaaggugucugaacuuuucugggggugggagggagguggacauaggauaucauguagucuacguggucaggaugacucugaaccacuccuucccgugccugcuguugggauaagaggcuuguguuagccgggcguggugacacaugccuuuuaucccagcacuugggaggcagguggauuucugaguucgaggccagccugguccacaaagugaguuucaggacagccagggcuauacagagaaagucugacucaaaaaaaaaaaaaaaaaaaaaaaaaaaggcauguguuaucuuuuuuugugguguuggguuugagcauugcugauaaauaaguacgucaucagcuuagguacuucccagcccaccacauaggaacuuguaagauuuuauuugagggcuggugagauggcucaguggguaagagcaccugacugcucuuccaaagguccagaguucaaaucccagcaaccacaugguggcucacaaccaucuguaaugagaucugacucccucuucuggagugucagaagacaacugcaguauucuuacauguaauaaauaaaucuuuaauaaauaaauaaauauaaagauuuuauuugagagaugugugugaacaaaauacuuugcuuucacuuuaaaaaaaauaacaucugaauaaaguuuuguugucuuuuaaauuuaagcuacagucuaaaaugcaauuuuguauucauauuacuuuucauauuauagaugauauuaaauuguaggcaguagugaaaaauuucagaguauaugaaguuaaaagucagccacuuggagcucuuaaggcagaggaguuguuuuaguguucagcagaguugcugcacaaugguauuuggcauuuauguggcaucagauggcugauggcuaggaguagggaaauuuacauuagaguuuguuuguuuacuuacuuauugaugugagacaggaucucucuauaaauccaugacuggccugcaacacuguguagcccaggcaccucaaacucacagcugccucugucuuuauaguauugugauuaaacacaugugccaagauaccuggcuuuguguguguguaugucuuacuuuguagcccuggcuguccuggaacuauguagaucaggcugcccuaaacucauagagauccccaugccucagcugcccagguacugggacuaaauggcauaugccacuacacccuuggcuuguuuuuauuuacugccuacaggcaguuguauggaacuaugaguagcuuggaguccucacagucaguaaaggcgucacaaguuuucugcugagucauacacagaguuucuccucuguagcugggugugggcagaaaggcuggagcacaagccuccuucucuccuuucccagguuggcccccuguguggugagcagcuaguuaucugccucuuucacuguacuccuaacuccugccuggguauuugggauaauucuaaagucauuauuuugggaauacauugaauuacagaauuacauuggguucuaguucugaaaugccuauucuugggccacuuguaacuuuuaaaaguuguuuucuguaucugauuuuuguuuguuuguuuguuuguuugguagguuguuuuuuauuguuuaauauucucuccuuugcuuaguaauacugugggggucuuguuuguuuuuugguugaucuuuuaugaauuuuugcuuuuuuaccccauuuucuacuuguuuuuucccuaguuaggauuucagucuuuagcucuggcugucuuggaauucacuguguagacuaggcugucugacuuugaaagcacacugaugugccugucgaugccuccuaagcacugggauuaaaggcaugcugcaccgugcgugccuggcgaggcaugggcaauguagucauuauauucagacuuugaagagaaacagcgggaccuguuuccagugcuguccuagacuuggaaaugccuccuguugugggagucaugcucucucccugcccugcccauuauaccuggaugcuuugugauugauuuccuauuacaguuucagagagaaauagccacauggcuuagaauguuuacuggcuggcucccuagagaaaacacccuuccuucccuguaaacauucacuggcugugcuggcuucuuguccucugcauauacauugcucugaauuucugaauguuuucaugacauuuacuucaguuucuguuguguuguguuguuuuguuuuguuuuguuuuucgagacaggguuucucuguauagcccuggcuguccuggaacucacuuuguagaccaggcuggccuugaacucagaaauuuaccugccucugccucuugagugcugggacuaaaggcgugcgccaccaugccgggcuagugucuguuuuuaauaagagccauaauccugcuuuugcuuuucuaacaucucuuccacauguuuaaacaugauuaaacaucuucacaccagugugccacaguccauucagauuccuuuugcucuucugugauuuuuaucuaaaaagcacagagcauuuguaagcauaauaaucucuggggaagagaguagaaaaacuaaacuccucagcuggacccuccuguagaguuacauuuucaaauccuuggugagaggcagagugcuaacugcugcuagugggcuaggacagguauaccagggcgaaugcagaggaggcccucaucugcagauccuggcuggcuacucugccuuguggcauggauucggugaugccccucugcuuggcuuuuuuguuuuuguuuguuguuucuaaguugaaacuguaagcaucaggaaauuuagaauuccuccauacuuuacauuuacuggaagaaaucagggucacguuuuaguuuagcaguguuugggauacaguuaauagcggcgaaggacguuuaaguccuucauuaggauaauacuuaacucuuuugaaaggauacuacuuucucucaaauguagcaaaacaacccuuuggauauuuacaugacuuuguuugauugaaauaaauguucugauaaugaaaauagcgaguagaguuagggaaaggacucaaugugcaaucuauucauuuugcagaugugggaagaauauccugauguuuaugggguuaggaggucaaaucgaagcagacaagaaccaucacgauuuaauguuaaggaagagguaagaaaagacggauucaaggauuugcacuucaguucccuuuucaccccaucugcgacugguguguuuuacuauuaaagagacagcuucagguguggcaguuuaaagcgccucuaaucgggccuuucugugauaaguagggcaagaaguuaaguaaaaacuacucaccaaauaagucauguuucaauccaguaguuauggugucggaugcuuuuaauuagaacuugacuuugagugaaguugauugugguaaguugacuuuagacaucuuguauucugucuuaagugagugacuuaucugcugaacacauggaacauggaagugguuuggauucacuucagagaaaggaaagagggugcucaguguauuuuguauuuccuaguucauguaaguuguagugugagagagaaaguuauuuucuaauauacucauauucuggucucauuaacuugagauggaauacuuuuuuuuagugauggggcagaaccuugguucuugagcaugcucagcaagcacccuaucucuuaccuccguccccagugcccagauuugugacuuuuaaagucaguauuguguacuggguucuuacaucuauagaguugcccuuguuucaugcuuuccagauuguaucacuauuuugugaaaucucuccauauuagauuuguagaguaaauucugaagggcuauucuuacuccugucuuagugaaauguccccuuucugccuuaagaggauuuugcacuucuuagcuauguaacauucuuuugauggaagcuauguauugacagccaaaugcuggggaguuagguacagguuuuauuagguguccucagaaagucagauucacaccaacaccuucauguuuaugcauuugaguugugaguggcuucugagcuggugagccugggcuucccuuucccguaguuuccagaccacugaaccaugcuccuuguauccaguuacuguguguacucguccugucuuauacgucaguacauccuuagcaggacccaggacuaacagcaguaggaacagugccauuuugguucauuugggggaagacgcugucacacugucugugacuauaauccuuccuuggccuagugcuguuaguucuucauucaugauugcugaugcucauugagucuaaggugacuaaaucaguaggcagugccuuuaaggcgcauucauuaaauuugguauuuuuuuucuagguuguuagaucuacagugguuugugcaguuacugcuagcacauguggcuuuuaaaauuuauauuuagaauuauguaaaauuuaaaauuuacuucucagcccuagaguaggcacaugucaagugcugaguucuaugugguggcuggcucauuguguuggagggacaugauuuagguaguuaguuguauuuguauuugauguugcugcuccacaugauucugaaguguaaacacgagaaagagacacuguauuuucaaagcaaaagaagagugggcugcaccuagcaaguacucaggcuucauuucaucuaaagucuuccugugaguuaaagucuaaucaucuuuccccucccacacugaaggcaaguagcgggucugagagugggaguccgaaaagaagaggccagaggcagcugaaaaaacaguaagucuuuaucauggggaaaugaccuaaucugacaguuuuaaauaugucugcguuuaugggacaaucuuuguguucugucugucccaggucucaagauucucuuuaaguuuguuagagcuccaacuuccacuucuuaagugcugguagccuaauuagcucaguuaauuuuuuucuugaauguaaacaaauaccaaaguagacauugcauucuugcaauguaaagaagauuuaaauuggccaaucucauguugauaugguaagauucauauuguuugugcacuuauuuuauuaugaaauacauaauguuuucauauaauucuaagauuauaguuuguagaccagaagcuuuuaauucuugaguuuagaguuaaaaauuuuuuuuucccccuuugguuuuuucaagacaggguuucucuguauagcccuggcugucccggaacucacucuguagaccagacuggucuugaacucagaaauccgccugccucugccucccaagugcugggauuaaaggugugcgccaccaccgcccggaagaguuaaaauauuuuacaacaaauuauauucuguucauuauuuuuugcagcauuagagauugaauagaaagccugacauaugccguaggcaagcacucuacccgugagcugaagccuugguuuugugcucauuaacuauggaauuuuucauuuuauuuuauuuuuugguuuuuugagacaggguuucucuguauagcucuggcuguccuggaacucacucuguagaccaggcuguccuugaacucagaaaucuaccugccucugccucccgaguguugggauuaaaggcaugcaccaccacgccuggcuuuuuuuuuuuucuuuuucuuuuuuuuagaaauuauuuucuuacaauuaaauuuaaaaagccuuuauuguugaauguguguguauauaugugugagugugcauguggaggucagggaacagcuugugggagucucucauguaggucuggggauggaaucagguuaucgugcuuggaggcauacaccuguaucugcugcaccggugaucucaugggccuuauuuuuuuacuuugacacagggucuccagugccauagguuggccuuggucuuauuguguagcugaggaugacuuuaacccuuggucuuuaugccucuuuuccauauucuggaauuacagguguauacuacuacauauagcuauauauauaaaaauaaagauuuuuuuaaaagauagucucaucuuuuuuuuaaagauuuauuuuauauauaugaguguucuaucugcauguauaccuaccugcauguccaaagaagucaucauaucauguuauaaaugguugugagcuaccaugugguugcuggggauugaaaucaggucaggaccucuggaagauuagacggugcucuuaucugcugaaucaucucuccaggcccagagucucaugcuugccaagagcacagggcuugccuagagcucacuauaaaccaggcuucccuugaacuaugacagauauugucugcuuucccugugcugggauuacaagugugugccuuuaccccugccuucaguaugguuauuuucucguuuuauuauuuuuggugcaagguuuuguuuuacugcccaggcuagccucaaacuuauggcccuccuagugaugagaugaaaggaauguagcauauuuauuuauuuauguauguaugcauguaugcauguauguagagacaaggaucucacuauuauagacaagucugagccuucugcuuucacuuuucaaguccaggauuauaagacaguccuucuaucucuagauguucacuguuuuuaaguuaaaaaauuauuacuaaguagcagucuuaccacccuccccauuuccaugguguacaguuccauuagcuauauugauuuuguagauccuuuuugaaaaacguagguauccaaaacuuugugcaucaucaauccaggaauacuuuccaccaaggucuucaguugcauguucugugauuaguaggcaaauuugaauuuuuuaaacccauuucuucaucuucaaaacaguaguaaaaauucugcuuacaauuaauuaaguuguuacauuaaauguauaauagugaagaacuucauagagcaguauuuaauaaggucuugcuugaauacacccaguuucuguucuguuuuacauaccgccuuggagacagcuugcuggagccucuuuuaggagacuuucuuugcacuucuguugcaugaguugcuugggagucugccuucuguuguuuauuuagguauaauggccuuauugggauguuuuugaaaugcccaacuuuauuacauuguuugaaggcaucauaguuucaauauguguggcaacugugauuuuauaacaaguuuaacagaaucugcuguguuugugugucaaccugaauuugauaauugagagacuuacccaaagggugacaugcuuuucagaaacuguauaguuucugcauuuuuuuuucuuuuuuugagaugggagucucagauuuuuaaaaaagcugaaggaauaaaguguagugcaaauguuguccuaaucugggcaugucgaauagcauuucuacagguucuuugucccaauaguuuuuaugaagguacuguguguugguccaacucuuccuuccaaccagagguuaaaauauuuuaguuauaaucaugcagaggugcgugugugcgugugugugugugucugucugugugucugucugugugugacauagagagggaggagggggagaaagaggucaugguauuuauuccuuucaguguuuugaguuguguaucugucauagaugugucaaaauggaguugggacauuauuagucccagauuggaauuguuaaugaaagcauccugucuuggggauaucugcuaucuggaagccauuauuucuucuucuccucaugugucuuuuaaaagaauucucuuuggcacuuagauguguacaguaguuagccacugccuuuuguggccaguacucacuauauuuaaaagugacuuuucucccugccugcccucugaauugacgcuuugcagccucucuuuucuaacaauggaaaguuaacuguuccuagcugaugaguagucagacuacuugugugcuuacuuuacuuuggagucucaguagcuaaauuuugguuguuuuucccauagucccaaaaauuugacaaaaauucuguugaugccuuacauuagaucaaaaugaaaguuucuuuuugauaacugaaauaguucuuaaucaaguucuugacucuuuaucuuuuaaauuuguuuauuuuauguguggguguuuugccuuuaugcauaauguuugccuguuguccuuagaguucugaagagagugugugccuccccuggagcuacaguuagggaugguugggaaccacugugugggugcugggaaccaaacacaaguccugggagagcagcaagucuuaacuuauuagccaggcccagccucuuaugauuccugguuccugcaaccugacucgcagugcauggaugacugggaaguguacuuuaaguucgcuuccuacaagaaaggagcacauuuacucguucaagagcucugugcuggcgugggagugaacauugggagguugauaauuacucuuaccucaucuccauagauggcugaucguucuuucucuuauuggguaugauggcaaacuguaaucccagcucuugggagggagaggcagaaagaagcagauauaauuuggcuaguuuaaggcuagcuuugucuacacagugaauccaggccaggcagaauuauauaguaggucccuguuucagaaaaaccaagccaaauaaaauaauucucuuuuuuuucuuguccuugauaauauggccaauuucaaaccccugcaccucuacuugucuagaugcucuggaacguguaagcuuggguguaguuuuuccuaggucuucaacugucuucugcagguuaugauugagaaaaguaggugugagguugcugugccugcaagcagcuuagucucucccaggaagaucaucucacugucucacugggcuguagacccguugauuuuauaccuuuuucucuguuacauucuugggguggaagagcccaaguucuugugguuguguauacauuuuuaauuggauugccguacuauggccucaacacaauugcugcaguuuuugccuuuguagugggucucacugaaagcacuaguucagauuagugauucugcguuguuuccauucguggacuuucccuugcuucuuaauugcccaugauuuugagacuuguuucugugaggccauuuuucuuuuacugcauaacugcugauucccuuuggagggguaaagaauuguucuaaguccuagggagagcacagacucacgugccggguucccaagugcuggcuggguucaccuuacuccaucuucuugacaaucaccuauuacuuagaugcccuuuuuguuuguuuuuucaaaguugguuuuaacuccucauugucuugucuuguucugacacaccauugugucugucuuuuguuuguuugucuuuuugagacaggguuucucuguauagcccuggcuguccuggaacucacucuguagcccuggcuaaccucgaacucagaaauccgccugccucugccucccaagugcugggauuaaaggcgugcgccaccacgcccggccugucugucuuuuuuauauucaaguuuuauacuagaccuucaguaagcagaagaagcuagguacaagaguauggguagauacaaagaagucuuuguuuuaaagaaagacugauaguuuagaaaccaguaacagggauuacuaaaccaguguccauccaaagguacucagcauagcugacugaaaaacugauagcgcucuuucauuaguuaacuucuuuauuuaaccaaggccauuuuuauuuaccagcuuuucuauuccacuuugugcaaggacucagugacguacauuggacguuccauuucaugaaaggguagauucuccuuccccaacucugacuaauucagguggagcagacuuaguuguaguaguaacaaaucaguaagucuugcagcuguuaggaaggcccaggcaguuacagaucaaccccuuuuaggagcaagccagcacucuuuuucuugcccuauggagacaaggaauuugacuuggcaguucugcgacuggcaucuuuguuaugaccucuguaaagggaaccagugggcacagugguaauuguuugguuuacggaggaaucucaagcaugugccuugcaggcuuuucuuagcuucuucaugcccaguagcuaucccauacuuuauuuacuacaggugagaaaugaacuaggucccugugggguucugguuagcccuuaaacuacaggucuuaucgagaaaagaacaccuauaggcuauggcuccuuuagaucuuuuaggucuuguaagaucucaaggaacaaagaacaccucccauaucaacuaaugacuaaaaccuaaggcuucaacagaacagauuaauuagucggaugguacguucaacacagaaagaaaaauucagggacuguguccuuaguuauguucuaaagacuuaaagcauuucauauagguugauggugaagcuuaauggaagaauauuugcuuaagccaacagacaaaaguguugggggcuggugcccuuuuccccauuuuaaaauacauauauauccaauaucagcaucguguguguguguuaauuuguuagaauucagagcuuucaugauugacaguuuugagucagaaacaaacucuugcugguucugaugcacgccgaagcuugggaaccuuugauguaaacuuagcauggacucuggccguccgugguccucaggaacagaggagaacgaaugagggacagcauuucucucuccuagaaaaaguggccugaaaauuauccucauuaucuccauuuauauuuguucccagaguuaaacuaggaagagaugguguguaauucagaaagaauaacaauccaaauuuacguugagcugagauauaucucauaguaucuaaaguacacauacuguguuucagaaaaugauuuuaggauuugucuuuugagauugcucagguuaagaauucuuauagaaaaaaauuauuuuguuuugcuuuugaucacagagaaaaauggaaacaggaccccucagaagacgaacaggaacagggaaccagugcagagagugaggcagaacaaaagaaaggaaaagcuagaagaccggucccuagaagguacacacacugcuugccgcccaggcugugucuagcgggccucacuguggguuacaugugaaggaggaggucugcugcagccagagccccagucagggccauucaugcugcugagggcuuggaugucugcuugcuuugugccagccuggaacuuuaccaaggccaagugucuaaauacugagcucccugccgcguggauggaugccaguucucacuggacauacauucuuccucuucauguauuuauuguuagcauaugcugauuauacaaacuaauggauuucuucauugcauuaucauauaugagugucaugggcucugaucauauucucugauagugcaucuuugcuuauuuguuuuuucauagaagucuagggugugugguauaugcaacuacaucuucugcauuaaaaaaaagaagccuggcaguaguggcacacgccuuuaauccaagcacuugggaggcagaggcagguggauuucugaguucaaggccagccuggucuacagaguaaguuucaggacagccagagcuacacagagaaaaccugucucgaaaaaaccaaccccccaaaaaaacaaaaaaacccuuccaguuuguguggccaaauuacaaauucuuuuggggagaacuaauucuuugcuuguuuuuuaaaaaagauuuauuuauuuauuuauuuauuuauuuauuuauuauguguacagccuucucccugcauauaugccugcaggccagaagagggcaucagaccucauuacagaugguugugagcucaggaccucugaagagcagucagugcucugagccaucucuccagcucucuuugcauguuuuauuuauuuacuuuuugccuuuuuaagguaggguuucucuauuuagucuuggcuguccuggaacucacuauguagaccaggcuggcauugaacucagagagauccacuugccucugcuuccugaaugugggaaucaaggaauguaccaccacuccugucgagaacugacuuuuuaaguaugaguauuaaaauauucuucugccugaccagaacuauauuuauaguuuauuaucuuauuuauauaauguccauaacauuaagcagacagucuaauuguauauagaugggcauaggcugagaaggcaacagguuugguaauuuuugaucaaacauggcaaaugaugguaacauaagaaggcagaggaaacuuaccaugauccucaagaguaauucagaagugaaaauagcauucaggcauuguucugaaacauuagaaauacagccauuagggcaggaugugaccuuuaggcaguuagagcuguuguuauucaccuucccaaggauggguagauucuaaaaacagcuuuagcacacuggcuuauauuguaauuuguguuuuugugacaauauuccauuguguagcccuggccuuccuggagcaaucuauauagaucaugcuagccuuaaagucaagacuccaaggaaauucaacuucuuccuuuguguuuuuuguugugugugugugugugugugucuuucugugugucugucugucugucugucagggcauuugugugcaugggugcaugugagugugugugguacagguguguguugauuggucaguggucaauucaggagcuauccucuucuuuuuugaggcaggaucucucccuggaaccuggcucagugauuaguucagcccuuucccagucuggccccaaccuagccccaaggguccuacugucccagucuggcccccaccuagccccaaguguccuacugucccagucuggccccaaguguccuacugucccagucuggccccaagugucccacugucacugccucuuagugcugggauuauaagugcaucucacugugccuggauuuuucuguagauugugggaauugaacucaggucaucaugcuuguguggcaacacuuugcagauagaaccaucuccccaguccaccaaauauacuuucuuccaggauugagugggguggggucaaaucacauccaacaccuacuuuuuaaauggcuuaaaagcuaauaguuuuugucggugaacaguuacauuuauacuucgauaauaguacuaaauuugaauccuaauuaugugaaacauucucuccagaagaauucuauucuuauuaaucauaucaccaaagcauacugugucuuguuuuuaauuuugucuauaaaaauguuguuacaaauaugucuucuacuuguauaaguacuuauagaguggcccagauuuguuguuuggccaaccccuggucuagugcccuccagggaaagcagccugcguuuccuuuccccucugagugcaagcuuuccagauuggagugucugcuggaucugugcccauuauuuaccgcugagucccggcuuacggcuuaggguucguuagguaggagaagcacaucacugugauuguaccuuaccuuuucccucuugcuuuucugagaguauuauguaguggagguugacuuugaacucaugaucaugaucaucucaugaguuguaugauuccgggucugaucccaugcuuggcucccuuuagugaauuauuuguuugugccacugcuguggggaugucauuauguagccuugaaguaguuaccaagugacagaguaaaagcuuugccauuucuuucccucugguuuuguuuagaacagugcccaaaccucaaguuaaaaagcaaccuaagauucagcguggaaagaggaaaaaacaagagucuucagaugacgacgacgaugaugaugaagcucccaaaaggcagacucgccgaagagcugcuaaaaacgugaggucaguugugccuuggaaguucuccauugauggugaugaugcagauguuuagaacuugguucuuucaaguuucagaugaugugaucgacagguaagaauaucaaccugaggguggcgcacaccuuagaucucagcacuugggaggcagaggcagguggaucucugugaguuugaugcuagccuggucuauauagcuuguuccagaaaggccagagcuacacagugagacccugucucaaaaaaccaaaaauaacauaagcuaaagccacuuucauaaucuagccauccuugggaaaaugguguugagcccaguggagagcaagaguaacaacagcucauuuccaaagaacucaagguuauguccuguccuacugacugucuuucuaauguuuuuggaagaauguuuggacuguuuuucacuucucaauuucucauugugucucauuguaucuuuugacauuuggauauaaucauaauauuaaacuuuaguaacaggauaugagguauuaauugaugaugaaaaagauauagcuauauugagguaauugguucguuuacucuagagacugugaaguccauuugcucucagggcauuugcauguuuccuuaggccuacuuagaacugugacgcugagcucuagagguacuaaucacuugccugauguuuccaacugauaguuaaacguaggacuaggguuuuaaugugcugguauuuagcuuaccucauuuuuuuacuuuguuauaucuagaauuauguuuuucuauaauuauuuuguuguguuggagacuaaacccagggucuugcuuauaugaggcaaauacuauugagcuaugccuuccuuguauuuauuguucauguguuguaaagguuuuuuguuuguuuguuuaccuucuuuuuacguuuuugauguaguucaggcuagucuggaacuaugucgucaaggcuauccugaauuuuacuguguagcuuagaucagccucaggcuguuucucugacuucauuucugggaucaucauggccaaauacauuuuauauuuauaauucauagaugugacugaaaauccuccacuuuuugaguucauuuaaauuaaauucauuuucuuguuauugcaugauugaaacauuugaucuucaggaauauuuucuuuuugucugaaauaauagcaauuuuccuuucguuacgaauuuucuuuuuugucauaauuuauauaauaauuauucaauacuaaguaaagcuuauuuuuguaguuuccuguauccugcuuauacauauagugugagcuacucuugaguuuaucugugggcaugcgucagagcuugaaaugggguacaaguaggccuugagucuacugacucaaaucuguaaauaacuguuggagucaaugugugguuccuauuugagugcuacucuguagagaugcuuagcucugaaggugcagucucuuacucaugcagcguuauuucucacacaguuacaaagaagaugaugacuuugagacugauucagaugaucucauugagaugacuggagaaggaggugaugaacagcaagauaauagugaaacuauugaaaaggucuuagauucaagacugggaaagaaaggagguuugugucuuuggggagcaaauuacucacuuuggauuuuugagacagggucucugguagccuuggcuggccucuaacuugauauauagacaaggauaaccuugaacuccuaaucuuccugucucuaccucccaaguucugggauuucaguugugcaccaccauuuucaguauauguggugcugaggaguugaaucaggccuuggugaugcuugccaagcacuggaccaacuggcugcaucuggagcccacaaauuuuuguaugcaauuuauauaugcauauauguacauauauucaaaaauccaauguuuuacauauucuuuaaugugauaaauauaguccacacuaguauuuugaauuguagaaauuguccugacuuauuucagagauaaagacaaaauaauguuuuuuuuuuaaauuuaaucuaguuagauaguacauaauguagugaugaaaucauagguacuuacucauuaacacagagcaaaucuguguuuaguuagcuguuuuugagucgccuuguaaaaauaccagacucaucacagacauauuugggucauagugaguuuuuuaaagaauccauuugagguauuucuuaaguuguuguaaaauauccuuuucaugggaaggcugggaauauaggacagugacagacagcacuugccuagcuccagcccucacugcaaagauaaaaccaagcauaacgguccuuuuucugccccaauccuuuuuuuuuuuuuuuuuuuuuugaaauucagccuugacuauguguaguguuaacuaggaaccuggugcccugcccgacuagccauuucccaguucccaguuagguuauuugaggguaagacagucaacagcuuugggaggaaaggacagggcauuuugauuucuuucucuauucuuggaggaagagauuugcuuuuugaggcagucaagacuaaaacgaaaagggugcugcugcuguuucauuguuugguguuuggacagcugacuagugugguaccacuugcaaguuugcacauguuuuaagguaaauaucuugaggauauuugaaaggacugagcccauccuguguuguaacugacuuauuuuacuaaguguaauuauacaguaagugacugcuuacuguaaggcaagacuuuugcuuuauugaagaagagacucuuccuggcaguugaauaauugggaaucuuucauugccugguuucuuacauuuucuuuaaagcugaccugaauccuuuugcagccacuggagcgucuaccacuguguaugcuguugaagcuaauggagauccuagcgaugacuuugacacggagagggaggaaggugaaguccaguaccuuaucaaguggaagggcuggucuuauauucacagcacaugggagagugaagacuccuuacagcaacagaaagugaagggccuaaagaaacuggagaauuucaagaagaaagaggaugaggucaagcaaugguauguugccugcuacagagugaagugguuuccaaucgcagggaagggagcuuugaagaguguggagaacacagcucucuaagauuucagauuuugccuuaaucagucugaucaaggaucacugaguagucuaugguucuguuuuuuuuuuuuguuuguuuguuuguuuugcuuuuucgagacaggguuucucuuuuaauccuggcuguccuggacaacucacuuuguagaccaggcaggacucgaacucagaaauccgccugccucugccucccaagugcugggauuaaaggugugugccaccacgccuggcugguucuuuuucuaaauggagaugucuucauauguugcuacuaaauuuucagauuuaaugagacuagcuagcuuacugaaccuuugcugucuuuucuuuguucaguauguuugaucuugacaguaagauuuugaguuucuuuuuccuuuucuuucuuuuucucuuucucuuucucuuuccuuuuuaccugauuuguagaugggcaaggugaggcagagaguaacguaagugaaucaaugacuugaauuuagagagacguaugcagagccaaugucaagaacauuuuguuauuuucuuugguuagucuggggugacuucugugaaauuuaauaaucuagaacccucugaauuaugcuuaaaauuauucuugguuuuaauacaauuugcagaaauguuuuuguugguuuuuaaaccacagaccuguuacuagaaaagauuaccaaagagacagacacauggacucauauaauuuuacauuuguacuuaggacauuuucucccauacauauguguagaucuccaaguucuaacugguauaugcuauuuuggucuucugucuaggcuagggaaaguuucuccugaagauguugaauauuucaguugccaacaggagcuggcaucagaguugaauaagcaguaucagauaguagagagaguaauagguaaguccaugaaaacucuuuaguccucuguaaacuuggagacaugaccuuuggcuuuaggauaauauaaauguacaaaaugaguuuugcaguuuuacuuuuugagacuaaacaaaggccuauauuuauuuugaagggagagcuaauaauuauugcuuguagguuuggguaugggggaugagaggagacaggaaugucaaggauauugguuccaagguuuccuaugagaaugagucucauucccugaaaugaaaggaucaagggaagaacugacguuuagaguugaaaucaaaugcuuagguugguaacuucauugucaucuaagagacaagcauuauuugagggcugcaacauuuguucagcuguagucuccaggucugaguauuauugcaguagaaguaggugauugacauggaauacuagucuuggauuuuauucuugaauuucggaguggggcuagcugguaucagugaaauugucugaggaaauaacuguuggcagaacaggucugauugagguggccucaggagagaguuagagggguucugccuuuuauuugaaagguaacagaguaguagaaugggguccagcagccaguguagguaggcuucuuugugaacacaagacgaaugagcacauacuugcaagaaaaucuuucagauuaccuuuuuacauguauggguguuuugccuucauguauaucuaugcugagugugcauacuuuguucaugaggaggcucgaggagggcuucaaauccccugguacuagaguaacaaagcuaugagcugccagaugggugggugugggaauugaaccugggucuuuuaggaaagcagcuuuagugcucuuauuagccuuugaccaucucucuagcccuuugcuugaacagucugcuucuuugccuuuuuuggcauguuuuuaauagucugucuuauuuuguguuugcucagcugugaagacaaguaaaucuacacugggccaaacagauuucccaggugagcagcagaucuuaccuuuaguaaauguucaaaaugagcagcuugugucuuacagauuauuuguaguuuugucacaugauauucauuaguuauacauuaaagacgaaaaucacuuccuacuucaaauuugacauuguuugauaauuuuuuauucaugauauagcucacagucggaagccagcaccuucaaaugagccugaguaucugugcaaguggaugggacuacccuacucagagugcagcugggaagaugaagccuugauuggaaagaaauuccagaauuguaucgacagcuuccacagucgaaacaacuccaaaaccauucccacaagagaaugcaagguuugccaauuguugaguuuuguaauuuuauuuuuuuuauauuuuuauuuauuuauuuccuguuuguuuugagacaggaucucucuaugauguugcucuggugucuuggaauucacuauauaggccaaguuguccucaaacucauggagauccauuuauuucugcaucuccaguccuggaauuaaaggcaugcaccaccacccccagccuacuuuuguauugguuuuuguggaaaggugugguaaccaaaggguuaguugggcacauauguagaagcaaaaaucaaugaugauuuuugauacaaugauacaauaagaaucaaugaugauuuaaaaguuacauuaaauauaaauaauuacagcgugggcuguugaauuugcucagaaacuagaguaaaccugcauguguguagcccuuggauuugguggcuuagcaccagacaagacugagcaucacugggcaugccuguaaucucaggucuuggagguggaggcagaggaaucagaaauucauggucguccuggccauggagugaauucaaggcuguuuuacucaugacuuaucucaaaggaaaaagaaagaaagugaauggggaggaugagagguugaagaggggccucagagauuaggaacacucacugcucuuggagaagaccuggguucauugacagcacccagguugugguuuacagcugugacuccuguucccagagacucagugccaucuucugaccugaaggauccuguaugcauguggucuacuucaggacacucagacacagacagacacagauaaacacacacuuuuuuuuaaaacaaggaucaguuauaugaugacuuugcugauuuauauaauuuaauacuuuauaauuagcuauauugugagaaauauuugaaaguagauaauuuaggcaggaaagaugucucugauuuuaauuuagaaacugaauaaacaggcuuuuucuuguuagauugauugaacaagucuuuucuucucauuggaauuugcugaggucuggaaauaugcuugauuccuuggacuuuaucuuagagaaauugaaguuuaauaacuucaaacucccucuugucugugaaagccagcaugugauuguuggucacgaaugugguggagaggccaaguucagaauagaacagagguggaggucauggcuccagugggcaaugggagagguuuccugaggaaaaaagccagugcuuacauuuccucugucccuugggaaguguagugguguuuaguaacauaugagagaguguccuggggccugggcuguaggcuuuguagguaaggaugguuguugcucuuccagaagacucgguuuccagugcccacacagcagcucaacaauugucuaguuccaggguccagucccagggcacccaacacugaccacaucagguacuaacacauguggugcccauauauacaugcaggcaaauacucauacacuuaauaagacuuccagagugcuacuguaucguuuagaaaaggugacaucaagguaacgcugagugucacaugguaucacuggaugagaaaauuaagagcugauuaguguuuacagaguuaugucagaaaaagaauaauuuacuuaaaaaaacuuaauuuuaggaugaacucugggaacagaauaggaaggggugaguugggguggcaauucauaccugaaauauggcuaauguuguacuuuaaggucaaggaaaaauguuguaagacuuagguuuguccauuuuuguuucucaggcucuaaagcaaaggccgagauuuguggcuuugaagaagcagccagcuuauuuaggaggggagagucuggagcuccgagacuaucagcuggagggccucaacuggcuggcucacuccuggugcaaguagguagaacauacgcuuagacuuucucuguggguuugccuuauuaguauccuuagagcuaaggguuggaccaguuagccuuugaggauuuuaagugauucaagguaggcgugauuccucugucauucugugaugugucaugugagagccuccuucacugcuaagggcacaguuuuaaaaacauuuuuaacuuaaguauaugguuauuuuccuguaugucugugcaccacuuguguacucuguaccuacagaugccagaagagggcauugguauccuggaccugcuugagagcugcccuguggguacugggaacugagcucagguccucaggaagagcagcgagugcuauuacucacugagugcucgcuccagaccaaccccuucuuugugucuuuacuguuuuuuuuuuuaaauuagguauuuuccucaauacauuuccaaugcuaucccaaaagucccccauaccccccccccccacuccccuacccacccacuccccuuuuuuggcccuguggcguuccccuguacuggggcauauaaaguuugcaaguccaaugggccucucuuuccagugauggccgacuaggccaucuuuugauacauaugcagcuagagucaacagcucugggguacugguuaguucauaauguuguuccaccuauaggguugcagaucccuuuagcuccuuggguacuuucucuagcuccuccauugggggcccugugauccauccaauagcugacugugagcauccacuucuguguuugcuaggccccagcauagucucacaagagacagacagcucuaucuggguccuuucagcaaaaucuuguuaguguaugcaauggugucagcguuuggaggcugauuaugggauggaucccuggauauggcaaucacuagaugguccauccuuucaucacagcuccaaauuuugucucuguaacuccuuccauggguguuuuguucccaauuuuaagaaggggcaaaguguccacacuuuuuggucuucauucuucuugaguuucaugcguuuagcaaauuguaucuuauaucuuggguauccuaaguuucuggacuaauauccacuuaucagugaguacauauuguguucguuccuuugugauuggguuaccucacucaggaugaugcccuccagcuccauccauuugccuaggaauuucauaaauucauucuuuuuaauagcugaguaguacuccauuguguaaauguaccacauuugugucuuuacuuuuuauauuaauauagauaucgaugguuauuucagaauuaaauuauagcuugaaaaauaaaauacucaaguuuauccucagguuuaggaagauggucucuaguuauaaacguauuuacacuaacucuuaccaagugagcaccuucacgacuugucuuuucaauugaaugcaguauuuaagccugaagaaacaauguuggaguuugacugagaaaaaugauuuucauuaaugcuacccguucucguguaggcagagugaaauguggugggagacauguagacaaguaaacagauauaaaaguagauggagacuugggaaaaagggcuuggguugguggagcagguaugagauaaaaggaaaauggggagauugaucaaagaauguuauguguaugaaauuguaaagcaaguaauuuuuuuuguuuuguuuuuaaaaaaaaaaacaacuuuuuugucagaagauagugaguccuacuuuuucuaaaggaucaguaagaacuuagaugucacuaaagaggucguaugagccagcacuuguauuguaugcuugaugcugcucagaaugagaccgugagcuuuguucagaguugcacaauguuugcuauauagucauuagugugggauugauugauugauugauuuugacauagucucuugauguaguucuggcuuucccuaggacucggcaugcugaccaaacuggccuuuaacuaaaagagaucuguugugaucuuggcaaauuaaaugcuuuguuuuucuagccaguauuacuagcuaauacuauuucuuuuuuuuuuuuuuaaagauuuauuuauuuauuuuauguaaguacacuguagcugucuucagauacaccagaagagggcgucagaucucauuacagaugguugugagccaccaugugguugcugggaauugaacucaggaccuuuggaagagcagucagugcucuuaaccacugagccaucucuccagcccccgcuaauacuauuucuaguauuaaauauuuuaaugcucugguucacuagugaagcacauauucaugcaaaccaguucauuaggcgcagaaacuuuugguugaaauacagucccaguagcuugaguauagcugcgagccggaagggguggcuugcuuguggguaguacugucucuccaggcacaggaacaagaguacaaacaccuucaggucugugugcuuuaagccucccuugguaaggauuaccaaccagccacagcuccugcagagagucuagcugccagcacuggccuucccuuggcuuugucuugugcuucuucuacuuguaagcagguagacugauguuuguguaccuccagagacaguaagcaaccacaguuaaauccugcagauguuucugagauaaacagccagaaaaggugggaaagaaggguagacccaccaagagccuuccuaagcuaggcugggccaaguccuccaagagggacuuaggcuuugaaagcaggaaggagagcuggugucugcagggaaauaggaagagccccugccaaagagagccagccacugaaggguuaagcugaauagaugacacugggguuaggccaucuauauauucuagcuugagaagaacccggaugagcugcgguacccaggagaaacacaaagucauaaacacccaacaaguaucagaguugugaggguucuugaaggguucuuuagccaucucuccagccuguaauaguguuuacaguguaugucauacuagaucucuaauuuccugccauauaggcuacuuucuguuucccaaauauacuuuucuaacuguggaacuguguucauuuucuucauuugucuuucuuuuuauauuuuuacaacagaaaaaaaaaaagaaagaaagagagagagagagagagagagagagagagagaaagaaagagagagagagaaagagagagagaaagaaaggaaaguggaguuacagcuucuuuucuaguccuggcccaugagcacuugcaucagucuuccaaggugcuuguucaguguucagaauccucuacuacuacuagcucuuuaaggcagaggcaggaggauugcagaucccagaucaaccuggacuacacagagagaaucuacuucauagaaaacaaaacaaaaaaugaaaaaccaaaacaauccccuuagaauccuacagucuuucuugaauauucucauucaguugcaaugaggccaggaauugucaacugugucuuauuuaaaacaguuccucuuugccuaaaauauacaaggccuugggcacugucucuagcacuacacacaauacaaaaaccuaucccuuuauaccugcaucaaguaggucuauaaaauaguagauguuguauugaugagucaaguggaaugcaguaggauggagaagguaauuugagcagaggcacaggacuguugguauaguguucaacagcaaggcugauagccaauuuacuccuuuguauaugaaugaacccaaggcuacaugccguaugcuuccaugauaaagcuuggcuucucuguuagagggauagccuagugaagacuauguaauucagagccuugggucuaagaugggaaccuuacaugucaucuaaauauuggaugcacuuacagauaagugucugguuguuauuucugucuucugcuuucuuccauauuuaggauucaugugucacugaagaugaggagaaauucauugaaaggacaaacugaugcuuuccuuugugauuauugugaacuguguauuuugcacauaguguuuuugucaauaucuaauugcuucguuuguauuguuuucuucaugcagaaguaacaguguaauccuugcugaugaaaugggccuaggaaagaccauccagaccauaucguuucucuccuaccuguuccaccagcaccagcucuaugggccuuuucuuauaguuguucccuuguccacccuuaccucauggcagagagaguuugagaucugggcaccagagauuaaugucgugguuuacauaggugaccugaugagcagaaauacggugcguaaagaaaaagaguugaagugguaugggaguuagaaauguaguuuggagauugagucuguuuuauagaugcaucaguaaacucuuucaaauacucuacugugcucuuaguacucgcaguugugaguaugcaacucagauagucuuuaaaacauugaacaagccuuuaaucccagcacuuagguagaagcaggcggauuucugaguucaaggccagccuggucuacagagugaguuccagagcagccagggcuacacagagaaacccugucuggaaaaaaaccccaaccaaacaaacaaaaaaaccaaaccaacaaacacaacauugaccaaggagcauguuauguuuuaagacagcaguugcacuggagucucucuuagcuggauuauagugguucucuucucuccaauuuuuucuucucucugcccucccuucuccacucccuaccagagucuuacuauguagcucaggcaagccucuaacuuguggcacuccuccugccucagccuccugagagcuaugaucaguggcuugcaucacagcuaguuugguuuuuauauuuauggccgcccuauaaaggagaacuacauuucuaggagucuuguuuaguaucaaacauugacuugagcaucaugaauuuagcacacaauaaauuugucuuuguuuagcaaaauauguuuuugagaaaugaaugacuuuuucaguacuuacugugugugaauucuuguguuagguacuguaacccuuaugauagucuucaaaauugauagcagcugucucccaugacaauagcuguccagggugucugucuaacccuuucguuuagauggagccugagcucuugagcuaugagucugucugguccuggagcuuugcucuugugcccuucacuuucacauggguuuuggagaugcuuguaguaagagccggccacugggaaucuucaguguuuaggauaaaugcugcaaacauauuuucauagauucaaacuugucuuuguuaaaugcugucauuuaaacagucugauuuggguuuggguuguaccuaagugauugacuguagcaugcuuaaggcucuggguuuaaauugccagcucugcaagcaaaacaaaacaaaacaaaacaaaaaauaucugaauuauaaacuguacuagguuuccuggcccuaauuuuaauuugguaguuauuaaaggagaaagcaaaccaguauuuugcuuuguggcaggcacccacuacuccucuucaguggcaguuagcugcaaguccucacuuccuuucccuuuuguuccuaagucauuaaauccuaagaauggagaagauucaugguguuugcugaguuugaucacaguucacuguggauucauuaauucuccagucucuuuacauuccuuacuauuuucuacuuauuaaauuauauuuuucacucuauaaaauuuguuuuucucaggggauauagcuguuaugauuaaugaaauuucuggucaaacuauugauuauaauuuguuacuucuuaauaaauaucaucauaugcaaagaauaauggaaauuucauuucccuaagucuggaaaagccguacuuuauuuaguuauaaaagauuuuuuuucccuucugagacaagcuuucuguauuucaagaaacucagagaaaucagccugccucugccuccuaagugcugaguuuaaagaugugugccagcaugccugauaaaguccacaacuuuaauugcugauaaguucugcacacauagucagaucuuagcaggaggguuugguuuauuugaaaugauaauaaaguuuuuccugcucagcggucuguaguuugacucugacuuucaauguucuagcuuggguuacagcaagucuucuuagagugcauagguuguucaugcaauucucaugagacuuguuugcuguuucuauugcauuuauuauaagacuuguuucagacacuuggaaauagaaauugugucuuaauuauuguuuuucucuucuuguagauaagggaauaugaguggauucauucucaaaccaaaagguugaaguucaaugcacuuauaacaacauaugagauccuccuaaaagauaagguaauuaguaauaaagguuaagucuugccccuguguauccuguuaaauaguggggcugugcaucccacuugucaugcuuucuugcuccguuuaaaaggugaaacaaacaaacuuaaaauguuccucaauuacuaaaauugugaaaaccaaccucaccguaugggagcuuaggguggcuuaauccaguugcaaggaugcaagaggaaaggguaucgagggugcacugagguauucuacaauaauuggagaguucuuucuaaaguuacuaagugguaaaugcuuuuauucuauauucaguguuguguucuuguuguuuccuguguugcaagguuggggugauaaaauaggcaagagaagaaucuuuugaagacaaaguaaccuagaguuuuuguuucuguuuuuguucagcauaccaguuuccagccucuugaaggggcuuguaguaguagauuguauaagagauucacuugcagcuuuagaugagcuugaauuuggccauugauagaaugagcagaagaguccuaauauguauuaaauaugugaagaauaauugugucuacauguguaccuuuguaauggaauuuguacagaaauuacuuagcuguguaaguacuucugggugcccuucugaccugguggcucaucuguucuauuuuucacuuuagaccgugcugggcaguauuaacugggccuuccugggaguagaugaagcccaucgguugaagaaugaugacucuuuauuguauaaaacucugauugauuucaaguccaaccauaggcuacugaucacgggcaccccucuucagaauucccucaaggaacuuugguccuugcugcacuuuauuaugccggagaaguaagcuccuuccuguuuguuucaaaaggugcuagaaugucuaauaugcuaguucucccuccugcuuccccaaccccccuuuuuuguaguuuugagaaagggucuuacuaugugauuuuggcuauccuguaauuauguagaccaggguggcaucaguuuuagagagaucugccugccuuggccucucaaauccuaauauuaaacgcuguaccaccacgccuggaaacuuucugauguucuuaauagacguagcagagcugcuagcauggggagcauaaagcauucaucuguggcagaagcagcucuguuaagaucuuguagcauaagggauagaagcuaagaaugugccugguaaggaggguuauguaguugcccaccacagguuugaguuaguuaaagauuugggaaauaagacaugagagacagguaggauggugacgcuucuuacaaucaaucccagcacuugggaaguuaaagcaggaaggaaggaaggaauucacuaccagcuauugagugcaagcccacuguuagcuccaugugacucucugccucagaaagcauaaaucagaacaaagucucaaagccacaugagugaaguauaugacguauguagucugacaugccuuaaacgcagucugugauaguagaagcaucgguuuuaguucuuacucaagccaaggugccucugaagguacucugguuuauuucuguuagauaaauuguauaggacagauacauaguauauauauucauuuggcugacuuaaaauugucuaguguugcucagugacaacuuaggacaaagucuaaauugguucguuuaguuuggaagacuguagagagcuggacccugggucauauuggcucauaacucuugucccacuacgcauuauggaucagcuguccuugccaucuuucugucucucacacgcugagccauuccugcucuguucaucuggaauguugcuucucucuguguugaccuggcacucaccucuuuucuuaucuuccuuccgacccccuuccuguuucgcugcauuucccugacuuaggcuuguggaaauacuaggaaucucacuugucuuauuccucugugauucucauugucuggcguaguaacuacuacacaggaagcaauguaauuacugauuguacaagugacauaauuguagaauguuccauaauuuauuucauuguaaugacuaaggauguuaaacaucaucucauuuuucuuuggcuauuugagcuucuuuagugaaauauuuauucaaaucuuuugcuguuaagaaaauuagagaggacugggcaggcacacacuuuuaacuccagcacucaggaggcaaaggcagggaaaucucuugaguucaaggccagacugguguacagagcaaguucuaggacaaccaaggcuacccagagaaacccugucucaaaaaugaaagaaaaaaugagaccggggcuagagagcugguuaagagcacuugcuguucuugcaggagaccuggguucaguucccauacuguccauaguggcccacaacuguuuguaaugcccagcccuagggaauaugaaauccuuuuuagcucugcagguacuacagguacuuggugcaguaacacacauccugacaaagacaccuaaaauaaaguuaaauagaauuuuaacagcacugcuucagcucuuaaaaauuguugggguuggagagauggcucagccauuaaaagcacugacugcuccuccagagguccugaguucaauuccuagcaaccacaugguagcuuacaaacaucuauaaugggaucuaaugccauauucuggugugucugaagauagcuacaguauauucacauacauaaaauaaaauaaaaaauuauguuaaugaguugaacaguucaugucuauaaaacaguccuggaugcaauuucucuacuggcuugugacuggcuuuuuguuuucuuuacuuuuugagguuuuauuuauucauuuauuuauuuaggcuuuuauuuauuuauuuauuuauuuauuuauuugauauuuucuuuauauacauuucaaaugcuauccugaaaguauacccucccccugcccuguuccccuacccacccacuccugcuucuuggcccuggcauuccccuguacuggggcauguaaaauuugcaagaccaaggggccucucuucccugugauggccgacuaggccaucuucugcuuuauauacagcuagagacaugagcucuggggguacuaguuaguucauauuguuccacuucuaggguugcagaccccuucagcuccuugggugcuuucucuagcuucuccauugggggcccuguguuccauccaauagaugacugugagcauccacuucuguauuugccaggcacuggcauaaccugauaggagacagcuuuaacagggucccuucaguaaaaucuuucuggcauaugcaauagugucuggauuguuuuauuuucauaacaucuuuugaagagacagauuuuaacuuuguuuuuguuuuuuuuuuuugguuuugguuuugguuuuuuugagacaggguuucucuuuguagcccuggcuguccuggaacucacucuguagaccaggcuggccucgaacucagaaauccaccugccucuaccccccaagugcugggauuaaaggcgugcaccaccacugccagccagauuuuaacuuuuaaauauaauuuaucaaguuauuuuugugugcuauguguauaacagguaggucuaaccaugggcccagaagacauuguuguuuuauaaauuucagcugucacauuagguguauauuuuauucugccccacugaaugcaugaugggucaggaccuugguucaguuuuauuuuccucaccgagcaauuuggaaaguuguuacgcaccauugguugaaggcagcaucuugcaaagaucuugguugagacagaaaggauguccucgugcucuguccgccgggaugcuccugucuguuguccugugcagcgcugccuuaguucugcuucacucuaguguuuaacauggaggauguaagacucggcuucagucuuucucagaacauuugucuucucaggcuuuaguuucuauuucaagaucagcucauuaauuucugggggaauucuguuugcauugcauuguaucuacauaucaguuaagggagaguuauuaaucuaauaauaacugugccuucuauuccauggucaaggaagguuuucucuauuuagcugugaaauuuuucucaguaguuuuuagugguuucauuguugacaaauuuuaaacuauuuuuguugaauuuuaaaucaugguugcaguuuuggacauuuuguuauuuugguaagaugcugaggauagaacucaggacugugugugugagagugugugugaugacuaggugggucagugcucuuugcugagcuaaguguauaccuugaacccucuuacacuguucuuuucaucucauuuagacugacuagagucuagagcuacaguuagaaagaacugcagcugagcauagagacagagucuaucuagugcuacaguugagcauagaacuaugcguagacuuuagagcuacaguuaaguauagaucuacagagucaagagcaguggcucaagaccccuuuggggguugaacaacccuuucacaagaguugccuaagacacauauauuuacauuaccauucauaguaguagcaagauuacaguugggaaguagcgaugaaaauaauuuuuaaauuuuuaaaaaaauuuauuuuauuuuauguauauugaauacaguuaacuaucuuuagccacaccagaagggggcaucagauuucauuacagauguuagugggaauugaacucaggaccucuggaagaguagucagugcucuuaaccgcugaaccgucccuccagccugaaaauaauuuuuuguuugggggaucagcacaucaugaacgcuggccuagagguacaguguguacagagcuacaguuuaggagauagagccacgacuagaaucuagagcuacagauagagagcagggguacaguugacaguuauauaguuaucauauucauauuuacaaucuuguuccuguaacuuuguuaucaauuuucuuuguauuuuuacuuauaggaccauauuucugcccuuacaggcuuuuaaaugucuuucuuacgugaaugcuuuuuauaucuugucuaccuuaaacuguagaauguugaauagaauuagcugguggaagugaaacgaucgauacaguuuuuguuuuuucccuuugcuucgguugagacaguuucuuguauauaaaugauacuguugaacccugucgcgcccgcucucgaccagcaagaacgacgcgaccaccaguccuucuaacagcaguuuacucaguccugauucuucuuguuuauaucucccccgaacccugggccucucacuccuuuuauacucucucucauccacgcaccgcaggccacgcccccucgccagucacgaggcuucagcuaaucagggcagcaggggcaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacagaaccccuuccugucauucagcuacuuauuccuguuuguucuuuacugccuaguauuuauacuuucaguguauuauuuaauuccuaguuaguguuauuauuuuaaauuauuucuucguggauucucuacgguuuuuguauucuagccuaaucuuuagguuaaugcugacuaacuuaaauucuccauagguugggaaccuagcacaccgugguagaauuguugguugacacagaauuaaggaaacuuuuccuuccuuccuuccuuccuuccuuccuuccuuccuuccuuccuuccuuccuugcuuccuuccucuuucuuccucuuucuucccuccugcucuuuuuuuucccuuccucacuacaguauuuucugggguagagucccucugcaccccuccauucagugcugucucuuggcuuuucaucuuuaccaaaguuaauguuuuggguugucuuggacacucuccuccucacuggagcugacuugggucauguuucuuguaggacgucugacagcauucuuggaguuugcccacuacgggccaguugucacaacuaaaauaucugcagauauugcuuaccacugucuuccuugggaguggaggagugaucgcagacugagcagcgcuguuuaauucugggcuggagucuuuuugucaguguccuuucauaguguccuuugucuucacugcucugccaucucuccagccugguguguccuuucucauugcugguuuuugucccuugucaguuaacugcauccauuuuuccuucccaagaaauuacagucacuggcggccaucuuagucaccuuacacaauuucugacaggguaccugacaaaagccgcuuuaggggaggguuucuuuuggcuuagaguuguagcacacagcccaucaugucugggaaaccuugguggcgggagcagacggcagcagcucaugcugaguuagcaggacacaggcaacuuugagugcuugugcucaguuugcuugcuuucugucaggcagcaaggaucuaccugcugagccagccuugucccuuuuagaaaguuuagaauuacauuuuguuuauucccucucuuuuauugaagauucagugaugggcaaaauuggccuuuccuggcaggacagauugagauuuuuuuccccuaccccuagaucaguucuuucccuguguguaacuaacaugacgauuuccucuguagguuugaguucugggaagauuuugaagaagaccauggaaaagggagagagaauggcuaccagagucuucauaagguacuagagccuuuucuucuucgaagagucaaaaaagauguggagaaaucccuuccugccaaaguggagcagauucucaggguggagaugucagcccuucagaaacaguauuauaaguaaguuccugccgagagguagaugguuuucaaguaauucaugccuuucuaaaaguaaaaccugaacauagguuuugguuuuggucuuccccuuccccuuucccuuccccgccccucccccuuugccucccccucucucuuccuuuauuucuuccuuuuuuuuuuuuaaaguuaagccuagaaccuuguaaaucuuggcaaguacucaguaguaaagcuuucuguucuuugagacagguuaucugugcaccucuaccuggccuuggcuugcuagagaccacagagcuuugucuguaaacucaacacagauuuugguugaauuucauacucagccagaagaaaaggucugccugucugccugccugccuuucuuccuuccuuccuuucuuccuuccuuccuuccuuccuuccuccuuccuucccucccuccuucucucccucucucccuccccucuuucuuucuucuuuucuuuucuuuucuuuucuuuucuuuucuuuucuuuucuuuucuuuucuuuccuuuccuuuccuuuccuuuccuuuccuuuccuuuccuuucccucccucccuccccccucccucccucccuccuucuuccuuccuuccuuccuuccuuccuuccuuccuuccuuccuuccuuucuuucuuucuuucuuucuuucuuucuuucuuucuuucuuucuuucuuucuuucuuucuuucuccccucuacacaggauuucuauguguggcacugacuguccugguuuuugcuuuguagaccaggcugcccucaaauucauagagauccgucugcuucuuccucuggaucgcugggauuaaaagcauguaccaccaacuaggaaggugguuuuuuuuuuccccccauuugaguaagagagaguuuacauaguacuuucaguuauguaaaugaucugaagaucaaaauguuuucagguuuauuuauuuuauguuauauauauauaucagaguuuugccugcaugcauguauguauguugucuuuagaaauuagaagaggguguuagcucuccuggaacuggaguuaaggaugguuguugagugcugggaaccacaccuaggucaucugcaagaucagcagauguucuuaccuaccgagucagcuccuuaaguuuuagugcuaguacucuuacucugaucaguuaagcuaaacaauuuuuuguuuuccauucauuaaaucuuccuugaagucuuuuuuuuuuaauguuagacauuagcuacuagaaauaaugaagaugaauggaacauaucccuuccagaagccuuguauggcuagaaacaagucauugugcacagucauggaagacagacaugugcaaggagagccguggagagguagcguugcccccuggcacagagcgagcaccccuuccuuucuaguccuccgaguggcauggacaggucacgguuugugccuuaacauaucguacagaaccuagaaaacagugaaucugguauagauggcagcaacacaugugcuuguuaugggcauucgcauuuaguuucaugacugggaugcauuugugugugugcguaugcaugugucuggauagcaaacccagggccucacacgugcgggcagcaccgacugcccuacuauguuuagcccaugugucuuguagaaauaucacauagacaaauuaguaugguaacuucucacugcccauaaccuagcuucaggccuuuccaguucacccauguuuccuguuuuaguguauguuucugaaauaaagagacuucuuuuacuuaaaaugauuuauuuuuuauuuuuauuucuugugcauucauauuuugccugcuuguaugucugugugaaauuguuggauccccugaaacuacaguuacaggcgguuaugagcugucauguggauacugggaauugagccuugguccucuggaagagcagccacugcucuuaaucucugagcuauuucuucagcuccaaaaagacugauugcuuauucuuuagaaguuugccuuguuaucaugccuaaaaguaguugauaaucucuuaacaguuuaauaguaugcagagaauauuuauauuccucaguuggagcacauauauacacagucauacacaggaacacccaugauauuuuguuuguuucaggaucugugcagcucuuuaucuaguauaauuuguuguauggcuuucauauauucuguagacaaacaccgacuuuaucuuuuuaagauagucuuguggauagcacaagcuggguucaaacugauguuucuuuauaccucagucuccuuagugcuguguguuucaguacauucugacuuuguaaauugugcauguguucauguuucuauguguucauuuauacacacgcacacuucauccuuaucucagugccccugcauuugauuaggucuguuuaagguaugguguggaauuuuccaucuguggcaucauguucauccuucaaacguuuuggaguuuggaauucggaguucugguucaggaaugcuauucuuauuauaauugauagcugcuuuauucucuaaaugauagagugcaccauauucauguuaaccauuuuucucucucaaaccagagccaaccagucacuuaaggaguuuuaccuacuaguuuacuggaggaugguacuuggagagugcacauucguggucuagggucucuuuguggauaacacuuuaacgaguucuuuacaacuaaauaguaccauauuuucuuucucuuuguggguuuggcuagguuuuagaucuccuuccuucccucagcaucuuaguuguugauacccuucugucugucuuccacuucucuccacaucccuuugacagaaucucacuguauagucucucccuuggcuuguccuuaauacuccucuagacucagccuccugagugcugggauaaaggacagaaucaugguugugcuccaugcaggcacccuuaccugggauacugacuauuccauuugaauguggauagguaguguauuuagcccguucucugcucacuugggcuuucucaaaggauuuuuuaaacacacacacacacacacacacacacacacacacgagugugucuuuagccuucuagaauugucuuuuagauuuccugugaucagugagguugacguacuugguucaaucauugaccuuuuuacgccugccugcagaugugaaggaucauguuuagguuacaggagacagaaaguaaaaaucugucuuuucacuuugcuuuccuacagcgccguaagcccugcuuacuugaaugaauguuucccauugcagauggauccugaccaggaauuacaaggcucuugccaaagggaccagaggcagcacaucuggcuuccuuaauaucgugauggagcugaaaaagugcugcaaccacuguuaucugaucaaagcucccgaggacagcgagagggagagcggccaggagguccuucaggugagcaccuccucuugcucgcacucgcccucuggagugagucagggcuguuuuagaguuuuauuugaaguauaaguauuccuucucuuccuugauuauccuucaaggaguaucaaaggaagcuuucaaaaacacaaggaaagccagacgucaguaguggcguggaauugagagagcccuuggauaugacagggguguuuggauaugugcuggaggcagaagcgacuuaaguuugagaacagcuuguucaaggcucacaugagcuacauagugagaccuugucuccaaaggagcaagcaugaugaggaaacucaguaacaaugcuggaaguacauaguagcgugggugccgcguuuaaagagcacuguguuugaacauaacgagugagaugucuucugaaucuucagucucuaauuaggagcagugggaagcugauccuguuagacaaacuguugacaagacuccgagaaaggggaaacagaguccuuaucuucucucagauggugaggauguuggauauccuggccgaguaccugacuaucaaacacuauccuuuccagguaagauggcucagugacucucuuccccccagagucuaacauuaaagcugcaggcagaccugcuuuucuucuugccuuuagauuacucugaugauaaugaccaugugaaggucauacguuuuaaaaaaacacuuuguuguuguuguuuguguuuuguuuuuuugagacaggauuucacugugcagccauggcuguccuggaauuuacuauguaggccagguggccuugaacucacauacuugccuuugccuuccaaguucugggauuaaaggcaugugccacucugccuggcaacacuuuauuauuagagagaauaaguggaugaggccacauggacaggcguguguaccaugguucccgaauggagaugagacgauaacuaugaggacuugauuucucucuuuccacugugagaucugagcuuuagcucagguccagaggcuuuuuaccugcuaacccuacgaucaguagcacuaaggacaauguagaaggaaagauuagcaacaagaaaacuuggcaugagaaaaguaccugugcuaccugucuuuaucuauugucaaaguaggucggaggaagugugagucugaaauagagucucagauucuaagaagaaaagaggcagcuuuguuguuuuaucuuaacccuguaggguguggcuuugguuugaggcugggagccaagcaggaggaguucuugaaacaagugguagugacuucucagcagaggugacuugaugcuucuguacaguggacuuuuauaggcgggauuucuuccuucagaugcuguugugagccugccuuugcaaaugccuuugguuccagucucugugcagauuuauuauaaggucaauagcucccacguguguaccuguuaugguuuaaggggcugugccucucauggccuugcagggauauaggucuuugcagacucugccugagucaucuugaccuuuuguaaaaucaagguuucaucuuaaggaugauuuuuaagggaugaaaugugaaaguaguucuacaugcugagacaugccuuuuaauuacacaguucaguauuugcuuuguguauauauuugguaauugcccuguaccucaaaguaauaaacuaacuaauaaaauaaauaacuaauaaaaaauuauaugcuugagucagugccugagacuugaguugaugauacaguuuuacuauuugaauaguuuauagugauuuuagauguaaauuuuagaaaaaucuccauauauggucaauuaauuuugaacguuuucaguaguuuccaaaugugcuguaguuugguuucuauagcauuuaauguuaaaaagcuaugaugccuaagauguauuguuuuucaguaggagccacuuacuaagugacuagaguuacugucuccucagcacacgggcuggguuuucaucucuuuccuuguggguuuugguagacauugugauccuugggucagccuuugaauuaggaacuugugaccuugcgucuguaacuggagagcugaggucgcagcagccaugcuguuuacacauaccuucagagcccuuugccagccauucccaguuauuuuuacucagugaagucugggaggugaagguugcaagcuugguguucuauucugaguguggccgaucuuccucacucaagacuuuucuugugguuuccuuuuacagcgccuggaugguucuaucaagggggaaauccgaaagcaggcacuggaucacuucaaugcagaugggucugagguacauugugcauggcuuuaauauuugcauaacuuggacuuuguauaugggggugucuuuccaguuuaaccaauuguguuaaacaauuuuguagcagcccuguccugucuugacaagagaccaggauacucuccuauucuaaaagaugccugguuuuguuguuccucacugggcaagcaugcacugauuuccgucagcuccucaggcugaacuagugaugcuuccuacuggcuuaccacauuuauggguugaaagaacaggaaggcaagggcaugaugggccaguucaguagaaugaacuuugauacauacgcuguccaagguucguaucuguauuucucugguccugaugcuuaaguagucuguuugccgaguuugagugacaucaaccucucagugugaugcagccuaauguucuuucucugcuacagcuuuacauuacuugauguccugccuggacuugguuuugccaaguguuuuguuguggucgcauccauauuaaagcuucuuuaaccaaguuagagacccugaguacauuuauaucugcauaucaguuggucagaugacagagcuagagcauucaucugaguggcgccagcugcaguacccaagcaggguguggagaguggcccacuuucuagagcuuagucagucucugaauuuguggguagucuuagugaacuacuguucucaauacuucuucugucaccuaaaucuuaucaucugaagggugauaauguauuagggaccaagcccaaggaguugagucaggauacuauuagucccgucccucuuccccuccuauuucuuuaacuaugaaaucacaaagcucugcuauguaauagcauaugaggauagaugugguagucgcugcacucucaccucucuuagcauagaaugggcgugcaguaaaccccgagacuccuuuaucacagugcucaucacagagagcccuggugcagcuuaguuucuuuuuagagaaaaucugaaguguaauuuuugauucucauucucucugauagccauauauaaaauaugguuuuucugauauauucuguauucuuuuaaaauuaaucuuauacuuuuggggacgaugucaccugcccauuugucagauguuguagauggugaagcauaccuaguguagccuucaccccagugacucagucuccacacauugugcacuucaucuguacagauggaagcaugucucauccacuugccuuauuguaaucaugcgcuaugugacuuugucugcuuuugguaaucaguauacuuggacaauuuuucucaugucacuaaaggccuuaggaaauucuccccugaucccacaccuccaaggagaucaaaccuaggucuuuguacaugccagacugggacacuaccaucaagcuauaucccuagcccagcaccuucugauuugauuuccaguaacuuuuuucaugccucuacuauucuuuucuauuuuauguggauaacuccuuggccugcaugucuguaugugacuucauaugugccuggugccuggcacccggcucugaaggaggccagaagagggagugggcuuccuuagcagugaaguuacaaaugguuguacacugacauggaggugcacaacuguuguacaagagcagccgcugcucugagcccugggccaucaucugugcugcuccugcuguuucccugcuguuucuuuauccauguuaucaccaucuaaauaguuauaaaaucacaagcauuucaaaagcacucccuaaaauagcuuaccguuauuuggucccugggcacaugcucccaucuuuagcagcgccaagcuccacaaucuucuuaaacauaacuagcaugcaguuuauaguauugcucuugacauuggaaauuauuuaugagaucaucaguguuggguuauauuuauaguuuugagcaucuuacccugaacugucuguuguuucuguauauacuauauguauuucuagcugcugauuaauuauuauugugguuauuuagaauucuugcaagacagcugucucccucuuuguguuuucauugcuuaauguugucaauuauggcuguuagaaugugaagagcucucuguuccuucuguaugucugucuaccuaucuagucuauuucuaucaucuguuaaauuuuuugaguugcacuccccaagucagcaguuuguuuauucauugacuaauuuauuuuguuuuguuuuguuuuguuuuuuagagauagaguccuuuauaacccaggcuggugucaaacucaguauauaauugcagauggccucuucuuccugagugccaaauuauagguguugucugccaccacacuuuccauaggccauuuuuugaaugguagauuuuuacucaaaagguauuaacuuuuguaggcuggugaaaugacccagcgcaugcacacacacacacacacacacacacacacacacacccaaaaaauauacaaaauaaagaaaaagaaguguuacuuuuugauacagauguuuaggugcucugaaaauagugauauuuuaagcuuuuuuuuuuuuuuuuuuuuuaaaccuggguuuacaguuuacuuucccucugcccacauguuuuucuaaguacucaccuauuaagcagguauaccacaccuguccagucucugauugcuauguacacuggaagacauuagagcccagucuuuggcacacaguguuuccucauacccagcggcaaggaauugcuuuucccucggaauccuuugugaugauggacguucuugugcuucucagcaguccugacucaugccaugcgaagugugucuguguacacugacucccuugcauuugggucgcuuguuacagcaguucccgagaaggcuguuuguguggugcuuugguuaacuuguugcauauacuaguuuuagcuggugugugaauuccuugucccugcugccuugcuagagucgacuuuccuccuuuguucccugcacugacacuuccucuuaauccaaugaaaaugucugugucucaaguccuugagcuccuuuuagccuccauaaaguuuguccaucauaucucacuuuucuucacaccugcagggguuuccaggugugagggcuuauuggagugugagagugucucucagaaggccacugcauaaaguaguauauugcauuguguacaggacuucuguuuccugcucuccacacgggcuggcggccugggaaucaauuuggcuucagcggacacagucgucaucuuugacucugacuggaacccgcagaacgacuugcaggcacaagcccgagcacauagaaucggucagaagaagcaggucaguggagaugggcucuagagucuuugugggacaguggguagagguuucuccuuccccaucacugugugcaaaugccgguuuccccauugcucugccuucucuuuauuaacuuguucagaaaagagaugucuuuggaccucagaugaguccuaguauggacucuuagccuacuucuaugugacauguaugucaugagugacuuucuacacauuuaccaggaaaggagaaugaggagaaugaggagcagccucagagcuuaagagcguggcuaagggguucaguaucagucagggcacuuagucuuauucuccaugacaguguagucugcagcaugcuggagcagcacaggcuugcgugccuguugcuuugucuaugggucucaaagacugcuuuccuacuggguaacuuacaaguuccuaugugaccagcgaggcagcauuuguaaaaucaagccaaucguuguugggauggucuuuguuaagaacaaggcugugcuaucuuuugaagcucuuuccuuuaagcauuuagccugcuccaguaacauaccuucugcacccaccagcucaccgacugaggcuggcagugugcaauccugugcuacaggagagcaaagugacauucuccuggauuuugagagcauuaacuugagcuuuacacagaaauaaucauaacguuucuucugacaggugaauauuuaccgccugguuacaaaagggacuguggaagaggagaucauagaacgggccaaaaagaagaugguguuggaccaucuggugauucagcgcauggauaccacuggcaggacgguucuugaaaacaacucaggaagauccaaguaagugccaggggaaaauggcgagacagagagucagauaguuuccaccagcauuugauacaguucugauagauuuuaccacaggcaguaucuauccgucaacuugaugcugugcggggagggugcugcccuccccccauuuauuuucgugugugugugugugugugcacacaucugacuuuuacauacaugcccuguggaggucagaggcaagaauugguauuuugcuuuuaccaugugguuucuggggaucagaugagaugaaguuuggacagaggcuucuucccacugaaccaucuggccggucccucgucuuuguuuugcaauacucuuuugucuuuacuucuggcuccacaugugacaugaugcagcagcagaaguugggccaugcuguuaauugcuucuuaguguagcacagaucaccucugacugcaacagaaugccuuugguagaaauagcuccugugcuguuacugauagugaaaauacuugugugaaggugguugugccuuuucaaacuguacaaacgggcaaauagacauagaggaaccguacugagcaguuuauacugggacuagcuguggauuacacuacaguguauuuaugaugaagucaaacuguucuuuguaaggaggcuguuuugagauaauuuuucuguucaagaagagccuaaaucagagaagucgaucuguuuuggacaagggaugagaaggaugaaguuauuggugaagaugagcugacuuccugggacaaagggcaggaaaagcauguguuuuuacucucugugcaggacaguaacugaguuucuagacuuaccacaaacucuggguuauuauugcagaauccgagggaucauuguucuuggggcagaauuaacuuuuguucauuuguccccuucugcaaaagguuuauacucggaaguccagguccagagugcauaacugacauuguuuaacaacuuuaaagauguuuaguucccucuuacacauaugaguguuugguuuccauguauauaucuuccacguguguaccugguuccugcagauaucacaggaggcauuggaacuugucucuugaguuacagguggcugugagucauugugugcacgcuaggaaccaacgcaggucuucuggaagagcugcaaagacucuugcacgcugagccauaguuuuagucccucuuaacauuuuuuacauuuuuauuugugggggaguugagggguacacuucugccucugucugaguguggagguagaagacgucuuguuuucuccuucaccaugugggucuugggcauugaaugagagcagccucaguuuugguggcaagaugcuucaccugcugaacccuccccuccgcccucuuacuugggaucacagcuguauuuuacuccuacagcucaaacccuuuuaauaaagaagagcugacagcuauuuugaaauuuggagcagaggaucucuucaaagaaauugaaggagaggagucagagccucagguaauccguuuggagcauaagaauuuacuuuuguaccuacuaugggaaucaguauggagguuuuuaaaauuaagaacagagcuggcauaugauccagcuguaccacuccuagaaccauacucagaggaaccucaagugagguguccccgagauguugcauauccaagcuaacuguagcacuaaucacaaguccaagcuacauaaucagccuggcuguccauugauaagugcauagguaaccaaacuacugucucucucuuuuuuuaucuuuugguuuuucgagacaggguuucucuguauagcccuggcuguccuggaacucacucuguagaccaggcuggccucgaacucagaaauccgccugccucugccucccaaguacugggauuaaaggcgugugccaccaugcuccgccuacugucucuucauauuugaaaauaugucauuuguaggaaaguugguggaucugaaaguuaucagauucagaaaaccaaauaucacauuuuuucuccucauauguggaacuuuauauauuuuauauauuuguauauaagcaugcuuauauuaauguauauguauguguauauacgacaugaaagucaaaguguauuuuggaagaggaaagaauaagucagcaucagcaaaagcauguaauuaagaauaaacauuauccaaguauaucauagacuuaagaaaauacaguuguauaacucaucacuuuuacaguaaagaugacuaguagaaaaaauguuuuaaagguuauuuuaugaacaucuaaauuuuuuaggaaagauacuuuguuagaaauuuuuauaaacaaaguaauuauuugaagggauauggcuuuuuaaaaaauuuuauuucuugcuaagcucaaagcuuuuacaacacuaaauaggaucagauaaaaccuugaaggauucuguaucuccccauauuuuucuuuccuagaauucccugacuauaaaugaauagcagugggaaguguuggguuugaaagaugugccugaggcuguggaguagauagaguaguagggaagaggcgugcaugcaccuaaggcuuguaguccaugcggagacugaugcuuuucuccuguaucucuguuacuuuuguuccuucaggaaauggauauagaugaaauuuugcguuuagcugaaaccagagagaaugaagugucaacuagugcgacagaugagcugcucucacaguuuaagguaugaugaagaccaugugggaggaaccagucaacacugacuuacuaacuagaagcucccuucgucuagucucuguguuuguacgaggcuuguuauuuccucccuuaccugaauuaacucgugcuagugucguucugaguucggauguuaggacuguagucugcaguguuccaugaggguaagcacugaagugaaccguccuuucuagagucacgggcagaggaaaggacauugauguauugccaacaggauaagcaaaagaccagaagcauggaggcauaugagccauucaugacaucagaugccaagagaagucaaaggcauuggaauuguaggggagaguugagagacuccccuaccucauggagacaggguuuuuucuguauagcccuagcuguccuagaacucauucucuagaccaggcuggccucaaacucagagaucugccucccaagugcuggaauuaaaggcauaugccaucaguaccugguuuacaguuuugguuuuggagggauauucucuuagaccuuuuuuuuccccucccuauccuuuauuguuuacucucuuuuccuuuucucuuguccuuccccuccuaaaggguugauaaaggauagucauuagugucuuauaaaaacauaaaaaaggaauagaucaccgcagugccgaggagggagaguuugagaauuaagucugugacuugaguucugcugagaggcaggaagucuugggacagcugugaguuagagugccuguggggagaaguugguugggagugacauaaaucuaggugguuucuuugcuguggagccacucaccaugugacuuuguccagccaguaccuacuguuagggaaccugggucacuuggcaauccuagggugggagauuggucuggagucuggaggauagucaggguagcaaguguuuccagagugcacgggagaguuaaacaugucagggaaaguuguugggucuaggagacugcuuacuuagugucgagggagaagaccugacucuuccaggcuguccuuguccuuuacaacacgugcagugacauguguguguacaaaauaaacaagcuacuaucaaaccccagacuuaaacuuuuguaaacagcacaacuaguuuuugcaaaaauaauugacagugagaugguuuguuuuuaacggucucagaaauuaugcuucuucuugaaauuuaaaaaaugugauuguaagaucaaaauauucuuacugaaaauugaagaguuaguuuuaacuacacaucauaaaguuuugauuugauuuuguguuaccuccaagugacuuugaggaauguaaacuguaaagguccauuugugcuccagcagacucuuaggccaagaaggaaggaguauaaaagagcgagaaacuggaacugggacucugcgcuggcagcacaguccguagggagcugccuggugucugagugcagcccgagccugggagcuccguagggagcugccuggugucugagugcagcccgagccuggaggcuugcugguuugcucucuuggggcacauaccguuagacugcaguuaccgccagcauuugguaguggacaaauggugugucuucuagacuaagaugggcuuuugagcacauacauacuuugacugguuacacuucugauaaaggugaguaaggugacagggugacugagagcuggcugcagcucaucauagagggaugugggaucaucauggaugauaauuaggugccaaacauguccuacagucuaagcccgugaaauuacccaggcagugcgaugcaagugaaauacacuuauuucaguaaaacuuaccaaacaguuuuuaaccuuucuauaucuauuucccuaauuuuaauaaaauuuuugaugaacugauagcuuuguuaaguugauuugggggaaauaaaaaggugagaauaguaaaaaaauuauuuugauuacauaauauuaugaguccuauuacagcguucuaaauuaaaaauguucauuuagcugauaccuugcagaugguguuuggagguugagaaaugucagacggggguugucuuuugucuuucagguugccaacuuugcaacaauggaagaugaagaggagcuagaagagcguccucacaaagacugggaugaaauuauucccgaagagcaaaggaaaaaaguggaggaggaagaacggcagaaggagcuggaagaaauuuauaugcugccucggauucgcaguuccacuaaaaaggugaggugagagggaaguucacuuucugccuguccugagugacugcacauauagauucgucagggagaacccaugcacgggagaggcccugaacaggagaggcccugacacaggagaggcccugacacaggccugcugggcagacacgaaguagcacgugcagggcucauaagcacacccugggcccuuuuaguuggucuuugcugauugguuuuuuugagaaaugacuggaaggguuccgaguuuacagaaguuuuuacuuugucuuugagguuaaaauuguugacaguccugaagacaauuaaguccauauugcugcuguccucauguuucagagugccaaauucucuuuguccuuaacugcucacaguacugggucuccguagggaaagcuagcaagcaugacuaguacagggccuccacaggcugcacagcuuauucagccgugcauaagcaccaugggauacaguguuacugaaauaagaacacacguuuauuauccaguuuuccgaguuacuaggcuugccugcuguccuguuaaaugagcauuaccacagggucagcugcuacugcguggcacacaguccugagugcauuuuuauuuccugcuugugaaaacccugucucaaagggaaugucauauuuucaucuuauuuuacaaaaggagaaaaaaaagacaagucauugcuuuccuguuuuauacugggugucuuauauauuacaguauaaaauuaaucggcucuuuuaaauucaguacacuuaauaauugcaaggucacuaaaaguaugacaguuuucucccuguucccugauaccugacauuuuaaggagaccaccuugucagcugggaugggaagucugagcaccaacacacaagccccagacuugacacuugcuaaagugcagcuuggccuuacucuuucucaggcucagacaaacgacagugauucagauacugagucuaagaggcaggcccagaggucuucugcuucugagagugagacggacgacucugaugaugacaagaagccgaagcgaagagggcgcccccgaagugugcgcaaagaccuuguggagggcuucacggaugccgagaucagaagguuggugaagucuacuccacuagagcuuguguggaaagauguguucuaagccuuggucccccacauguaugacagaguaggaaggaaggcagagaagccaacacaucuaggcuucccggaguuccugcaggguuuccagacuuggucuugccuacuuuuugucagguucuugcuuggguuggguaagguaggucucauguagcccagcuggccuugggcuccuguguggccgagggacuguuuguaguccccacccucaugccuuccccuacgagugccuagcucacaggcucuuuuucaucuuuuuuccuugcuguuuucaagauuaaguuuaccaaagggagacugauguguaccacgcauacuuguauucauaauguuuauguagaaauggcucugccaugguggacacuugcugcagugguccucaucagcaucagugcugaugcaggccgugggaguuugguuacauuccuguucuaguagaacacaugagaugucauuuggcagcuggccuuucuuaccuaaauacauucuuggaaugggaaagaugguaguauugcucaucuuuuuauuuuggucugugucuuuaaaucuaagucauguaggcagcuuguaguuagauugguuuuucuucuuggucucuucugaaccauucuaugcacagcagugauuaccugugaccugcgcugucuuuacuccuucauuucuccaucagugauucuuguggaccgugggguggcucaguauuccauucuaacugccuuguuuccauugcuagcuuguuuuuucacuuauuuucuuggugguuuccauggaaacuucaaggaacauguguaugccuaacaguuuaaugucagugguuuaugaaaauuuugggugcaguuccucaccuucuucaugucacacauucuucacacagaggaagcccacucacaugcuguuguagcucuuuucugucauugcacgugaagccugauggaggagaucccuugauacugcuuuguaguugaugauuuagugaucuuacauguacuuuucucuuuguguggaauuaggcugcuguguaaugcccuagauaaccugcccaaggguucucaucuagaguuuccuuuugggggugugucuacuaaugauggauucuuuauuuuuccauuucuggcuaucuuauuuucuuuucucuuucuuucuuucuuucuuucuuucuuucuuucuuucuuucuuucuuucuuucuuucuuucuuucuuuuuuaagauuuauuuauuuuauguauagggauacaccguagcuguacagaugguugugagccuucaugugguuguugggaacugaauauuuuuuacgaccucugcucacucugaucgaucccgcucucucagccccacucacuguggaccaaagauuuauuuauugucauacagaaguauacuguagcugucuucagauguaccagaagagggcaucaggucucauuaugggugguuguaagccaccauguguuugcugggaauugaacucaggaccuucagaagaacagucagugcucuuacccacugagccaucucaccagcccuucuuuucuguuucuguuuucaaguuuauugauucuuuuucuccuauuugucuccuugugaaaguuuucuauuuguuccuuuccuuucacacucuuggaaucaucuccaagguugcaugcaugcuggacaagggcuccaccauugaacugccauccaguucucuaguuuauacuucugaugaccgucuccuaggugacucuuucauucuuuagcuauaacuugcuagcagauuguugucucauaaguucaggugccagacuuguuaaaguacaguguucuugauagccuguguccuccuucuguaugcgcuguauuugugaucccacaggccuuaauuuuguuuuuauuugaaaaaucagauguuuuaaguacuguacuaugguaauucuggaccucaucuuuccccccacuagucaguuugcugcuauucgccgaacucccucaaauguuuuguaaaguuuguugucauguccuuugaagucucugcuccauuagcagugugauuagcaaaugacaggcagagauccaaccuagcaggucuucuaaccucuuaccagcaugguggagaucuuggguuagugcucugugaggcugcucucagcucuucucugaccuugaagaucugcacaugcagcagugaagucacggauuuuuccuuugcccuugugccgaccugcaaacauguggucuuuuugauuccugagaguacaucagaggcuuucaggauguucugguggcaucuuauucccagguuuuuugauuuuuuuuuuuuuuugaccauugccuuauuaucuccaagugaugugccccaggccacugguauauuaaaccuuugcaacuauuaccaaugaccuuuguaucuccacaaagaguucuaauucacacucacacacauacacacacacacacacacacacacacacacacacacacacaaaccuggacauggcccagcaguuaagagcacuggcucuuguggcagaagucccacauuugauucacagcauccacauaacagcuuacaagcuucuguaacucugguuccagggcaucugacuuccuguucuggccucccuagucaccaaguauacacucagaacacagacacaugugaggucagaacaccuauacacaugaugaugaugacgauggugguggacaccaagagcaauagugauuaaugaaaaaaugaaaaagacaaaccugacagucguacuucuagggaugcauagucgugcaucccuucaccugagagaguuccgaguugccucagauucaucuuugcugccagcugccauccccagggcgcacaguugaugaugguuucuccagguuaugguggcucuagagagaaggcauugauaguaaagcaaguugcacuaacagaaagcucuuggcucuugcugagacucagccauuuuuuugcacaaauaccuuagaugggcugcagaccuuuauaaugucuaggucucccuuggagcugguuuugccagguucuguuggugguuuuguuauuuuugugccgcugaagaucauuaccacuguuuucagagcuggguugagcccaaggccuugugcaugcuaggcaagagcugugucuuagcuuccuuauuauaauugaaucucaagguuuacuauuucaggcauaaaauauuucauuuuauauuaaggagaaauguaggguugagaaagaacccucagguucacuuucauauuuagcccauuacuaagguuuguauucaaauucuuuauuucauacuguuauuuagcuauugucaucuuuaauccuguugcugcgucucaguuccuuguuucuuagucuccuuccuuccauggcuacacaaccauucugucacaguaacuugguauauuacugugauagaggugaugugcugcagcaucuaguguuggugagauggugaugggaugauggcagggaucagcgugacugaaugcagagacuggagaaguccauuggaagcaaggaugggcaaugccaauagguuccuaaauagcuuuguguacauuuucaauuaguguguguguacauauuguguguguguguauauauauauauucugcuuaauuuuaaaaaguauuugucagagccauagaaaucuuagaacuauaucaucaaucauaaauaaugaaaaauacucugacucagagcucagcauagaguuaguagacugagauggucaaguaaugauguuagaguuucaucauaguugagcuguuguguccuggcuccuuguaguggcaguuucuagguccugaucugucacugaggauaaacuuggcaucugcuuugaauagagcuugagaauguguuagguucacccacucagaaacacucaauugucgcuuacuugcugcauggauugugccagucucaugacaguuuguggcucauacuucaugacaggauauugugggauuuauacaguuaauacuuguguguuuuaauuaauuuuguugaucauauucuuagguucaucaaggcuuauaagaaguuuggucucccucuugaaagguaagaccaauaauagauucuauccuuguuuuuacuuauagaagauagaaggcuuucuuucuuucuuucuuucuuuucuuuucuuuuuuuuuuuuuuuuuuuuuuuugcaucuagaugcaaaauucuccccuuugaagaaguuaguuuaaaacccauuggauguggcaaaaugggucugugguccauuagacaaccuggcuuuaauauaguggauuuaugugcuugguuugaugcauuguaguggaguauaggauaaaugaaaaugaacagaaaggcaaacuagugugugcagucuuuagacacuucacaugcuaacaguugcagauagcucauucguaaaguaaacucaggaccugauucuucugauguuuauggcugauguucugugggcuaucccaaggcaaguuuuggugauggaaauggauguacuuuaguuauuagacaaggcucuuguuggccuuggacugaccuauacagcagguaucuuucaagagcaagcacuugugagaucuagugauauucaugcaguauucagaaaagagggcccagugucuccaucuucuucuuucaggcuagagugcauagcacgugaugcugagcuaguugacaagucuguggcagacuugaaacgccugggggagcugauucauaauagcugugugucagcaaugcaggaauaugaggagcaacugaaagaaagcaccagugaagguaagucagcaaguguaauucaggaagcaaagcuuguguaucuggugcacaugcacuagaauuucuauuucagggcuuuuaauaacaguacugauagccaggugugccuggugcuugcacuugucuauuuugaguugcuuuucugugagcuguguugagaccccaucuaucuccucucaggggaagagaauguaugaugugaugaacaagccaagacaauuuucugacgcugcugugaaaagaguaaacuuggcugaacgaugcaaaguagaauggucaucucaauauuuuggccuugaaggauuauuauagacuaaacaugaugauagguauauuucuauauuauagcagucguaagacauuuagagagagugagugagagagagagaguguguguguguguauacacacaugaauuauaaguguuggacaaguauagacaaguagugaaaacacuuugguuuauugagauuuucauggcacucuaauuuguuguaauuggguuguacauauauuuucuuuccucuaaaaaaccagaaaagaguuuuugccugaugcuuuaauucuuucacugugguaaaacaccauaacuaaaaccaguuuauaaagaauuuauuuuggcuuauaguuuuggaagguucauaguaguuaagugugguggcagaaucaggaagcugagagcucucauucucaacacuaagccucaagcagaaagagcaaacuggagguagcucaaggccauauaauuucaaaguccacaccacgugauguacuucgaccaacaaggcaaugccaacuaaaccucccuaaacagcaccacuaacuggagaccaagaguucagauacccuauccuggaaacacuucuuauuccaaccaccauauuguacuaccagggcccuauagacuuguugccauauugcaaaaugcuuuaguucccauagucugucacagucucaacacuguuuaaacccaaagucaucucuuuuaagacucaaugcaauuuguuaacuguaauccuguauaaaauaaaaaaguaagcuauguacuucuaguauacaaaggaacaguacuguguccuuguaugacuucaggaauugaccugacugggggucucaagguuaugaagaaaagcugggaucaggugaacuaggcucucugauggagaagccacagcaguggacucucagagaguguuuauaacauacagcugagcagggaggcaggguaauugcauacagcugagcaaggaaccaggguuauuacauaccaacaaggagucacaguuuaugggauacagguggaucaaugagaugggguuagcuaaucccugaaggggagccauguucagaccauaaguauccagggggugggggagaacuguggugggcaauuucgguacacacucagacccauaggaagacuuugccauagcucugaaccucaacuggggaagguucauagcuccucuaagguugaggcuuuggagucuuugacaugacugaccaugucaacaguacacauuuacuaagaacucuugcgcgcgcucgacuggccaggaagaacgacacugcaacaggauccuucugcacacguuuauugggagagcuugauuguagaggcgaaaagacuucgagcccagaacuggugcugcuuuuauaggccuaggaggggcgugucucacacccggaaugguuaugcacuaagccucauuugcauguuccucaucugauuggcuacucucucucaguaccucacagaaccucauuaucauaccucauuugcaugucucacaucugauugguuauacucucaguaccuuacagaaccucauuaucaugccugggccaggcagugucuuugcaaaaaacuuuacugcauauguacauauugguuguuuguccaaucuuaugcgugguggccagcaguagucagugccacucugcaacggcacauguggcuucccacaaagaacuucuuucaugcagggugucuugucugcuccccacagaacagaauauacauuacaauugcaaaagguaggaacgcagacauaggaaauccuggaccaaagcaagauccacgaggguaaacaccaaaucuuggagcuuucuugucccauaucaguggaucuacuccuccagcuuugcugucugucacagacaucuaucuuuucagcugguuccagucucuguauguacuuucguaggcgcuugucucaugccguggcaucuccuuaucauuuuugagucugcauuucaauccaagauucaucuucacagcuucacacguggcuucucccagccuggaagagauuucuguuccacaugcuuccuggcuucaguggcuaucugaagucauggaggaggaauccauauaccuccacucuugcaucugucaugccucuaaagccauuaucacacggaagacacugcuguguuugcuuaguugggaugggcucuccugugccugaaccacgauaguaggagcuuugguuugcagcugcuuucuaggagcagaaaacuccuuaggcauuuugcaaauuggaagcuuagcugaguagaucuuacccuaauucucuuagugcaggucucuuccuuaguggcccucaucucuaacaacugcagcuuuguuaacacagccuuggcugggacacuauguuuccuggggacccuuuucucuccaaauaguucacuuuguauuuuucugcccacuugcucuuuuucaucuuagacuugaaugaaugucaauaauaacuaugccucagccucaacauuauucaggcuugaaauuuccuccaccaaagaaauucauucaucauuugauguauagaccagauugguuucacacccagacaaagucucugccuuccagugcuaggauuaaaggugcgugccacuccuccugcucauuaccccguuauuuacccuuagcuaaguucuuaggacaaaggcagaagauagccagcaucuuacuaaaauaucacaagaguggccugucauccagcuucuacuauuguccuuucuggaacguuuugaauuuggccuccauagucuacauugcuugcagcgcugucuucugggcucauacuugaguggcaaauuaauuucugcauaugguguucagcuguuuggaugucuuccuuauuccucugaaacccaacauggucugguucuucaccgcaacagagcaugcgcuguccucguguccuccuuagucauauggugacacacugaccaaaaccauguugguaggaucggguuucuuauaguuuacaguucagaguucauuaucaagggacucaggcaagcaacucaagcaggagcagaggcaggagccauggaggaacaaacagucuuuacucgcuuccuucccgagcuucuucagcuugcuuuucuuauagaaccuagggccaaccugcucaggggugccaccauccaaaguggguggaggccucacacauuagucguuaaucaagaaaaugcccagcugggcaguggcagcacacguauuuaaucucagcacucuggaggaagcagguggaucucugugaguuugaggccagccugaucuacagagugaguuccaggacagccagggcuacacagagaaacccugucucaaucaaucaaucaaucaaucaaucaaucaaucaauagaauagaauagaauagaauagaauagaggaagcgagaagaaaguuccccagagacaggccuccagaccaaucuguuguagauaucuccucauuugagaauucucucuuccuagaugacuguagcagauaccacugaaaauauuaaccagcacccccuuuugaagaaaaacuguuuuauaagcagggcacugaaguggucacucagaaaagcagguguccucauggguuccccaggccuuguccgucugggucacuuaccccuuucuuuucuuccuccuuguucugcuuacuaacacuacccucugacaguucuccccuggggagcucaggguuagaaggcggcuaguugucuaaaaguuccauucuacuuuuucuuaguuacuuacccucggguaguuauacgcccucacaguaaccagaggguuuggaagauuaaccaucccauacauuacagugcuugucuagagucagguuuacaguguuagcuguucuuaucaaguaaagaaacgcguuuuacucugaguuucacuuuuaaggauauuuuagaaauuagcaaaauuuaaaaauauuucagauauaguggaacuguuuuaguuuauuuuuguaacagaaaugugauaguuugaaugauuugaacacucaacuuuaaguucaugaauucacuuuuuuuguuguguuuuuuuccuuuuuuuuuaaaaguuuuauuuaucuuauguaugugaguacaaugucacuguuuucagauacaccagaagaggccaucagaucccuuuauaguugguugugagcgacucuguuguuucugggaauugaacucgggaccuuuggaagaacagucagugcucuuaaccacugagccaucucucuccaguucccuuaugauuguauuuuuaaggcagggucucauguaauccaggcuaccaugaauucacuauguagcuaagguuaacccuaacuguuuacuggugagaucuugggaguggaucaccacaccugguucuacacagugcaggggaucugacucgguuuuaagcacagucccagcugagaaauuaaaaguaauuauuaaaagaaccaacaaacagauauuccucuuucuuguuuuauuuuuauuauguuuuauuuuuauuugcugccaaguucaugcgaguauauaauguguaacaucguggucaguccccccucucccugcacugacuccuucucugaacaccuuccccggguacauccgacauuguuucgugacucagcgagcuccgcgagggguuguggguucuuuaguggaccaucagcauuaucaguggcuguaccacugaagagaauaguuucucuucucccaacaaccauuagcugccaauugcuccuucaggauggugggauggggucauacaaccuacuuuucugacugugguggaauauugagggguccuagcucaugcaggugaaccgcagcugcuuugaguccagaagaccauuaauaugacacucuucccuggucgccagcucuuaaccuucuuuucagcaacccccucauuccacaaugguccaccauauuccuugagccuuggaaggguaaugaagaauagagauguccuguucagggcugaacacucaacacucacucagucucagcgcugugaccaguuaggagucugcucacugcaaacaguugggccaaagcuuaguagcucuaauguauggguaaaauguaaaaguuuggaaagcaguugacacugucuagcaaaacaacagaaguagagucuccacuagccugugacugccccagcugugggcuguugaucagguuuauagcaacaguguggauacccuccuugaggaggugucuaauucaagcagaaguguuugugcaaucccuauaaaacucaguuuccuguguacuaguauugguuguugucauuuuauauacacaagucuaagggauucugugcacuguuguguuguguuguguuguuguuguuggagauuuccucccuuauuguaacgcauggccuuuuuucccuuauacaugcuccuguccuuguuauggcuuauugcuucuugacauugacuuaccuccacuaaacuucuauuaccuauguacuauaccaaccauauuuagagaggccaggcucuacauuacauuucaguguaagacuauugauucuauucuuuaaaacguuaauauaauuauguaccuguuuucccugcacuguauauauacauuucuaaauaucaguauuagucauguguguguauguguauguuuuaagacaggaucacucuauguagcccugguggcuuugaacuuacagggaucugucugccucugcauccugaguacugagacuaaaggugugcaucgccaugccuggccuucaguauuaaccuuaucauucauaagacuuccacaugcaaagcuuuauuucuuugcgugucucuuugaguuuauaauucaugaacaguucuuuuuuccaugugugauugugucaucaauugaauucagacuuuccuuucauauauuuuuauuuuagggaucaccuuucucauuuugauugaucuguccaccugccuguuuuaaugucccaccuuucuugauaggaucuugcuauguagcgcuggcuugucugguuuccacuguagcucaagguagcgucagaguccuggugguucucuuguucagccucuccagugcugccauugcagcagugccaugcgugacguaguguugucauuuucucagagauaaaaaauauuuacacugaaacacuuuaaagucaaaaguguagcagaaaaaaaucauguaaaagaggguuguucucauucuugugugccucuguguacauccuucaucuuaggccacuguccugguaagguuugaauuuauuuuagugcuuguuucaaaaaaaaaaguaacagaauuuuguugauguuauguucugcauagcaugcuguguugaggugguguuuacguuucaucuucucugucucuccauucuaaguagugagucuucaguguuuucacaucagugaaguuacaagaaauuaauguaaccucuuaaacauucuacuuuguacuguugccagaguaucuuuaagguggauuucuagaacugagauuauaaauuuuagaaguggguccugggguaaauauauacgaguuugcuuugguauggccagguuuuccugugugggucugguucuaccagcagauguuugguagugccuauggacaaggcucccagacagaauggcuucuuaacauuuugguauuuguuugugaaacagguuuucucuauguagaccaagcuguucuggaacucacuauguagaccaggcugcccuggaacucagagcuccaccaccuucugcaugcugagugcugugauuaaaggucuacaccaccauaccuagcagauguuuguuuggauuuuugauagcccagcaggggagaaaggaacucauuuuucuuuuagugaauucauuugcaucuuuuaagauagauguuuauguguuguuuuacauaaacuguugauauuccuguucuuucucauuuuucuacuaagaaccaucuuuguucucacaaaauaaaguggugucuugguuaucuuguaguugucagcuuaggcucuggccagagugguuuuauuuucaauugcagauuaguuuugauuucagaguagucuucucaggccugcugugcaggucaguccauaugacugcagugugcuaacuguuugcaugcacucugcuccugcagaaagugacugaagggaaacacgaaucaucuaaagcaugaguaugccuucagaauccugaguuagcuguaucagguguacaguaaagaaggauaaacaagaaaguuacggguauaaauuccaauacauauuuaaaacuaaauguuaaaauacugcuuaaaauuuauuuuauaaauauuaguugaaaacaguuucucuuauaaauuauguuuuugaucuaauaauacucuggagucuauagagagagacuaucucagaauuugacaauaaauagcuuguuuccuuaaggaauauaaaacuuauaaccuuuagggaaaggaccaggcaagagaagaggcccaacaaucaagaucucugggguucaggugaacgugaaguccauuauccaacacgaagaagaguuugagaugcugcauaaaucuaucccuguggacccugaggaaaaaaaaaagugagugucuuuaccgucccugcauggcuggcuggacauagacugagguuagagcugcgugugguugaguaacaccucucuaacugcuggaaaggccccucuucucaggccucuguguucgaaccccuguagguacugccuaaccugccgagucaaagcagcacauuuugacgucgaguggggcguggaggacgauucucgucuguugcuuggaaucuaugaacauggcuauggaaauugggagcuaauuaagacagacccagagcuaaagcuaacugauaaagugagugcgugcagugcuggagagcucuacaucuguugugugguaucuuuguauuggugacuuaucuuuaacuguuucaagaggggguuucuuuauucugggaaaguuaccaucuuuagugaacuguggcaugucucauagaugauaauaaaaggaaagacgacaaccaggagaaauuauaggagaaaucuuaaaauucuaauacuucucacaggccaaauuucauuacagcagauaccagggucaguuucuuaggacugaagcauuccugggcccuacuuuuguuggcccaucguuuaaccuaauuuuuuucaguucuguacacagagaaugagugucaccuugguauuuuuguaaugaauuuguacuuucuuccacaaaauugagccucccacccuaucuauugcaaguauaacagggccgugcucagagcuguaaacaagggcagcugacuggaugcacucuaugugugcuccuaucagggcuuuguccuggcacauuaaacacugcucaucccaucugguuuuaggagggugacagcacccuguagaagcacugagaccaaaucgagucuggccggagagguccagcugcgguagacggaucagaucauguccuggcauagcucagugcucuccggcaaugcucuaagaagcauuuucaaucuaaaacaaagcuuuaaccuagcuccagggauucccugcuccuggaaggaggaaauccacgucggcugggaugcucuagcagaugaagccacaagccccuccuaccugaguuguucuacccuguuaacagcacagguaggagccagugggagagcuggauuucuccaucccauuuuguaaaacgagaauggcucaugagggauuuucagugacugggagccauggacaugagaauaggaucugaggcuuuaaucuguguuuugggagguugggagggaaagaaaugugcugaauucuuuguugucucuauuuguccggauucacuaaccgggcugugggugguggcgugugcuucucuuccuuuccuguugaagauucuaccaguggagacggauaaaaagccgcaggggaagcagcugcagacccgaguggacuacuugcugaagcugcucaggaagggucuggagaagaagggcaccguggccagcggagaggaggugagcgagugcaugcaguaucagccggcuuccccagggcagccuggaacccugcugagagagcauccugcccucucaugcuuagacacgcuuugggguuucauagggcagguugcuugcuaagaacaaaauguucaucuagugauugaacgcaauaucuuggcacauuucuuacaauuccacuuaaguauuguaccaguauuguagucuucaucucuuuggacuggcagugguccagaccugccuuuacucuuuccuauucuguguccucaguuggggccauaguucucauguuuagguaucugacuggguggcugugauaauggauuccaggagcgggcuguugcauuccaaacuaauuucagaaauuggacuucaguuuugauuacacuggcucacugaaaaaccccaaguugcuaaugaauccauuggaaguuucuuuucuuuaccuccccaggaugaggagucagaaaagagaaaaccuaagcuuaaaaccagcuugcauagccagccuuugugugggcugcugcuuagguccucccuagcuguguucugugugcaugugugcacaauaaguaaaacuuacaugaaaaaaaucacugcacuuccauuugguauuuuuauacaauaguauuucaaguauacaguaucacucuguagauaguauggcaggaaugugauacaugaaauacuaaguucuagagacaagcuagaucauacuuugauuggcuagaucaacaauauuuuaagcuuuuucugaguuuagauucguaauuuucagguguuauacugucgucaucuuuaauguuaaguauauuuuuguacuugaacuguuugaaccuuuucuggggcuuuuaccuuuagugaauuccaaaacaugaaaucaguaguuucaagaaauuuaaagugguguggccuagcuagaagcuaggagguuuguuuuauccagauuuuauuuucuuugagguacaauugcuuauccuuuuguguuccuaaguuauccucuuuggauuaagugguuguuacugcaucagcuguauuucgugcuccugcuaauggguuggggcugauuuguaguuuugccguauuuuuauuuucuaggccaaacuaaagaagcggaagccucgaguaaagaaggagaacaaagcccccaggcugaaggacgagcacgggcuggagccagcgucgccucgacacuccgacaacccaucugaagagggggaagugaagguacgagaccugggaaggcaugggucgugucuguucauagacagaagaguaaaauaacaguauauugucugucuuuaccuagccugccagagggaaauacugucucuuagucacugcauuacugugaagagacaccacgaucaagccuaccauacaaaagagagcauuuaauugggggguugcuuagagcuuccaagguuugguagagagcauggcagcagucauaggcguggugcuaagagaaggagcugagagcuacauccugaaccucaaccagaggcugggggagaggagagggagagggagagacuaggccugguaggggcuuuugaaacuucagagcccacacccugugacauaccucccccaauaagaucgcaccuccuaaucuuucuguuccuaucagagauuccacucucuggugacuuaagcauccaaauaugugagccuaugugggccauuauuauucagaccaccauaguaguugcuccucuuaaguaagcaguuacagauuccaacauagcugaaucaugacaaauggcaguugguaauucucuuuguuuuagagaaugaaagaaauuuguagaaacugguuaacagggaacucaagacuuacauuauaaugcgguucaguuaguuggagggccuuuagaggcugaguguagccauuggcuugccagcuuguaauccaguuugcagaaaguggaagugccuugucacucagugacaagucugauuuuagucuuauuguucugagaguaauaugugacaaugccuccagaagggcccccaguggcuauaaggaccaacauagauuugaacucaaguacaugaauucagguacugacagccucaucaguacuaguugacacguaguagggcagguguaauguuucuuugguccuugguuuuuuuuucuguuuguggaguagaaacaguaaugcuguuguuuuaggggcguggggugggugguucuugggaucuaacucagggccucaugcauccuguacaaguguauuuacugagcugaacuccaucuggucagugcuuuugagaguuacuuugagaauuggaucagagaguguaacagugucugccuguacaaaucuaguggacugagaguucuacaaguucugcagugcugguaggcucuuaauggaaaugacugaagucacugaugagcccugguccaaugcugcuuucuuuagaaacaaacuaggaagccaagauugagaaaugugcgguuuucugcuuccuaggaugauggucuagaaaaaaguccaacgaaaaaaaagcagaagaagaaagagaacaaggagaacaaagagaaaccagugagcucucggaaggacagggaaggagacaaagagaggaagaaguccaaagacaagaaagagaagguacucagcauacaagauuucauauaacaugaaguauaaccccugggagaacugucuuugaguguaucuaggaaggaagguuggucugcguaagggaugccugcacccuucucacaggaaagggagcuaggcagucuugagcuguuguaauguagaagaccuuuauuuggucugccauuacacauuugggcagaaguguaugagaugagaugggauaagugagagagaaucauguacagcuucuuagacuaugacagaagaaaacugucuacauauacugcagaccugaggaguugaggguuccaaccagauaccacauaucagcagcagacacuggaguagaagaccuggguaaaggccuucauguugggaguuucaggaagucauuccaaaccauagaauugauaugguuucauuacuagguagaugugaagagaguuguuuguaaugagcccuuagcauugcuucaagcaaaucacagcuauaacucugccaucuacugacaccuucacuguuuuuuacgauuuuaauuaaguuuuauguguauggauguuuugcuugcauauauuuauauauuacaugugugucugguucccaaagaagccagaagagggcauugacuccuggaacugaagcuacaggugcuugugagccaccaugaggguucugggacuggaccucugggccuuaagaagagugggcaguguucauaauccacgagucaccuuucuagcacucgccaucuuaccuuuuugacguuaacuuuuguaaauuuccccuuggaauaugacuauaaauauaaaauacugcuuagcucagaccauuggguagccucuucucuccacacaagaguauauuuauugcacuaccuuaccacugaagaacaggugcuaaaguaguucuuauuagauaauuuggcuguuguguaguagaagcuauuuaggucucauacuaaaauuacuuucuaguuuuucauguuaaaaacuaugcugugguuaaaagcauuuucugcucuugcacagaacauggauucaguucccagcucccaugugguggcuugcacccaucuguaguaacuccaguucucggggauguaauguccucuucucaccuuguggacacuggacacauggacuacacaugaauuaagggcacagcuacacaaauacaagaauaaugcuaaggcuuugcaauaagaguaagcugugcuggguaaaggggaugaagucuuuugcaucaguguuccuacaaaauaauguuuccuuuuguuuuguuuuuguuuuuguucucaguuugguuugguuuuguugaguuauuuuugagacaggguuucacuauauaacccuccugaccuggaacucacaaagauccucaugccucugauuucuuuguguugagguuaaauaugcuuggcaguuucacguuuuuucauguuuacuucagcuggcuuuuccccuuucgggcacugcugcaucuccccuuguccaguuccucuuccuguucccacuccucagaaugccuacuguaaaguugaugugagaccaugcuguugugcuuuugugaguuuuauuuaaaaauauuuuuauguuuucuuugugugcacaugucugccugacuauauucaggugaaccacaugcaggcaggagcuuacagaggugucagauucccugggcauuucugagccuccaugaagguccuggaaaccaugccaggauccucuuuguaagaucaagcauuguuaacucuaggacuaucuuuccagacacaccuccuccaugcuuuuuuaaaauuuguauuuaaucuguaucaaauuuuccuaaauaaucugugugugucccucugaaggcuuugaaucuacauuauuuuggucuccaugcuuguuucucuuggcuucugucaguuacaguuaauaugcauuccuggaccagacuguagcuguuaauaaagcuugcugcaugguaauuaggaguucuguuuaaauccuuaguuucuucaugaaauuucuguaaauuauauugauaaacucaaagcuguaguugaguaccuuuagacagaaaugggaauacuuagaauuuagguauuaaucuuuuaaguuugugugaauugaggucaucauuucccugcucuagcaaagcacuggucuugcagaggacccagguucaguucgcagcacccacccacguucugauucacaguguuuaugacuccaguuucuggagaucuggcacccucuauggccuuuucauguucaugcacagauguggagcacauaaacccauacagauacacacacagucauauaaaacaguaccaccaccaccgucaccaaauaaaacaaacaaacagaacucugccuagauuuuaagauuauuuagugaucaugacucuuuguaacucuuugaaaaggucaaagguggugauggcaagucuucaaguaaaucaaagcgaucucaggguccugugcacauuacagcaggaagugagccuguucccaucggggaggaugaagacgaugaucuggaccaggaaaccuucagcauuguaagucuugaaacggaggaugcugaugcuuggacacaaugcucgcugugcucugucuucccaggugcagccacagagcuucaguuaggguaaacgcugcuguguugcuuugcaagcauguccuuguuauguuuacagauuguaggcugaaccaguagggugucuuauauuucuguuuuugagaguaugugugggccugcaugaguuuauguguaccacacacuugcagaguuuagagggguucucuguggcacuugggaaauagaaaugugccagucaggaaacaacauuuggagacccugucuuaaagaagaaauuucuuauucuucuauuguuuauagugaaaguaggauccaugaccaagcugacuagauagcuaacucccugaaucauguugaugccccugugauagauaggguauagaggcgagagaggagucccuggagauccagcaagaagggaaucugaucuggugaggcagguccagggaguaauguuugaaguggguucugaaggaagcauaugggaaugggagaagaaagggacaugcaugccagaguggcaggggcucuuaugauguaugagguggugacuguggcccuguggcuagagugguggcuuaagacgcgccaacuguugaggagaagggcuuuggcuaaggugguaaagcucuagaccguaccugcuuccacgcuaugaagcugagaguuggaccaggacacacucacuucugggagccugggaaggggcugccagccuuuauccauuccacaacucuauucucuuuccaaaccuuacaagucauggcucacuucagcaacucuuucaggcuaaagaaaaagcugucguuuuuugcaacgggaaaugucuuugucuugggcugacaauagaagggagaauauugacccaauucugugauguucuguguuuggccuuucucuguagacccuaaaaccuauuugcauaugccuaugguuuucuuucuuugcaaugaagacaguuuucuuauauucugugagcauuauguucaccuagguacuagaaacaugaaugaaugaaugaauuggauaaugaauacauucauuauucccuguucuuccuuauugcgcuguuuagaaauaaagcaauaucugaugcuucuguggugccacuuuccgguuuuuuuguguuaauauguuuugaaccaagggucuuguucauacuagccacauaugugacuaagucuggugguacaugcuugucaccugaccacuguggacacagaggcaggaagaucacaaacucgaggccagucugggccacauagcaagaucagacuagcuugagcugcaggguaauuuauauguucuguagaaaucguugguacauuuuuuauucccacucacugaaacaguguuuccuaauuuguagugucucuuuauuccauuauaaaaacugaaguuaacuacugaaaaugcccaugaguuucuagcugaggagacuaccacagaguauauaguaguuuuguuguuucauuauuaagaaacuuuaugaucgcgguuuucagguuaacccuauaguacuguuuacauuugaccuucuucguggccacagcucucuugcagauggggaaagaacauucagagaggcuaagucagguaucaaagguccucaucuaaucccggauauggugacggcacuuacaccucggaauucugugucucugcacuugucccauuccacggguguucccacuccucucauagugacacgcagcaugagggugggugucuuuccuggaccucaguguguggaccuguuaagcauucuuugacaugacucaugcucuuuuggcuuguugcaguguaaggagaggaugaggccugugaagaaggcacugaaacaguuggacaaaccugacaaagggcucagugugcaagaacagcuggaacacaccaggaacugccugcucaaaauuggagaccgcauagccgagugccuuaaagcuuacucagaccaggagcacaucaaauuguggaggagguaacccacucuggccuugauucugcccaguuugauuugacaaugugcgagugugcucuguuuuuaaaaauagauugcaugguuacuuacucuuuugccaacgggauucauuuguugacaguauaaccuuaggccucagcuuccuuuucaugaaauaagccacuuuguaaaguccagccuuuucuuuugauguaccauuaaugugguuuauaugaggaugaugauaauaguaauaauaauagcaauaguaauaauagugguaauaauauaauaauaacaacaacaacaguaacgggcuuucuggcuuguugucagaauauuugcuuuaaacccauaagacacaaaccagaauaauacuuuccucaucucagguuaguguuauuaagucuacuauaagaaaugggcuggcuccauaacuaucuuaguuacuguuuugucacugugauacaauaccagggccaccaucaagcuagggaggaauguguuuauuucagcuuaugacucuuaggucaccuuucacugcugaaaggugaggccgaaagcagagcaggagccuggagacaggaacugaagcagagacuucggagcagugcugcucacugguuugccccuuguggcuugcucacccagaaccacaugcugagaaauggcaccacucagugggcugggcccucccaaaucagucaucuaccaaggaaaagcauaacaguccaaucuggucaggacuuucucauucauguucucuuuucccaaccugacacaaaaaaaagagcuaaaacaggucuaacacguaaagcgaagcaaagguuauaagcacaugaacuugaguucuccauuuucaucucccuaauaaaaaaacucuaguaguaacugaaauuaaugcaagacauuaugacuugcauguuaauuuauaaacagguugccuaucccuuaucagagaugcuuagaaucagaaggauuuuagauuuuaaaauauucauaaacauagguaaugacaugucuuuaaaugggaagcaaaucaaauauaaacuuccucuuuguuucauauauacucacugucccuagccugcagguguucuuguauggagcauuuaguguaucugcauuuugacugugacccaucacgugaggauaagggugucauuuuccuccugaaggaucagugucaugauuuucagaacauggacaucucccguaguuacucagagcaaauggcaacccuggaaagcaacugugauaaucgucaagaugggaggugcagccacccaaacuguugagacaggaggccuguaguuugacuuagggucagauuggccagccuagugagacucgagggacguggcuuuguagcuuguacaaagcccuggccuuaguucccaguacuagaggaaauguugaaaaaguaauguuaaguguauuuccauaaacuguauuuaccuuuagcccaugugcuucgugguuaaugcaucucuggcuuaguggauggcucuugagugaaacaucgguuuucagaaauuucgucaugaugcuagugauagcaugccacacuuccugaguacaaaauauaguuuucaacagucauuucuuccugcuuaacacuguuuacauuuccccacuuuacuuagcauauaacgcuuucuuucuaacagauuaaaggaugguagcaggucaucuuuggcuuucugcuaugcucuugguucuguugguguuuaaaaccuggucaccagcacguuuuuauuaaaacguccuugauuuuuaaaaguucaaaaauaauacaagguaugacuuccauagaaacuaaccaucuaaaaauagguauagaagcaguuuuagaaguuguaugaaggaacugccuacagggauggcgagacaguccauccauaaaagcaaaugccauucuuccagagaacccagguucaaucccuucguuauggcucauaaccauguauaacuucagaccuccuucuagccucuacaugcaccaggcacacauauggcacacaacacauucagaccauacacccuugcacaucugcacaaggauggccagggaggcuggggaccuugaacugugagaguagaugagcuaaguggaaauggugaaacgaacacagccaaggcuuuagcagaggcuugaaagugaacagccagggcacugggaauguguagggucuguuguaauuugccaagaagccuguggcucuuuauaagagaggccuuaguaagcuaaguggcucucuaccugacauaguauguugacuguuugguggcccagcccagcacagcauagagaaagugcucacuggaaagcuuggauaaagagcacuguugguaacuuacugucacuuccagcgucucuguaauuacccucuuugugccauuccuauguaugcuauacagcaaugccucgcuagggccuucagcagucucuuagagaugacaggccuuaguggcaaugagucccgggauuguaguaugcucuuguggacccagcuuagugcaaggacuuggauaaccuuuuacaucaaaauuuaguaguuugccaucuauaaaaucacuuuuuagcuaggcaagauggaacauacauuaaaaauuccagcacuugguaggcagaggcaggcagaucucuugaguucucuugaggagagccaagacuacacagaaaaacccugucucaaaaaaagaaaagaaaagaaaagaaaagaaaagaaaagaaaagaaaagagagaaguaccagaacaaaacaacaacaaaaucaguuuuuacauuguuuaauuuaccaauacuauuuuucuuuuaggaaccuauggauuuuuguuuccaaguuuacagaauuugaugcacgaaaacuacauaaguuauauaagauggcucauaagaaaagaucucaagaagaggagguaaaaacgcaaauguaguccuaauuuauacaacuauugcaagucaguuccacaggaaaccccuuagguuuuguuuuucucuggggagguaaugaucaauccgugggguuguuggugcccuauaggccauugacucuuugccuguguuuuacauggauuugguacagccuaagcaaggugacaaaaaccagcgcaggucacagagugugugaccuaugguccagacauaaugucauagacugugauuuuucauuauacuagguaauuucauuaguuccuaacauacucccaugaguaggcagacaguaaaacuuuuguuuauuagguaagauaaccaaugcauuagagccaaauaggguuuuaaauccugacaaggaucuguuaaccugugaucucaugaccuggaugcuuguuuucuagacccuuccuucuuauguauauccuuuuuuuuuagcuuguaauguggcuugucauaagucccauucuugugugggcccauguacuuggcauccauccagcuccucacacagaagauuccaaauugcucacuuaaaggaguagacaguuugcagugcccaguaguuguugcccuuuuguauaaguacguauguauuguauggggauggccauaagggugacuuggcuucugcuguagcauuacuucucacgcaggcaagcucuccuguagaucugcuaccgucccacaugggccauguccaaaucagccacugaggagcaauuguggacauuauuccacauucacaaaugugucaggcccacgaacacagagacucucugucucucauguauugcugugccuucagcaucuguagucaugcuagggccagcaugggcacuuagaaauaguuguaaugugaacuugcuggguuauugaccugagaauuaugcccucaagcagcucaucuuucaacuuuacacugacgaauaugauauagugagaauaggcacaauacagugugucuuagugaaacucuagucaaaguuuuuauauuugucuauucauuuugugagugagagaaagaaagacaguucaugggaguacaaguaugagcgcuuauccaaggacagcuugcagucgucuguucuuccuucuccuuccacauacucuguguauccgggcuuagacucaggcugucagcauuaguguugagugcuuuuaccacugagcaucucaccggccucuaucaguauaacuuuucuaugggugggagcauaguugggaaaggcccuuaggcaggagaguaaguuggguugaggaucugacagugagcacacgguggcaaacuucacagcaguugaugagguugagggacacacggaugucgagugagucaucuucuuucucugauaguugucuuagcuaugguugcuagugcugggaugaaacagcaugagcaaaggugaggaaagaagucagcacaggaacucaaacauggcaggaccuggaggcaggaggcggggccauggagggugcugccuguugccuugcuccccuuggcuuacuuuuuuauagaauucaggacuaccugcccagggauggcugcaccuacaaugggcugggcccugccccaugagucaguaauuaagaaacugccuuacaggcuugccuacagcuaagucuuaaggagcccagccucaauggaggcuccuucucucagaugaccucagcauguaucaaguggacauaaucuagccagcacaguugcuuucacaguuugucagcagaguagaacgcgugcuucuccuuccaagaguuuaguuuaaggcuaaccaaaggcuaaaacaugcuuacagugggcauggcugcuggccaauaaucaugggacgguacagccaugaauuucuuacucaagcaucaaaugaaauauggagaagauauuuucauaaugugccaaauaaagaaaagacagaaacaaauaaaguguuuuuuucuguucuuuauacgcaaaagguuuagauauagagcaaauaauuuaauaguccuuccccuccuggucagauuuuaacucuucccauuugacagcugggaguucuuuagccuaguuagccuuggaaaccuaguaagcaggauuuuguguggcuguggcagucuucugagagugcugacuaccuggcugugugcacagggacaggcuguauacagugacaccuagcuguccuccauguguucucacaaguagagguugguuuuccugcaaugaacuaguaggucaaaguccgcagacugccagcuccuguuaggugauugccgcuguggaagcccaugggaguugacaaacaguuuuggcaagaauuuacuaaaaggcaguucaaagguagagaggagcaagauggaccuguucaggaggugaccuuuauucugaucucagaacuuaagccuggguucuaagcucuucguuuuuuuacucuuccaggaacaaaagaagaaagaugauucgcuuggugguaagaaaccauuucgaccagaggccucgggcucaagccgggauucucugauaucucagucccauaccucacacaaccuucauccucagaagccucauuugccugccucccauggcccacaaaugcauggacauccaagagauaacuacagucaccccaacaagagacacuuuaguaacgcagguaggccacuagguagcuuuuucggaggugucacaacccucagucaccuuguuuucgaaggacauuuguacuuuuaccaagaccuuauugucuguucuugguugaaauaaaacaugaaauaaagaucuagaagguuaagggccagcucuaaauuaagggaccacagguaccauaaacaaacaaaagguaaugggcagacuuagggagcaacuuacuucuguguguaagguaggcauucagacugcuaauacuuaguuggugacaagaagauaaccaaauagaaaaaugaacaguggaugguuggcagugaagaagcagugugugacagagaccuuucagagacuguaaucugauaaaggguuaguguggaaaguagaagggacugguuaagaaguggccaaaggguuuaaagagacauuucucaaaagcugcucaugagaacucugaaacacccuaacucaaugguccucaaccuguggguucagaccccuuucacagggccacauagaagauagagagaguuauauuaugagucacgacaguagagaauuacaguuaugaaguaucaaugaaauaauuguaugguugggggagucacuacaacaugaggaaguguauuaaaaggucacagcauuaggaaaguugagaagcacugcccuaaguuaaguuauaguccagacagggaggcacagagguaaacggauaugauuuuagcucacagcuucccgcuaagucagcagagaagccuguacccuucuuugcugugugcugaggacugauuaccuguagggccauacgguccuuugcuuuuggaacuaucucagcaggacguaccggaacuucguuuauggacuguuuuauucuuuuucaggaacugaugugaguuuguugcaaacaauuuaugcuuuagcuuccccuaauuucacucuacuagguccuagccuuguaugcaguggacauuuucccagcugcugugcuggugguggcccagggacuuaaccuguugccuuugaccuuuagauuagcaccuguaccucaguagucauuuaucucagagaccaguuagucucaaguuuuaauaaagguguacaaacagccagcugguguguagaaaagcacgcagcauuguggaccgcagugagacaccacuugacaccugagaauagcuauuaucaaagcagcacagggcucccaggauguggaggugaaggcaugcguuuguugccaguguccauugaugaacacagccguguagaaagcgugaguagagguuccuaaagcauuaacagagaacuccauccgacccagcagacccaguacugagugcaucucaggcugaagggcuggcgggacuuuuggguuuacuauuggugaauacuuacuuaaaagagucagcauaugggauuaaccuaagugagggauuggcaggcacccauuagaagugagccugucacuuguggccauguggaucaacccagagguuuuaugauuaagagcuguaagcuggugcagaaugaugauacuacgugguucuuccauaugcagaauuuaacgaguugaguuuagaggaucagagaggagaacagugguuauccagggcugggaagcugggaagaagagguggaggaaaugcugguuaaaggauaguuuaguuaggagaacaauguucaagagaugaacuguacagaauggugacuaguugacaauauauccuuuagaaucauugggagguuuuaaauauuaacacaguuagugauuguauaguuaacauguauuuuaagacaugcauaaaaugaguaucuuuggguuuuauugcuuugaagagacaccaaggcaacucuuaucaaggaaaacauugaauuggagcuggcugacaguucagaaguuuaguccauaacgucguggugggaagcauggcggcgugcaggcacacaugguguuggaggggcugaggguucuagcccuugaucaauaggcagcagaaggggacuguguguguuucacacugaguguagcuuaaacacguaagaccucaaagucccaccuccacaguguccugcuuccuauaacaaggccaaaccuccucugauaaggccacaacuccuaauagcaccauuccccaucggccaagcguucagacacacgaggcuauggggaccaaaccucaucaaaccaccacaauacguacauguaguuucuauuuaauuuuaaauauaaauuuugaaacaaagcuuaaaaagggaaaagaaaaguagguugaauuacauuuguuuagaaaaauauagagacagccagacaaggugguacaccccuuuaaucaaagcacuugggaggcagaaacaggcagaucucuugugucuuugaggccagcuugccuuauauagugaguuccagaacagccagaaauagagaaacuaugucccgauaaaagaaacgaaauauacagagauaaaauucaagguguguggugguaucugcaaccccagaacuagagaggcugaagcaggagaggacugaguucaggguccugcagccuauguaagauuuccucgaaccucauuacagcuauguagauuaaggauuagggaauccauggaacauuccuauaaaagaggaaaguaaaacugcccauauaacaacauuccccacccccagcagaaaguuaaaaaaauuuuuuuccggggcuagagagauggcucagcaguuagcacugacugcucuucugaagguccugaguucaaaucccagcaaccacaugguggcucacaaccaucuguaaugagaucugaugccgucuucuggggugucugaagacagcuacaguguucuuauguauaauaaauaaaucuuuaaaaaaaauuuucccacuuauucaggucagcaauaauuaaaaggagaaaugcacacuaguuauuaaggauaggaauuguucuagucuguuuugcaaaauaacuugaaaugaguaaauauaucguccccugacuaggagagugguuacaugaguauuaguccaucuucacccaauaucaucaguuauuacagagaauuggccaaaccagccauuguacacuugcuguuauuaucagcacuugggaggcugaggcaggaggauuacauguuugaggcuacauagcaaaguguuaucucaaaaaguacucccacauuuuccugaaaguuuuauucaguaaaaauguuuggggcuggagagauggcucaaggguuaagaguacuggcugcucuucacaggaccuugguucaguucccagcacccacacaaccauguggaacuccaguucuagagaaccugacuccuguaggcuucuguaggcacugcaugcaugcgguacacgagacaugcauccuggcaaaacacucagauggaaaagaaaaauaaaguuggggaaaauaagucaaaguggggaauaauaagaaccaagcaaucaucaacuccaugccugucuuuaacugacugagacgcagcucauacagcauuggaaggugagccagucaguggggcuggggacggucaguguccugcauagcgacuugugccuccgugccuccuuccauuuagucucugucuccucaaaugaaauucuauaccauuccccauccuugucgcuuucauagcuaucugcauuuuaccucugaaaauuaauauacucugacuacuucauguaaauggaacauauaguauguuaccguuuaugacuggcuuagcaaaauguuuucaaaguucauucuaauugcagugugugcgagucaguacuuaauuccuuuuuuauggaagguuauuuuuuucacucaauggauagaccacguuuuguucauuuaucaauggacauuucauuucuccucuuauuuuucuguugagaauaguacuaauauaaaucuauccaaauauuuccuggagugccuuuuuguaacuguucuagcuaggcaucuaggauagauugcugguuauaugguaaccgucugucugauuucugauuagccaaggaccugucucccuuaugauacugaagcacauguaaaacagaaggugugaaacgucacgucugccugcccauuagugacugaccuuagaugaguaggagagagggagagugcaggaauuuaaugugugcauucuuuacugcucaccaguuaaaauaaguaaaaaggacuuuuagagacaggagaggaaaagguaaagagcaagauucaaagcacauagaagcacaauauaagauuuuuccuacagcagucaagagaagugcaugucauucuaaacuuuaguuacagaauuccauuuguguacauauacacaguggaucgcacguuugaggcuguguagcaaguuauuaucucaaaaagugcuuccacagcuccuuuaaacugcuagccacuaaaaauaggucugggccuggagagcuggcucaguaguuaggagcacuggcugaucuuccagaggacccagguucauuucaacaaaguguguguguauguauguauggauauguguguguguucuucaguuugagaguagcuuaaacgccuuguaaaaauuucaagauuuuuuuuuuuuuaaagaaaaucuauuuucaucuuuaccuccuuucuaaggaacauuaaaucaggugugguagugcaugccuuuaaucccagcacugggcgaguucaaggccaguuuugucuacaucguuauaggcggccagagcuauauuaagacccuaacuaaaaacaaaaguucauugcaguuacuuagggauuuuuuuuuauuuuucauucauguguaugagcucuuuuguucgaauguaggucuguguuucaugugcauaccugauauucccggguuagaggaggauaucaaagccccuggaauuggaguuacagaugguugugagcuuccauguggaugcugggaacugaagaguccucugcaagagcagccagugcucuuaaccaccgagccaucuccccaguccugguuacaguuauuuaaaacuccuuccucaguaagcgccucaccguccaaaccaucauaggcuuuuuuuccuucugauuuuuagucucugcccagguacaugacacagugcuuuaaacccuguugcagcuguagcuggugguacuucauccccuuggcuucccaagggaagcagaugcccaucucaguaugguggcuuggccuuuuuuguccugagcucagcccuucgaaugacuccuuauguauggucuaaagaagaggucuccagugaggcuucagcagcuaacacagcucugcugucgacucagcagccugauucgcuuuggcugucugagugagguacuaccgcgaaacagcaguuuugcuuuccaaagucucuucucgguucuugagugaguuucauuucaggggucugcugcagauuagggcaagcaagaaugaaagacuaagaguguguuagaagaucuuaaaaaagacaggggugguagauuuucucuugccuucaaaguugguggcaacauuuaaaacuuuauuagcaauaaagcaauaaagcuaagaaggaggaauucucuccuuauaacaggccaaccuuaguaaauucuuccaugugcuguagcuaagaaacgacuuuccucuugcagaucgaggagacuggcagagggaaagaaaguucaacuaugguggugguaacagcgcccccugggggggcgaccggcaccaucaguaugagcagcauugguauaaggaccaccacuauggugaccggaggcauauggaugcccaccguucugggagcuaccgcccuaacaacauguccagaaagaggccguaugagcaguacaacagcgaccgagaccaccggggacacagagacuauuaugacagguguguagaaaggugugagaggugaggcacugacuuguucaugagaagaaggauggugaugccuaugcaggccuguccaucugaugcauccugggcuucucccaugugucaguuacagaucccuugucccugcuguggggacagccugaggaugcaggagaggaggaugcauugucggauguauuucugacuugauguguaugaguguuuugccuacacguggguauguaaaccauaugugugccugguaccucgggggucagaagaguguaucggaucucuggaccuggaguacagaagauugugagcugccauguugccguugggagcugaccccagguccucugcaagggcagcaggugcucuuagcaccugagacgucuccccagcccuguccucuuuuugaaaaguguugcuuuguucuugaagacuuuuauacacgcacagaucaugugcuuuugguaauuucaccccauugccccuccucccucucuggaccggugcaguuucccucccaacaggcuuccuuccuccuuccaugucuuugcuugugacccagugagcuuucuugugcuugcugcaugaguuggggugggguguuauuuauggcacaggcaacuuaggaguaucucacacauugcuagacgaaaggacacugcucuccuggcacucuuuugugguuuuauuauauuuucaagucagcauauaauguguuccauaucacuauggcauuuuugaacaaaguuguuucuccucccccaucucucccacccuccuacuguccugauuuccccuugugacucccugccagauucuuuuccucuuucaugucccauguguccuggaagucccaugccaccguacuuucuucucacauaauauaucuccucuugguuuacuuucuagauucauagaauuuuccuguucuuaaaccugacuacauguguacauuacggggcagcauccacauauaaaggagaauucugaguuugagucaccuuguguaccuuccccauccauuucccugcaaauaucagagaggcguaggaucucugcaacucaguagccagccagccuaaccuaaucguuaagcuacaggucucagugagagauguugucucaaaaaaacaagguuagagcaaugagauguuuagcugguaaaggugcuugcagccacgccugaugagcugaggucagucugccuguggaugguggcauaugugugcacacaguggaugguggcauaugugcacagaguggaugguggcauaugugcacacaguggaugguggcauauguguacacaguggaugguggcauaugugcacacacacaugugcacacagaguuaauagaugaauaaauuaguaugaugcuuuucuuuaaaagcugagugguacuugagguauguuagcugaggcugacuucuggccuccacauucacguaccucacacaccugaauguguguccacacaucaccuaugagugaauacacacaauacagacucaaugguaguaguucauaacauggcacaugaggugggcaccagucugugguccuugcccacccggauccaauaauuuaagucagccuuuugaaauucuauuucucuacagcugugcagugccauuagugaagugacaagccaguuucacacugugaguuggcaagugugagagacuucacuuaacaucuggcuguugacugaacuucuuggcaccugugggcuucccugggcagauguuaugcuuugugcuuauagacugcucugugaauuuaaaguggggcaauaguuacacagcguuuuugucuccugcuguuguuuugggagaucuaccauuuagaugcguagcugucgccugcauuagccaccucaugagggagccugcaugcucucugccuccugcuuucccaucaucuccucaggcuucucugugcaggucugcauuucugccuggucuguccuuuuguccuuguguucacugaggcugcacugugaggagguguuuauuuugacggguauuuuugcuggauguaaaguuuucaguaaccaguuucaguacugugagaugcuccuccauugucugcuuuaugccuucugacaaaaacgccugucuucucccuuuuccucuuuacggacaguuacuguugaaugccugguucuguccccuaucauaggcugugcuaucugccugccugccugccugccugccugccugccugccggccugcgcucccugccuccuucccuuguaauggaguacagagauuaaccccgggcuugagugcaugaagcaggugcuuucugcucagcacauugaagcccugacucacuuuucuuugcauuucuuuuacucaggaaucacccagcucuuuggauauguaggguuauuuuucauaccuauaaauuugaaagauuuucaauauuuuccaaauaauguugccauuuuccauuuccucuggaaauugaaauuguuguuaauguuauccugcuugaagugugguaugcugacuagacuguacuuaucagaauuguuccucaccugcugaugaugucauuugagucaauuucaguuugauuagcuuagcucauuauauuucauaucuccugauacuuuccaugccuaguaauguauuagauggccuauaaaacaccauugacagcaauauacuccuaugugcaugggugucacacacacacacacacacacacacacacacacacacacugcucuauguguccuggcauuguuuauuuguucccugugauuucuuuggcauauucauccuuuucagauugaaauauucuuucuaguauccucuguugacuuaguggucaggacagguuuucucaaccaauggggcacaucuccuuuggggguugagcaacacuuccacagggucacccaagaaaacacagagauuuacuuuauaauucacaauaguagaaaauaauuaagauucauaaauaguacagaaacaauuuuaugaauggaggucucuacaacgugaggaacuguguuaaaggucagcauuaggaagguugaggaccaccgcuuuagucuguuuucuugugaauuuuuaauuuuauuauuauuuuuuuaaauauuuuuauuagguauuuuccucauuuacauuuccaaugcuaucccaaaagucccccauacccucccacccacuccccuacccacucacucccacuuuuuggcccuggcguuccccuguacuggggcauauaaaguuugcguguccaaugggccucucuuuccagugauggccgacuaggccaucuuuugauacauaugcagcuagagucaagagcuccgggguacugcuuaguucauaauguuccaccuauaggguugcagauaccuuuagcuccuuggguacuuucuccauugggagcccugugauccauccaauagcugacugugagcauccacuucuguguuugcuaggccccggcauagucucacaagagacagcuacaucuggguccuuucagcaaaaucuugcuaaugugugcaauggugucaguguuuggaagcugauuaugggguggauccccagauauggcagucucuagaugguccauccuuuugucacagcuccauacuuugucucuguaacuccuucaauggguguuuuguucccauuucuaagaaggggcacaguguccacacuuuggucuucauucuucuugacuuucaugcguuuagcaaauuguaucuuauaucuuggguauccuaaguuucugggcuaauauccauauuauuauuauuuuuuaaagauuuguuuuuaccuuuauuuauguguagguauuaugucuguuugcaugugaguguaugcacacacgugugcaagugcuccagggccccagaggcucagacccuccugaaagugcaugcgaggagcaaccugugcucuuaaccacugagcaucucucgccccucuccuucaguguuuagagauaguuuugguggguauagugaucuagcugacaggugugaucuuuuaggacuuggaggacaucuuucuaagcuggucugcuauaacgauuucugacaguauaguaauacugaguaauacugaauauuacuauuguuagaguacuauugcagucagggguuuucucauuggccuuucuauacaagcaacuuggauuugcuuucuugcuuucuuuaaguauccuuuauuuuauauuuugaauguuuuaauuauaauauguuauggagauuuuuuuuuuuacuggucuuguuugagauucucuaggucucuuguaucugggugagcaucucuuagguuuggggaguuuucuucuuuggguucacuaaagauauucuugauuccuucacuaugguuuucuccuucaugccaucuuuggaggucagggcuuuaaugguuaucucaaacuucuccuauguucuguucauaguuucuucuacaacguuuucauugaccuuuaucaaguccaguuucucuacucugucuucuauccgacucuguaaacgugauuaguucuguugccaugguuuuccacugaggguuuuaauuggcuuauugagguuuucauuucaaauaucauuucaguuugggcuuccuucaccaaaucaaaguuguuuuguuuguuuaaauuggauugacuuucucauuccauucaucuuugcccuuugaguuguuugcucacagugaaauucucuuaaauuucuuagaaguucuuccaggucauuuugaacaggaaccauugcuauagauuuguguuuuuggagauauguugcuuauuuauuuauuuauuuauuuauuuauuuauuuauuuaugugugugguguguguuguuguuguugcuugacaguugcauauuuagaguugguuuugguugagcuuuguuguugaagucaccuuccuuuaguagaggaguuuacauugcucaggacucacagcuagcuguguugggaguggaacauccugucuuugacugguguuugaugcuauagucccuauuucaagugguuuugcuugucugcuauggcccugguaccuucaguuguggucaggagcuuggaacaaguuuccucugccaguguggaauucuuucgggucuaaaggccagguaggauaauuggagggucccagucaggcagcugguaggacucugggucacauguggugauaggagugucccugauagggaguggccugggagcuaaugaauuuggagagaaagagggccaagacgagguggcagucucagcaagcagcugccugguuugagcuacugggauaguggagucuuuaaguguguagguagccuaccucaugugcuggugggguaagucaguuuguaaaauaauuuuaggcaaccuuagugcugaguaucuagguugauucugggucuugcugcuguuaaugauuuacaaauagguuuuuaaaaaauauacaucuuuuccuccugagcauggaaauauaaaaauauuuauaguuguguucuccugaagggagaguugagcuuacugcaguuuuacugugucugucaucauaggaugccuuuuaccaauaugugugaaacagcugacuaacuacugaucuugugucuaugugugugcuuuagcuuccuggugacauaagcauuagucucuggaucucuguguaugugagggaauggaagcagaagauagagcaagcauuaggaaucuagcuuuguuuuucagcugaucuuugcaucucucuuucaggcaccaucaugacuccaagcggaggaggucagaugacuucaggccccagaauuaucaccagcaggauuuccgacgaaugucugaccacagacccaccauggguuaccacggccagggacccucagaccauuaucgcucuuuccacacagacaaguugggggaauauaagcagcccaugccuucauugcacacugcgcucucagacccacgcucacccccuucccagaaaucuccccaugauuccaaaucacccuuggaucauaggucuccuuuggagagaucacuagaacagaaaaacaacccagauuauaacuggaauguucggaaaacauaaaggaccacuccugaagacagggagaucgcggaagucaucaagcacuugggcguucugcuc

SEQ ID NO: 3875 - RNA, 16791 nt, Mus musculus
cuuccugcuguuuggcgaguacacagugcaaugcaguaugucugucagcgcugcggcacaaaggaacagccauuuugugacugagcuggacuugcaccaagaugccagggccuccgagaacugcugccugcgccaacuaccgagcugccuuuuauuucaucaucagaguacuuaugggaacguggggaaaaggauguucugauauuagguuuguuuucagcguucuuaaaaauucgauuuuuuaaaaguauuauuaucagcgucauaaaauggcugccacuuaaaacugccugucccaguacacaaacacugcucaugccuuuucuaaucaucccugccuuacaaggcuagcgaaaaacguuaagauuuacccacaccucuggauaccaaaauauggcucaaaggcaagacaauuuuuagauagauauuuaauuuucaauuuagaaaugccaugugcuagaacaugugcauuccuuccccccugguuuccuuccguuccuggauauaacuuaaguguuuggcauacuuuuuauguccaucacuaagacuacuguauuuaaaaauuuacaaauaugaacuguuuaaaauugcauucuuaaaaaguaaaaacuuaucuccaaaaaucgugauauacaaagcacauuagacuucugcauuaacuuuaaaaaaugcaauacacauaaucacuauuuuaaaaguauagugcuuguuucaaaaacaggaaaacuuaaaacuuuugcugaucgcagucucucaaguguauuugaucugaaagcaauuccuuucaaucccugcaguaucaggcugcaaagguggugguuuuaguuguguucccuaaacacuauuuuuucaaaaauuaauucucuacagugucaaccuacuggaugacacaggaacaccuagcuacacaagggcaacauaaauuucaacuccggagaaauaucaucacacaaaacacaaacauucuuuaaacuuuacaaucuuuaaaggaagugaugucauaacuguauacaugcauuaauaauguauauaacuuaagaguaacaguaauuuaaaaguaacuccaucuucaacaagucuggaguauucuggacauucaucaaauauaugauuuaaaguauacuuggcaaaaacaguaaaaaccugcuucuuguuuugacuaaaggaauuaaaugcaucacaaugcccaaguuauuacccaaauaauacuaaguuuauucaaagacaucacuucaagaguuagagcagucugaucaaugaaacaaaaaaccuugcauaagaaagccaaaacccuggugagaauaugcaaaucauauacucaaggggguaacaagucuaacucugggucuuuccugacugucaaaugcauugaagcuuccuaugccuucacacuguggcuuuccagagaauucgucuugcauuagaagcuuucuguccuugacccaguaaugacaaaagcaacuuaaaagagauccaaaauuguaacuacucaauuuguauagaaauuuggaaauguauuuuuuaacgcaaggcucaaaauauuuuuaguaaagaguaaacucaucaauuuguaaaaaacuauauuccacacuucaaaauuuaaaagcuaauuuaaacaagaauuuuauguaaaauuauaaaguaaaaucaaaauuggaucauauaccaaucacauucuuguuagcugcaugauuuuaaaacuaugacaugacaauucuuaagaacacauccagaaaugcauucacauuuuuaaauuaacauaaagauacagucauacaacaaaaaauaucuuauaugcuuuauuacuucagccacugauaagcuacuucaaagaaugaaggagaaaucaugauuuaaacaaacagcacauuaaaaagcuucagaagagaaagcauuacaggacacugucaaaauaaauggauacauuuaaagcagcaccaacuaaaacauaaggauaaaauaaaauacaauuauuaucaaccagaaagaacugucuuaauauacacaaacauaaaccuuguaauauuuuaagcauaaaaaauacaauuacauugccauaguaacaaacacaaagcuuaaguauuaauagcauuccaaaauuuuugugguuacagauuuaaugaucucaggaacuauuuauuaagguuuugauaagucauaaaaaaaauuuuaauugucacguguaucaaaagaaacaaucaaaaauauaaacugaaaggcaucagucaagggguccuauuugugauuguguuuuuaaauguacauuuuuucauucauauaacuuucucaaaugucuauuuacuauaauuuacuacuaccaggcugcucuauggcccucgguuacaaguuugaauaucccagauucuucaaagaaaaaaauuugccuuguauguaaaauggugcaaugcagcaauggcuaaacagacaaggucauuuuucugcagcaugaaaaccuaaaaccugaaaauuuacugacagaaaaacuacaguuucuaggaaaggccccuccggagaaaaguacauuaccuucugaaugcuguaagaggccuuaagucacaacucaacuuucauaaauugauaccaaaaaaucaggguguggcauguuagcaaucucaaggucacgcuuuaaaaaccaacccaaguuagaaaauucuugaaauacagacagcaauccaugucugucaaaguaaacaaguguaagcugagguuucccgaaaaaaaaaaaaaaagaaagaaagaaagaaaguugauagcucauaccucgaugcauugcuguguagcgaacuguccuccucuuggcuuuuguccuuauuucucaucaucuuuuaauucuuaaauauuaagggggagggggaaucuguguuugcuuugaaguccugugcccagguauuuacugucaaaaguugaaagaaaggugaggucccagcuucugcggaugguuuuauuaucaggaacaaaguccugacgauguuagcgauauucauguaaugcaacaacgauaaacaccagaaaaacaaaauauuucuauuuuuccguuuuaaaaugagagggggauaaacugaacgacagaagcaucacuaucaauaaggaaaguuucucaaaaguaacacacuggauacaaauaacaaucucucuaucuuauugcgucauccaggaauuucucauauuuacaguaaauaaagccaaguucaacauuaauuuuuuuaaaauuaucacugauuaucauggacuuaccugauccauguaguagguccaaagcaagaguccuaucuaguaguagaaaaauauccgauccaaaauaauuuuuaaaaacgcaaaauucuccguuaaaaaacaaaaaguaaaugaaauaauccucaaauauguugacuugucaaaaaauaaagcaauaauuaauacuaaaacagguccggaaggggaaaaaaaaaccucauuaggagagcgcacaaaaauggaggugcgccauggcuucuaagcuggaaaaaacaacgaccugggcucucaauacggcagcuucuuccaacaaggcacgaaaagaaagcuccuaaaagcagcuuuucucccaaaaaaagguucggaucgaccccaguaagucacuagaagaggcagggggcugcgggggcccccugaggcugcccgaaaguuagggaaaguugcguaaagugaaccgaagcagggagcaaagcgcgcucucucuaaggcacagccgccaucuagagccuccuucccagcucugagagcucugccuuugauugacacucucuacauuuaccccacaacucaggugauguaccauagacccaccccuucaucuccaccaaaaaaaaaaaaaaaagaaagaaagaaagaaaaagaaccagauucuccauccaagagagccagaagacccccaacuccacaccucccugccccuccagaccacuccaucagagggagggggaagggcuucuuaacccccucuggcucaagcacccuuuuuaagccagagagaaauguaauuuguuccuuuugucuaaagaucugcuaaauauuucaguccuugagcuaaaauaacuuccucccuggacaggaaguggaguuuuaucaagccauuuugaaauaaagauaauuucaagagacucuaaagcucaguuuaagaacuaaucuuuaaaauaauuaacaccccaccauggguaaaauggcuuguaaauagaagcaacauuucaacaccauaaauuaaaucaacucuugccuucuuuauggugccuaaaaacaucuaaagauuaagggggaauuuuccaccucaacuggaaggaagggguaauuuuuuacaacucaagagcgccucccuaguguucaacugcaguagagcaaaaguuaauacaaccauuuucccccccagaagaaacaaacuucuuuguaaaccauuaaucuuggaagugccacacaucaaacauauuuacuucuuacauauauuugggcauaauuaauaacuucgaauucaagaaauuacaccaaccuuggucaccuuuaaaucaaacacucaaccucaacuccaaaaucaaaagaacccuuucacucauguuugaaaucgaauucuaaguacacucacauuucaucaaucaccgccacuuaaauaggccacaucuaccagccaauuaucaacugucaaagacaaacccccuccagauggaagcacgaggucuauagaaacaaaauuacaaaugcaacaaaguauucucucccaugcacacaaguaaccaaccacauacaaaugccgaaaaaacuaaaaacauuccuuuacugaacccuacuggucaaaaccaugacacuccagcaaacgaauucauuuuaguuucacuaccaaacguaauuauguuaaaucuaagaaaauguaaaaaaucaguuucaagucuacaaacauauuuccaucaaaauccaaaaacucaaguuuucaauuuacaaauaucaaccaccucacaucauccaaagaacaaacacugcaucuguauuaaccacagauguguauucuaagguaguuuacauuaauaacagacuauuucauucuuuguucuauauacugagaaaaacaccaccaaucgucauuuggucaacaaaguccccaucacugcuuuaucaaauuuauuaccaaaguagcaaucaaugaaaaucuggcauuugauuucaaccauggguaaccaaucuaaagcaugguauaauucauuuaaacucccaacugcacaaaacaagaaaaacaagaauuuuuuucaaauguaaauaaauuacacugucauauuagguaagcccuuuaauguauacccaaagacuuuaaaaauacaccucuaauauaagacaauacaauacaaauuaguauaacucaaauauucagaugagcauuucacauggcaaaggacgacuuucaucaacaaaaauugaaagacacugagacugucuuggacuauacaggaaaugagaccagcacuuuguuuuauauuauauauucacuauaaucuccugacacauucaaaguuaccauuacccaaugauuaaaaugcaagauauuuugaaaugacccaaacucaaaggaauuuauucaaacccuauaauaaaaagccagccaaacuggguguauauagcuuuaaucccagcacucaggaggcagaggcaggaagaucacugcaaauuccaggccuggcuggucuacagacagaguugcaggacagccaaggauacacagagaaacccuguccugaaaaaauaaaaaauaaauaaaaauaauuuuuuuuuuaaauagaagaaagggggaagggggagagagaauauaucuauuuuaaccaaaggaccauuccacuuaaucacgggaaaaauccagguuuucuaauacacauaaaucccaaacaaacaaaaccauuccauuuuaccagcuuuauuuaguauacuuuaaugaaaagcagcagcuauaaaggucaaaauguuaucaagguaaaaugaacauuuaaugaaaacguccacugaaaaaauuuauaaaaggcccaaacugagaaauuuuuaaguuuuagagauuuuauuaaaguuaacauuccauaaggucacuucagaucaaacugcaagaaauuccaggaauacaaacuaccauuuguagaauuguagagucuucuccagaugucaaaaauguacaugacauguaacaagucuuuaggaaguaaauuccacuguccauuuguguuggguaagaaucauucauuucauggaauccacauuaaaagaauccuguguugguuguauaauauuacagcauucuugcauuaauccauuuuccucaauuccccauaaugggcugccaucuugauuucucagugguaaaguccauuucaaacucuucaagcggggugcuucauaaaaaauuagaagaaaaaaauucuguuggaguaacagucaucuuauucaaacagaaaauucuauccacuuugaagauauucucuaccauacacaagucuuuaaugaaacagcacuauuguaacaaccucucaaagacagaaucaaugaauucacauauuuuaaguucuccugucacagauacauuuguauccauuaaaaauaguuaacagccaagggucaaauucuuaagaacuuaacaugaguaucauagugcauauaugaaaaguaaaaccaaauauuaaaauucaagaauggugggagacuaaauuacaaccacauguggacaauuucaaugcaaaaaguuuccaagcucuuucaaagaaaacuaauuauauaaucuuagauuuuuaaaaaaagcaauagcuaacugcauggcauacuuuaacagucuuauagauauuaauuuuacuuagaagcaccuuuauagcuucauaucugaaaguggagugaauguaagucacaugaaaaaaaucagaaacauuucagcuuggcuuacuuggaauuugccacaaaaaugcuaucucuucucaaaucauaaacaacuaaauuucacuucaaaaacaucauuauguuccuccuggaaaaauuaaucuauugcuuaacaguuuagacugaaggaaggaaaagaugagaauccaggggauuuuacuccuugucuccggaggaucauacucacacaaaacuugaaaaacauuuuuuacaauuuucauguuauguugaguccauguguauguauguaccugucuguguaguggggggugcacuuguauguggggcaagaacauguguagaccugaggauaauacugcugcugagaaugaaaaucaucauaaccguaauuguugaagcaagacaccucggucauacccagagcucaucaguuuggcuuaucuagauaaccaguuuccucugggacccaucuccaccuggaauuacaggccggugguaucugggcauuuacuugcauuuugggggacacaaauucucaagcaagagcuuaaugcuuaaaugcugagccaucuccugagcuggaaaagacauuuuaauuuuaauuucuggucuuucauauacauucuacaacuuuccaacucaacuuguagagcuagucagugauuacaguaauaaaacaauaugaaaauguuacuucuuggcuaauuuucugucuuccuaacuaaaauuaagguguguucuucaauacacacauuguaaaacaauaccaaaaaaaaaaaaacuagacaaucaaaagacaguggugccuccuauuaaaaaacaauucuuuaaaggaguaaggagugucacagcaucaguuaagaauccauacaucaagauauucucuaguagauuuuaaaaauuucucaaauccuacaaaaugaaauauaacuccuuguauguguguaucaaugaacuaccauuugccuuguucuuuccuuaaaauuaaguaauggcuauacaauuuacuucuaaaacaauuuuuuaaaggagggggaugagaaaagcauaguaucuuucagaaggaagaguaguauacucauagcgugcauaaauuucuggacuugagccccagaaccacauaaaacugggcaugguggcagcccuugucuguaaucucagucugggagaugaaggaccaaacauucaaggucauucuuggauaggugggacuaaccucaaaaaaaaaaaaaaaaaaaaaagaaagaaagaaaagaaaaaagaaaaggccagauacgguggcuuccacaugagaucccagcacucaggagaagcugaaggaagaggauugugccgaguuuaaagcuggaguaggacacagucucauaaauaacaaaaacuaaugauauuaucauuagaaaccuacucaaaaucugcacucccauagcagucaugucgucaaguguuguaauuuaaaacuaugagagaaaaccgacaacuuuuacauuauaaauccaugaucaaaaugcacucaugcaaagccuaagacccaaagccaaaaguaagaauguuguuagaagcaaauaaguaugaaagcuaauaaaaagaucuuuuaaaaauuacuaggaaguaagucauuugcacucaugaaauuucaaauacaacaaaaauuguauuuacaaguauaaguuucacuugaagaaggaaucaaacaugagcacuugaaacaugcaaauguuaacaaaaugcacagcucaguggauaccaacaaagagccuaaugacuaccucuugugacacuacugagguuagaugagcuggcacacaacaggagaugaagugcaaaguauuccacugcaucacaguaauccaagcauaaggaccucaaacucaagaguuagaacacuuucuauuccaacagcaacagcaucgcugagaacacaggucacggagucacuuauuuaggaacaguucugccucuaguguuauagugggggagggggauguucacuaggaauggauauagauaaguacaucucuuucuacauuaacgugugaccgcgcacacacacugcacaggcguuccugugcucuaguauucucugcuuacucagacagaucaagaaccugucaccugauuaagauucaaacuuaguaugauuagaaugcuauuuuguaauuuucuaguuuguacuucuaaguacauauauuuauucuaagaccaacuuucuguucaaaucuuaaguuuuuaugucaccaagauaguuaauaaauuaucucuggaaauccagucacuagacucauucauaacuuaggaacagaaaauugauuaugacuaucuucaaauagguuagacguuauuaacuaaagcgcaggccacugacucuugaggaguguaagcaggcucucggaauaaaacaccucuuucccucuaucucaagcagcuuuacaucuaagauaaagaacagccucagucagggacuaaggauggccuugaacaucugcuuccugcccacccaagagcuacaauuauaggucugugccaccacguucagcuuaucuuuaccaguuuuaacagcaaagaaaaauauagggaacaaagaaaguuaaaaagaaauuaaugcuuccuaauuuuuuuaaauaaauggcuguaaggguacuacuauuaaugaaauuuauuuuucagaaguuaaaugcuuguuuuacaacuaaagauuaacauaaaauguucaguuaguacaaaaauaccauccuuucugucauguaauuguauauuuaacacuuaugacuuaguucugucuuuugcuuuugucuugaaauuuuaauacauuauaaaagaaacccugacaccuauuuggucuaaugcuaaaauagauugaaugcucaacagacuauauuaacaagucuggaccuuaaaguaacaguaaaauuauuacagaaagacuagcuaauguucaucaaugaagggauaaggucaauuacugauaaaaguaaacuuuccugaguuuacaaucuaaucuaauuacaaaccaaguuuaaaagaccaaguuaggggagguacauagauuacuucuaauuuuuauuaugaccaaauuuagcuuucaaacacagcuauaauauuuuacauuaaaaacauauuuuaauaauuuuauuuugccuuucauuauucucaaagcacuaguuaauaauguuuaauaaaagcuaaauuaacacaacaaaccaacaaauauuuacggaguagcuagugccaggcaucuauggucuuaacuguaaccacacagggaacuagacaccuguaguagacaaauuuggggucuccuuccucacucucccucaggaaacacacaaaccuugcuucguaggccauugauagccagccagugcagucucaguggcaauaacuggaaaggggagagggggauccugcagaaucuggauucccaagugucuuuauugcuaugaagcagcuauagacaauuaucuuaaguuuguugccaaugaacaaauaaauccuuuuggcaauucacccaaaaugauuuauaacaaccuucccauuuuacucuuucccacuacuugucuaguuuggaauuuaaaaauaaaacaaaacaaaacuauuucacagaggugguaauauuaucuuucaaagagcaauuucuaugucaauaaggcuaaacuuucagucuugaaguuuuaaguucaguuaauuuaucagaacuaauuacaauuagaaauuaauuagaauuaauuucuauuaucuagaaagaaccaaaguagcaaguucagacucuaggaccauggccuguuuucagugaauguucuaagcuguguauccauuucaguacaaguacucucagcccugaaacugcaaugagaaagcacaacagaaucuaaacaauacagguaaaugcgcaaucaaucaaucaauaaacccagggcacuagaaacaaguccaaaugggaguuuuuggucuuuuauuuucugaccccauuugugguggacauaugccuuuaaucucagcacuccgaaaccagagccagguagguaaaucucugaauuccaggcuggccugaucugaguucuugguuggcccauaguuagacccugucucaaauagaagggugaauggguggguggauagguggguaaauauguuucaauaucuaaacaaagggagaaaggcaacaugugauuaauaaacuuuacauaucuaggcuggacauggugccacugucuuuaauccaagaucucaggaggcagaggcaggcaaaucucuuuugaguucaaagccagccugaucuauauuaagaauuucaagaccuucaaguauaguguuugaaacucugucuuaagaaauacuucacgggcuggcgagguggcucaguggguaagagcacccgacugcucuuccaaagguccagaguucaaaucccagcaaccacaugguggcucacaaccauccguaacgagaucugacucccucuucuggagugucugaagacagcuacaguguacuuacauauaauaaauaaauaaaucuuuaaaauuaggaaugauaaaccuuuaaaaaaaaagaaauaaacuucacauuuaauuauuaugaauaauuauguuuaaaauaucuacucuuaaaacacuguuuacagguuugauaaagcuaugcacuuacaauuccaagucaguaacuuaaaauuccuaguuacacauaaaauuaaaaaauaaacccaacaaguaaagacuuacuaaaugcuucgaugucuauggugcaggccuuucauuccaucugaggauucacauuucugcaaaaaccagaauagauuguauuaacuccuaugacuuacaguacaacuucaauaccuuccaaacuacuccaagcaaaagacaggaaaauugugacaagaccuuaaauuuuugccgaugccagagcugaacucuagaacaaguuacuaaaauuaaaagccuagacaucauucauucaccaagaacuccauaugaguaauaacugagcuccugccuuaacuugacuggcuaugcgauguugaaaacaagugaacaccacauuaauccauacacuggucucccaucugauacauuucuaaaacccuaccaucugcaagauccuucucccuauuacuacuauauucaguauccaucauaugcuagcagcagcauaguauaaucccauauauaaucaaucuuuggguuuuuuuucuuuuuuuuuuugguuuuuugagacaggguuucucuguguagcccuggcugucuuggaacucacucuguagaccaggcuggccucgaacucagaaaucugccugccucugccuccugagugcugggauuaaaggcauauaccaccacacccggcuuuaagauuucuuuuuaauacuugugugugugugugugugugugugugugugugugugugugugugugugugugugugugcgcgcgcgcgcgcggcgugcacaaguucagaagacagcacuggcuauucuggaucuagaguuacaggaguaugagugucaagaaccgcacuagguccuuccaauauacaggaucuuaaaugcugagccaucgcuccaagacuaacacuaauaaaaauauacacuuaucuaugcaauuucgggaguuuucacuaauuucugacuuaaguuccucaaaacuaaaugagaaaugcuucccauuucaaguacuuucugagacauggaugaguuuuccauuuaccuugguuuuguauaauuacaauaaucgcaaaauaggaaagggcuguggugguggacaccuuucaucccagaucacaggaagcagaggcaggcagaucucugaguuugaggcuagccuggucuaaaaagugaaucccaggacauccugggcuauacagacagaccuucuccccacaaaaagggggggggggugaggagggaaauaaagcuaggugguauaauuaggugguauauaacacuuaacauaugugacgccccgaauuuaaaacaacaacagcaaaauaaaacuguuuugaaaauuucaugugagaguucaaaaucagcuuggguuaccuacaugagaccaugugaaagaaaaagguuaaaaacuuaaaaguuuuaagauuuuaagauaucaaucaaacuaacuucuuaagaauuguuugcuaagaaauguaaaugaaauaaauaccuaauuuuaaaaaaagcaucauuuguaaguauaaaaagcaauuuccuguuuauguggcaaaucuaaauuuauuuuuuuaaaucauaaacaagaaauauagcaagaucuguuuaaaaauuaccauuaaaguagguucuaaaauaucuuccuaauaagaaacaauggaaagcaaugaucuuaaaauuuuuaaaccuugaaaauuuuaaaguuaaguguaaucugaccuuaauaggaagauuuuguuaaccacagaaggaaacuaaauugacuuaggggaagggauaccagucuucuaugacagaguguuuccuuaguaucuaugagguccuugauucaaaauuaaagaaacugauugagaaucauuuauaagaguagaaaauguuuaagaaaucuugguaaaagggauucucuaagagaaaccccucacagugguuugauaaugugauuaugagucagucacccuaccagcccaaaaaauuuagguucuaaaaccaccaaaaagucuuuugaucucaccaugcaucacaaugacauuaaugacauuggugacauccaucacagguccuccuuuccuaaagcaccagagcccacuuaguucaguuuaaguagacuaaaucugauuuuccucaaacuccuacccaucucauauacuauaacauguauucugugauguaaaaauaaacuuuagggaauauaaaugagcauaugaugcuggcucuuuggcaguaaaagucaagaacuuuuguugguucuuaaaucccuuaaacuuuuaaacucuaauaugaaaauuuaacaacacugaauaagaaaauguuuacaaagauagguuagugauagucaucugcaaggcauaaauaaaggugcaacuauguuaauccaagccauuucugagacaagcuuuucauggucauccuugugcagccugagcagucccagauaaacagacauuucuuacagagaauuucuuuaaaauaaaucauuaagguaggcaugaugguugacagcuauaauuccacaacucaggaccaaggacacuaucucuaaaaagaaaaaggagagaaaaaaaaaaaaaaaaaaccacaaagauucuauuuuaaaaccuccuugaugaucugaauuaaaagcacuaugguuacgguuacauuaaccacuuaauucuuggggcugaagggaugacucagugguuaaagcacuuacgcccucgcaguuauacgggugugguucucagugcccaaugguggcucacaaccauccuucuuuaacuccacuuccaaagaauccaaccaccucuccugaacucugaauguucuaggcucacaugguagugcaaauacauacauguaggcagaauacucauucccguaaaauuuuuuaaaucuuaaaaacaauuauuucauucauguuuagaaauacaucuuuaaauuauuaaaauggggccugugagacugugcaauauguaaagggacuucccaacaugccugaaaacguaaguaagucuaucuccuaaaacaauccacaagauuccuacucaacuucucugaccuucaaauuugaauuugcaagcacacacacauacaaacaaaugaaauuaaagcuuaagguaaaaacuguuucaugacgcacaguccuagggaacaucauuagauaauguauaaauccuaucaucagaaacacaguuuguaaaaaccaggucaccuaccuuaaaaaauuccuaauagucuuaaauuuaggguaacaaacacgauggcuagcaucuguaaucccagcacuuuuugaggauaaugcagaauuacuaccuuaaacugaagcccagccuaugcuacacaguaaaauccuguuucaaaaagucaaaaguaugcuaccaacacugcuuuaaugccaauccugauaacccauaggugggggcaggacaauuccuaaaggcugguccugaccuccauuuauuuucacacaaguacauaaauguaauuuuuuaggauggaaagcgaggcugagaugacagugacaguauuuuucuaccaugugcaaaggcugaguucaaucuccaauaccacaaaauaauaaaaaaugcagaaacaaguuuuuaaaaaaauuuuuuaagucgauuacaucaagaauagccaauuugaaaauaacaucacauccaacuuagaacuucaugaaaugauuuuaucugugaaaugcagaaauauauuuacuuaaaauaauuaugucuauuaaaagcaauaaaguauguaagguauacagacuacaaaucuuuaaaccucucaucaucuuuaaagcagugaaagcauuacauuagauugcaggcagcgcccgugacugcuuagucaucacauacaccugauguaacaauacaaauguaagagaaaaaaacauaauuuuuuaacucaaaaacagccuaaauuucuaaauacucaagaaacuaugaucagaaacugaaaguuaaagaaaauucacauuauaauuaccuauuuuauaugcuaaaaaucuaugucauguuaugauccaaaaacacuggugacuagcugcaacaucuuuggucauguuaauccuuuaaagcuauaaaaacaucaaauauauuccaacauaaacacaacuagaauaaggaaauuuuuaagaauuaaagaaauuguccaaaaugcuaagauaaaaccaaauauuuaagcauucguuacuuuaauccauaaauagaaaauacgugacaaaaacuuaccuugaucauauauaguaaagcauauaccauuguaggccacauaauacuaucuaagauauaucugaugacuaaucucaugacaguaaaccuuuccauuaaauuagcucaaauaauaacuauucacacugaauauagcaguaucauaaagauaauauguuauuuuucaaaaaaacaauuuacucuaaacauuuaucugguuauaaaaacugccucuaaaagacuagaaauuuagcaguuacuacaucucuuauuaaauuaaaaaauuaaaauuauuuaauauuucuaaccuccagcuguuuauuuuucuguccaaauaagaccucagauaaagcauauugccaauuuauacauacguucugauaguaucauaggaaacagaucauucucaauuuuuauaacuguucaacaaauagcaacuacacacucuaucagcugcagaaaggaaacccuagucuuagcacauguuauaggaauauaggauuaaagauccuuuuguauauauucuaucuuugaaagauuauagaauuuaaaaguguaucauuuucuuuuuuauaacacaaaccuaaacugcaaaacaaaauuucacuaagcuaacacaaaggcaauaaaauuagucuauuccccuuauuugacccaaaaguagguaaacacaaguugauuuuccauauauucccaagauauaaguaaauaugcucucucauuuuaauuaacuauucacuugguguuuuuuuuuuaauuucccaaggcaucacuuauaauuucauauuuucuguggccaaucacuuacaaacaauaauugaauauuacuucuggauucaagcuuauaugggcagauuuauuucuuuacauacaugaggagucacauuuucugcauucaccuuaauauucaccuauuaagauaaucauuucaugguaugcugaacccaaaaacuauuucucuuuuagguucaaaaacaccaggacacugacagaagccucuaagagcagugcauuuaguuugguggaaucuauuuauuuuuguaguuguuuaaagaacuacuaaauaugaguauuuuaacu

SEQ ID NO: 3876 - RNA, 16791 nt, Mus musculus
aguuaaaauacucauauuuaguaguucuuuaaacaacuacaaaaauaaauagauuccaccaaacuaaaugcacugcucuuagaggcuucugucaguguccugguguuuuugaaccuaaaagagaaauaguuuuuggguucagcauaccaugaaaugauuaucuuaauaggugaauauuaaggugaaugcagaaaaugugacuccucauguauguaaagaaauaaaucugcccauauaagcuugaauccagaaguaauauucaauuauuguuuguaagugauuggccacagaaaauaugaaauuauaagugaugccuugggaaauuaaaaaaaaaacaccaagugaauaguuaauuaaaaugagagagcauauuuacuuauaucuugggaauauauggaaaaucaacuuguguuuaccuacuuuugggucaaauaaggggaauagacuaauuuuauugccuuuguguuagcuuagugaaauuuuguuuugcaguuuagguuuguguuauaaaaaagaaaaugauacacuuuuaaauucuauaaucuuucaaagauagaauauauacaaaaggaucuuuaauccuauauuccuauaacaugugcuaagacuaggguuuccuuucugcagcugauagaguguguaguugcuauuuguugaacaguuauaaaaauugagaaugaucuguuuccuaugauacuaucagaacguauguauaaauuggcaauaugcuuuaucugaggucuuauuuggacagaaaaauaaacagcuggagguuagaaauauuaaauaauuuuaauuuuuuaauuuaauaagagauguaguaacugcuaaauuucuagucuuuuagaggcaguuuuuauaaccagauaaauguuuagaguaaauuguuuuuuugaaaaauaacauauuaucuuuaugauacugcuauauucagugugaauaguuauuauuugagcuaauuuaauggaaagguuuacugucaugagauuagucaucagauauaucuuagauaguauuauguggccuacaaugguauaugcuuuacuauauaugaucaagguaaguuuuugucacguauuuucuauuuauggauuaaaguaacgaaugcuuaaauauuugguuuuaucuuagcauuuuggacaauuucuuuaauucuuaaaaauuuccuuauucuaguuguguuuauguuggaauauauuugauguuuuuauagcuuuaaaggauuaacaugaccaaagauguugcagcuagucaccaguguuuuuggaucauaacaugacauagauuuuuagcauauaaaauagguaauuauaaugugaauuuucuuuaacuuucaguuucugaucauaguuucuugaguauuuagaaauuuaggcuguuuuugaguuaaaaaauuauguuuuuuucucuuacauuuguauuguuacaucagguguaugugaugacuaagcagucacgggcgcugccugcaaucuaauguaaugcuuucacugcuuuaaagaugaugagagguuuaaagauuuguagucuguauaccuuacauacuuuauugcuuuuaauagacauaauuauuuuaaguaaauauauuucugcauuucacagauaaaaucauuucaugaaguucuaaguuggaugugauguuauuuucaaauuggcuauucuugauguaaucgacuuaaaaaauuuuuuuaaaaacuuguuucugcauuuuuuauuauuuugugguauuggagauugaacucagccuuugcacaugguagaaaaauacugucacugucaucucagccucgcuuuccauccuaaaaaauuacauuuauguacuugugugaaaauaaauggaggucaggaccagccuuuaggaauuguccugcccccaccuauggguuaucaggauuggcauuaaagcaguguugguagcauacuuuugacuuuuugaaacaggauuuuacuguguagcauaggcugggcuucaguuuaagguaguaauucugcauuauccucaaaaagugcugggauuacagaugcuagccaucguguuuguuacccuaaauuuaagacuauuaggaauuuuuuaagguaggugaccugguuuuuacaaacuguguuucugaugauaggauuuauacauuaucuaaugauguucccuaggacugugcgucaugaaacaguuuuuaccuuaagcuuuaauuucauuuguuuguaugugugugugcuugcaaauucaaauuugaaggucagagaaguugaguaggaaucuuguggauuguuuuaggagauagacuuacuuacguuuucaggcauguugggaagucccuuuacauauugcacagucucacaggccccauuuuaauaauuuaaagauguauuucuaaacaugaaugaaauaauuguuuuuaagauuuaaaaaauuuuacgggaaugaguauucugccuacauguauguauuugcacuaccaugugagccuagaacauucagaguucaggagaggugguuggauucuuuggaaguggaguuaaagaaggaugguugugagccaccauugggcacugagaaccacacccguauaacugcgagggcguaagugcuuuaaccacugagucaucccuucagccccaagaauuaagugguuaauguaaccguaaccauagugcuuuuaauucagaucaucaaggagguuuuaaaauagaaucuuugugguuuuuuuuuuuuuuuuuucucuccuuuuucuuuuuagagauaguguccuugguccugaguuguggaauuauagcugucaaccaucaugccuaccuuaaugauuuauuuuaaagaaauucucuguaagaaaugucuguuuaucugggacugcucaggcugcacaaggaugaccaugaaaagcuugucucagaaauggcuuggauuaacauaguugcaccuuuauuuaugccuugcagaugacuaucacuaaccuaucuuuguaaacauuuucuuauucaguguuguuaaauuuucauauuagaguuuaaaaguuuaagggauuuaagaaccaacaaaaguucuugacuuuuacugccaaagagccagcaucauaugcucauuuauauucccuaaaguuuauuuuuacaucacagaauacauguuauaguauaugagauggguaggaguuugaggaaaaucagauuuagucuacuuaaacugaacuaagugggcucuggugcuuuaggaaaggaggaccugugauggaugucaccaaugucauuaaugucauugugaugcauggugagaucaaaagacuuuuuggugguuuuagaaccuaaauuuuuugggcugguagggugacugacucauaaucacauuaucaaaccacugugagggguuucucuuagagaaucccuuuuaccaagauuucuuaaacauuuucuacucuuauaaaugauucucaaucaguuucuuuaauuuugaaucaaggaccucauagauacuaaggaaacacucugucauagaagacugguaucccuuccccuaagucaauuuaguuuccuucugugguuaacaaaaucuuccuauuaaggucagauuacacuuaacuuuaaaauuuucaagguuuaaaaauuuuaagaucauugcuuuccauuguuucuuauuaggaagauauuuuagaaccuacuuuaaugguaauuuuuaaacagaucuugcuauauuucuuguuuaugauuuaaaaaaauaaauuuagauuugccacauaaacaggaaauugcuuuuuauacuuacaaaugaugcuuuuuuuaaaauuagguauuuauuucauuuacauuucuuagcaaacaauucuuaagaaguuaguuugauugauaucuuaaaaucuuaaaacuuuuaaguuuuuaaccuuuuucuuucacauggucucauguagguaacccaagcugauuuugaacucucacaugaaauuuucaaaacaguuuuauuuugcuguuguuguuuuaaauucggggcgucacauauguuaaguguuauauaccaccuaauuauaccaccuagcuuuauuucccuccucacccccccccccuuuuuguggggagaaggucugucuguauagcccaggauguccugggauucacuuuuuagaccaggcuagccucaaacucagagaucugccugccucugcuuccugugaucugggaugaaagguguccaccaccacagcccuuuccuauuuugcgauuauuguaauuauacaaaaccaagguaaauggaaaacucauccaugucucagaaaguacuugaaaugggaagcauuucucauuuaguuuugaggaacuuaagucagaaauuagugaaaacucccgaaauugcauagauaaguguauauuuuuauuaguguuagucuuggagcgauggcucagcauuuaagauccuguauauuggaaggaccuagugcgguucuugacacucauacuccuguaacucuagauccagaauagccagugcugucuucugaacuugugcacgccgcgcgcgcgcgcgcacacacacacacacacacacacacacacacacacacacacacacacacacacacacaaguauuaaaaagaaaucuuaaagccggguguggugguauaugccuuuaaucccagcacucaggaggcagaggcaggcagauuucugaguucgaggccagccuggucuacagagugaguuccaagacagccagggcuacacagagaaacccugucucaaaaaaccaaaaaaaaaaagaaaaaaaacccaaagauugauuauauaugggauuauacuaugcugcugcuagcauaugauggauacugaauauaguaguaauagggagaaggaucuugcagaugguaggguuuuagaaauguaucagaugggagaccaguguauggauuaaugugguguucacuuguuuucaacaucgcauagccagucaaguuaaggcaggagcucaguuauuacucauauggaguucuuggugaaugaaugaugucuaggcuuuuaauuuuaguaacuuguucuagaguucagcucuggcaucggcaaaaauuuaaggucuugucacaauuuuccugucuuuugcuuggaguaguuuggaagguauugaaguuguacuguaagucauaggaguuaauacaaucuauucugguuuuugcagaaaugugaauccucagauggaaugaaaggccugcaccauagacaucgaagcauuuaguaagucuuuacuuguuggguuuauuuuuuaauuuuauguguaacuaggaauuuuaaguuacugacuuggaauuguaagugcauagcuuuaucaaaccuguaaacaguguuuuaagaguagauauuuuaaacauaauuauucauaauaauuaaaugugaaguuuauuucuuuuuuuuuaaagguuuaucauuccuaauuuuaaagauuuauuuauuuauuauauguaaguacacuguagcugucuucagacacuccagaagagggagucagaucucguuacggaugguugugagccaccaugugguugcugggauuugaacucuggaccuuuggaagagcagucgggugcucuuacccacugagccaccucgccagcccgugaaguauuucuuaagacagaguuucaaacacuauacuugaaggucuugaaauucuuaauauagaucaggcuggcuuugaacucaaaagagauuugccugccucugccuccugagaucuuggauuaaagacaguggcaccauguccagccuagauauguaaaguuuauuaaucacauguugccuuucucccuuuguuuagauauugaaacauauuuacccaccuauccacccacccauucacccuucuauuugagacagggucuaacuaugggccaaccaagaacucagaucaggccagccuggaauucagagauuuaccuaccuggcucugguuucggagugcugagauuaaaggcauauguccaccacaaauggggucagaaaauaaaagaccaaaaacucccauuuggacuuguuucuagugcccuggguuuauugauugauugauugcgcauuuaccuguauuguuuagauucuguugugcuuucucauugcaguuucagggcugagaguacuuguacugaaauggauacacagcuuagaacauucacugaaaacaggccaugguccuagagucugaacuugcuacuuugguucuuucuagauaauagaaauuaauucuaauuaauuucuaauuguaauuaguucugauaaauuaacugaacuuaaaacuucaagacugaaaguuuagccuuauugacauagaaauugcucuuugaaagauaauauuaccaccucugugaaauaguuuuguuuuguuuuauuuuuaaauuccaaacuagacaaguagugggaaagaguaaaaugggaagguuguuauaaaucauuuugggugaauugccaaaaggauuuauuuguucauuggcaacaaacuuaagauaauugucuauagcugcuucauagcaauaaagacacuugggaauccagauucugcaggaucccccucuccccuuuccaguuauugccacugagacugcacuggcuggcuaucaauggccuacgaagcaagguuuguguguuuccugagggagagugaggaaggagaccccaaauuugucuacuacaggugucuaguucccugugugguuacaguuaagaccauagaugccuggcacuagcuacuccguaaauauuuguugguuuguuguguuaauuuagcuuuuauuaaacauuauuaacuagugcuuugagaauaaugaaaggcaaaauaaaauuauuaaaauauguuuuuaauguaaaauauuauagcuguguuugaaagcuaaauuuggucauaauaaaaauuagaaguaaucuauguaccuccccuaacuuggucuuuuaaacuugguuuguaauuagauuagauuguaaacucaggaaaguuuacuuuuaucaguaauugaccuuaucccuucauugaugaacauuagcuagucuuucuguaauaauuuuacuguuacuuuaagguccagacuuguuaauauagucuguugagcauucaaucuauuuuagcauuagaccaaauaggugucaggguuucuuuuauaauguauuaaaauuucaagacaaaagcaaaagacagaacuaagucauaaguguuaaauauacaauuacaugacagaaaggaugguauuuuuguacuaacugaacauuuuauguuaaucuuuaguuguaaaacaagcauuuaacuucugaaaaauaaauuucauuaauaguaguacccuuacagccauuuauuuaaaaaaauuaggaagcauuaauuucuuuuuaacuuucuuuguucccuauauuuuucuuugcuguuaaaacugguaaagauaagcugaacgugguggcacagaccuauaauuguagcucuugggugggcaggaagcagauguucaaggccauccuuagucccugacugaggcuguucuuuaucuuagauguaaagcugcuugagauagagggaaagagguguuuuauuccgagagccugcuuacacuccucaagagucaguggccugcgcuuuaguuaauaacgucuaaccuauuugaagauagucauaaucaauuuucuguuccuaaguuaugaaugagucuagugacuggauuuccagagauaauuuauuaacuaucuuggugacauaaaaacuuaagauuugaacagaaaguuggucuuagaauaaauauauguacuuagaaguacaaacuagaaaauuacaaaauagcauucuaaucauacuaaguuugaaucuuaaucaggugacagguucuugaucugucugaguaagcagagaauacuagagcacaggaacgccugugcagugugugugcgcggucacacguuaauguagaaagagauguacuuaucuauauccauuccuagugaacaucccccucccccacuauaacacuagaggcagaacuguuccuaaauaagugacuccgugaccuguguucucagcgaugcuguugcuguuggaauagaaaguguucuaacucuugaguuugagguccuuaugcuuggauuacugugaugcaguggaauacuuugcacuucaucuccuguugugugccagcucaucuaaccucaguagugucacaagagguagucauuaggcucuuuguugguauccacugagcugugcauuuuguuaacauuugcauguuucaagugcucauguuugauuccuucuucaagugaaacuuauacuuguaaauacaauuuuuguuguauuugaaauuucaugagugcaaaugacuuacuuccuaguaauuuuuaaaagaucuuuuuauuagcuuucauacuuauuugcuucuaacaacauucuuacuuuuggcuuugggucuuaggcuuugcaugagugcauuuugaucauggauuuauaauguaaaaguugucgguuuucucucauaguuuuaaauuacaacacuugacgacaugacugcuaugggagugcagauuuugaguagguuucuaaugauaauaucauuaguuuuuguuauuuaugagacuguguccuacuccagcuuuaaacucggcacaauccucuuccuucagcuucuccugagugcugggaucucauguggaagccaccguaucuggccuuuucuuuuuucuuuucuuucuuucuuuuuuuuuuuuuuuuuuuuuugagguuagucccaccuauccaagaaugaccuugaauguuugguccuucaucucccagacugagauuacagacaagggcugccaccaugcccaguuuuaugugguucuggggcucaaguccagaaauuuaugcacgcuaugaguauacuacucuuccuucugaaagauacuaugcuuuucucaucccccuccuuuaaaaaauuguuuuagaaguaaauuguauagccauuacuuaauuuuaaggaaagaacaaggcaaaugguaguucauugauacacacauacaaggaguuauauuucauuuuguaggauuugagaaauuuuuaaaaucuacuagagaauaucuugauguauggauucuuaacugaugcugugacacuccuuacuccuuuaaagaauuguuuuuuaauaggaggcaccacugucuuuugauugucuaguuuuuuuuuuuuugguauuguuuuacaauguguguauugaagaacacaccuuaauuuuaguuaggaagacagaaaauuagccaagaaguaacauuuucauauuguuuuauuacuguaaucacugacuagcucuacaaguugaguuggaaaguuguagaauguauaugaaagaccagaaauuaaaauuaaaaugucuuuuccagcucaggagauggcucagcauuuaagcauuaagcucuugcuugagaauuugugucccccaaaaugcaaguaaaugcccagauaccaccggccuguaauuccagguggagaugggucccagaggaaacugguuaucuagauaagccaaacugaugagcucuggguaugaccgaggugucuugcuucaacaauuacgguuaugaugauuuucauucucagcagcaguauuauccucaggucuacacauguucuugccccacauacaagugcaccccccacuacacagacagguacauacauacacauggacucaacauaacaugaaaauuguaaaaaauguuuuucaaguuuugugugaguaugauccuccggagacaaggaguaaaauccccuggauucucaucuuuuccuuccuucagucuaaacuguuaagcaauagauuaauuuuuccaggaggaacauaaugauguuuuugaagugaaauuuaguuguuuaugauuugagaagagauagcauuuuuguggcaaauuccaaguaagccaagcugaaauguuucugauuuuuuucaugugacuuacauucacuccacuuucagauaugaagcuauaaaggugcuucuaaguaaaauuaauaucuauaagacuguuaaaguaugccaugcaguuagcuauugcuuuuuuuaaaaaucuaagauuauauaauuaguuuucuuugaaagagcuuggaaacuuuuugcauugaaauuguccacaugugguuguaauuuagucucccaccauucuugaauuuuaauauuugguuuuacuuuucauauaugcacuaugauacucauguuaaguucuuaagaauuugacccuuggcuguuaacuauuuuuaauggauacaaauguaucugugacaggagaacuuaaaauaugugaauucauugauucugucuuugagagguuguuacaauagugcuguuucauuaaagacuuguguaugguagagaauaucuucaaaguggauagaauuuucuguuugaauaagaugacuguuacuccaacagaauuuuuuucuucuaauuuuuuaugaagcaccccgcuugaagaguuugaaauggacuuuaccacugagaaaucaagauggcagcccauuauggggaauugaggaaaauggauuaaugcaagaaugcuguaauauuauacaaccaacacaggauucuuuuaauguggauuccaugaaaugaaugauucuuacccaacacaaauggacaguggaauuuacuuccuaaagacuuguuacaugucauguacauuuuugacaucuggagaagacucuacaauucuacaaaugguaguuuguauuccuggaauuucuugcaguuugaucugaagugaccuuauggaauguuaacuuuaauaaaaucucuaaaacuuaaaaauuucucaguuugggccuuuuauaaauuuuuucaguggacguuuucauuaaauguucauuuuaccuugauaacauuuugaccuuuauagcugcugcuuuucauuaaaguauacuaaauaaagcugguaaaauggaaugguuuuguuuguuugggauuuauguguauuagaaaaccuggauuuuucccgugauuaaguggaaugguccuuugguuaaaauagauauauucucucucccccuucccccuuucuucuauuuaaaaaaaaaauuauuuuuauuuauuuuuuauuuuuucaggacaggguuucucuguguauccuuggcuguccugcaacucugucuguagaccagccaggccuggaauuugcagugaucuuccugccucugccuccugagugcugggauuaaagcuauauacacccaguuuggcuggcuuuuuauuauaggguuugaauaaauuccuuugaguuugggucauuucaaaauaucuugcauuuuaaucauuggguaaugguaacuuugaaugugucaggagauuauagugaauauauaauauaaaacaaagugcuggucucauuuccuguauaguccaagacagucucagugucuuucaauuuuuguugaugaaagucguccuuugccaugugaaaugcucaucugaauauuugaguuauacuaauuuguauuguauugucuuauauuagagguguauuuuuaaagucuuuggguauacauuaaagggcuuaccuaauaugacaguguaauuuauuuacauuugaaaaaaauucuuguuuuucuuguuuugugcaguugggaguuuaaaugaauuauaccaugcuuuagauugguuacccaugguugaaaucaaaugccagauuuucauugauugcuacuuugguaauaaauuugauaaagcagugauggggacuuuguugaccaaaugacgauuggugguguuuuucucaguauauagaacaaagaaugaaauagucuguuauuaauguaaacuaccuuagaauacacaucugugguuaauacagaugcaguguuuguucuuuggaugaugugaggugguugauauuuguaaauugaaaacuugaguuuuuggauuuugauggaaauauguuuguagacuugaaacugauuuuuuacauuuucuuagauuuaacauaauuacguuugguagugaaacuaaaaugaauucguuugcuggagugucaugguuuugaccaguaggguucaguaaaggaauguuuuuaguuuuuucggcauuuguaugugguugguuacuugugugcaugggagagaauacuuuguugcauuuguaauuuuguuucuauagaccucgugcuuccaucuggaggggguuugucuuugacaguugauaauuggcugguagauguggccuauuuaaguggcggugauugaugaaaugugaguguacuuagaauucgauuucaaacaugagugaaaggguucuuuugauuuuggaguugagguugaguguuugauuuaaaggugaccaagguugguguaauuucuugaauucgaaguuauuaauuaugcccaaauauauguaagaaguaaauauguuugauguguggcacuuccaagauuaaugguuuacaaagaaguuuguuucuucugggggggaaaaugguuguauuaacuuuugcucuacugcaguugaacacuagggaggcgcucuugaguuguaaaaaauuaccccuuccuuccaguugagguggaaaauucccccuuaaucuuuagauguuuuuaggcaccauaaagaaggcaagaguugauuuaauuuaugguguugaaauguugcuucuauuuacaagccauuuuacccauggugggguguuaauuauuuuaaagauuaguucuuaaacugagcuuuagagucucuugaaauuaucuuuauuucaaaauggcuugauaaaacuccacuuccuguccagggaggaaguuauuuuagcucaaggacugaaauauuuagcagaucuuuagacaaaaggaacaaauuacauuucucucuggcuuaaaaagggugcuugagccagaggggguuaagaagcccuucccccucccucugauggaguggucuggaggggcagggagguguggaguugggggucuucuggcucucuuggauggagaaucugguucuuuuucuuucuuucuuucuuuuuuuuuuuuuuuugguggagaugaaggggugggucuaugguacaucaccugaguugugggguaaauguagagagugucaaucaaaggcagagcucucagagcugggaaggaggcucuagauggcggcugugccuuagagagagcgcgcuuugcucccugcuucgguucacuuuacgcaacuuucccuaacuuucgggcagccucagggggcccccgcagcccccugccucuucuagugacuuacuggggucgauccgaaccuuuuuuugggagaaaagcugcuuuuaggagcuuucuuuucgugccuuguuggaagaagcugccguauugagagcccaggucguuguuuuuuccagcuuagaagccauggcgcaccuccauuuuugugcgcucuccuaaugagguuuuuuuuuccccuuccggaccuguuuuaguauuaauuauugcuuuauuuuuugacaagucaacauauuugaggauuauuucauuuacuuuuuguuuuuuaacggagaauuuugcguuuuuaaaaauuauuuuggaucggauauuuuucuacuacuagauaggacucuugcuuuggaccuacuacauggaucagguaaguccaugauaaucagugauaauuuuaaaaaaauuaauguugaacuuggcuuuauuuacuguaaauaugagaaauuccuggaugacgcaauaagauagagagauuguuauuuguauccaguguguuacuuuugagaaacuuuccuuauugauagugaugcuucugucguucaguuuaucccccucucauuuuaaaacggaaaaauagaaauauuuuguuuuucugguguuuaucguuguugcauuacaugaauaucgcuaacaucgucaggacuuuguuccugauaauaaaaccauccgcagaagcugggaccucaccuuucuuucaacuuuugacaguaaauaccugggcacaggacuucaaagcaaacacagauucccccucccccuuaauauuuaagaauuaaaagaugaugagaaauaaggacaaaagccaagaggaggacaguucgcuacacagcaaugcaucgagguaugagcuaucaacuuucuuucuuucuuucuuuuuuuuuuuuuuucgggaaaccucagcuuacacuuguuuacuuugacagacauggauugcugucuguauuucaagaauuuucuaacuuggguugguuuuuaaagcgugaccuugagauugcuaacaugccacacccugauuuuuugguaucaauuuaugaaaguugaguugugacuuaaggccucuuacagcauucagaagguaauguacuuuucuccggaggggccuuuccuagaaacuguaguuuuucugucaguaaauuuucagguuuuagguuuucaugcugcagaaaaaugaccuugucuguuuagccauugcugcauugcaccauuuuacauacaaggcaaauuuuuuucuuugaagaaucugggauauucaaacuuguaaccgagggccauagagcagccugguaguaguaaauuauaguaaauagacauuugagaaaguuauaugaaugaaaaaauguacauuuaaaaacacaaucacaaauaggaccccuugacugaugccuuucaguuuauauuuuugauuguuucuuuugauacacgugacaauuaaaauuuuuuuuaugacuuaucaaaaccuuaauaaauaguuccugagaucauuaaaucuguaaccacaaaaauuuuggaaugcuauuaauacuuaagcuuuguguuuguuacuauggcaauguaauuguauuuuuuaugcuuaaaauauuacaagguuuauguuuguguauauuaagacaguucuuucugguugauaauaauuguauuuuauuuuauccuuauguuuuaguuggugcugcuuuaaauguauccauuuauuuugacaguguccuguaaugcuuucucuucugaagcuuuuuaaugugcuguuuguuuaaaucaugauuucuccuucauucuuugaaguagcuuaucaguggcugaaguaauaaagcauauaagauauuuuuuguuguaugacuguaucuuuauguuaauuuaaaaaugugaaugcauuucuggauguguucuuaagaauugucaugucauaguuuuaaaaucaugcagcuaacaagaaugugauugguauaugauccaauuuugauuuuacuuuauaauuuuacauaaaauucuuguuuaaauuagcuuuuaaauuuugaaguguggaauauaguuuuuuacaaauugaugaguuuacucuuuacuaaaaauauuuugagccuugcguuaaaaaauacauuuccaaauuucuauacaaauugaguaguuacaauuuuggaucucuuuuaaguugcuuuugucauuacugggucaaggacagaaagcuucuaaugcaagacgaauucucuggaaagccacagugugaaggcauaggaagcuucaaugcauuugacagucaggaaagacccagaguuagacuuguuacccccuugaguauaugauuugcauauucucaccaggguuuuggcuuucuuaugcaagguuuuuuguuucauugaucagacugcucuaacucuugaagugaugucuuugaauaaacuuaguauuauuuggguaauaacuugggcauugugaugcauuuaauuccuuuagucaaaacaagaagcagguuuuuacuguuuuugccaaguauacuuuaaaucauauauuugaugaauguccagaauacuccagacuuguugaagauggaguuacuuuuaaauuacuguuacucuuaaguuauauacauuauuaaugcauguauacaguuaugacaucacuuccuuuaaagauuguaaaguuuaaagaauguuuguguuuugugugaugauauuucuccggaguugaaauuuauguugcccuuguguagcuagguguuccugugucauccaguagguugacacuguagagaauuaauuuuugaaaaaauaguguuuagggaacacaacuaaaaccaccaccuuugcagccugauacugcagggauugaaaggaauugcuuucagaucaaauacacuugagagacugcgaucagcaaaaguuuuaaguuuuccuguuuuugaaacaagcacuauacuuuuaaaauagugauuauguguauugcauuuuuuaaaguuaaugcagaagucuaaugugcuuuguauaucacgauuuuuggagauaaguuuuuacuuuuuaagaaugcaauuuuaaacaguucauauuuguaaauuuuuaaauacaguagucuuagugauggacauaaaaaguaugccaaacacuuaaguuauauccaggaacggaaggaaaccaggggggaaggaaugcacauguucuagcacauggcauuucuaaauugaaaauuaaauaucuaucuaaaaauugucuugccuuugagccauauuuugguauccagagguguggguaaaucuuaacguuuuucgcuagccuuguaaggcagggaugauuagaaaaggcaugagcaguguuuguguacugggacaggcaguuuuaaguggcagccauuuuaugacgcugauaauaauacuuuuaaaaaaucgaauuuuuaagaacgcugaaaacaaaccuaauaucagaacauccuuuuccccacguucccauaaguacucugaugaugaaauaaaaggcagcucgguaguuggcgcaggcagcaguucucggaggcccuggcaucuuggugcaaguccagcucagucacaaaauggcuguuccuuugugccgcagcgcugacagacauacugcauugcacuguguacucgccaaacagcaggaag

SEQ ID NO: 3877 - RNA, 3004 nt, Mus musculus
ucauuauaugaagaagaaaaccaugauugaaguguuccuucaggccggcagccucuugcgguccucucuggcugccauuuugggauagaugguucuauuuccuuuugugaaaggaacaaagucaaaacuacuggcaaggauacccuuccucuuugggauguauccagugguaaaauaaaguuuuaugauuuccuuaucucuaccucacagaagaauucagagcaccuuagaaguguaccacuguaggcuuccaccaaaaugcacaaaugaagaacugcauuaaaaaaaaaaaugugacaaacagauaccaacguucuuguggcucuuagagcuaugacuagagacauggacucagaaagagaaccgcagccugguguuccaaaguagaagaacaauggugguacgggaaggaaaaacacccauuuuaccccagguucacagacaugaauccugcuaaucauuaccauuuguugugaauucaugagcaauucaaagaguuuaugaacugaguuucuaaagccuuuucaauucuguaugugguuaccaugcucuuggacacucuaacauagauaaugcucuuuugcauccuguuuaaaaucaaauucccaaucuaguuuccccuucucucucuauaacacuggagucugcuucuccuucgaaagaucccucccucccucuccgcuggauccuuucuuagcuucuaacaacugugcuuacuuggauuggaguacacauaucuaaaacuuaaaagcugccauuccacaucuaagagaaaacaugcagugucugucuuuuuugagucuggguuacuucacucaaaucagggaacacaucgucaagauaaaauauuuauuugcugagauuuuuuucaucccgaguauugccuuauccacacaguuacacaaagaucaaaaggauuugugacuguguguggcugauugucacaggcauagcuuuuuuuagagauauauauuucuaagacugaaugcacgaugauuugggggaaagaauuaauacguaauuugaauucaaacgacaagcuuaaaaagaaauauuccgcuuggagaagcauucuuaaauaucucuggggaauacauuucuuuuauuaauccagccagccacuggaugucauucucccaauuuaauuacguuuaucugccaaugggugaugcugcuucuuaugcauguaauuugggucggugcaaauggugauggcaaaucauuguccugagggagauaauugcuguuauaauuauuuacucaugcaaguuaggcaugugugaauuuuaccucggucagaugaucuggaaauacgaaugggagaggccauuucuuaguucuuggacauuuuucuagauguaacaucuaguccuaaguacuuuaaguauguuaucucaugaauccucacaggcuuccuagacuggccauagugaccuugacaucauugauaagggaauaaagauucaagccuaggccuacaggcuacauguacaaaugaucuguacacgcugcuguugcugauaaaaugggugacagagcuuuguaaagaauguacaguagaggccaguaagaugacucaggguggauaugggugcuugccaacaaacccaaugauugaaguuugauccuugguacccacauacuggaagaaacuccuguaaguuguucucugaccuccauacauaugugcucaacacacacauauagguagaugaauguaauaagaaaguuaaaaguguccucaugcuuaguagacugcuaaugucaccuuagguccuguuacauuugcagucagguccuauaugaguucagauaccaauuuucauggggcacugaauaucacacauggguccggaaugauaaauacaccauguccuggaaaugugauagacauccuauuuugccauucagcuacuugggauucucuccucuguggagccucauuauccucacaugucucccauucacugagagugcuuggaucucuaggguucuuacagagucuuuuucuuguguucaagcucaaucuucaucauucaagguuauagccuuauuggauauaggaacuuguuagacaucuccuuaggucuuagagaauacagggcccugugccaggcacgggaugaauaugcuuugaggaacuuaucagaucuaugcaguaauaauuagcugauguugaaaagguugcagagcauccaggugcaauguagcugacagugcagcuugucugugaggcuucucuugagguuguggcaucccucauuacaucacuuguuggaugcccugccucauuagauuauuuuaguacauuauagugccauccagagaaagaggaagggagauggggaggggaaaggagagagagggaagggaagggagagggagacagagggagagagauugaauuugagaacuucuuucagaaaucuugccaucauuaaugucuuccucccaucucuuccuuccccuucccauauaaagacuugaagaaggagugagaagucuuuuuuuuuuuuuuuuuuuuggaugggagaggugugguguccauggagaggaauacuaucuaguuacccuccguguauuugaggggcagggccuaaaaagcaauuauuucgacaguuuauaugucugcacauugguuacaggucacaccagcacacaggcuggcugauuuuucacuauccagauaggaugggguggugcaggaggacacuggagacaugaggccaugggagagagaggcaaggagggcuuuugaagugacuuauacacacaagaggggauggcccuguuuugauuaccaccuauucaagaguccaacuaguaaaggauuuauuggagauguggggcuuugcagcaacuucacauauuggcacuuacugcagaggaagaaagcuguuuguuugaggugcuacucaaaagagugcuacucaaaacaaaaacaaaaacaaaacaaaaacaaaaacaaaacaaaacaaaacaaaacaaaaacaaaagcaagcuc

SEQ ID NO: 3878 - RNA, 1200 nt, Mus musculus
uauuagccuguaggagccuugggaaacuguugagaguucuggcuacucagcgucuggcccucauuaacuuuaacccugggccaggaaugagggauucaugauagcaucaggauacacauagcucuaucucuggaugugguuauccaaccgcuuuugaaaucuuguccaauucgaucuccaucaaaugugcucacuaacacuuaaaaucuaugacauuugauuccaguuucaggucaauagccaaguaaugauuuaacacuauccacucgaagacaucuuuuccuggguagacagaauaggucuggaagugcacugucugaaacucaagugcggaccaccugagcaagacagaagaaagcgacaaaguagguacuugguaauccuuacaaguggauucccugggcauaguagguguccaugggccuuugggcaucaauaaucccuuucuggagacaaauaaagcaaauacauauuguacagaugauccacuccccgugugggcgagcgaccaugauggggaauuaagguagaacuacagaaacucgcagcugcucuccagguacuauaacuuuaucccuccacagaaagauggcuauugggaucugggugggacuagucccccugcaguuaccgcugagcucagggccacacucgggcgccuuuuaaauucccccagcaauugguggauggagaaagagccagggggaaaaaagaugcauaaugauucguucaccgggcggaugaaacggagaguagaggacgcaggaugcuaacuggcuuuuccucccaugugcaggucaccugaaccgcgaugccuuccagucucugaggaggcucccugaacucgccauauggcuccguuuucaagaggggagaagaaacaguuucaugcccaccugccugcggcaucuccuuucaggcaccccuucccuagccccugcccggcgcgcgagcugccggcauccacggucccgcccgcuccgagcuccggccggcagcucccccggcggccgccucugcaccagucgccaaccuccgugccgggccgaggucaugcccgccugcccccggagccggcgaggccccuucccggugccaggcggcaagcccgagaagcgccggcagggaaggggguccgccgcagaguuggcacccggacucaccagguaggcgcccaccguacccugcgccagcaucaag

SEQ ID NO: 3879 - RNA, 212 nt, Mus musculus
cauggacaugagucaugugcagcccaucaagcuggcuaggguaaccaaaguacugggcaggauugguuugcagggacaguacaugcaggugagaguggaauucauggaugacaccagccgcucuaucauccgaaaugucaaaggcccuguucaagagggugaugugcucacccuauuggagucagaaagagaagcucgcaaguuguguugac

SEQ ID NO: 3880 - RNA, 2971 nt, Mus musculus
guucuuuuuuuuuuuuuuuuuuuuuuuuaaaucucaguauuauuuaaugagaacgccccacccugccauguacagggugccccgcacucgcuacucacccaccauguuaaggaaaagcaccaggaaguacagaggguccucauggcugcucuccagaguuauaauuuaaagguauuucuccaugguaaaacuacaauaguuacauaccaaggcaauacuacaugcuuuacauagucccaugaaaaaaagaauucaauugauccuaaucccugaugcaaggcacuucaaagcacccgcauaaaaugcccauguaaacagcagugcagugcaccuuccaaauaacaugacuugugcacaaccugacccagacagaaggaaaaagaaagcccaucacugccacagcuaaaggcauguuaaaauuuccaccaagaaacugcuucccucauuguucacagaacaggcuacauaaccuuugugagauacaaaacccuugugggcauuucauacugccaaaccagcacgcaccaggggugggcaccaagucagagugcucaggagugagagcgcuaggcaucgcugaacacgcacguuuccuagccaccagcccgggcaggcuguuuguagcaccauggaaaaugcaugaccagccacaaagguacaaauuccaaucagcucuuucacgaggcucacuuaguccacaguaaucaacaguagugacaauaauuuuuaaaucauugacaaaugauuagcuuucccuagaagagaaguucuguaucaguacaucccauguacacagcaccaguuuaaacaggauuaucaaacaccugcagcagcgcguggcuaacuggaaaguucauuucuuagcgcuuuccaugucgggauaaaaucacaacagugaugaacacugacgggggauucaguaaaacagagggguggcaacuguccagguucuacugccuucucaggaaccacaagaggcagaggccaacggcagggcucaggccccaccagguuucuacuaccaagcaacugccacacacacuacugggagaguaagggggucugcgugugacugcaacccagaggguucugaguccaccuccagcuucgaguccacggagggcggaggguuagucggcuuccuacagagacaggcacaucugccuuucaccagcuugauucuuaguagcaugcccuacuuaggcauuuaaagggauaagggcauauauagguaugcacagugaagaaucaacuauaaauauuccgacuguugcuuuuuuaaaauuacagauugaagugacuccucagagaaaaccgguuucuucauaaaugaaauauaguauauaaaaagcuggaaugauggguaguuaaaauacaaaacucaaguacaaaacacccuauuuuuccuuuccaaacuacacagauucauacaguugacucuaccauauaacugcuccauauauaauuacaccacuagcguaaaggaccauuaacacuaaagccccucaguuagcacacugaggcucuccguccugaggucugcauuagaacugcagcccugagcccgagcugagaggcacccuuccuaagcguggcucucuucuuccugcucucgggucccacaauuauuaaaagaagggaucugcucugcaaacgacugugccauccacugcccauucggaacaucgccgggggccgcuucuccucucggcuccgcacugugggcuguuagcccauuugaagcaaugccacaagguuccccauuacauggguuuuccccauaggcgccgccguaagcugccucauagccuggaucauacuuuucuuccuuaacagccaucuucuuugcguccucuugcgcaaguugcaggucaaauguauacugcacuuccugaacguccgcguugcguucaaugccuuucaguuggucucucaaguccuucagcuuaauguaguaaugaacuuuguccugggcccggggaaacugagcacaucuggagcuggacgacggcaugacuuagcacaggguuucugugucugggaucuugugggguugaagcccaaauuccaaguucuuaaccuuuacuccaaaaacuucuuuacugaaaauuucauaaauacauuuuccauuaaacaccgcuauucguggcugauauuucugcaguuucugcaccaggaugcgcccuccuucccggaacucuuuacuagacagauccuugcugcccggcgucguccguuccaccauguuggugaauccgaugccguacuugccggguaagguguggucauccaugugauucagcugcaccucacucagccccgacaugaacagacacuuccagaagugauuuccaggcccaggguagugauguccuuuguaagcagccauuaaucccggguuaaugccaaugaucacaauauccagauugaaggucaaaaugucaggaagagucuuggucagaagcucagcuucagagacgccguugaagcgguccacuuuccuuuucacuuuaaacgcgucugugauuuucuccugcuuuuccuuugauuuuguagacuugccggauuucuucgacguagcagguuuuuugggcuccacugguuccuggggcucugcugcucuggguuuccuuuuccuucucuuuggagcuucuggugcagguuccuggacaggagcgucuacgggcaccugcuguucugucacgguugccauguuaggagcuacugcuggcaccugcuguccagucgugacugccauguuaggaacuucugccaucauuuguugaaauggaaaugaauacaaagcuugaauuugcuccagagaauagcugcgcgcggccucugcguccauggcggcgccgccgaggguacggccacuccugccgagcccacgggcgcccgcucugccgcucagcacgcggacucaccacaggaucggggcggccgguggauggacggccgagacuugaag

SEQ ID NO: 3881 - RNA, 1092 nt, Mus musculus
caggcugccugcgagccacguauuaaucaggagaaaacacggggacuuugcucaaguaccuaacaagcagauuguagugaaagcgccguugccugagcacuaguucgucuggcaccuauuuuacggagguuugacuaugagccaaaugucgugcuggcuccugggaacaucaaccacacggaaauagacagagguaggccccgcccacccguggggaacuauccaucuguggaaggauagggaugcggagccacaaaaagcaaaacaaaauguagaagucuaagacgcugguaagguguccugaaguacaacagaaguaaaagaagcagagguaggaugggcaaagggguagagauggcucuuggucagugucucgggcagggguuauaggcccugucucuucuugguacacacguuggagugggaguuggguguguggcucaccuggugacugaaacacaccacuggguugauguggggaaagaagggacuuauccugagcugaguuagauggugauggaggagccugaacuguagggcaaguacccggcacccucucggcuuucugccauguaaggauacaauguaaagauggcggaggaaacacugggacaagaacucuuaccagacaacagaauggcaagcacguuggacauggaagucacccuccagaacaauaagaaacuaauuucugcuucugagccacccuggcuguggguacuugcuacagauagcacauauuggcgacacaaugaugguguccugagagaagccugacugaagacuuuucaagguaguggagucaucuguccacgaugacaucuuuuauugcuaagucacugugguaguuugaauaaaaugcccccaacaggcuccuuaggaauggcacuuuuaggaguugugaccuugauggaggaagugugucugagucuuucuuccugcugccuuccagcagagacugauguagaacucucagcuccuucucugacaccaagucugccugcaugugccaugccuucuaccccgaugauaauggacuaaaccucugaaacugcaagccagccccaauuaaauacuuuccuuuaugaguug

SEQ ID NO: 3882 - RNA, 8350 nt, Mus musculus
agggacuggauuaacgguauuuugggggguucaaguggcacauaggucuggaaggaagguaggcgggcaggcucgagagugacaguggguucgaaagaguaauccuuaccuggucauuccauguccagcccaggaccgcaggagccacgacccggaguuucuuaaaaccugcaugacugaaauugacccuccgcggcgcuuggcuuagcucgagccagcaccaugagccucugugggggugcucacagacaggaaaucaccugauugcucuuaaauaguccuguaaguauuuuuucuucaaauuuaaagcucuauaaaaccauuuauguaggaacuuuccccuuucuaguggucuaacacuagaauuucaccuaccucccccaaagggaaugguucauuccacucgguaaacccgccccucgccggcccgcguugccucaugggaaccugggguuggcugagggcucugccgggcgccgcgguaccuugugggaagacagaaagauggcggcgcccguagggcguacucuuuuagggcuggcuagaggcuggcggcagcuugacagguucugggcagguaguucucguggcuugucccuugaggcugcguccucaagcagccggucuccauggcgcuugucgggcgccuugugucugcagcggccaccgcugaucaccaaggcgcucacuccauugcaggaagagauggcgggucuauuacagcagguaaggcagucacgggcuuccuggugcggcggagggaagcaacaguaucaaggaggucuugauuuccauggagacucugguacuucgugugaccuugagcaaacguuucauuucucgaccuuuagugacaucugcaagaugaaguuaccguacugaguuggguuaggauauagcagguguugaaagaguuuaguuggcuuguuuucucuugaucauucgguguggauagcuuccuucuuguucauucaauacuguagggauccgggggcaaacaggaaucacucccuuuaacuuaggagcucucagacuauagagaaguguuugugauguuaggacgaaagucguggugacugugggcacauccuuaagauaaugcgguaaaguuugcuuuaccucagggagcaauuucugugaaagacaaaaaacccaaguguuguugcuguugggucaggagauagugauggaaggucuuccguaucccuagacuccaaaaggcuuuugucuggagaauacuaauggaaacucccgucagugcuuuuugcucaauguauucacucacuugacuuuuuuuuuuuuuuuugguaguccuuuuucuuucaccauaaagguauucguagccaauacugugcgucugugugcaaagugauaggcaguuguggaugugacaggcacaucgcucugcuucgcagagaguuuccagguacuggaauuagggauacaaucaguaaccagucuuaugacuaauuauagacuuugguaagugcuauuaaggaaaacauagaguacuagaagaguuuuacacaggaccacauagguuuuauuuuccugagaaguauccaggaauaucuuucugagaaagagguauuugaguugaaauaagaaggauggauagaaaucuggaagaaauggcaugaggagaaagagagacuaggaagaaggauguuggaaagucuucauggcaggaaaguccuugaauagaugcugaucagagacgaguagaccuagugugugggaagugggucuucagugcccucuguucuccuugacagucuuaaugaaguucuccuacugccuacuuacaauccagugggcuuuuuuuuuuuaaaucuguauaguguuucauucuauuucugauuguguuaagaguuguacgucugagccugucaaggucacagaagcuuuguuuuuuuucuucuuccuuuuccuuuucccuuucccagaucgagguagagagaagccuguauucagaccaugagcuccgugcucuggaugaagcucagcgacuggcaaagaagaaagcugaccuuuaugaugaggaacaagagcagggcauuacgcucgcacaagacuuagaagauaugugggagcaggcauuccuacaguucagaccuggagcucgggaaacagguuugugaccuccugggccaaccacaagggagcgagagacaggaauucucacuuccaaaugaaggacaguugccugucuuuugcuuugcauuuuaauaacaagcuucaaguaacaaaacaguuuucaggaaaguaguacucccucccuauuccuuauaucucccuaacaugaguuuuuaaaaaggcuuaugcuauuuucaguagaaguaaagagucuuuucuuucuguuaaaacuugagguugucacuggaucagagagugggaggacuugagccuuucuccucaauuccuguuuuauuagaagucauucugagagcaggggcugagugcuauugucccuguuucaaggaugaugacuggagaacagagaagguggggguuaguuaguuagauugguaauagcguuaaauccaacggcaagacuuuguuuguuuguuuguuuguuuguaacuguguaacauugccgaggucugaacucaagaaccuccugcuugcagggcaagugcacucacugccucugagcuagauucuaguguuuacgcucgaacuuucacaggcauugcuucuuuuccaaauguuucagcuauacguugcuuuuugagaggaguuuauuucugguuucgauucuuagcuuucauuuugaguuaggauuauacuuuggcuuaaacagaggacaggguuugugguaguuccugauggaaagcucuaaaacucaaaacccuugcccguaguacaucauaguccuuuauuucuuauuuuucucuuuccucugaucaucccuuuuauagaagcugacaaaaaaaaugaccggaccucguugcaucgaaagcuagacagaaaccuuguccucuuagucagagagaaacuuggagaccaagauguuuggaugcuuccucaagucgaguggcagcccggggagacccuucgggggacagcugagcgaauccuggccacacucucagguagacucuuuacccucugaauccccccagauucauuucagguuggcauaaggauagacaguggaaaguuuaauggauacugaugaguaaaaauucagguaagaggcuggguaugaaggcacacuuauuuaacuccagcaccugggaggcagagguggcaggggugugucucugugaguucacugcuagccuggucuauauagugaguucaaggacagccagaccuacauagagagacccugucucaaaaaaaccaaaacccaaucaaacaaaaaucuuggcaaugauuuuccuuagaauaagugaguauuuuuaucuuucuauauugagauuuugguacaguaaacacuauucuuagcccuucccuccucucuucucuccguuuuccuuccuuccuucccuccuuuucuguuuuucucuuccucuuucuuucuucuuucuuuucuuucuuuuccuuuugguagccaggguggccuuguaccugaggaugaccuugaacuucugagccucuugcaugcguguugggauuauaugccugagccacagucuuacgcggagccuuguguauguuagacaaacacugugccagcugagguauagccccagcaccaaggggagaaaccuuauuuggcaagcuuguaccugagcugggagaagaauuuccaguccauugccuuaaucacuuagcuacaauugcaucaaucagaauucucgcacucaggaaauguaaguuuuguuuuucaguaaguacuagagauggagcuacuggccuugugauuagugggcaagcauacuaccacugaccucuauuccuagcacugcugcuuguaccauagcuuauccauugauucaacucgaauugucaacauuaucccugccgucuuuaugaugcaugcaucuuugggucauacuggaguguugcaagucauccggcuuuauuuucacagcuuuagcugugauguccuucacuucucauuagacuaugguauuguuaauguuagaggccagguaauucuuugugagacacucuucuuuguauuguaagguguuuagcaucuuuggccucuacucacaaguugcuaguagcaauauuuuguuucccaccccuagccccagugugacaaccaaaaaaagucucuccauauugcuagagagcaaaauuagcaugguggagaaacacuacugaaaaugcaaaaggaaguuccgccucgauuuuguuuuauaucuccagugcugcugacaugugguuucugcauaaaaauuccaugucacuuugcauagaauuuuuaacuguuuuccauagacacacaaguagccuacaguuuuuauucuggucccaauccuggcagcucuuagcaaguuaauauauaaccugauuucuaaccacggagagcccuuguauuuccuugagucaguggauuugcaagcaucucugcuuguggcaugcagguccauuuaggaagaaugccaucuccaaguggagagcucuuuaccccaggcuccugcauaugcaggcaguuuaugcaggagacauuucuguggcugccauuuuuccaggccuaucuagcagcugggcacagugccugcccugugguugcuucugccgucguguggaacacguucuuucaccuacaccguugcaccauaaugguuuauuugcacauuuuguucuugcuagaauucugaauucccugaaggucaggagucuguacuucuuagugaguucucagcaguaccugucacgugguccacuuucugguguugagaacguggcuuugguaguagcguaagcacauggccacuugacuggcugugccaggaugagaacuccuaggaaaugccccuugagccuuucucacuagggucuuccuuagucuauaggagaggccacaagcuacauugcuucugucggucucuuagcggucacguaggaaucggcaguuggguuuugggcgcacauucucaggcuccuucauacaagcaugcauggugcuugcucggcucuuccuuuucucugccugagggaagggguucugucuuggcacacggugucuuuuaauauucccacugaauaaaugcuuaaggaaauaaaggguuccaaauagguauauuucuauuuaauaaauacauaaaauauaaacugaugguaaagaaguuuauuacaaaguuacuaaaguagaaaauuuaaaauggaacaacaaagaagaauuuucguaauaaauauuuaagaaaagcaaaaguacauuccguccccacuggcucuacccuucugcaacguggaauuucaagagguggagucaccgugucagaggugcgcaugcgccaggccagaggugugcacguggaggaggugaggauucgggagccaagccuguugacuuccuguguggugacaggagcuguuaugguggagccagcuuaccuggaccucaccaguguaggagauuguucuuauuugaguuuguagcuguggcagcgguagagacagucucucuugaauuaguguguaguguuugccucuuuguugcugagaccaaccaucuuuuaauaugcucaucauauuugugaaucugugaacugucagcucagacuccucauuccuguuuguagugaaaugguuuuuuaacuugauaauauuuuaaucuguguuuuccagauuuagaaaaauuauauaccuuauucacuuaaguuuggagagugcaggaaaauauaaagaacugugccaguucaaucccaccacguccagaugcccgcgcagauacucgcuguacaugggagcacguuuuguauguaaauucaucuggugcuagucauguuguguugagaacaucaguucaugcauauguuuaauggcaucaagcucuaguaagcgcagcacgagaagaucucucaccuuuucugaggcgcgcucacugacagugcuucucugaggcgugcucacugagagugcuuucccgugcagucguuuagaaaugaucugcacauguucaagcacagaaagauuuuuuuguuaaaaaaauuaaauuacuuuuauuuauuuguguguauguuguguggucacgcacaugcugugcauggaguguaaggucggagaacaggucugauugauugguugucugaaccacgugguccuggugaucuuacucaggccaucaggcugggggugaauaccuauacccucugugucaccucccaaguccugacuuccacuuauuuugagauaggaucucacuguguagcccaggcuggccuagaacuaacucaccacguaguccaguuugcccuugaguuugcagcucucuuggcuccgucuccagaguccgaacaagagaggcauugucccaagccuggcucccaagugcuuccugauacuguaagaugcuguuccuugguuaagugugcugaaaaugcuuuucugaguuguuuuguucuuugagacaggaucucauguaguuuaugcuggccucgaagucaccgcauagcuaaugaugaccuuaaacugcugauucuccugccucugccucccaaggagcugguugcuuugagaacauugggaguguuggugucacuaacacauucugcuccaguguaucauuuuauuuuuguaguaugcguguguguauguguguguguguguguuuuauuuuuuucucuggaagauuugaauuuucugugagcaaacauaauugcuuuuucuaacuuaaugucuuguuugguaggcuggccccuuuugauauguaaaauauauauucuucuaauacucuuuuuuuuuuaacugaaaaauuugaaaauacaucauaauugagaaaauacaaauuauucacgaaagcaucaucugacgcggacaaacuuuuaugaugaugaaguuucuuucaagugcccauggucucagucacagggugaggacugagagguugggcuccaacucugcuuuuuuguuuagcugacuguucuucaggugccauuuagcaauucugcauuuugccaucuuugaaaugcuagguuaggguuauuaacucuuccuucauugcuuacugcagagcgcagaucuggcuugaguguggugauacaugccuuugauccuaguauuagauagugaagcagggagaucaccacuuugaggccagccugggcuauagaggguucuaagcuacccaagucacaaggcaaagcuugcagaagcucccucauggccacuccccuaaggucagguuggagacccccuuuuuuuuuuuuuuuuuuuuuuuuuuuuugaggcaggguuucucuguauagcccuggcuguccuggaacucacuuuguagaccaggcuggccucaaacucagaaauccgccugccucugccuuccgaguacugggauuaaaggcgugcgccaccacgcccagcuggguuggaaacccuuaagaggugaugagcuuugaugcacagauaucaaguuuaucggucccguuuuaacaguugaugacagggcugagugcagaagccaccugccauggcucccagauaaucuuaacugcacugugaacuuguaggcccacagugaguggcagccuggcaccuaggggagagagcauuugacuugagagggaggagccccuuucaggacugccacaugcaacuggaucaccuuuagcucuguuagaaguggcuuuggaugaagcagcaguggauggcuguacccuaaucuuccaauucuuucuuuucucuucagaaaacaacauggaagccaaguuccuagggaaugcacccuguggccacuacaaguucaaguuccccaaggcaauucagacagagagugaccuuggggucaaggucuucuucuucaaagcucugcugcucacuggagacuuugugcaggcugggaaaaagagccgccaugugugggccaguaaggaagagcugggugacuaucugcagcccaaguaccuggcucaggucaggcgauuucuccuggacucugauggacucagcugccugugaaugcugcucacacgagccaaauguaggaccucaggaacaauguugauagaccauuuacaggacugucaagaagcagacucaauucgagaauuaaaugugucugucauuguguugaauuuugauuuguccuugguggacaacuggcuuuacccagugaagagggccaggacagauuggacagcuuauuucucuauagcaaguaaaagcguuauguuacagugaauuaacagaccuacugggcccaggggaaaaaaagaaaugaauugaccuaaau

SEQ ID NO: 3883 - RNA, 9876 nt, Mus musculus
cggguuuaccgaguggaaugaaccauucccuuugggggagguaggugaaauucuaguguuagaccacuagaaaggggaaaguuccuacauaaaugguuuuauagagcuuuaaauuugaagaaaaaauacuuacaggacuauuuaagagcaaucaggugauuuccugucugugagcacccccacagaggcucauggugcuggcucgagcuaagccaagcgccgcggagggucaauuucagucaugcagguuuuaagaaacuccgggucguggcuccugcgguccugggcuggacauggaaugaccagguaaggauuacucuuucgaacccacugucacucucgagccugcccgccuaccuuccuuccagaccuaugugccacuugaaccccccaaaauaccguuaauccagucccucaucguacucucucucucucucucuuuuuuugccccccagguuugugggcauugccccagcuaagaauauccacaccggagccccgagauuagaagacucagcugccaggcagaacacugaaagggaagcggcuccaagucgcuucaggugaggguaaguggaugcagcgcucuggaaaguugcauccugugacuucugcccgacaccguccaaaaucauagaaaaaguuaauuccuggcugucauuugccaucugugggagcuugugcaaaucagcacacuauacguggagauaaugcuuagagggguuguugggaaaauagagggaugagcaggggcauaagguagcuguucaauuagcaacuguuagcuaaguguccaauguauauaaauaccagcuuucuuuuccuugugagauaagcuuuagauccgacuagcagcuuucucugccuccaacauaaaaugucuugaagaaccacacuaacugcacaucuagauugugccuuucuuaauuucgugccuagcccugggaccuggcauccugcagcaucccacuaguagaaauacuuaauaugcaggcgguauauauguucacuuaccuucacaucuguuuaacaguuacaaaagcuacuacuaccuguugaguaccaggauaaauacaggaaauauagguuaugucuccccagaaguaguacacaacuugcaaaaacaacacacaggcaaauguauuaaccauaaucugaucaaaaggauaauagagguaagaacuggcuggacauuuaagagaguaaggcacacuugaggaauucaggaaagacuaaguaccguggacuguggaagugacuaggaucucagcuggacaagaucauugugaucguggcaggcaaggguaacgucuguggaaaggcaggcugucagaacuggcuugugaugccucuagaaaggcauuucggaaccuguggguugcaaccccuuugggguuccuaaggccaucagaaaacacacauacauacguuacgauucauaacaguagcaaaaucacaguuaggaaguagcaacgaaaauaauuuuauggcugggggucaccacaguauaaggaacuguauuaaagggucacagcauuaagaacacugaggaccacugcucuagaaggauccaaauggcagaggacagcccugucucccuagagcuuuuacacuuuauccccugcaggcaacgaggagcuacugauggaauuugauccaggaccguuguagccguucauuuggcaaucccagacacuacuaggauuguugggguucugucccugcuccaacaguaaagcaggcaaucaggcauagccguaucuguccaguucugggacgaguugaugccaugucauucacucacucauucauucguucauucauucauucauuuuuaggauggccuugcugugcagcccaggccacccucagacucacaauccucuugccuuggccucuugggugccugaauuacuagagcaugccccagccucagccuuacucuuuagggagucuauaaccacuguguugaugugaagccauggggagcaagaauggaagcugagaagacuugaaagcaguuagaaagcaguggauauagguaaaaauaauggugucuggaauagggugauaguuuuacuagccagcggacuuugguuuuuguguuuuauuuuguuuugagacaaagucuugcugugcaaccuaggcuggccuggaaugugcggcaguccuuagucucccgggugcuuagggauuacaggcaucuguccacacccagcuacagaucuguuaauauaaaaugugagaaaaggagaggugugaaggcucaaaacugggcgccaaacaacugaaaauauggaauuguuauauauuaaaaugucagggacuaagaguugagaucugugugguuaaguuuaagaugccuuaugcuugcuuucgaaaggccuuguguaaucauguauaauaaaagaaaacauuugagacacuuagcaucagaguaggaguagagaugccauauagacggauaucuggaaggaggaagaaccagcaaaagaaaacuccuccccaagacaggaagaaagccagacaagauuucccuuuuaguguggugcagcaaaguagggacccgagccguguuuggcacugcagacaggaugggguggcaagcagcuagcaugauugcucauuggauuuaacaguauggaggugguuggugaccuucaguacagccuuucugauggagagcucagaaauaacuucucauuguuucaaagaaaauaaacaaguauugucauuccuuuaaggaagcauugcuguaagggaaaaugagaaguucuuaggaacuugggguuuaaaauguguggaguuuugggugggggguuguuugggguuuuuuuuuguuuguuuguuuauuuguuuuguucuuguugucuugacuuuaugacaugaccguauguuuugcuucugggaaccagagaaagacugauacugaagugggaacauugccagagcaguguccuuguggggcuagugaugcagcuggagcgcgaugacaggagaguccuccaaggccuugggcacagauguuccgugguggaagcuggaaggaagucugauugauucuauuucucugcagaggccaucagcuggccccgaggaagcaggcagggcucagauguuuacagagacaaaaggaaauauagaagaggcauccaggagagugggaggauaacugaauugaggaugauugucaggcaucuugagagccugcucgaugcuggcaauucauuaagaugaagcacugggucuugguugagucagauuuugccccuccccacccccagguucuuagcagugucuaaaaaguucuaguggucauaaauuaggagauagaauccagugaaguaaagccagagaugcuaccaagcaccccacuguucccaaggcagccccccacagaaguguuaaauccaaaaugucagucaaaaagcccugguguagagagagaccagucaaccaugccguguuugcacagacucaaauuaucuagagagauggauuuaacaagggcugggaguuugccaggagacugugaagagagacaggggaguugagacuaggauuuaguccccgugaggagagaaguaguaccugagguauguggagugacagcaaucugacgggcuccucagagugcugcccugaagauagcaaggggucaggggcgggggugaccaggaaugcuugaagccaaaguuaugaugcaugcguugguaaugauaauggcugccugagaccccaaaaagugcauagccaagguaggacagaugacgguuaaaggagacaagguuuagaaauaaaagugcagaucuuuuggagaccuagcagaauuagucaguagcuauuuagaaguagugccagaugacacugagccagcuaugguguuugcaguuuauuugcauuuuaaauauuuuuuuaaauuaaauauaaguguaucaucccccuuccauuuucucuuuguaauacuuccuuuauaucccccucucuccuucucaaauguauaaccucuuucuuuuuuuuuuuuuuauuuaauugucggagguguauuccuaacuacauaaauauuaccugaucagucuguauaauguuacuuguaugaauauuaccucaggguugaccacuugggauuggaucucccauuuucaguauuccuuaauugcuuauauuugcacuuuuaaagauuuuacaauuaagccaggcaugguggagcacacuuugauuccaguacaguacaagcgggggcaaguagaucccuguauugggggauagccuggucuacauagugagcuccaggccagcuagagcuauauacugagacccucaaaauaaaacaguccauugguaaaugaaccuccccgccaugagagaaggcagaaagacuagucccagaaagcucuaucucucuuagagccuuccuuagaagaacucaguauaccuucaaccugagagaaucuugucuuguuuuguuuugugauuggcucuugcuauguagcccaggaugaccaggaacucugucaucauagcuggucuuaaacucaugguugcucuccuggcuggggugucuugaucuuggccaugcccuagauuaaguggcuuaggcuccuaguuuagaucuugcuauauaaagggcauuguacugguuuuacucagacugacacuuguauuugcacaacacggguggggaauccauggagaaaugauggucacugaaacaguagugucaucuacaggacugggacacuuuccuaucaguacagaagcugauaggccagccgcccacagaggcugugugucaagcuaagacugggccacagaaagcaaugcagugugcugagcuuuugaaaauaucccuacagaagcagauggggcgggguggggggaugcuugaaugguagcguguuuucagcauaguagaaaugcagugugggugugugaguacaagucugagucugauuuagguguguaggcauaaugaaacagccgagugacucccaucugaaaugcugaaugacagugcugugcguguuuacacuuauaaagaacacagacccaaggccaguccccugggcccaaggccuggcuuuucgugcgcgcuagcccucuuucuguuugggacuugaguucuccaccugaacaggaagacuccagccucaggggaacccaguaacccagcacaccgucaaggccaguguucccaacgcugaaacacuagagucuccauaagguuugacccguaacaggagcagagcgccuccuccagagccagggguuugucagcgcuuuuuugaucugguguguguguugggggaaggauggugugggagguuugaggccuuuuguggugguagauaacagaggcugggcagucuuacgguauauccuaagcuguacguaucccuguuaaccuugaauucagccuuccacccugcccuccaccuugcuuggcucacaguauucaacuauuuuauuuuauuuuauuuuauagcauguauguauuuccuuugauuuaaagaacuaacaaucaggaaauuaaagaaaauguuucuucugauugcagccuuuacccuccgguuccaggacaggagagcucucugcagugggcagggaugaaguuugaggacgucccaauugcacacauuaaagcaaccuacaacaaguaagaaaagggugcccgcgugaguccccuaggaacugcuucugccucaggccuucuuggaguagaagucgggugucagaugcuagcuucgucucuucuuucuuuauaagcuuacucaaguuucaugaaacuauaaaauagauugaguacaguguaauuguaaggguuucugccguccuugggacuccuaugcuagcaucagaagggcugcauucgaagcaaguggagagagaagcagugcucagauacaugauuuacuuguaaaguagccagaauguauaagccccuuaguuagccuucuuaccuuaggcccugugcacugcccuuucccuagcagggcuaaguguggcggugaaggaaagacuacugugugcuguggggugcuagcacaagacacaggugcaguugggcucccagcugcagaagcauagggcacuggcgacagcuuugcaggcuagguccuacuugaaagugggaucugaguuugguggcauccugccugccacacaguugcagcacagcacuggagacgauaauccuggccuagaaugcgagcacccaagagccacagagccuacagcagcaucucucucccuucucgugagcuaaugcagacguggcuucugagcucuccacacccugcugugucugugccuuuucaguacgcccugaaugagaaugcuucuguguagcuccugaaguguaagcgaccccaggggaggagugaacuccauaacaagaccaacaggcagguggucccugcucagggcugacccagcaggucuccuggacagcuccccuucacuuuccccuucccaggaacacccagaaagcucugcagaaaguggggugaugauaaccaaaggggagacagaaaacaugccuuagaauuugcuuaaagucagucuugggggguggguguuuucuagacaggguuucucuguguagccgggcuguccuaaaacucacucuguagaccaggcuggccucaaacuuagaaauccaucugccucugccucccaagugcugggauuaaaggugugcacuaucacugcccagcuuaaagucagucuuaauuacaauuuaccauuuuaaagcaaauuaggaaaaagcuucacuuacuuaaaauaauuuuuggucagagaauagaaugucauaagcauuugaauuauaauaauauuauaggauaacugguuuugugggauuauuuugagucuuuaugguuaccucugaaaugauagauacuagauucgcuucaaaacagcccauggaugagggcauguagcggguuuagaggagacacuguauuuggaugugacggucauuguuggagcagaaugagguaacaggucucuggcauuuauucauaaacuuuuuuaaauuaccuuauuacauguuuacuuaguugucaggagugaucauaaacaugagguggucagagaacaauuugcacaaauucucucuucccaccgugugggugcaccuguaagccaucccucacacacucuucuuuacauuguuguaguggaagauacucgaauuuucucagcauugucuuuuuaacaguugccuaaugcaacgcauguagguuuuuauaaaacaccaagcgaugucacaucagggaaaaugcugccccagggaaggcuucauucaggaggaagugguuccuucgggugacgcuccccuguugggugacgcucuccugcccuuggauuauggcacucccccuaagugugugauuugcccaucuuccuuuagcggaggaagcuaaugaccuuuucuuucucacuguggcuccuaaggacuuuagcaagcucccuuccuuccugagcaguacuagaucugugugccuccuuuucccagcacacagauccagguagucucugccaccaaugcgucccuggcccgcgccuccuguggcacagaaggcuuucgcaaugccaagaagggcaccggcaucgccgcacagacagcaggcauagcugccgcagcaguaaguaccugacuacguggcuccacuuuccuuguggcuuacaguggggaagucucauuaaaccagauucggaaaccagcacaugccaguguuugggggccucugaucuuugcccaccccuguuagaugcccugacacugccgcugcuuuaagaggccuuuguagaaagguuaccaacuuucucucucagcuucaguggagaagaaagaugucauuuauguucagaggaauaagcagagagcugaaggcuuaggaaccaacacucccuccaugaaagaccacugggcuguauucuauucaggaagcaugucuuauagcacgggucccaaaaugacgucauagaucuuucuagaagcaaaucaggcagcuccauuucagacacuucauuaguacccugucuucagaagagccugcuauuagccacucuuucaagagacucggaugcuggggauuggucagagucagggagccaguugagcucucugaugugaacccagaugggccuugagccagagcugcguguuuucugguauagcaaagaccacagaugugugcacucugacaagcaggauacuuccugaaggaacaccuugaccuuuaagcuagacguaaggcaaucuuugacugcuaugaguagugaucaccaaagcacagaacgauguaauugcccaucagaccaucagacggagcauagucggcuaagcagcacaugccaguguuugggggccucugagugguagcucuugaguaucuuccaggaccuguagugaauguguuccuaaucuggacacauacuuaacuguaaagaaacuaaaucccacugucuaagugggcccgaccuugauauccauggugacaccucagcauuuggaggaaaaccaggcaauaucuacaaguguccauuagauggcagugcaguccugucaccuucguuccuuggcucuguucacuagcaucuacccuuguccacuaggccuuaacucccucugugucuucugccucacuguuugcuucugucauugcccuuaucccaugaguccuggggacaguagccagagacugggcugcagcacugucucaggggcauugacacuugccucucuccagaaagccacaggaaagggagugacccacaucagagucguagugaaaggcauggggccaggacgcuggguaaguuacuagcgguucuccugggggggggggggggucuguguauguaugucuguguguaucugugugucuguguguguguguauguauauguaugucuguaucugugugucuguguaugugugugugcgcacgcgcgugugcauacacgugcacaccuguucuucagagucagguauagagauagaaaugucccuuagugagugacaugguauuguuuaaaguuccuuucuguuccugugaucugcuaauccccgcagagcaagccugggucauggauuaauuuauuaccuucuugggucccagccccuuggauggaaaaguagucucugggggaccaucucaagcaaguccucagcacagacagugaaugcgauggagaagggucaaggcgcugggcaccuugagagggauucugagaccaguggggcuagagcuuccuccaacaaaugacaucucucugacuuuaaaagaacgagauguuggggugugagugugugugucccaggagaagaaaacacuccuguaaagcuaccagagugcauagauagaaccucuuuccagacuguaaaacacaagguggaggcagggggcuggaaccguagacaucaacagugagcuuccauccuucucgagcccugccugacgauggcggucaucauuuugaagccugugccuuuugccuauuucugaucuuuccagucugccaucaaaggacugaccauggggggucuggaagugaucucaaucacagacaacaccccggucccacacaauggcugccgaccccggaaggcucgaaggcugugacgggaagggagccugcacuuggaccuggccucaggucuugacuccuguggauccuacagaaggcccacuguggaagccgcuggagccggcuguucucgagcccuccuuggggaaacacuccucuccucgcaccgaggcuggaagugccaagcuggccucuuggacaugagggagugggaaccccaggcccacuguggccagcucagccucugcuccaaaaauaaaaaacuauucucuguaguag

SEQ ID NO: 3884 - RNA, 9876 nt, Mus musculus
cuacuacagagaauaguuuuuuauuuuuggagcagaggcugagcuggccacagugggccugggguucccacucccucauguccaagaggccagcuuggcacuuccagccucggugcgaggagaggaguguuuccccaaggagggcucgagaacagccggcuccagcggcuuccacagugggccuucuguaggauccacaggagucaagaccugaggccagguccaagugcaggcucccuucccgucacagccuucgagccuuccggggucggcagccauugugugggaccgggguguugucugugauugagaucacuuccagaccccccauggucaguccuuugauggcagacuggaaagaucagaaauaggcaaaaggcacaggcuucaaaaugaugaccgccaucgucaggcagggcucgagaaggauggaagcucacuguugaugucuacgguuccagcccccugccuccaccuuguguuuuacagucuggaaagagguucuaucuaugcacucugguagcuuuacaggaguguuuucuucuccugggacacacacacucacaccccaacaucucguucuuuuaaagucagagagaugucauuuguuggaggaagcucuagccccacuggucucagaaucccucucaaggugcccagcgccuugacccuucuccaucgcauucacugucugugcugaggacuugcuugagauggucccccagagacuacuuuuccauccaaggggcugggacccaagaagguaauaaauuaauccaugacccaggcuugcucugcggggauuagcagaucacaggaacagaaaggaacuuuaaacaauaccaugucacucacuaagggacauuucuaucucuauaccugacucugaagaacaggugugcacguguaugcacacgcgcgugcgcacacacacauacacagacacacagauacagacauacauauacauacacacacacacagacacacagauacacacagacauacauacacagacccccccccccccccaggagaaccgcuaguaacuuacccagcguccuggccccaugccuuucacuacgacucugaugugggucacucccuuuccuguggcuuucuggagagaggcaagugucaaugccccugagacagugcugcagcccagucucuggcuacuguccccaggacucaugggauaagggcaaugacagaagcaaacagugaggcagaagacacagagggaguuaaggccuaguggacaaggguagaugcuagugaacagagccaaggaacgaaggugacaggacugcacugccaucuaauggacacuuguagauauugccugguuuuccuccaaaugcugaggugucaccauggauaucaaggucgggcccacuuagacagugggauuuaguuucuuuacaguuaaguauguguccagauuaggaacacauucacuacagguccuggaagauacucaagagcuaccacucagaggcccccaaacacuggcaugugcugcuuagccgacuaugcuccgucugauggucugaugggcaauuacaucguucugugcuuuggugaucacuacucauagcagucaaagauugccuuacgucuagcuuaaaggucaagguguuccuucaggaaguauccugcuugucagagugcacacaucuguggucuuugcuauaccagaaaacacgcagcucuggcucaaggcccaucuggguucacaucagagagcucaacuggcucccugacucugaccaauccccagcauccgagucucuugaaagaguggcuaauagcaggcucuucugaagacaggguacuaaugaagugucugaaauggagcugccugauuugcuucuagaaagaucuaugacgucauuuugggacccgugcuauaagacaugcuuccugaauagaauacagcccaguggucuuucauggagggaguguugguuccuaagccuucagcucucugcuuauuccucugaacauaaaugacaucuuucuucuccacugaagcugagagagaaaguugguaaccuuucuacaaaggccucuuaaagcagcggcagugucagggcaucuaacaggggugggcaaagaucagaggcccccaaacacuggcaugugcugguuuccgaaucugguuuaaugagacuuccccacuguaagccacaaggaaaguggagccacguagucagguacuuacugcugcggcagcuaugccugcugucugugcggcgaugccggugcccuucuuggcauugcgaaagccuucugugccacaggaggcgcgggccagggacgcauugguggcagagacuaccuggaucugugugcugggaaaaggaggcacacagaucuaguacugcucaggaaggaagggagcuugcuaaaguccuuaggagccacagugagaaagaaaaggucauuagcuuccuccgcuaaaggaagaugggcaaaucacacacuuagggggagugccauaauccaagggcaggagagcgucacccaacaggggagcgucacccgaaggaaccacuuccuccugaaugaagccuucccuggggcagcauuuucccugaugugacaucgcuugguguuuuauaaaaaccuacaugcguugcauuaggcaacuguuaaaaagacaaugcugagaaaauucgaguaucuuccacuacaacaauguaaagaagagugugugagggauggcuuacaggugcacccacacggugggaagagagaauuugugcaaauuguucucugaccaccucauguuuaugaucacuccugacaacuaaguaaacauguaauaagguaauuuaaaaaaguuuaugaauaaaugccagagaccuguuaccucauucugcuccaacaaugaccgucacauccaaauacagugucuccucuaaacccgcuacaugcccucauccaugggcuguuuugaagcgaaucuaguaucuaucauuucagagguaaccauaaagacucaaaauaaucccacaaaaccaguuauccuauaauauuauuauaauucaaaugcuuaugacauucuauucucugaccaaaaauuauuuuaaguaagugaagcuuuuuccuaauuugcuuuaaaaugguaaauuguaauuaagacugacuuuaagcugggcagugauagugcacaccuuuaaucccagcacuugggaggcagaggcagauggauuucuaaguuugaggccagccuggucuacagagugaguuuuaggacagcccggcuacacagagaaacccugucuagaaaacacccaccccccaagacugacuuuaagcaaauucuaaggcauguuuucugucuccccuuugguuaucaucaccccacuuucugcagagcuuucuggguguuccugggaaggggaaagugaaggggagcuguccaggagaccugcugggucagcccugagcagggaccaccugccuguuggucuuguuauggaguucacuccuccccuggggucgcuuacacuucaggagcuacacagaagcauucucauucagggcguacugaaaaggcacagacacagcaggguguggagagcucagaagccacgucugcauuagcucacgagaagggagagagaugcugcuguaggcucuguggcucuugggugcucgcauucuaggccaggauuaucgucuccagugcugugcugcaacuguguggcaggcaggaugccaccaaacucagaucccacuuucaaguaggaccuagccugcaaagcugucgccagugcccuaugcuucugcagcugggagcccaacugcaccugugucuugugcuagcaccccacagcacacaguagucuuuccuucaccgccacacuuagcccugcuagggaaagggcagugcacagggccuaagguaagaaggcuaacuaaggggcuuauacauucuggcuacuuuacaaguaaaucauguaucugagcacugcuucucucuccacuugcuucgaaugcagcccuucugaugcuagcauaggagucccaaggacggcagaaacccuuacaauuacacuguacucaaucuauuuuauaguuucaugaaacuugaguaagcuuauaaagaaagaagagacgaagcuagcaucugacacccgacuucuacuccaagaaggccugaggcagaagcaguuccuaggggacucacgcgggcacccuuuucuuacuuguuguagguugcuuuaaugugugcaauugggacguccucaaacuucaucccugcccacugcagagagcucuccuguccuggaaccggaggguaaaggcugcaaucagaagaaacauuuucuuuaauuuccugauuguuaguucuuuaaaucaaaggaaauacauacaugcuauaaaauaaaauaaaauaaaauaguugaauacugugagccaagcaagguggagggcaggguggaaggcugaauucaagguuaacagggauacguacagcuuaggauauaccguaagacugcccagccucuguuaucuaccaccacaaaaggccucaaaccucccacaccauccuucccccaacacacacaccagaucaaaaaagcgcugacaaaccccuggcucuggaggaggcgcucugcuccuguuacgggucaaaccuuauggagacucuaguguuucagcguugggaacacuggccuugacggugugcuggguuacuggguuccccugaggcuggagucuuccuguucagguggagaacucaagucccaaacagaaagagggcuagcgcgcacgaaaagccaggccuugggcccaggggacuggccuugggucuguguucuuuauaaguguaaacacgcacagcacugucauucagcauuucagaugggagucacucggcuguuucauuaugccuacacaccuaaaucagacucagacuuguacucacacacccacacugcauuucuacuaugcugaaaacacgcuaccauucaagcauccccccaccccgccccaucugcuucuguagggauauuuucaaaagcucagcacacugcauugcuuucuguggcccagucuuagcuugacacacagccucugugggcggcuggccuaucagcuucuguacugauaggaaagugucccaguccuguagaugacacuacuguuucagugaccaucauuucuccauggauuccccacccguguugugcaaauacaagugucagucugaguaaaaccaguacaaugcccuuuauauagcaagaucuaaacuaggagccuaagccacuuaaucuagggcauggccaagaucaagacaccccagccaggagagcaaccaugaguuuaagaccagcuaugaugacagaguuccuggucauccugggcuacauagcaagagccaaucacaaaacaaaacaagacaagauucucucagguugaagguauacugaguucuucuaaggaaggcucuaagagagauagagcuuucugggacuagucuuucugccuucucucauggcggggagguucauuuaccaauggacuguuuuauuuugagggucucaguauauagcucuagcuggccuggagcucacuauguagaccaggcuaucccccaauacagggaucuacuugcccccgcuuguacuguacuggaaucaaagugugcuccaccaugccuggcuuaauuguaaaaucuuuaaaagugcaaauauaagcaauuaaggaauacugaaaaugggagauccaaucccaaguggucaacccugagguaauauucauacaaguaacauuauacagacugaucagguaauauuuauguaguuaggaauacaccuccgacaauuaaauaaaaaaaaaaaaaagaaagagguuauacauuugagaaggagagagggggauauaaaggaaguauuacaaagagaaaauggaagggggaugauacacuuauauuuaauuuaaaaaaauauuuaaaaugcaaauaaacugcaaacaccauagcuggcucagugucaucuggcacuacuucuaaauagcuacugacuaauucugcuaggucuccaaaagaucugcacuuuuauuucuaaaccuugucuccuuuaaccgucaucuguccuaccuuggcuaugcacuuuuuggggucucaggcagccauuaucauuaccaacgcaugcaucauaacuuuggcuucaagcauuccuggucacccccgccccugaccccuugcuaucuucagggcagcacucugaggagcccgucagauugcugucacuccacauaccucagguacuacuucucuccucacggggacuaaauccuagucucaacuccccugucucucuucacagucuccuggcaaacucccagcccuuguuaaauccaucucucuagauaauuugagucugugcaaacacggcaugguugacuggucucucucuacaccagggcuuuuugacugacauuuuggauuuaacacuucuguggggggcugccuugggaacaguggggugcuugguagcaucucuggcuuuacuucacuggauucuaucuccuaauuuaugaccacuagaacuuuuuagacacugcuaagaaccuggggguggggaggggcaaaaucugacucaaccaagacccagugcuucaucuuaaugaauugccagcaucgagcaggcucucaagaugccugacaaucauccucaauucaguuauccucccacucuccuggaugccucuucuauauuuccuuuugucucuguaaacaucugagcccugccugcuuccucggggccagcugauggccucugcagagaaauagaaucaaucagacuuccuuccagcuuccaccacggaacaucugugcccaaggccuuggaggacucuccugucaucgcgcuccagcugcaucacuagccccacaaggacacugcucuggcaauguucccacuucaguaucagucuuucucugguucccagaagcaaaacauacggucaugucauaaagucaagacaacaagaacaaaacaaauaaacaaacaaacaaaaaaaaaccccaaacaaccccccacccaaaacuccacacauuuuaaaccccaaguuccuaagaacuucucauuuucccuuacagcaaugcuuccuuaaaggaaugacaauacuuguuuauuuucuuugaaacaaugagaaguuauuucugagcucuccaucagaaaggcuguacugaaggucaccaaccaccuccauacuguuaaauccaaugagcaaucaugcuagcugcuugccaccccauccugucugcagugccaaacacggcucgggucccuacuuugcugcaccacacuaaaagggaaaucuugucuggcuuucuuccugucuuggggaggaguuuucuuuugcugguucuuccuccuuccagauauccgucuauauggcaucucuacuccuacucugaugcuaagugucucaaauguuuucuuuuauuauacaugauuacacaaggccuuucgaaagcaagcauaaggcaucuuaaacuuaaccacacagaucucaacucuuagucccugacauuuuaauauauaacaauuccauauuuucaguuguuuggcgcccaguuuugagccuucacaccucuccuuuucucacauuuuauauuaacagaucuguagcuggguguggacagaugccuguaaucccuaagcacccgggagacuaaggacugccgcacauuccaggccagccuagguugcacagcaagacuuugucucaaaacaaaauaaaacacaaaaaccaaaguccgcuggcuaguaaaacuaucacccuauuccagacaccauuauuuuuaccuauauccacugcuuucuaacugcuuucaagucuucucagcuuccauucuugcuccccauggcuucacaucaacacagugguuauagacucccuaaagaguaaggcugaggcuggggcaugcucuaguaauucaggcacccaagaggccaaggcaagaggauugugagucugaggguggccugggcugcacagcaaggccauccuaaaaaugaaugaaugaaugaacgaaugaaugagugagugaaugacauggcaucaacucgucccagaacuggacagauacggcuaugccugauugccugcuuuacuguuggagcagggacagaaccccaacaauccuaguagugucugggauugccaaaugaacggcuacaacgguccuggaucaaauuccaucaguagcuccucguugccugcaggggauaaaguguaaaagcucuagggagacagggcuguccucugccauuuggauccuucuagagcagugguccucaguguucuuaaugcugugacccuuuaauacaguuccuuauacuguggugacccccagccauaaaauuauuuucguugcuacuuccuaacugugauuuugcuacuguuaugaaucguaacguauguauguguguuuucugauggccuuaggaaccccaaagggguugcaacccacagguuccgaaaugccuuucuagaggcaucacaagccaguucugacagccugccuuuccacagacguuacccuugccugccacgaucacaaugaucuuguccagcugagauccuagucacuuccacaguccacgguacuuagucuuuccugaauuccucaagugugccuuacucucuuaaauguccagccaguucuuaccucuauuauccuuuugaucagauuaugguuaauacauuugccuguguguuguuuuugcaaguuguguacuacuucuggggagacauaaccuauauuuccuguauuuauccugguacucaacagguaguaguagcuuuuguaacuguuaaacagaugugaagguaagugaacauauauaccgccugcauauuaaguauuucuacuagugggaugcugcaggaugccaggucccagggcuaggcacgaaauuaagaaaggcacaaucuagaugugcaguuagugugguucuucaagacauuuuauguuggaggcagagaaagcugcuagucggaucuaaagcuuaucucacaaggaaaagaaagcugguauuuauauacauuggacacuuagcuaacaguugcuaauugaacagcuaccuuaugccccugcucaucccucuauuuucccaacaaccccucuaagcauuaucuccacguauagugugcugauuugcacaagcucccacagauggcaaaugacagccaggaauuaacuuuuucuaugauuuuggacggugucgggcagaagucacaggaugcaacuuuccagagcgcugcauccacuuacccucaccugaagcgacuuggagccgcuucccuuucaguguucugccuggcagcugagucuucuaaucucggggcuccgguguggauauucuuagcuggggcaaugcccacaaaccuggggggcaaaaaaagagagagagagagagaguacgaugagggacuggauuaacgguauuuugggggguucaaguggcacauaggucuggaaggaagguaggcgggcaggcucgagagugacaguggguucgaaagaguaauccuuaccuggucauuccauguccagcccaggaccgcaggagccacgacccggaguuucuuaaaaccugcaugacugaaauugacccuccgcggcgcuuggcuuagcucgagccagcaccaugagccucugugggggugcucacagacaggaaaucaccugauugcucuuaaauaguccuguaaguauuuuuucuucaaauuuaaagcucuauaaaaccauuuauguaggaacuuuccccuuucuaguggucuaacacuagaauuucaccuaccucccccaaagggaaugguucauuccacucgguaaacccg

SEQ ID NO: 3885 - RNA, 15297 nt, Mus musculus
aggcgccugauuuauuccggagugagaggagcggacgcaggaacucucgagucccagcaucagagcgcguggaccuuuucccgcgucccgcagcaugcaggucucccgugugcuggccgcgcugugcggcaugcuacucugcgccucuggccucuucgccgcgucuggugagucccucuggccucgccccuguucugcccgccgcucggaaguucucagcgacgcccucccucuacuccuacuguugacaaacuugagcagagccuggagggggacgcucagggguaggagaggcgaacgugccucugugcucucugcccuggggccuuggggcugugauaaguagcuuuugcacugaguggugacccuggacacccggugacagccuggccuccccccccccccggcccccucagggaugugacuuacacauaacaaaggaauccgcugcgucgugccucuuucuuuuuuaccgcgucuguaaagugaggccaccgaacugugucugcuuuccaauccaaacaauuugggagagucuaggacucuugugcggguacaacucaagcuaacguuaccugaaacucuguccugaacccgccugguuagagaauccaaugaacuuuugugucccacuuguugguguuugaucagauaagggaaggaaugacagaggggucagugcgagagacuggcuuguagguggggcuggucuggaacuuagaaaagggcuuccugcccccggcugaccuuggccagcugcuuuaucuccccuaacccuucuccuccuccuccuccuccuccuccuccuccuccucugcucugagguccccaguagacgucugggcuucuugcgggaugcugcuggagagaguucaucaugaaaaagcagugcccacguggggcagccccuaaauccuuucucauagaaacgggacuggcggcgggacuggagugaucacaggcaggagagaucacagcuguguucugucgcccagcacaggaucugaccucgggguuggagcugaaggcauugggugccccaagcuuccacgaccuggaaacuccuggucuguccacucagcuggaaagaugcuugggucuccucugacccuuuccaccccuccucuuugcccccccccccccaaccugcacccuggccaaauguuccuggagacacuucccagagaaggacccugaaaucccauaggauuuuuagaggagcuggccucuccuggucucauaugcagguggccagccucagucccaacgccacugcuucuggccaccuuccacuuucugauuuccucucugaacccuugguuugguuccuggugcagguguagggaaggcugaaagcggggcccuuguugguauugggugccuaggccuuggccuauccagaaccuccacgugaggcugugacugugcccuuccaggucagaagggauuaaccugcuauuuaaagcaagugacuaauaguucugccacagcgccuuagggcucuugcugaggugaagcugugugggcuggugcucauuaaugguguugccugccuccagcuugggaaccugagcucccgggggagguggggguaggggagggggcuugagcuuucuggagggccuugggugggcagcuguggggaggagaagagaucucuuagguucgaguccagugccgaguuuggggugaagucuaguaguacaaagggcccucuuuggguacagcagaccugggaagcagcuguucacugguuggugccagugucaggguaccugggacagaugggagugaggugagcuucggagccagggugcuuccagucccuguuugggcauggcgacagggugggguuugccagcugcuuggcugagcuguguauuguccaucagaucacaggauaggugaucucagccccagcuuaccccaccccucuuucugucuucuccguucugguugacagugcacaucugucacccaaggcgcccucaaagcuccagugaucucuccaaccuuccuccaucucuucaguucacgauucacagagccucucagauucaccugcucguguuucuucccuuugccccagugugccaaugugcuuccucaucauucagccuggaagcugcaucugcugcaucugcugccgccagaccugcacuucuuaaccugucagccuuguccuacgccuuucagccuucugccauucagacuucagucuggcuugaggggggggggggagauggagacagagacggaggcagagauggagcgaugagagagaaacacacaaacacagagagacagagacagacagacagacagacacacacacagagacagaaacacauaaacugagagggagacagagacagagugagagggagauacacacacacacacacacacacacacacacacaugcucgugcgcgcggugguggggcgugucugagacuugucagccauugccugggaaggcuaaaaaguuauugacagacugcagcauacaaagucuaaacuugucauccuuaaggccccucucauucuggccugaguucagucacaccugaaccauucccgaacgugccauguccucagugugucugcuucucucuagaauauuauuuucuagucccuugucaucagcuuuaaauaaaauguauuugcuuuauugucuauauaugugugugaggguuuucugccagagcaauaagugcucuuaaucgcugagccaucucucuagccgauuuuaagauuuguuuuaucuauuuuuuauuuuuauuuuuaaagauagauuuauuuguuuguuuguuuguuuguuuauuuauuuuuuaauguaugugauaguacacugucacucuccuuagacauaccagaagagggcauuggaucccuuuacaggugguugugagccaccaugugguugcugggaauugaacucaggaccucuggaacugcucuggaagagcaguuagugcaccuaaccacugagccaucucuccagcccuguguuuguuugcguuuuguuuuguuuuuacaaauuauguauacauaucucugugugggcaagugcaucugaguacaggugccuaggacucugcaaugcuugacacgugcuaccauugagcuauaucccuagucucgaugguuucuugaggauagaauaacagcuaacuucugucucaggggcccagcaugugcacaugguagugggacucuuucuuuucuuuucuuuucuuuuuuuuuuuuuuuuuuuuuuugguagcgggacucuuaagugcuuaccaaaugaucauguuuggucugugguugcaggugacuucugugacuccagccugugccugaacgguggcaccugcuugacgggccaagacaaugacaucuacugccucugcccugaaggcuucacaggccuugugugcaaugagacugagagagguaccugcuccccauggccugccuccccugucucuuccaaguggguagcccuuguuccaaugauuucaguaugugggcaaacugauccuuucagagacccucuuggguccaggauggugguggcggggaagaaaagagacucauuuggauggaucgcuggaggcugggucacgugcugcccuuugcuguguucccagcccuuuuuagaccaccucuucaucugaugugucuccucgcuuucaggaccaugcuccccaaacccuugcuacaaugaugccaaaugucuggugacuuuggacacacagcguggggacaucuucaccgaauacaucugccagugcccugugggcuacucgggcauccacugugaaaccgguaagcacuggggggccuguugcugggcacaggcacuugcagggaggcugccucuguggagaccgaggaaugggcagaguucagagagcgugucauugucccguaccaggcuucacaccuagcuuuuucucuugggacuucaggccaggccugguguuguggggaaugagaguguggggaccgaggucaugggaaugccauguccuggagauauacaaugucagaguuaagucuugggacucuguucacccccaagaagaaacagguaugcuguuuaacuuggagccaagaccagcucacaggggucagggaggagggggagggaggcuguguuguccugugcuauaggaaggcuagaagccugguauauagggaggagcugaccugucugaccuguuuggcuaucuccugggcuccagagggcccugggugagcaccagcuaacauugcuggugauaguucaacaugcugcccccaacucugcccuaagcagcauagcagggcuuuucuugcccugugucacaugggaagggcuguguucagauaagggagggaggaaggugugugugugugugugugugugugugugugugugugagugagggguccaguuuucagcucucuaggucaggaaguggacauccuggggacuauagaagaaggagccagcugggucgacuacaugugggcugggccccaggaugggagaauauaggcagagucccugggauggcccugacuuaaggagacagagcaaaggccuggucuuugaaggcuggaccaaagccagaugagcuuaagaucuguagggggaggauaggggagcuccugauugcuaaggcagguggaaggcuggguggagccaggcaagccugcuaauuaccgaguggagccgggcuaaccaugguguaucugggugugaauuagcuacgcagccuucucugggcugccaggucuagaguuggcucuaggcuggauuguggcaccuggaacagaggguagguggugcccacacaggcugcaggagugaggggggcagagggacugcacucuucuuguuacacuguuucuggugccaaugccaaggcugcaccuuugggucccuuggggugugaagaugguagguaugaggcaucagcuggcugaccuggcccagaucuuggacguccagcuccaguugacaucuuaccaucucuguaagauugguagcagcugcucgggacgagccuucacuacuagaguccuguagguuauuccugguagcagaagccuggguacccgcuguagguuuucagagggauggaaagguccucuugccaacaggcuugauggauauccugaguuucugguaucacguuacugguuacacaaaggugauggggcuguggcuggggacgugcuaacauacguauggguggguggguaaggacuugguggucaaaggugcaaaggauccagaagagagcagagugcuccuuacacucuccucagaaagcugcugagggggauucuacaaaguaccauggagaggcaggugcgaugccaaaagccucuaauuggggccaaggcaggagaacucacagguccaaggcuagcaugggcaacugggagugucccugucucaaagcaguaaggacuggggauguagcucaaugguagaagccucaccuagcuuguucaaguuuaguccccaguacuacacacgcgcuaagaagaugacgaaaagccugcuuuguguggaguuaccuucgcuguuccguacuguccaaggccacucugcucccaaagccacuccuccugggcgagccagggcuagggauguggaagaagaggucauccugcuuuucucuccuaccagagaccaacuacuacaaccuggauggagaauacauguucaccacagccguccccaauacugccguccccaccccggcccccacccccgaucuuuccaacaaccuagccucccgugaguuaacucugcuggcuccuugucucccgugucucccgugaugucuucucuuccaucugcugucggugucccuugguguuaucugcucugagugagggucugagguucucucugucucuagguccucaucagaggccacguuguuuuuucuccucuugucccguggacauaaccgggccguggaacuuuggauuaggcucccgauggucacugucucccugcagguuguucuacacagcugggcauggaagggggcgccauugcugauucacagauuuccgccucgucuguguauauggguuucaugggcuugcagcgcuggggcccggagcuggcucgucuguaccgcacagggaucgucaaugccuggacagccagcaacuaugauagcaagcccuggauccagguaggaaagaacauaggguagggugauagggaacacaaagagaggugaccacgagugaugugucuauauauggagggcagccuugggccuggagccagugggcaaauuaugagaggagauggccuuugauaaaggggcuuuggcacccauaggccucuuggggucuuggaacuugggcuuuucagagcguaggcuccagaaccucgggagaaaaaccagccccuuggagaaagaacccagugagcuagcccguuggguuugguugggaggaacuugaugaugaggagacccaucuuucuugccucgggguccaggugaaccuucugcggaagaugcggguaucaggugugaugacgcagggugccagccgugccgggagggcggaguaccugaagaccuucaagguggcuuacagccucgacggacgcaaguuugaguucauccaggaugaaagcgguggagacaaggugggucuaaggagaggagucuaaagucaggaccccuaaaagucuagcacugauugagaagcaagagaagccugagugguaggguuggggugaaucucccagugucccuugguauguagacauggauagaccuugaucauguugauguucugugguugcaggaugcagucucacccgauagaggcucagaguaguagugcccugcccuggaagcgguggugguugugguagauuugggcuccauucugaacauuucagggcuacaguguacaguugugaagguguaauuaacaaagugggcaccguuuacagcacagauaccacacaguucuguacugcuguuuucauaaagucuuuggaggauguacacagagagaggcccucuagagagccccacgugagcuggaguuuaugcccaggcccugcgaugaccaagaagaaggugacagggacacuguucugaugguggugguggacagucaaagccagggcugcaggcucagucuaugugggcucgguggaggcuguucuuccacccacugauggccucucaggcacgaaggggaagaggcaaacgcgcuuccuccuccagcccucccccuucucuucuaggaguuuuuggguaaccuggacaacaacagccugaagguuaacauguucaacccgacucuggaggcacaguacauaaagcuguacccuguuucgugccaccgcggcugcacccuccgcuucgagcuccugggcugugaguugcacggugaguccgagaugaagcuuccucugauguugugagcugcucaggggcuaccguggagacugaccccuugcgucccgccugggaguuccaguuaugugcugucugccaugccaguccauugcucugggcauuuuggauggucauuucacaucucaguauuucugcuuauuuugguuccuggugcuucuagaauaggcagugaauucuaccacugcagggggauugucuguuuucuuuguugcuguguucccagggccucaaacacgugggugcuuaguaaaucuuugaugagggaugaaugaaugaauggauggaaggacaccuggcugcauuauucauccgagauacccagccgggaggugcaagcauagagcuuucccugcgucugccaccugcguugugucagcaugcaggugcuucuaggacuaucgagcuuggaguuuggugcuucuacagacagggggacuagaaagggacagauuugcugcugaaccagggagauuacucucugaaguggaccuucugaccaauccugccaucuaguuaaagccccacugucucuuuugaggcugguuucucuuugcagccauggcgccaccugcuggccacaugggguaacuacagggcuggcucugcuggacuggagagcucgccccagacccgcuggaagccagaauacuuggaauagucgguugugccuucuuucccuucaauggcacuguuuccuguuucugcauuuuagauaccaccuagagcugaguuuugggucucacuguuuuuuuccccccuuaagugcuagcgacucagggguuugugaauacuagccauaggugccacuacugagccacacccaagccccggucuauuuuguuuuguuuugguuuugagauaggaucgcucuacauagcccuggcuguccugagauucacuguguagacuaggcuguccuugugccuuugucucccgagugcugggauuaaaggcauaugucaucaagccuacucccuucccuuuuaaaaguauagaguuaagccaguaagaagucaaacuuggcccuugugcucaagaagccaauugaaacaacuaaauuaauggucaaacgugggaauauggacauauaagggaagauggacacagauccaguagucucuucaaguccaucuuugggguccugaacuguguugaaaguuuaaguagagggccagggacacgcaugucuaagcaguccugaguuguugucccgcccacugcugacucaucauugccugggcuucugucucauccuggucuggcaaguuguuagaauguauaaaaccuucagggaggcagguucccccuucuccaggcacgggauuccuggguauauuugcaucuguuggcagccauuguuucaguagucugauaaucagagagagagacacacaaguaucuuuuagaauauugauuuuugccaggaagguuauccugcucccagggccauugccuuuugcuucaugugacuccuuaucuggcaaaggacagaacucagucugguuuggccacugcucccuggggucacccagccuucacugcuggcuugaggccucugguucucuuaaguugccaggauaguguaguccugagugauuuaaaucuugggguggggcaaucugagagucauaacagagaaugaagagcugugcccucugccuccuucccaccuuucucuguaauccaggcuguuagcuggagagugaugaugcaaaugugugugugugugugucugugugugugugucugugugucugugcacuguacaugugagugggugaggcccagguguccugggaguucacaaggcuucccagaccaggguuguuauuuuuagcagacagugucuuggguaaauuaacuguuuaauuuagacaguuacuaaguuuccccuaaauacuuagaucccaggaaagaacaagugagaccuuugaccucaugaaacuuuuacuuuuguucucucuagggagucagaggugagauuagcaaaugaaaggaaaggaagggggcgggcaagauggcugaguaguucaaagcaccugcugcuguaccagaggacuuggguugguuuuuagcgcccacaucagguggcucacaaccacgaggaaggacaguucggguggucccagugcucucuucuggccuccauguacugcacacaugcagugcuucuacagcaacccaggcuaacacacagauaaauagauacggugccuaaacucucaggcgcauauuauaaagaagagaaaagaagaaaggccagcuagcagccagaagucugaaggaggaagugauggggucgcggggagcaguguguguguguguguguguguguguguguguguguguguguaggauucuucagcugaagagccagucccaggaagaucuuagaaagaguaugcuagguagagacuugcaaggacaaagguccuggggcuuguugaaggauaagaaugucucuggggcugcauccuagagugugcagggaggcuuggagaguggugagcuccauggaccaacucucucagcaucuuccagcucuacucuggagcugcuggggcagaauuuuuaauuuaguuuaauuuccaguucugguggguuuuaaaaaaauauguauguauguauguauguauguauguauguauguauguauguguaugagugcucugucugcaugcaccccuacaagauagaagaggacagcagaucccauuacagaugguugugagccgccgugugguugcuggaaauugaacucaggacuucuggaagagcagcuagugcucuuaaccgcugagccccccaguucuagugauuuuacccagggcagguacucugucacugagcuaaaucuccagagugugucucuuuaauuuuuaagagauaggguuuugcuauacaguccaaaucaccaaagacacugucugcuaaaaauaacaacccugucugggggcauuuauggccuccaggacaccagggccucaccccagguuggccugaucgugcaauucuuccgccucaaccugcuaggaucacaggaagguacaccaugccuggccagcuuguuuauaagcucugccaugucuguggagagcuacagagggucucacuucacagaggagggaggaguuggcccccagagaggcaaggacuugugcaugcauauccugaggucauggucucuaguuugccuucucugggaggcucaugacaggggacagggaugguuguaaagggucccacuccuaggagaugaggauaaugaguaaugucugcaaaguagucccaggguaguggcugccucagcaugucccuguccugggcccaaaggaugaacgagcucacagcccaggaaccucuuuggaagcagaaugaugucuagccuuuuguauuggauagcucagccgcaccuucagcgaguuugggaggcaggcauuugggggacacacuucccaggugaaaaugugacucuucauccccucugccccacccacucuucugcuuuucuggggauggggguggggaugcgguaggguaugagagacucgaauuauccgcccaggaguuuuccuuucuaccuagcauuaccuguucauccaggagcccuaugagugcaaacuugucggccauuccugagagugagccuggaggcagagggcagggacaaaggcuauucucaggguguacagcccggcaugccagaaauguuggggugagccaaggcccucuuaaggaaugcucucgggaagggcacagaagcaacccccaaacuccaggaaucccugggcuucaguagccuguaaccccuggaggguagggaugcuugcuauacauugcuggauggccagggcuuuacaggucccagcaugggggaugaugucauaucggugugucggucaggaucaggucuauugagauguggauacaaccucucugugguugugggcaacaucucucugccuccguuuucucauguauaggaugggguugcugaaagcuacuuauuuguucaguguguucugugacuaaaguaagucuaugauaccaggaaacacccaguugugugaggugaccugagggaagggagggagugcuaggaguagucuggccaugugggucagggggucuuggugguccucuaggugcaaguugggauggggugggguuggagcugaguccagcugacuguagugaagagacaauggagagcaagcaaggcuaagagagcacuuggucuuggaaggcagauaggaaguccaagaggaugcuaaguugggcaucauggccuacauccagauguuaggaagcugaggcuggaggaucuucuaauagguuuuuuuucccccugagacuggguucucuguguagcccuggauguuccugaaaacuggaggaucucuugagcccaggaguucaaaggcuaguuuuggugacacagcuagauccagcucaaaaaacaaaagcugaguugucacucgguugguaagagugacagaagccguggguucggcauucagcgccacauaaccuaggugugggggugcaugguuguaauuccuucacuccggcaguggaggcaaggaccagauguccaaggucauccuugauggcauagugaguuuaagucagccugggcaacauaaaauacuaccucaaaaaucaaaccgaaccaaacccuaaaccaaaauaaaagccguuuaggaaccacagccguuucuccuuuaucgucuuguaccuacacauacuggugacagccccuuuugcccacaggauguucugagccccugggccugaagaauaacacaauuccugacagccagaugucagccuccagcagcuacaagacauggaaccugcgugcuuuuggcugguacccccacuugggaaggcuggauaaucagggcaagaucaaugccuggacggcucagagcaacagugccaaggaauggcugcaggugagagcggugggaucugugagccugcccagcccugucugcucuccaagggaucuccugaaaagccuugguuuucuuuguuucuuuuucuuuuaaccaggccaccccuuuucucuugauccugcuuugguaugcuuacacacacacacacacauacacacacacacacacacacacacucacacacguacaugaacaugaacaugaacaugcacacacacauacacacacacacacaugcacauacacauacacacauacucacaggcacauacacauauacaucuacacaauacacauacacacccacucacacacacauacacacacuuacagacacaaacacacauacaacuacauacacauacauacacacacacacucacacauauacauacauauguacauacacacacacucacacauacaccuacacuuacuuacacacacaugcacacauacauacucacacguacacacacucacagacacacauaaacacucacacacacauauauauauauuuacacacacauauuuacacacacauacacacacacacacacacacacacacacacacacacacacacacacacucgggaguaggaccaccccaucagcugccacagagugucaaggcuugccugugggcagcagggcaggauggcagagggcacucuaggacuaaaccacuucagcaaagcacauguguucgcccgcucaguguaacugggaaaucucaggagagaauggagaaugcagauggggaaacugaguccuggaagauuguguggugcuuaccugcugguugugggugagcugagcuuauagccuagaucuggggacugccugucuaggggucaguuucaaggauagggcaaggacaaaccugggcuggaggugcucagucggaguugaguucaucaagagccaccugcuccaggcagccugacagguuucagaagcaauucucacucauauaggcuguggugucuuggccuguccaucauaccccaacauacaucugaugcaggagcuggcagggucggccaaggccuggaacuucugaaaugcacuucaccgagcuuuaccgugcuggaguucgugggugucaaagugcauuauuuaugugucuuuauuuuuuccuucacauuggagauagaacucuggguuuugggcauuccagaccagugcugugccacugaacuauauauucuguucuugguauuuugagacaggguguugcuauguagccaggcuggacuuccucuccauucucagccucccgaguuauaggguuuuaggugagccaccauacauggcuuuaugcucauuuuauggaagagugucuuagaguuacuauugcagggaugaaacaccaugaccaaaaaggaguuggggaggaaaaggcuuauucagcuuacacuuccauaucacuguucaucauugaagggagucagggcaggaacucaaauggggcaggagccuggaggcaggagcugaugcugaggcccuggaggaaugcugcuuauuggcuugcuccacauggcuugcucggcugcuuucuuauagaacucagggcuaccagcccagggauggcuccacccacaguagucugggcccucccccacaaaucaccaauugagaaaaugcuuacagcugaaccuuauagagaggcauuuuuuuuucucacuugagggucccuccuuucagauaacucuagcuugugucaaguugacauaggacuagccagcacaaggaggaaaugcgcuagcaggccauccccagugugucugucuuuacaccuucuugaagaaggcuccaagcuagaacaauguuguuuuuuccuguagguugaccugggcacucagaggcaagugacaggaaucaucacccagggggcccgugacuuuggccacauccaguauguggcguccuacaagguagcccacagugaugauggugugcaguggacuguauaugaggagcaaggaagcagcaaggugggugucuguccggcuacaauuccugggauacuguggguuucugaugggugggggagguggccgacuguggagcacuacuccugacacuccagugguuuccaggucuuccagggcaacuuggacaacaacucccacaagaagaacaucuucgagaaacccuucauggcucgcuacgugcguguccuuccaguguccuggcauaaccgcaucacccugcgccuggagcugcugggcuguuaaugcucaguccugccagcccaaacgaugaggauggccagaggcugaggggccuccuggcccugccucccaggcccugcugccuucuguggcugacgaccuucuuggccuucccuucugauuguacuggggcuggaggcaggaagggccaggggauuucagaguugcccuucacccuuucccucacccugcagcccccacaggccuccugcuagcccccuucucucaggcauucugggggaguuggacaggucugagaugaauagagaagaagagugaaguugggguaugugggcuaucuguaccaaccaccccaaguccuaaacuuccugccagggcuugacucaggacugaagggagccccugacugcccaucccucucugcacaccacacauuccuccauguuccauuccgggaaggagaggcccacguccgcuugcugucccuugggucaccagguccugccucuuaucuccugagacgccucuugacccuugcacuggagccucaguugacaaggagacuggcgggucuggagaggucgguggcucugggugguugacagguuggcugugggaccucugcuggcuugcuacccaaguuaacaagcagauuccaaaauacauucguguucuccacuggaccc

SEQ ID NO: 3886 - RNA, 1344 nt, Mus musculus
cgggcaauucuccuauaauugguuacuuuugaugucuuuagccagugggccuagaugcuauuggguaagguccuccccgaggggcgggauaaggggagccggcuaaaggauggguuauguuugaugguugaugauacggaguagaggagagggccuauugugauggcuuucugaguucuggggcagaaagguccggagucuuauagagaugaacuggggaaagagauagcccagccgugggguucucagcacuggugugcccaggaagaugaaccuguagcucaggacguagguguuugaaguguggaguccuaacuuaguagagcagagguggugagucacuaaaccagaaagcaagagguggaggcgacaaagagguggaggcagcagccuuugaccucuuucagcuagggaagugggugggaacaugcaggacuuuauggaccuguuacagucccuaugaucuuucagcuuuuaaccagcccuugugguuggaggccacuuggaagaagugaccuuugaagucagacugcagucuuggccgugccuuuuagccuuuuagaguucucacugacuauauuugguaagugcugguugcugauagaagaucaguacagugcgugguguuccacgggcguuuaucaagacuagcuauucaucacucacccucuccauccaugcaccuagacuggguucuaccauucugugaaccugaggcucuguucgcaacggcacgugccugauggagagaauacugacaacccgaaagggagcuccagugaggcagccaccgacacacugccaaggcacgcaguguggcuccaagagaagaggcaggagacagaaggaacacauagccagaggaaggaauuuagauuugaagcaauguuaaauuuucucuuaauacauuuccggaccccgacaaggaaagcaugagccaacucaaggaggaggagccagcaccggucuccuguuuguuauuccagcaggaagcugaggcaggaggauugcuuuacuuugaagcuacauaaugaguccuccucugucacaaugaggccuugucacaaacaaacaaagcaaugugagcaaguagcagccuuugaaggcuacuuagugcggauccagaagucccucuaaaauaucccucagacucccccauuucucauuuugaagguaugggacaccccagaguguggacggaaagacucuuggaacugcauugaaccccagaccuuucaaagcacccauaacugugggacaguagagaggaggagaggcuccauugcucuucgguuuucccccaguugucauguuaccucaauaaaguuucuccucaauauuuau

SEQ ID NO: 3887 - RNA, 17570 nt, Mus musculus
cugaaaugucuuauaucuuuuuacucuuaggccaaaguucuucgugaaaccaagccaaucccuaaccuugucuuugccauugaacaguaugaaaaauuucuuauccaacugucuaaaaaguccaagguaaaaauguucuuuauuuccacucucauuuacugcuggaaggagucuagcaagcucuguggcaggcagcacagcuagagguggucaaggugaaugucaucugguaaaagcaaaggguccuccaaguacacacugaaaggaccuucugcugucccagguaaaccugaugcagcacaugaagcugaguacuucucgggacuucaagaucaaaggcaguguccucgacaugguucuucgagaggaugaggaagacgaaaacgaagagguuggugccuacuucugcuaugcuuuugguauauauuucuaugaaaaguagcagacaaacuccccuguccugggguccuguuucuacagcauucuggcuggcuuuuacacccucccucaagguaggcccauucaucaccugagcccaauguggguuccauuuuaaguuuguaaaagcuagaaauaauaucaguagacaagacccagucaaaauuagacauuuauauaaaauaaucuggcuagccggcugaugcggaguuccguacaucacugugccccaggccgucuguagcugugaugcuccgggcucccagcaucucguccaucuacucaggacggaguucuaagucacaaccugggcagcagacgggaaagcacaacuguuccaggaguuugguguuuguuuuuauucccaucaccuuagaacaagguugucaaaauuucuacucuccccuucuagggcacugcaucagcacauacacagcaggacagagaaccagccaagaagaggaggaagaaaugccugaguuaaugugaccuuuggggcaucugcuucauuugugcccaacaguaccccuugucacacagccugcacugauguugguguccugguucugaacgcacugaauugugccuuccguuaggaggacuuuccugggcagguccugcuacagaaaaauggcugccuuuugcaaaaaagcacaucugaaagccugaguuuaggaaccugcaccgcuccaauaaagcuccacaggagcaaauacagaaccuccagacagagcuaggguccaggcuggcuucguuuuuccaaggagccuuuggugaguucaauuaucugguaaauauccagugcuucaccuguaagacgguggaaauugguuaggaugccuccagaauugugacugaacucagaaaugagaaucugaauguuggggucaaagacagugggugugagggagucuuugagaguggcagcuugucuuauuauaacacaagcuuucuaaccaacucuggcauuuucagcacagauacauuuuuuccacauaagaaugcacuuuggcuuauacaauaaaacuuuaaacauuucugguguaguuuugaaaaugggucagcguacauggaacauuugaaauucuaacaucuucauuuacuaugagccacccucugcaacaguucccuuugugauuugaauaucauauucauuuuagaauacugcauaaguuaaaugcauguuucuugccgagagccccgagguucuaagcuacuucccauucuacauguagagggaacaaagagugcacucacccugggggaucccauaucuccuuuccaucccaguuggguuagaaggaguuuuacaguccauggucacuuccuuccugaggcacuggucaaugucuacugcacugaaaaaggcgacugacuggggcagaucauucagacccagcuuauaggcaaacaugcaccugaaagaaaccaagucuucccucaccgccaugcccugcugugaagauaggcuccucacuccaugaggaaugacagagcagcguuucuccuauuucaaucacuugcucuuagcaaaaccaugagacuggaggcuauaccgccuaauaccucugagauacugagauacaauuagggacucaacacacuuuucuuauugauacuuaaaaaauaaaaauaaaaaaagaaauugaacccaaauaugagaaauaaauauguacuuuuaaacacaaccauccccaaguccaggagauaggagagcacggguaaugauguugcacuuuaagcuuguuauccauccauuaucaggcuagcucaugguacucaaauagguucugacuggcagaucaacagggaauaguaacaauaacuuacaugagcuagguuuuuaguauaaauaaauacaauucaacaggugugguggcacacaccuuuauuuagucccaccacuuggggaggcagaguggugaaccugagugaauucagguggaucuccaaguucaaggccagccuggucuauauaguguucuaggacaucgaggacuacauagaaagacccuguuucaaaagaaaaaacaaaaacccagaacacccgaaacaaagacacuacauguuuucuaaguugcauuuguauuuccucuugaaugucuccacacugacuccaggcauacaauacuaauccaggggagcaauaacacgccagagcccgugaccuggccacgaggaugauucaguaucgcaacaugccacuuucagacuaacguuaagguccuuuuuaggacuucuaucaacuuuaaaaauaaaaaggcugaaccagucaguucucagugagcucagugagcccuaagacccaacauaccuggucaggagauuggugaucugcagugccagggcggcacgguagcgguccuccucacgcaccagguagcgaaccucgucguggaugcugaugcagaagcgcccaucaauggcaaauuccucaaacagccacuucauggccacaagcaugagauguaaguagucuacagcagagcucuguaccacccaguucacacgacugguuauaaacuagagauacagggacaucagugagccacucaccaucuaccucucggccaggaacccugccucccagccccaccuucucaccacacucuauggcggcaagacaccucaccucucccuggacaacugagggcuccaaggcucugcugaugcagcagcccaguacugggguacgugguguaucagacauggcaauacucuccagcuuauuaaacauuucugacucugugcccccuguccaugcucguucagaggcuaccucccacuucuuccaucgugaccugggggaacaaagacccccuuggucagcccuuugggaccccacaaguccccgcaucuucaccacacaaggcucucacuuccuugaagcuucucuucggaucauucgaagaucuuguagggagacccagccguccucuguccuguccacaggaagauucaacuguuucaccagccacucaccauccgcagacagccgauaccuggggguaguagcagcaccaugucaucccauuauaugaccuccucuguggcacagacucacuggggauggcaacuaggaagacgccaacacagaaacacaggcuuuuguguccccaaagaccuaggcuguaucauguuaacucagugaugggcagacagucccagugcccaaugaccaacaacagccuuuuauuaguucaagggaccccugaaggggagaaggggccuggaggaaccaaaaacaugucagccaagcccaacuucuuaacuccuacuguuccagacucucagcauuccucggggcuccagaccaugucaccuauugcaagggacaucaggacauccccacaauuuaggccuucaauucaaauucuugugauguuuuuguucucugucaaaagugaauaugcugagugguuucuaucaagcugacaaaaacccagggccaacugagagaaugccucauugcacucaccuacaggcagaucuguagggcugugugugugggauuagagagugaugagggagggcgcagccuacugugggagacuccaggcagguaaucccagaguaugccagaaagcaggcuuagcaagccaguauauauuauuccuccauggucucuacacuugaguuucucucagugauacgaaaccuaaggguuguuaggauuaaauaaacuuuccucccaaaauugcuuuuggucgugguguuacccucagaaauagaaaccuaacuaagguuuccacagucaaucagcuacccaaauggggacacuucacgguauaccuaauuuaaaacaaaacaaaacaaagacacuucacaguauaccuaauuuuuaacaaaccaaaaaaagggcuggagagaugguucagcaguuaagaacacugacugcucuaccagagguccugaguucaauucccaggaaccacaugguagcucacaagcaucuguaaugggaucugaugcccucuucuggugugucugaagacaauaacagugaauaacauacaugaaauaaaucuuuaaaaaaaaaaaaaaaggcugccaauguagugccaccucuccucccuugcacuuggccuugagcacaccucguggagcacugcugaaggagggccugcacucaggcuuugcauauuucugcuccuucagcgccugucuaucugcuuacuuuuguuccuacagcaaugagcacaggaccccuaaccuccugcggguguuacauaaggaaggagguugggccuguguuauaaauaaccacugaugacaacauacccuaaguacaguuuuacccugugaaggaaaaacuaacacuauaaagacaauguuacaacucuaaagauaaaagauaaaccaucccgcagcuagguuuagagggacagcacucaagugacagcccagagauggaagagagcuguaaagcaggccugugguccugggaugcuaaugugggcggaaaagggacccucaccggcgcaggccuuuugugacugcauacaucugcugggccuucucagcugccuccugccuugugagccugugguugaacugcaucaguaggcgcucagcaaaggacugcccagccccauagaugcggccauaguugaagauuuuggcaugcucucggcugaugcccacaguggcagcugucuugcugugcagaucagugccucugcucuuccugcccugcagagucauccagccaaaggccgugcagccuggagaacagacaucagcgagaagcucagacacuuggcccauccuccuuggccaagcaaggguccugucgccucaccccugcuuaccaugcaucccagcaaagugagcaucuccaaguacagcugcgauccacaguuccugugaguccacaucagcacccacaaggacauagccagguggagccugcaccauggcuuucaacucacugccuacccggucaggcugcaggaagagugggaucaggaccaccuagaagcccaaggcaucugcuacccuggauuucuaggcccagugcugacuaagugcugguauuucuccugaggaaagacuuuggagaaugccacacagccccgauccagcuagaagaugaagaauccuaugaaacuguacaccagaccccacugaccuggaucaucuaaacuaugacagcuguggccacuaugccuagaauugucuagucagcagcagguaccuaaaacacauuugcuaaaggaauggaugacgugaagccagauuugagcccucuguagcccagagaacuuucuuucucauaccccugacuaaaacuccaaaggcucugagaucguuuccaaagaccugaaagaggaagaagagaauccaggaacagagaggacauauacccgagcauuacuggcagugagccacgugggcuccacagcucgacgggugauggugccagcagucaccaccugggguaggauggccccauaguggccuuccucaucgaagcuggggugccuggaauagggagaagcaaagaagugucagcaggcuuguucuagcccuaagacccacaccacucagcucucuaucucacaagcacccaguauaccauaccuggucacaacccggggcagagcugaccuggggagccauaccaccaucugggaacuguaggacaagaaggcuagcucagcacggcauaauguacgccaaugcacugucaccagcauuuugcagccccaucaguuucagggaugcuauguggcccuugaagccuggcaucaacacuucuuacuaaccuuacucagggugggcucuggaucccaacagaagaaucaggguagaauguaccaauccccucacagaggccuugugaucauaaccaucuuggaaaugaccuuugagauaaauccauuugccacgacagacaguuucagcucucaaugccuaauauagguuucagauaaccagcccuccaaggucuuuauccacaaaccauggaguuggggacagccaaaauccuuccauguaaacacaaaguccuccuuacauaaacagagaaaucaagcccaagacccaugucaccaggaccaacacuaagcucuccaucuaggcugcccucuggaguagugcaggcaagucaccaaugccagagcagaacuggaggaaaggaagcucgggcccacagaugccugacagacauacagacaggccuccuguaaccccacuuuggccuaccugauacguuuaugagcauuccuccaaaaagaaaucauuuuauuuauuuccagggcacgaggcccacuggcaccuccugggccagccugcagggugccauccuccaucuugggcaggaaaucuuuggcaaagggacugcccacauuguaguuguuaccguccuguggaggacaaagaaaggguugggacagguagcacagcaccagguaggaaacggacacggacacugggccuucucccaacagaaccuaaaaccuccagcagcuggggcaguucccaccagguauccugcauaucuuuaagugcacauacaagaaugcuaugaucagacaaagcuaguaacaacagcccacggaagcuaccagaugacagauacaauguuacacacuugauauaugucagguaaccccaccaggaugccucucaccacucaauuuucaauagaaaaucaaaagcaauaagacaugaaaauugcccuaaaucauaugauuuaggagccucuaugacugucaaucccacaaaaagcaguuuccuggucugaguaagcaugaaguccuacugugggucagaaucacagugagaacaugaggcagccacaaaccauaccuugugaggcagcuugaaaaaccagcaaccagggauauucacaucauuauaagguccguugccauggugauacgugggcuggcuggauuugggggcacaagcagcaggcuguggggccacacacccagaucaggcccugcuccagcaccugcauucagcaagggccagcggguaggggagguggggguggggaaagggccugaaacugagcaggcaaauugcaaagugacaggagagcauggucacagguucccuccuugguccccuacaguuaagaaccacaggggaauagggcagcaucuccaagucucccaaaaccuagugaacucuggugggaagucccaacuguccacuacccacccagagagcccaagcagguaggugucuugcucaccagaacuagagguuggcucagcccugaauucuccaucuuggccucagccucuacgucuaagcagcccaguucuucuaccuagaugggcccaggaaucggggugugagagguaggcagcuguaggccugaauucaccagccuuucccuccaaagaacucagacuagaccaaucuagggugagcaaccaguggcagcucucauacaaaagguguuccauuuugcuagagagacagacccucacguagcaggcucacagucagagugcauccucaccguuugccacauggcacuacugucagugaguaagaacuccucagccaggucuaccuccuggggcuccaauugcugcuuccccuguucaaggcagugcuuccuguauaaggacucgauggcucugugcagagaaaauaacugcugauuaccaggagcuugcucaggccaggcagcucgcugggguuuucuucugguccuugguuagaucucacaucagcugaggaaggagacaacgauuucuauggcuuuuaauuucucugaauuggggggaacaacccaacugacuucagcacacuggugacaggcuggguuucaauaacuggucugacucaaauucaaguuccucuaugcuugagggcucuggaagcacagcaggggacaugagcacagaaggcuaccugcagagcuagcuccuguccacacccaggugugggcucaguggagcaaggccgugucaguccuuccucugaaaaucugacgcccugugauuccugacacccuguggaaccaggacccugggccaccuucacuaccuugaccucggcauaacaccugucuauccaucaaacacgucagcuugucuuggcugucaguuauaaauguguuugccaggccuggaccuccuguguaugaggacagaguucaaucucuagcaccauaaaguuugaaaauucaaaagaagagagagagagagagaggagagagaagagagaagagagagagaagagagagagagagagagaagagagagagagagagagagaaagccagccacauguaaaaacuccucacacaccuaucaucucaguaguugaaaagcugaggcaaugggcuagauagagggcuggcucagugguuaagagccccgcugcccuuccagaggacacagguucgguucccagcaccuacaaguugguucacaaccaucuauaacuccaguuccaaaguuacacccucuucuaaucuccaccauauaccaggcauauaagugguacacauacggagagucauaaaguagaaaagugaugaugaugaugaugaugauggggaaaaauaaaaaagaaagaaaagcugaggcaguaagauggccuugagguugagagcagccuaggcaacauagugaauccuaggcuagccuaggcuuuggaaugagcccaacucaaagccgaaaaucaaauaaaauaaaagauaaauaaauaaaaguaaaacucuuuucucauugagcugcuuagauacuaagugagguuuucacugcacaacgcucagcagcaugguggcuggcuuguagugagcacucacauuccacucaagaaaagcugcaggcuggcccaccuucccucuguacucgugcaaaggcagccgugcugcugggacaaagaacuagaccccuucccaucagccagaccugaccucggaaaggaagggacgcagccccuuccuccguggagcuggaaccugagucuuaccuguaggggcagguuacugcagcggauucuacaguggggcucacuggcggcucggucagauuaucccgacgcccaggcacuagguagccccaaccaugagagucugaguaguguagaggaaaaccaucccaggucagugccaugagcuuaggagugacccgcauuugcaggcugaggaggcuggggccgggagcccaggcagggucaucuagucgagggcagagcuuccgguaccaccuauuccccacaacagggguuuaaaaaaaaaaaguguuccauuagggagaagggaguaggaagggucucucuuccacgacauaccucagcccaccuccaggccuccaagcguucuggugccucuuguggggggcuucgaaccuauguggcaucuccuagcauuacugaucugugugucucacuggcauccuccagucaaaggcccuuuccaagccucacuguagccucucagcagcagcagagcuuccuuccuacccaucacaacucccacugcugcagacacacagcugucucucacaggcugaucaccagagcugacaccaugaagguauuugcauccaggcucacaagagugcagugagcuaucucacuggucacuauggcugcccuuuuccucaucugucucuaagacaccaaugagcagcaccuccucaaagaaagugccccuuauugccagaggcaggacugaacugccucagacuauacagucuuauuacaggucagcuuccccggcuggucugcacaccacugcuccuggaagagagaugaguuccuuccauuuguguccuugcugcugucacaggcggcaugccugaccgcaacgcacugugccaucagggucagagucaacacaagugagcagaaacggaaggaugaacacacgucaagacaucccaggucccagaccuugcugaggcccaaacaaggagggcccgaggauccuacaagacagccucugugugcuauggagagccagucuuacccaggguguccuggaaggugcuggggucgcuuaggcaggagguccguggugcuccucagcugcuguaaccgguugugggcuguuacacuucgcugaagcuccuccuccucgcugggcgggccaggaucugugcacaauucgggagcuuagaaccagaagggacucacaggucugaaagacuacagcaacccuuuccaaggguccccuggguucuaggucugucccagagaucacccugucccauucccaucuaagcuucccaccuuccugauccaugggauccccaaagggcccagcucccucgaugggcaacuugcuggcugaggcuggcuucuucaccuucuuugccuuuuucugcuuaaacuccugcaaaucccauucuaggucccagagccaagggucuucuuuguaccugcagagccaguccaccaggcuaggguuaaggcugagcuaaaauucaggccuccuaccugccuguacccugcauugacccagccugcccagaaccugacuaccucucuccugagagcaacugacaggcaucauuagccagauccaucagcgacuucuucaucucccgcuggagcuccucauauguguucugugccucugucagguaacgcucccaguucugguugacaggcagguaggacacacccaucuccagcaugccagccagagucacuggguggggacaccuaagggacaaacaccaagggcugccauaaaugaccacaggagacaaucauugaauauaggggcuccauucucucagccuacaaaagcuaaguggccagccuaaggaagaaucagcccuaccugauuacaaugggaccgaguaccagagcccacccaccccagggauuccccuggcucccccucaccucuccaagaagaguggcagcugcugcuggaaaaccucaaagguggcccacacaucacgggcgcaguacugcaucagauccuagcacaagguaacaaggaacuuguugcggggacaauggaggaagacagggacaaccccagcuaccuccccaaguucaguugcaguuacucacagccuguguauuggcugugccagcaccauaccuggaaguucucucggauaucccucaugcugccuuugacgaacagcucccgaggcuccuucucuaagggagguccccccacauaaagguugugcacaucugcaagauuauuggcacugcugauauccauccagucccaagaugagaucugagaaaccaaagggaagucagcuuggucucaagugcaacaaguagaccacugacgggauggaucuuaagcaccccucucuagacagacccaaaugcacacucaccgcuggaccauuggcuuuccucggggacuucugcccucgcuuuguggacugcugggucuugugcuuucccugcuuggcucccauccacaggcugcgcuggaagcugcucagccccgagauggccaugugcaugcucauaguaucgagaaaacgcauccgggaguccugaaggaagggcaggggagggaaggcugcaacacaggggccagcuggccagccccuccuuagcuccucacacagccuuugcccccagcacacagccuccaacauaaaacacagaagucucaugcuugaccuaucgccuauaagggaccugcccaauucccgaacgugcagaaguggcucagucccagugcacaaguacuuccagugcacaaguacuuccagugcacaaguacuuccagugcacaaguacuuccaggcuuccagcaacagcccgguaacuccagguagacugacuaaacaaggccuucagagcuaugggccagacccccagcucugguccuggccuucccaagcuguggucccuggcaagucagcaaggccuuagcaccuuaaaugccaggcuaaggguguuacuaggccuacucccuugcccugccauucaccuuacccugcugugaagagucaaagaaaaaggguuuuuuauaaucuaagaacugucacuaccacacaucagacagcucugguugucugacaugugugcuauucaaacucugcucaaaguccacugagggagcuucuguuaucucucuuuauagagacuggggcuuagagauguuaaggaaaaaauacugcccaucaacagcugaggcaggauguggcccaggcuguaacucagagcccucaaaaacucuaaaaugccauucuaagauaagagccauuuuauccuggacuaacucccaguccugcgccaacacagcagggauggagcucccugcggucuuuagggaagacaggagucaucugccacaacaguuucaaacaccaugcuaguguguuguaagucuguucuggagaucagcagcugagcagagaucaagcaaagcuggucaacagacgucccagcaaugcuggaaaggggguggaaacagucacggagaaagcgaggcuuuuccuagcaaaggugacagggcuuuuggcccaccuuauguuacagcacuccauucccacaaaccuuaccugaaucagauacuguucccugauaugggcucggucaaaggaaacauugugccccaccacuaacuguuccugcccauccugcuugguggagcugcuggcacuaguggagccccccaaagggauuaggucagccggcgauagcuggcugguccaagaguaacgcucuuccaccagccgccggcugcaccaggaauaccugaaagaggcaagaguggacaggguuaccacgaaggacuagacuucuauuccacaccacccacacaugccagguccccaagggcugcuccucacgccacucacugucacagaagucaggguaucauugaggagagaaaugacacagccccuuuacuauucgccucccacagauuaacagagcuaacggcuaugacugggugccaugggcaggaaggugugugggcccacuggguaugcagcaagcucugagaccuuuacgaauaggaccaaccccuugugucuuuaagcacaaaacagcuaguaugccaagugcuaauuaaggagauggcuggugauacaacccaaaguggagaauuuaaaguggaaaaaaaaauuuuuuuagaaagacaaaugcugcauacacagagugugaauuggcugagggcugcaaagacuccgaaggacaaauaaaucaugcacaggagcaaccaccucagugagagcgagcgccaagaugagaauguaugcacacgugccacaguggguguggaagagacagaugagugcuguuugcaaggccugacugacucaggagaaggcuagucugcucaagaccccaaagugaggagaguggccgcuaacggagaccugccccaagccacgcacacuuccaaaggccugaggccacacaguggacaguacagcucugacagagcucccuccaaccuuuaaggaacacaggagugaucugccucaaguuuccaacugaaaaacucgcugcuuuaaaucuggcaaacucuagugcguacuccauggugggacuacauaaagcacccacgcuggagccuuccucugaccccagccugucaaaguccuuuguaacaacagaagcaagggcucaagaaugcuacauacgggcuggugagauggcucaguggguuagagcacccgacugcucuuccgaagguccagaguucaaaucccagcaaccacaugguggcucacaaccauccguaacaagaucugacuccuucuucuggagugucugaagacagcuacaguguacuuacauauaauaaauaaauaaaucuuuaaaaaaaaaaaaaaaaaaaaaaaaaaaaaagaaugcuacauacuugaagcuaugacaaugacaagaacuucaguuaacagaagucaaacuggugucuagacacaagccugcagcuguguaugaagccaucuuaauauaaacuuagguaugauuaaaaaaaaaaaaaaaaaaggagagccaaacuucagaucagcuggaauccauguuaucaaugcugaaugaaguucuccuuagacucccaaacgccaagggccugggugaucucccuucaggcaagugacugauuaaagcccuuaccacaagccuucuggaagcuaccuucugggaggcccagcugucugccccacuccuacaggcugugugcuggucagguuauacacccggguggcagguaacguggacaugcuguccacagcuauaacagucacaugacaaggagaaaggucuucgcgcaagcccagaccucagcacuggcuucugcagucaggcagacucuguggugcccccaggcccacugacagaauggaaugagaauggaggcagaaugggaaggagagagaagugaggaagauggaaagguggaaaggaagaacagggacuugaccuguccaaaaaugcccaacugaccaaaaaccucaugggcacugcuuccguccagccacccaaaccugcucuaucuuuucagacgauggcuugcuguuccccuggacucuggccaccacgucacaugagcccugugcuucuuaucucagcuucaacuaagucaccgaggacgaaaccaucuagaugcgcucguuccagccaggagugccuaccuuagcuauuuagccaugcuuucaccauuuucaacugcauauauaacauuucgcagcuuucuuuacaaagauggagcuuccaauaggaauaaagaaacugccaacuuuuuuuuuuuuuuuuuuuuuuuuuuuugcuggccaugccugaaagcauuaaggcuguaaauaguauuuuaauccuggaacgaagaagaauaaaaagggggagaaacaguacugccaucauugcuugaaaaagaaaccuggguagcacuuagaaaguuauuuaaaaagaaaaggaagagacuggauauacuucuuugagaccaaaaucucuacuuaggaggaaguacuaauucuuggcuggggggugggcaagacuaggcuaccuucacgggcauucggaaagaucuggcauuuacggaagacacuggggaugugagcacuguaaaccgccuagagcaaucccaccucaggaacaccuuccugugcaaacuaaccgucggcacucccaaaaccaaacacgggacaaauggcuuuucagacuaacuucucacggaagcuucuugggggucaggauugaggcacaaacucguggucaucuuaaauggucucucagucugucucaaacacaacacgguauccuccgaaugggcccugauaugcgcuuggguguugccuggagccuaugcaccuucccaccauagcgagccucacagaagcaggauuaagcagguugaguaaccugcacacagagggaacucagaaaauguucuccgaaccaaaccauuaagcugggcccccuacaaacgguaguccccuguugcuaacccccgacuuaccaggccgagggggauauggccaccgccaaaguggggcagguucccucugccaagcagaccuccacgucgaacaccagggcccgcuccucggggauggccacggguucggccucccccucggggccguaccggguccagcccuccgcccaggcccagcucuugggcucggggggcaauugggccuccaauaacgaggcggccgccuccaaguaaggcaggcucugcuucugggccaggaggcggaagugcugguccagguugcccccgaagagccggggcaggcgcagcuccacgucuggcaagggcguggccggcugcccccagagcccgugcuucugcaggugcucuacgcugcgcugcaccgcggccucgucgggcauuuccccgccgcacccgaagaucugcucgugcaggccucucgacaacaucuggaugagcagaggguugagccgcagcugcccauucucggaggagggcauuugcgacggcggccgcccgucgcuggggacggggucgaggacggagcuggagacccagcgcgcgguugcugguacuggcccugaggcgaccuuggcgccagccaccuucuuccagagcaggcggcucaugguuggugcagggagccccccgcugugagucggggcaccgggcuuugggcuccagcuugacugcuuuuaguggccgaaagacucagagagagacgcguccccucucugugcuccugucagugaaauaggucucaccaugccugccuuccucacacaaguccuaaaggagacagacgauaaaaguguuauuacaagugucacggacuugaacaaaccgcuuaucccgcaacaaacaucugcugcgugccaaacaagcauuuucuccacuugaucuuagccaaaaggccagagcggaguagggacauuuuucuguuacgccuccaacaaccuuaagaaauggcacugcccccucccgaggacagggccacaccggcucggcaguuaacuugggagaagccgcuggagaugcugaaauggggagacgcagacagaccaggguucuggcucuccaacugcgugaccuuggcccagcuccuuaggccccgaccuccuccucuguaaaaugggguuaagaacucuagagccacgggccacugcuguaagaguggcagagggcgcgcucgucgaguggcccuaaccccaguaggcgcucggcagacagcaguugccagucccaccccgccggcggcccgagggccuagcgccccaacuucgaaacccgccgaacgagccacagccucgggguccgcacccacacccgggcgggccuagggcgcccuggucggggcgucggcggccacccccgcacgccgggacacaggguccccgccgcagccgccgcccugcucccggcccggcuucccgaguggagagggagcagccgcgcccggcccucccccugccgagcccgccggaaaccucgguccgcuucgcgcuucccguucugcggcagcccacagccccggcgacgacgcggcguccgcggcgcgcggcccacgcagccucaggguggcgugcggucucgggagcagccgcaacuucccgucugcgcgaacugggucccgcggcuacccagaggcaggcgggagacucccccgagcguccaauaagagcgccgccaauggagccgcccgcccgcgggggugcagagggacuuccgggugagguccuccgcuacuucccuccccacggaaaagauagaccagucu

SEQ ID NO: 3888 - RNA, 2130 nt, Mus musculus
uucucgcuggcggccgcguggccuaauggauaaggcgucugacuucggaucagaagauugcagguucgaguccugccgcggucgacuuguauguuguuuuuaucugucaguuuguuaaucccaagauucccuuuggaaauaaagcgaaauugaccguagugguuaugaccaacuucuagucuaaacuuaauucuuggaacucaaggaucugagcaaacaacugucagggugacacauugcuuaaacggugacagcggucgagagccuugucccggauggagaguggagcaaacggagcacgugccguccgaagucuagauuugucaccuauggaccgcaaaggcuaagccucgauggagucuccucccuccuaucccggacaaugaugcuggggguugaugcuguugaguccgauuggucgcgcccaccgggcacagcugaagcacgucccgcuucagagaucugucaaucucuggguccaccucccguugcuccgguuguuucugcucccagcucuccguagagggucagcugcaaagggucaggcgaauauggccugggugaauaacugggacccagggauucaagucgagagucccguacgaggaaagaaaagaucaggauugcuucaggcagacuagggggcacaagcagcugauuagggaaaaaauucggaccgcgcugaacggcagcccccacuuccaaccagcgagaccacccggacgcugagaacuguguacaggagagagggucuuugacuuuuuucaggagucgcuccucuauccgcuuuuccugucacuagcagcggcagggacucauacagaacccuucuccuuucuccuuuucuuaguuucuucccccucuuuugucugucugucugucggccuguuugcuuguuuguuuguuuuuaacgaugaggucucacauuguaacuuagaacuuacgcgguagcccuggcugcccucccgccucagugcuugaacuacaaauauccacaaucuagcucuccagcugagacauucuuauacauuuuucuagauguacuuaauagacauaaagugauuuuuguuuguuugauugguugguuaucaguuuuauauauauacacacacaaaccagagucaacuagauaagagauuccuuauuuugugauucuucuugcuuuuacauaacuuugcucaguuuauuuugcuauaaggugaaaaaggagaggcucuuaacucaggaagccuccgagcaggaaaaacaauuucauuuuuauuucauagucuccuacugaaauucaguguucucuucaucugugagccuaggcaagcugccacguggcgcuagccauacccgugccuuguucucaacgguguuauacucgcuguaaauuuuucaaaacuuugauugcagccauuggaguuucaaagagcgguagcugcgaggaagagccuagaaacugcgauuuaauggacuaacaaaccccgcaucaucaggaagcagugaugcacaucuucaaccccagaacgcuguguuggagcccuccccugggcugugggaauagcucaguggggggaagagcauggcuugcaagagcgagcaccuaccugaagccgugaagggagggaauacgugaggggggggguacgcggggggggggggggcugccacacccagagacucacagaucacccgaucuaaucagcaaaaucuggguccccaugagaggccugguuucagaaggcaagauaaacaaguccugagaaacaaacauccaaggcugaccucuggucuccacauacacaugccuguguuaaauugacaucugacccacaaagaaacaaauacccuauuaacugaucuucccccaccccaccuccagcaugccucaaauaaucucugucuccugucucuggcuccugcugagugugucuguuuuggggguggggguugccugaggaguuuuauauuuguuuauuuuugaggccaggucucacuaugcagcccuggcuggccuggagcucauuauguagaccagguccacucucacacagagaaaucuuccugcuaggaucuuugagccucuguaaaacccauaacagggccaaacuccuggaguuauuaaagaugacaugguuacauggu

SEQ ID NO: 3889 - RNA, 51891 nt, Mus musculus
gaugcccgauucacucagcccuuccccaggcucuggccaaggcucguuaggggagauugcgauucugcccagucuccaguuaucugagguauccauucuuuuucacuccugcucucggugccagacucauucucugagucuuuauaacaccugcagauguauuucagccccuuccucuaggguaacguuguucucuacagggaaggaccaaggaccgacgaggaccaggcuggggagcucuucaaggggucuagccucauaaggacuuuuaguucugcucaggggucccaugcugcccaucugaucuggagucucuugugaugggcuccagaacgagaugccgcccccacuccccuaccuuuagcccuugaaccuccacaucuguuaagggacacaguguuccaggcuaugucuauagcaccugauaugagggguuucugggcucugcgccauccugauaaagcaggacuaggucaugccucacuaccuccagucacagcuugcuccucuggccagaaaagggagggcuaggcccacagaagucugggaccacaccagccuguggacaggguuuguacagugaguacugcuggagucugagggggugggguugagaggagagcagggucuggccucuagcuugcaggaaugucccccaccccacccuucacagcaucuguaaaccacacacacacuauuucacuguaccacagcccauaaugauccugcugccucaucuuuccagucucaaccugaauuuacagguguagaacaccaugucuggcugaaauucuuaacuaaaaauguuuaaacucaggcuggugagauggcucagcggguaggagcacugacgcugcucuucagaagguccugaguucaauucccaguaaccacaugauggcucacaaccauccauaaugagaucugacacucucuucuggugcaucugaagucagcgacacugaacuuauaauaauaaauaaaucuuuuaaaaauguuuagccggacggugguggcucacaccuuuaaucccagcacuugggaggcagaggcaggcggauuucuaaauucaaggccagccuggucuacaaagugaguuccaggacagccagggcuauacagagaaacccugucucgaaaaaccaaaaaaaaaaaaaaaaauguuuaaccuuguuuuauuuuuaaguguaugaauauuuugccuccaaguguguauguaucuguggagguuggaagaggccaucagaucucuugggacuggaguuacaaaugguuugagccauuaagugggugcugggaaccaaaucuggauccucuacaagaacaaaaaguacucucaacuguugagccuucucuuucacucaacuguaauagaauacuuacuuuuaugugugugguguuuugacugcauguaaaucugugcaccacaugugagccugguacauaagaaggccagaagagugugccagauacccugggacuagaguuacagacacuugugagaugggaauguaggugcugggauucgaaccuggguccucuggaagagcagcaaguacucuuaaaugcugagccaucucuucauggccccuuccccauuuucuuaaaggggcuuggcacuuuauuuugcagaggugcaugcaaguuacacagcuagucuuggccccugacuacccagcuguuagaguggcagagugaauaauccuccauuagggaaagguggagauacauacauguuguagacucacuggauauaaaggcaggacagcuucccugaguagcauccacugccagccccuccaaggcucugaggcacugaauggccacucccaugcuggcugggugguggugggaugauagagacuggaggggaggcugccugcaugguuugagggaagcaguggggacuuuggcagagacuagacucaggccuggguuucucuugcuagcuaugagaauuaaauggagccucaguuuccucauuuguaaaaggaagaaaauaagacaaauaacacagaauaccacaaggcauacccagaugucccacuaagugcuagaaauacucgauuucucuucuauuuguggaggagaaaaggaauuauccaucuuucuccaaaagaagggcacucacaugucccaagugcacccaaggucuuuuggggagugugaggauggguugggggacuucaaaaacccccugguuucugcuuuucacaggcaaacuaaggacaagcaauucuuuggaaagcagaagucagagcccuuaguggagggcugccaucgcccccugcugguacuuuaugguagcggccuucauuucuaacuggagaaauaaauucuugguuguauuuuaaugaaauuuucaggauaggcauuuugcuagguccuaaggauacaaagagaaagacguugcuuguuaagguuugaaaaugagaaaaaaaauaaaaauuaaaauuaaaaaaaaggaaaaaaaaaagaaaaugaggugugccgggcagugguggcgcacgccuuugauuccaacacucgggaggcagaggcagacagauuucugaguucgaggccagccuggucuauaaagugaguucuaggacagccagggcuauaaagagaaacccugucucgaaaaaccuaaauaaauaaauaaauaauguuuuaaaagaaaaugagguguucacuacagucuuguguuugaacaguuagcccccaguucagugguggcuuuauuuauuuauuuauuuauuuauuuauuuauuuauuuagagauuguagaacaagguggcuuacuagggucucucucauuucuuaccuaagcacacugcuuccugauucagugagguguaaguuucuccccagcuccugcugccaggcauugagcugucccagcccagauccucuccacuguacggcugugugugggcaguuguauggaggucagagaaccacuguggggaguugacucucucuuuccaccauguugaggaugggucucucuuguguccaccaugcuguguauuccaagcuagcagcccuuuaagcucccaggggauucucccgucucugccucccauuuuucugugggagugcugggauggcagacagagccaaggcuucuggcugggaaggggcugaacucuggucaucuggucuccacauacacugagccaucucacuggaccagaaaaaugaguuuuuauuuuuauuuguuuauuuguuuuagauuuuaucacucuuaacuuuacucugaaacucaaacuuaccccaaaccauuguugcaauaguaguuagccaugcacaguuguaccccacuucucagagcagcauugguaguccagcaggcccaguucacaccauagcuuaagaaaaacucaauggggcuggagagauggcucagcaguuaagagcacugacugcucuuuagagguccugaguucaacucccagcaaccacaugguggcucacaagcaucuguaaugggaucugaugcccucuucuggugugucugaagacagcuacaauguacuacucauauacucauaagauaaauaaauaauucuuuaaaaaaggaaagagagaaagaaagaaagagagagagagagagaggaaggaaggaaggagggagggagggagggagggagggagggagggagggagggaggaaggaaggaaggaaggaaggaaggaaggagagagggaaggagggagggagagagagugagaguguugggaugugccagucuaaguucugauaaugagacauggauaccuaccuaccuaucucuuacuagcucuuacuguaagcccacguuacacgauuuucaguguuccuugaaaggaggccgacugaggagucacuggucaucagagccagcaagucugagucagccaugggugucgugcggucagcccucucaucugagucggggagcgacuuccacugccauccuuccuuuccccccuacuccucagcccuggcuacccucagccucaccccuagggccauccuucaccuugaaagcaaacaaguaccacugcuuuuuuuuuuuccccauauguuguuccccucuucuucaagcuucuuuccaucacccgaagaacuggcaggaccagccucaaccuggggcauucuaaaggggcggauuugucuggucgguuuugcuuuuggguuguuuguuugccuguagagcaugacaacuacagccccuacaaagcugaaauuauuauuuuuuucuugcuguccugaaacucacuauguggaccaagcugaccccaaacucugagauccguuugccucugccuucugagugcaugaauuaaagguguacaccaccauacacccggauagaaaaaaguuuucucuuuaaagaaaaggagccuggcaugguggcuguauugagcauaguaaaaacagcuuuuagacauguaaaaauagguuagucaggauccccacuacacccaaggcuggaccugauaacuagaauucauugacaucacucacucaagauaaucugacacaggccuagaaccuuaugaugcccacuggacaaacauaagcagagagcaagaaaaauacuuuguacaucugaagagaugcuaccuuggucugcucuguggcuggagugucucccccaagaccuugacccuggaauugaagacuucuguuagagacuggaccugaccuucagcuaagauacauccaggcuuaggaccgugguaagaaacuuacagugugaacauuuugugaugacccuccgcauaauaaaccacaacuuuuguuauacuaacuauguguaucuacuuucuugcucacaagaguagugcacaccuuugaucccagcacucaggagcccagccugaaagugaguuucagaacagccagggcaguuacacggagaaacucugcccugaaaaaaacaacaacaacaaaauuauaauguugucugauaugacauggauauuugcaaaggaaauauuuaagguauuuacaauaagcuuucuauuccuccauauauauauaauuuacauguauguagucugugugcaugcucauguguauacaugggugagugugccuguagagaucaaaagucagcuuugcuuauuaccccccacacccccaggcuucuugguuuuugaaaccagauaucucgcuucugccuagaacuuacuaauuuguuuaggcuagcugcccaucaggcccagggacccacuuguguuugccccagugauaggauuacaaaucaauaccacugugauuagcuuuuacuuuuauaauguguauggguguucugccuguauuaugucuauguacuguaugggugccugguacccucagaggccagaagagggguuagaucccccuggaacugggguuacaggcaguccugacuucccacauggaugcuggaaacuaagaccagguccucuggcccugcuacacugcuuuuuguuuguuuguuuuuguuuugcuuuguuuuaaauaugggcaguggggaucaaacuccggucuaccugcuuguggggcaagcacuuaacggacugagccaucucccccauccagcuuucuagacuuucuuacuacacuuuaccaguggauuguauauuguguguguagagaaugcaauagagaaacuacuaaaauaaauuaaauaaauaaaauuaaaguacauacaguaguucugccuucuaucaucuuuaacuuuuuuuuuuuuuuuuugguuuuucgagacaggguuuagcccuggcuguccuagaacucacucuguagaccaggcuggccucgaacucagaaauccgccugccucugccucugcugggauuaaaggcaugugccaccacgcccagccaucuuuaacuuuuuaagauacauuuauuuauucuguguguacauaggccauggugcgacuuacaggguuggcucucucgaucagacaggucccagggauugaacucagguugucagacuugguggugagcuccuuaaccugcugagccaucucaagccucacccucccccacacacacacacauuuuuuuuagagaauuuuuguaaacauauacagaaguaggcacugagccugcacauacauaccacccaccacaccaccagcaaccuguggucaagaauguccauccaucccuagcuccccuauuuuugaggggggaaaaauuagauaaucccuuuauuccuuuuuuuacugauuuacauuuauaaaauuacccuaauuuuuuuucuugauccaucuguaccgccauaauaauaccacaugccaggcaguuuauaaacagaaaaaaaacucauauauuaaaauucuggagguaggaagucuaagauaaaguccccagcagguuucaggucugacgaggaacugcuuucuggucauagacgugcagcaccuucaagcuauccggaaacuaagcugguagaugagcaggugagcuccugggccuaugagcaucaugaggaugcuaaucccauucuucagugagcuuccaucaugcagucaucucccuaaaggcccuaccuccuaauuugaacacauuccugauuaaguuccgacaugaauuugggggucauguuuauaucauccuccagcaaaguugaaugccuuccaccccccgcccccucauuacccccuccccauucucuuuccaaucgcauaagauggaaacaccuugguagauucauccagaccuagggcuuuaaauggcagcuagauauccaucauuuucaaguuaccucauugcuccuauuucucccacuguuuauacuccuauaucuaacugcauaccugaaaccuccucacuuggggguuauccuaugugaugguuuguauacgcuuggcccagagaguggcaugauuaagaggugugacccuguuggagugggugugucacugugggugugggcuauaagacccucacccuagccuggaaguaugucuuccacuaaccaccuucagaugaagcuguagaacucucagcuccuccuguaccaugccugccuggauguugccauuguaaggcccugacacuuggucaaugguacuuacuuugagacaccccauagugauacaccgaggcacagauugaugcaagagcaagagguuuauuuuccggugccucagaaucaaccuucaagucgauucuagucccucaaggcaagugacuagaaggcgacuccaaauggcuauuacaagcgguuucuauacuuuuuagggauacaaguuacaucagcaagguuacaguucaaacuuauuagcuaagcauauuaaccuuuauauuauuggcuagcaagcaugggcagaucaugacacacacuugaacucuaccugggacuuucuagaaggucaggugacuaucagugcauucugugguuuaucugagacuuuuuuacucaagaauguuccuguggguggagaauggaacuugaccuagccuugacccaaggcaggagggggaagcuauaaggagggugugggacuggaaaaagcccuuaggguccuucaccaugcuccuucccccucacgccuugaugauacuggacugaaccucugaaccuguaagcuagccccaauuaaauguuguucuucuaagacuugccuuggucauggugucuggucacagcaguagaauucuaacuaaggcagaaguugguaccagggauuggggcauugcugugauaggccugaucaugcuuuuguuuggaagacuguggauuuuggauuugggaagcagugggaugcuuuaaauggggcuuaaugggcuauccuaguaggacuauggaaggcuuuguuacugagagugguuugaauugugcagaccuggcucaagagguuucaguggagaauuucaauacguggccuagagacugguuugugguauuuugaugaagaaugugacuacuuucaaaagaggcugccugaggcuaagaugaagagacucagauuaauugcauugacaaaggaagccucauagaagcucagcagagacuuuguucucugguuaagucuccuaaagggcauuuuaaacaaguguagucagcuuaagaaggaaaauuuuaaauacaugguuugaauauuaaagggcaccaggaagugaaauggagccgaauccauuguucuaggagauagcagauuaagggagugggacuuugagccaagagccuauccagcuaaauuuagauccuggccuggugguacccaccuuuagucucagaagauaggccuacugaucucuaauuucaaggucaaucuacagagcaagaucuagaacagccaagcuuaggcagugaaugaacuggaaagcagcuagugauaauguaauagaacaagggggccauguuccaacuccuacaagcagcagaacucagcugcuucugccauguggcuuuauaguccagagggaaggagacuacugggacaauugaggcugguuagcuggagcuaagaaauuaguggugauuaagaggagaccagccgggcgugguggcgcacaccuuuaaucccagcacuugggaggcagaggcaggcggauuucugaguucgaggccagccuggucuacaaagugaguuccaggacagccagagcuauacagagaaacccugucucaaaaaaccaaaaaaaaaaaaaaaaaaaaaagaggagaccagcaucgcugaggugaaaucuucuggaaaguguuuucugagagcacaaagaagcuuuguucgaacuacagccaagguuguacuucaugcugcagcuggacucgauaauguguaagagucauccaggugguacugguuuugaagguaugaaggguucaugaagagcagcugaggcuuggcacugugagaggccauggaaggccacuguugaaagugcagccucaguuguaguugacggcccaggacugauggggucaugaaaaggaguugagacuuggcaccauaaagagagccuauaaagccaggugugguggugcacgccuuuaaucccagcacucaggaggcagaggcaggcggauuucugaguucaaggccagccuggucuacaaagugaguuccaggacagccaggacuauacagagaaacccugucucgaaaaaccgagagagagagagagagagagagagagagagagagagagagagagagcuuaugagaagcuauuggugaagccugcuugcaucagaaaaccccagcauauugaagguaccggugguaccaugggaugaucaccaagaaaggcaacagcaaugaagugaaucaaccugagcuuaaagugcuacagagggcagagcuggaggagaccccuuuggaggagcccagacauugaaacaauuagcuauaacaucuuggccuuggagaccccaagauguucaaaaugccagaucggugagcuaucugcugagaaaagcugcuaacagggaguggcucaggagaaagaaguuuguuacagucaacaaagaugaaaaaggaguuagagaucugaagacugcuuugacaucagccauggagaugcagaguuuggaguuugcccaccugguuuccugucuugcuuuggggauuacaguuaagugauugaaagaaucucagaagagaccuugaacuuuggacuuuuaauacuauugagacugcuauagacuaugggaacuuuagaaguuagacuaaacauauuuaucauuaugcuauauuuagguaugaccccaauagacucauguuugaacaggccuauggugcccagggaguggaaugugaugguuuguauaugccuggcccagagaguggcaccauuaggagguguggccuguuagaauagguaugucacugugggugugagcuauaagacccucacccuagcugccugauagucuuccacuagccgccuucagaugaagauguagaacucucagcuccuccugcaccaugccugccugaaugcugccaugcuccccugccuugaugcuacuggacugaaccucugaaccuguaaaccagccccaauuaaauauuguccuuauaagacuugccuuggucauggugucuguucacaauauauucuuggaucaccacggcuaacaccagucaugaguuacuaucccuaccauagguccaaagccauacagugugguccaguaauuuccacuuuuacuugaaauuuccccuuaggaacacagauuuauauuuuaaauaauuuaaaguacauauagagcagcuggagagaugggucaguggcuaagaacacuugcuauucuccagagaaccagagcucaauuuccagaacaacaucagacagcucaugacuguagucccagcuccaggggaucugaagccucugggcuccaugggcaucuacacucaugugcucauacccacccacaugcaagcauacgcaccuacucaugauuaaacaugauaaaauggaucuuuacaaaacacauacagaaagguguugaaccugcauccccaacaaauggauauuuaaccagcaaaugauguauagugacuuuuuaaaaaaaagauuuauuuauuuauauuauguauaugagaacauuguagcucucuucagacacaccagaagagggcaucagaucccauuacagaugguugugagucaccaagugguugcugggaacugaacucaggacuucugggagagcagucagugcucuuaacugcugagccaccucuccagcccauauagcaacuuuuaaaaaguauccuuuuuuaugcauacaaguguucuucauacauauauguauauguacccuaugcaugccuuguacugaggucagaaaauggcaucagacuuucugggauuggaguuaugguugguugugagccaaccauggguacugaucuuaccacugaauccucucuccagccccaccacccaccuuuuugaguguuucacuauguagcccugaauggccuggaacucacuguauagaccuaguuagcuuugaacuuacagagcucucugccugucucugccccucuggagugcuggguuaaagguguagaacaacaugcccaguucuuuuccauuacuacuuacauacuuaauuaaguaaaaauagaaacaacagagacauagacauaagcagguaggaagaagguuuugccugcuuaauuaauuguuaucuuugauuaaggcacaguuuugccauguagcucaagaacuguggacccucuggucuuggacugacucauaagcacugugauuauaagaacaugccaaugugacucguuuucauauuaucaaaauacaauaaacauuuagguuacgguccaugguucuuuauccugauaagaaaaaauaaucuguuucaaauaaccucgccuggcaugcugauacacacugcaaucccaacacugugaagguucaggcaggaugaccuaagagaauuugaggccaaucuuggcuacagaguaaggccuuuuauuaaaaauagaauacugacaacagaaaucuaauaauccucauuaauuccaagauuuaucuagacaacuuaaguguaagauuugauuagauuguucuuuuuauuucaaaauauggcuggcaagcuaucauucuagaaauggugucgucuccauuauuuuuauauauugauuuauaauuauauuaggaacauuaauaauauguggcuuacuuacuuucauaaggccacauguccuuuuuuuuuuaagucauuuaaguuaaaacucaaucagauaaucccaaauccucuuacugugguaccaauaggaaacacauaugaggggcugaagagauggcucaguggauuaaagcauuugcugcaccuccagaagaucuggguucgauucccaucaugcaaggcugacucacaaucagcugcaacuccaguuccaggggauccaacacccuauucugaucucugagcacaggcaugcacaugugcaaaacgcccauacacacacacacacacaaaaaaaaauccacuggccagagaugagaccaagagggagcauacuugcuaacaacaugccaggcugggaguuccaucccuagcaacaccucccugcccccauauacaauaaaguuaaaaagaaagcgggaggggggaggaggaagacacgaaugaguguuggagauguugguucagugcuugacuguccagcauucaggaagucuuggguuugauccccaauaccccauaaacugcguuuggugcaggggcaugucuacagucccagaacuaggaagguggaggcaggaugaucagagaaguacaagguacaguuugaggccaauuuggaauauaaaagaaagucacaaaaacaaacacacaacaaaaacaaguaaaacaaaaccaagacuucagaaaacacuaaucuacugaauggaugagcuguaagaaggcgggugcuggaaaucggacguucuaguguuuuuuucugcacccauuggacuggcuugcguacucucugguguguucacuccuuaguuuguaaaacagccuccccaggugcucugcagacgucugauuagguaucuuuauauuacauuuuccuaccuaggacccguauugcucuucugucacuucucuuucuucccgaaaacacuucccugccuuccagaccuuuacaauagaguauccgagguccuuccacuaugcuccagccuugcuaaguagccccugcuggcuuggaaccugcgauccuccuaccuccgucccucgaguuugaggauuaugaaauguuccuuucgucuuuuacagaaaaaaaaaauuaagcccuccgucauaggcuaaaagacuuaagaguagucuaaagugaacuugacucaagcauccuaaaccccucacugugcacaucccaggcuucaggguucuaguaaacacgccccgccuuccgcaggcgacacacacacucacguacgcgcgcgcguguacagacacacacacacacacacacacacacacacacacacacacacacacucacucacacucacacucacacacucacacucacacacucacacucacacucacacucacaucugcgcacaguagcccaaacgaaggcuuccgcgcccaccgccacgcccccgaaguaccgccucuuuaaauuuuaaaacgaaggcucaggccaaugagaacuacauuucucccggaacucagcgccccgcccaccgccacacccuccaccaaucaagcggaggucuuccacacgccuuccaguuaggguuaaagagggaagugcuuacguaacuuacguucagccugcagccaauaggagccgaguuuggguaccagcuccuccaauagcugcagcugucggagagcgcgggagccuucggagcagggccucagagaagcgggcaauggcgcugguucucugaagagagugcuuuaccucaggaagggccacgcgcggccgggcagagggagucccguggcggccgagauggccugcugucacaaagugaugcugcugguggacacagcgggcgucucugcuccucauagcccggcccgacgcgccgcccuccggcuccucacuuaccugagcugccgcuucggccuugccaggguccacuggaccuucaaguucuucgacucucagggggcacggagccggcccucccgcguguccgacuuccgcgagcuggggagccgcuccugggaggacuucgaggaggagcuggaggccaggcugggggaucgcccucccggagcucaccugccgggcccgacgcccagagccacccacacgcacggugcccugauggagacgcugcucgacuaccagugggaccggccggagaucacgucgcccaccaagccgauccugcggaguagcggcaggaggcugcuggacgccgacggcgaggccagggaggcccaggccgcgcucgggggcuuugggaacgccgucuuccuccuggcgcccuguccucacucgcagagggagcugcuucaguucguguccgggugcgaggcacaggcucaacgcgugccgcucacccccaagcaggugauggagaagguguugcccaagagaguccaagagguuaugaucgcccgaaauaucaccuuguacuggguggacaccaccgagcgaucuaagguaaggugagaagcagucuggauccgguccgcaacuccccgacagcugaacuugucaggcuccguaaagugccacagacccagaaugaaccccgugugccuuccgagggaaacccuugcgggucgcaaaggacagcguuccuccaacaaaauggguagauucuggguaccuauuaaauccgaguguggaagagccucugcgcuuugguaccugggugcuuuugcguccuuaguuuugcuacacagcacuuguauuccagcaugguggaagccugguucagccaggcuacaggacuuggccgcuuguuuugucuagugcugcugugucuuccuggaccucuaauccucucccucugaggcaguagaaaccucucuuaaccuuuguuguuggcccggccugaugacgccccagcccucaggaggcagagaggcaggucucucucuaguucuagccuccauccaggucuaugcagagaggccccaucuccaaaacaaaagcaaaccccuuuguuguuguggccugugcucuuucucuauuguguuccaguuggacacaccagacacaccugucaucuuccauuuauucuaaaaacaccaccucaaugacuguccauggaaagcugaggcaggacugucacagugcagggcuagccagggcugcuagaucuuguuucaaaaaaaaaaaaaaaaaaaaaaaagcaaacaacaaaaaucucacaguuacaggucuuaacuccguuuuguauuuccccacaauuuaacauuguguugaggaaauauuugcugauuaaauuaaucacuuuuggggggagggggagguucgagauaggguuucucuguguagcccuggcuguccuggaacucacuuuguagacaagguuggccuugaacucagaaaucuaccugucucugccuccaaagugcuaggauuaaaggcgugggccaccacugccuggcuauuuucgggguguguguguguguguaaauuaaucacuuuuuacaaacuuagucuuaaaacagcuaauuuggauuuuuuugaagcagugaugcuucuugcuugaguaagugcuaugauaaaugugugugugugcuuguuuugaaacagacuaguguaguguaguggccuggagcucuguguaauggaugauaaacucuuggucuccugcuuucauauguauauaaagauuuuuuuuccuguuacaucauuuaguaaagauauaugcacuacugagguacuccauugaguacauccuacccugcuuuaggugcuggagauauggugguaaauaaaguguauuuucuaguuuggaagauauauuaaacagaugugcaaaucaacgaugauuucaaaacuugcuccaaagaaaaaagacugagugagggagcagcugguuauuguacuuaaagguggacuuagggaagaaggccuuucuuacagacuugaacagugaaugaggaagaaugugaaggccgggaagacuaauccagacuuagcaaagguguggguguaaaggguaugagcugggagugaacuuuguauuacaguagaaaggcgaggagcucugaacccaggaaagcaauggggaggacaaagugagaaagaacuggccaguccuccaggccaggcuugaaacagaucaaugagaagauuuagaaagugguuuaaauaggugaagagcuacagguaauagaacuacauagcucugcaccaggaguugauuaaguagcaagauuacagaugagaaauuaacaauggucauacagaauguuaagauucaggggaacaguugggggauaaauaugaucaaaauauauuguaagaacagcuccaagaauuaauuuacaacuuuaacuuuauuuugcguguauggguguuuugucuguguguacuucuaugaguuaccugcaaggcuggugccuaugagggccauaagagauugauuucuaggaacuggaguuaucuguuguuuugagcugccaugugggugccaagaauuaaaucuaguuccucugaaagagcagacaauacucuuaacugcagagccaccccuccggcucuaauagaaauauaguguuaaagcugguugaaugaugccuuuaaucucagacuuaggcagaggccaauggaucucugaguucaaggccagccuggacuacauauugaguuccaggacagugagacccugacuugaaacaaacaaacaaacaaacauuaggcacuuaguauuaaguauuagggcuggagagauggaugagguuaggagcacugauugcucuuccagaccuggacucaauucccagcaccaaaguggugacuuacaaccuuuguaauuccucucccaggggauuugacaccuccucuuuugaccuccaagagcaucagacaagcaaguggugcguagacauacaggaaaaacaccuauauacauauaauaaauuuuauacacacacacauaaagauuuccaauauaaauuggguauaguggagugcuugggagauuugugugcaacuaacacauguaaaugaaaaguccuuucuuaaguuuuguuuuucaucaguagacagcccacacccuacccuuccaagcugcucuucuggcugaaucaguuucaauagauuuguuucuugugacauuugagccaguuugcuguucuuccgcauagcagugaacuacauggaugauaacagauuaaucgauuaauuaauuuacuguuacagcaccucaaaacuuccaagauggcugcugugccugacugaaggaaaacuuucagaauaauacaucaugguuuucuguuuuguuuuguuuuuaaagacagggcucagguugugguauauagcuuggaauucaguccuacuacuuuagccucccuagugcuguggcauuuaauugauccaucaagguucaugaaagugucauuuuuaaaaacaucaagauaguuucauucuuggacugaugucucuaucauugccuugcuguauuuguggcccaaauccuugcaccucuuugaacuugaauauaauguauaguugggggcugaccuggauaaccuugaagacccuuccaguuccuuguuuuuuccaaagauuuuuuuuuuuuuaauuuuauguauaugaguacucuguaguugucuucagacauaccagaagagggcaucagaucccauuacagaugguugugagccaccaugugguugcugggauuugaacauaggaucuuuggaagagcggucaggacccgcugaguucaucagucuuaagggaacuagaagacacugucucaaccauucuuugucacucagagguggcacaauaaguuuguugaaaaaugcugcuugaauaucagcauccucugagugaagcaaagaggcaaugcuuuaacagagcaggauuugccauugauagagaaguauacuaagcacccagcugguaaagaggcacaggagguacaacgggaaaggcauuuccaugcuauacauucccauaagguaaaaugugacacauguaagacaaagcuuuacaguuccuaaaaggugggauggcugauggaggaguugcugaguuugguuuuaaagggcuuuauggcagugcuagaguugcuucaucccaggagcaggaagcauaaaggccagcuugaugagaucuggaugagcacacuugagucauagaggcaggaguuagaagcaggacacagccuugguuaucuguguaagaguucgucaaggccaggugugugcucuuaaucccaacacuugggaagcugaggcaggaggaccucaaguuuaggcccuuuuggacuauauagaggagacccugacuugaauuagccuaaauaaauuaauauugauuaauuuaaaaguuuaguugagccuaauggugugggccuguagucuauccuguuuucgaggcagauggauguaaaguucagauccuuccugcuuuauauagugaguucgagucuagccugguaacuugaugaggcuuuguuuaaaaugaaaaguaguugggcuggagagacggcucagaggauaaggaugguugcuauucuucccugaguucagguuccagcacccauguaaggcaguuaauaacuguauauaguacuagcuggccucugaggacacccacauacacugcauauagguauuacauguaaauaaaaaugaagucuuuuagaacaugaaaaguaguagaaaguggacuaauuuuuaaaaagccaaguccuauacucauuuguguaucauguguguaggagggcagaagacaacagggugucguuccucaaguggaacucacuaagaagguuagccagccagagcauauuaaggauacaucugucucuguugcucagugcugggauuauaaacaugugucccugugcuuggcuuuuuuacguggguucuaggguuugaauucagguccugugcuuauaaguaagcacuugauugauagucaucucccugguauuccauuuucuugaaggcauauuaugugguaauuaucuucuuaagcuauguaguaauggauacuagguguuauuuguacuuaggucaacagguacauuaauuauauaacuugacccuuuaauaauuuuucucuauuuccucuaguguauucauaaaugccuuuauaacuaauguguuucuuuguuguguuuauuuaguugugggcuuccccagaccauguuggauacuggacagugugugagcugcuacaccauggaggagguaccaucuugccagcugaaacuuggagccugggauuuacuaaagccagggaaacagugcugccaugugguggcgagcugucacacaaaccucaccccuccccguggaucucagcucugccaauagaugccacuguaaacuguuugcuguauaauucugaguaugaagccucauuuccacgaauugaaggaacauuauuucucccuguucaagguaagcaaauaaguauuuuuuaaaaaauauuuauuuaauguuguaugagcauccuguugcugacacaccagaagagggcauuagauucaauuacagaugguuauaagccaccaugugguugcugggauuugaacucaggaccucuggaagagcagacagugugcucuuaaccacugagccaucucuccagcccguuuuuuuuuuuuuuuuuuuuuaaaucuuacuuuuuuucuuuaaggcauacuuccaguuucuuuagcauuucuuauagccugauugguuauaauugaaaggauuaaaagaucuguaagcaaaaaucagacaccaagccugaacuguggugcaacugccaguucauguguuaaaagggggcggugggggggggacacgacgacugugauuacagaggguuuuucaguccuaccaaaagaggaguaauauuggucaaauacccaaggacauggguauuaagauaucauugccuuguagaagaaauugauaaauuagagaucauauagaaagagaaugauuuaagaagaaagaaauuaaaaccccccaaaugauaguuguuaccaggaaaagccaacaucuucacaaauuuguuugccaugauugcuacauggugaagcucauuucugaguaaaucauauauucacauggaaauacuguauagagauguauacuuuaaacuauguuguaauuaugagccucuuaaggauuuuuagguuugauguuuucuguuuuguucuguuuuauaaggucucaagcuggcuuuagauucaccagcuuugaacuucuggucauauugccuccaccucucaaguggugggcuuacagguguaugauucaagaguuggccaguuuaagaguaguuuggggccuagucuuaacucuuccagagguccugaguucaauucccagugaccacaugguggcucacaaucaucuguaaagggaucugaugcccucuucugggaugcagguguacaugcagacagaguacucauacauuaaaacaaaaacaaaaaccccucuaacuccaggagaucccauguccucuucuguucuucaagggcauuaggcacucauguggcacauauacauacauacaacauauauuaacacucauacacauaaaaggaaaaaaauuuuaaagagugcuuuuauuugaguaauuuuccauucaucuuuagaauauauccuuuucauaauauauaauauacuggcuucuacagaauuauuuuucucauggguaccuugguauuuagcuaugagccuacauacuacacaguuacuuacuacugaaccaucccuaaucuugccaaaguagguauuauuucaguuuugcuuuugagucuuuucugagacagaaucucuguauguagccuagauuggccugggccacucucaucuucccaccuaggcaccugagugcuaugauuauggacauuuaccaccacaccaaucagagacuuauuuuuuguuaguacuacuugaguacauauuuccaaaucaugauugagaaguucuuauacuauauccauguauauaaugccuaaugaaucuucucugauagcuugcagacuaaggguugauaugaauugagugguagacaguacccacugucugaacuggaaaucuuguuucuuuuauucuuacucugacaucucuucuagaaacuuucauaugcuaggauuuuaauacucuuuauuucuaacaggcaaagaaauugaagaaacaugggcaaucucccuggagccuuuagccaugcaucagagacauuuucaaaagccagucagaauuguccuaagaggcucaguggcacaguggucucucccagugaguagugcuuuaggcacugacaguuggaugcuacaaaguccagaggaacacaggucaacucaaaggcuguuguuucaggagcugguaagcaggcugacugcugaagaauuccaucugguagguguccuccacauguuggggaucucugauagcacacuggugagaugagauauacuuguucacaaaaugcuaaggaucaccuuucuaauacaaucucacuaaaacuagugguaguuuucagauaauacuguuuucaccgaagcauaugaaaaugauuauuggggugacgagauggcucagugguuaagagcgcugacugcucuuccgaaggucuggaguucaaaucccagcaaccacaugguggcucacaaccauccguaaugaaaucugaugcccucuucuggagugucugaagacagcuacaguguacuuacauauaauaaauaaauuaauuaaaaaaaugauuauuaguaaagaaacaauuuguaaaauugcauauaccauguauccaauuaaguuaaagacucugaauuuacauaggagaaaaguaguuggccaaauaggauggucauaugagacugaaaugaugggugguuucucacuauuuaauaugugauaauauacucugauuuuaauguauuuaagaaaaagcugcugcaguguaaaaacagcauaauagcacaagauuaguuacucaaacuuggagcugucuucugaaaaggaacacagauacacccagcuuugacuuuaaaaugauggcuuguuuguuugagaugggguuucagcccuagcuggccuggaacuuucuuuguagacaaagcuggcccugaauucauaggcccugcccuccucugccccugcagugcugggauaaaugauggacaggcaccacccccaguugugauggcuguuuuuaaacucuuuaccuuucuuugccuuuguaaucucagaaaguagauacuuauucuggauccuguaguaaaagauuccagagggagauucuuguguugucuggaaacugucuuacacgcuccagugaaaagaacaccacaaugcauuauuccuaauaugacacaaaccuugcuuauacuauguagacaagguuggggacucaggucaucuaaauuaggucuuagcucuggugcccagaugugagccggcuaaaucccuucagugguuuuguuguugccucacaguuaaguacauuuaacuaagucagguguaucuguuaacuucuuccugcaccaacaggugaucuugaauaaggagcuuuuuccuugucucaguccauccucugugaagugguuguaagagucaacaaauguguaauggcuauauagcuguacuugcuuuaguugccauguacuggacuuggaaaagguggaugugggucucuauucuuuuucccucuugaauaaaucuuauuuuccuucuuuucuuuuuaaaaaacaaauauaguuggaaagaugcagagacaaaaaacaccuaguaaacaucaccagcaguguaaguuuuuuuuuuacagguugaaacuuagggauuauauauaugauuaguaaauucucuucugccucugauagacagcuauuauucagucuucuaguaggccacauucuuuuaggcauuuugacaauaauauucucaacuaauuagcauuucuuuguagguugccaguguggauccuggugaaggcuggccccccauaacgggaauuauuuccccauucucugccaaugccaugauucucacaguguuccgagccaaagaagcugaauuucaaagccauuuucuccaaacagcugcgacugaagguucccaggauacagcuucccuuuucucagauguuguagauaguguccugaaucagagucauaauuuauuugaagacccugcgucuucugguaaguuuucccaccaguaauuaacauagcacagggugguuugcagucucuucuagccuuuuucaucacguguuuaguggaaucccaggauguuguaagucaaauaaaacugagcucuauagaagcuaucggccguuuagguugcuaguuuuagaaauccugaaggucuccagcuaaaggcgcuguggaacacuuugaaacgucguaagauaaagccuggcuccuaauguagcucagacuguaaauguagauggcuaggacauaaaaguagaagggagaguucaaaacaauccagggaaagaggcuuaaagaaaagggacauggguaauaacgguacuaggaaaagaaucaaaauauugaaaauauuccauauuucucucaugugcaauuucucuguauacauacuuacauacguaugcacaugugacaugaaagcagaacuguuugaagguggaaagggaagcagcagaauugggacaauuuaagaagggagggguaaauaugaacaaggcgcaaugauacauacauacaagugucauaggccgggugugguggcgcacgccuuugaucccagcacucaggaggcagaggcaggcggauuucugaguucgaggcuagccuggucuacaaagugaguuccaggacagccagggcuauacagagagugcugggauuaaaggcgugcgccaccucgccuggcccacauuguuuauucuuguaguaacuuuucgagaagagaaaacuagcauagauuuagccagguggugguggugaauguuuaaucucaccggucagaaggcagagguagguagaucugaguuccaaagcaacuugcaggauacccagggcuacacagaaaaacccugucuugaaaaaaaaaaagaaaggaaggaggaaagaaagaaaagaaaaagagaaauagcauaauguuaaauacauguaggagaauauuucagaaauaagaugaagggcuguguuaguaauaggagcaaagagcuucaaauuauguucacauucccacccuccaucccugccccagacaagguagaccuggaggagcuggaaaugcagaaugcagaugcuguaacaaugagcauuuggagagagggagucauuccgggggaaacgcauaagcuuggauucuccccuuggcucugaugucuucugcuuucuguuccuuuagcccccuguguuccagaguggguccagcaggagcuuagucauaccagcuccuggaguccagcucuugucgaaaagugguuuccuuucuccaacgccaguggugcuacuucagacuugauggaaucauuuugguaacgcuuuauacaugucuuuguauauuggucuuugaagucaauagucagaugggaacaggcuuguucugaaggaccaagccuauccuauaacucagugucaccucuuacacugcagauuuaccagcucggugcaguaugaugggauucugcaucuuuagucugcauuaacauuacuguguuguucuacuaaaaggcacuuuuaaaaugaaguggauuucuuagaauaaacuacauuaaaugcauuuagaggauuuuuuucagucaaauguaaauaaacacucacauaguauauaaacacacaucucauuuaccauucuguugcuuugaagagauaccauaaccaagccaacuuauaaaauaaaguguuuacuuguuuuuaguuuccaugaccaccauaguuuggggguaugguggcagucagucaggcaagcauaguucaggagugguagcugagagcuuacaucugaucacaacuuggaggcagaucaagagagagaugagacccaggucuaggcuuuuuuuuuuuuuuuuuuuuaagugacauaucuucuccaacaaagccacaccuccuaauccuuccuuaaaaguccaccaacugaguaccaagcauccaaauauaaacaccuaugggggccauucucauugaaaccaccacacuaucuauccauauaaaauauaugagaaucaggaaacauuuagaacuuaguaucaauuacagcaggaauuaagcaaacuuggguaaaguuaucagcugccaagcgugaugacuugaguuuggucucuugaaucuacaugguugaagaaauggauaacuucugcaaguuauccugacuuucagaugugugcuuuggcacacgugcacacacacacacacacacacacacacacacacacacacacgcaaagaaaauuuuaaacuguaauacacguguggugauuugacuaagaauggcccccauagguucauauauuagaaugcuuuggucauuaggacauggugcuacuugagaggaccgaggagguuggccuuguuggaggaagugugucacuggaggugggcuuugagguuucaaaagcccaagccagucccagugucuuucucugccuguggccuauggauauggaucuggaacacucagcugccaugucugccugugugcagucaugugccuuaccauacugaaaacaucuaaacuguaagcaagccuggauuaaaugcugucuuuuauaagaguugccaugcucauaguuaucucuccacagcaagagaacacugauuaagggaauagauuaauuuaugcugaaagaaauauuuauaaauucacugguuauuucucuaaagagaaaacgaagaaccaauuaauaagaaucaaguacagucagggcaaagaaccgggaaugguguugcuuucuguaaucucagcacuugugagaugcagaguuagagacccgucugggcugccuugcaggacuuguccagaagcaaagacaaauaucacaacuaccucccuccucaagggaggagguaaucgggauaagaacaggcaugaauuacauagaaaauuacauagaaaauaaaagaugguggucaacagauaaaggugguuuuuuaaacguaagggccagcaagauggcucagcagguggagguucuugccgcacagacuuuguauuugaggucacuccuuggaaccuguggaaagauggaaagauggaacugacuucacaaaguugucaucugaccaccacacaaaucaggcaccuaugucugcacacucaaaaguaaacaaaaaaauaaagaaaagucaaaguaagccuuaccaauggacaacugaaaaagacaaagguuuuaccccaauacacagcuuuagaaauguagaagauauaguagaaauucaaaugauuaaaguugagguauuuuugcucuuccguauaguuauccguuuguuccaaagucauuugcuagaagaauucucuuccaggugaauuucuuucaguugaccaccauuguucagauaccguucuagacugaagagcccagaaacucuguuuauaccauguugucuaaagcacugugccaagauaccauauauuguagcuuuauagcuuaggucuaaaucagguagguuaaguagugucaacuuuauuuuguuuauuuucuacuuacuuugauuccagauuucuugauguccauaugaaguuucaaaucugccuauuggggcuggggaaauaaacagcuuaguagaucagagcaggugcuaugagaauaagaagacccgaguucaauuccccagcaccacauaaaagccaggcuggccacacauaacacugucuuaaauacaauaaaguguagagcacuagaucuauaaauaauauaaauaaaguguagacaccuagcauccuccacuggucucugcaugccugcacauagguguuuacauuucaucacacacacucucaaaauacuaauaggcaaauaaucugcuuauuaauuuuucucaaaaaaugccuauuggaauuuugguggaguauguauguauagacacauagcuaaauuuggagaagcacuggcauguuuaguuuuugaucuauaaacuugguacgccuaucuguuuagaucuuuaguuuuccaugguauuuuguauuuuucaguguacaaauuuacucugcauuauuccugaaaaguaucucuaaauauugauuguacagguauuaucauagacaauuuaaagauuuuacagguaaaugaugaaacuuaagagaauacagccauguuauuguauacagaaucaauguauaaaguuaauaguaugcccaucauaaacagaaucuaucauuuaugauauuuauuuauuuauuaagucuauagauuuaaucccuugagacuguggucuuaaaaacuauaauauccaagaaaagaaacuuauauugacaagucacuaagaagacuuaggguauagaucacagguagagugcuugcucugccucagguuugacacccagcccuggaaaacacacuaaagugcuuaggaauaaauguaagagaggauggauagaaauguuuaagaucaaaacaaaaguuccuccucucaugacaugcagauuuucuguaaaacuacaguacauaaggcaguguggcauuagcacacagguaagccaaaccagugggagaauguagacaagccuacaaagugacuccugcguuuaugggggaugugauauauaauggacaaggguggcagcgugagcccccaggaaaggcagauucaguuauuaaaguaaucaugugacaguugacuaucuaaaagauaaaaauuaaauuuuaaucuuucagaaaacacaguaaguuucuaguagauuaaaaauaauaagaaaagcacuuuaaaauuauuagaaagauacaacucaggauaacuuauguguaggugugugugcuuacauauggcuaugucacauaaaugcaaaugcccuaggggggaaaguuguccacugaaacugaagauaguggugguuugagccaccuugugggaaucaaaccugaguccucugaaagagcauuaagugcucuuaaccacugagccaucucccuaacccuuauguacuucuguuaaaacuagcaaagaugagccaggcgugguggugcacgccuugaauuucagcacuugggagguagaggcagguaaauuucugaguuugaggccagccuggucuacagagugagcuccaggacagccaggacuauacagagaaacccugucucaaaaaaacaacaaaacaaaacaacuaguaaagaugaauaaacuaaaguuauuuauauacaaaugaaaaauaugcugaguaugagcaacuguaaaagguaaaauuaugauacauuuauauaaaauuuacagugugggaaauagaaaucguguuuguguuuauacauaaaaugcaaauaaaucuaaaaaggggggaugggaaaaauggagcggggcuuugacugugucuacaaugucugauuucuuuuaaauauagaagcagcuauaacuauuaacaagaacuuaaucuugauacuuuucuaguugaaaaauucauauuuucaaauuaauagcaaaacuuuagaaaagaaaaaaagagaguuggggacaaaccuucucuaccauccaacucccaugggacagugugucugcugaagucuagaccguacauaugaugcugauagcucugcacguguucugauucucaugguuugcagaguuagaauuuggccuuauacuaugcaucuugucuuacagguuguuacacgcugccucaccugauaaugaugaauccuccaaaaccgaaagugaacuaacacgcugccucucugagcucuaccagagaucucacgaagaaucuacuguagucaaucaagaacgcagcagaaagaaacguaugcacauagaaagccuguuucuuaaggcagucuuguuuuccuuuugagacuguacguuuuauuaauuuauuuuauuuuguuuuuguuuuucaaaacaggguuucucugugcagagcccugacugucuuggacucacuuuguagaccaagcuggccuuggacucacagagacccaccugucucacuugccucaccuccugagugccaggauuaaagucaugcaccaccacaccugaccaagaauguacauuuuaaaagacuguuauucuuucuaaaaaagaaauaaaagcuugauuaagauugaaauggaaacuaaaggcaaauuuccauauuuuauauuuuaaaauaauuguauuaguucaauaugggcacaggcacugaaaucaauaauugauaaaugggaccucacugauugagaagcuucugcauagcaaaggacaccaucauucaggcaaaacugcagcuuacaaaacugaaaaauaugcuuuacuaacuauacagcuaauacaaagaaaauagccaagaucuauaaagaacucaagaaaccagauaucaagaaaacaacccaauuuaaaaauggcguagaaagaaaucccaauagagacucaagggauugagaagcacuugaaauauuugagggcuggugagauggcucaguggguaagagcacccgacugcucuuccaaaggucaggaguucaaaucccagcaaccacaugguggcucacaaccauccguagcaagaucugacucccucuuccggagugucugaggacagcuacaguguacuuacauauaauaaguaaauaaauaaauaaauaaaucuuagaaaaaaagaaauauugauauccuuagccaugaaggaaauacaaauaaaaaauuacaaauaaaaacuacuuugggauuuuaucuuauaccugucacaaugacuaagaucaacaacaaaagagugauaguccauccuugugaggguguggcauaagaggcagaggcagacauugccuuagucacugauguucuuccuuccuaaugaauugagcauccucauuuugauuauaauacaaauaucaauacagcuuuuuaaaaaacuauuuacaaauauuugcucaucccaacucccaugcugggaacugaaccccgggcaucaggcauguuaggcagugcuuuacccugagcaacauccccagccugacugaucuucaggagcuucacucauguuguuggccauguggacuguuuucaauuucugucauaaauaauauagcaugaaaauuggcuuuugauguggagugcugaguuguuucagaaaaggcuugugcuuuccuuguaugcaugagcuacgagcucuauccaucccuagcacugcaaagaagaagcgucuccucgccacucccacucaggagaaguguguguggugcuggcuuuguguaaaacguggagauggcacuggagagaccacucggcaguuaagagcacugguugccuuugcagaggacccgggauuaguucccagcacccucguggcagcacacagccaucuguaacuaguucaggggguccagugaagaggcucucaucuccuuggguaucuuuuaaacaaaaaaaaaagggucguugagauauuuaguucuaaacuucaguaaaguaacauguuuacucuguauuguagguagaaacagauaaaagaacugcuugguuuacauaauuucugaaggaagcuauuucuuuuuaguauucuuucauagcauuuggagacuuaguucuugauuccauggaagugaaacuugacuuuucuuuccaugcugauguuuuggcaggugguaucccucgaacuccagugagacagaagaugaauaccaugucccgcuccuugaagauguugaauguggcaaggcuaaauguaaaggcucagaaauuacauccagaugguaguccagacacggcuguagagaaagggcuccagaaagcugucauuggcagaacagcagacaaauuggaagauagaggaaggauauuaagaaguucuaaacuuaaagguauucauucacccuagagcgucuggugucuguuauuauauaagaggucuggaggcugaggaaucuagcccaguugauagagugcuugccuagcauucaugaaguccuugggaugauuccccagaaccacauaacacuuagcaugcuauacguauaaucucagcacuaggagacagaggcaggaggaucagaauuuuggugacauugcaucuauguaauaaauuugcagaaaccucguguaaauaaauauacaaacaaaucaaaugagcuagggggagggagaggagaaauagauuauuuggggaauugaauacuagaguacaaccugaguuguuauucuuuaggcgccauccaccuuuuaaaaauucuuaauuaauuuuauuaaacuaaggucucauauaguccaggcuaucuucaagcucucuauguaacuggccuugaacuccugauccuccugccucuaccuccccaguacuaggauuacaggcaugugcuaccagcccaguagaaucuuucacugaccuggagcuuacugagagaguaggcuggcuagcuagcgagcccuagggguccaccugucuacauucccccaggauugggaguauaagugugguccaccacaucuggcguuuuaaaaugcuggugcuggaagcucagguccccauagcuuaacagagccauauuguugaguuuuaaauauuuuuuuacaauauuuuaauuuguauuuauaugcucauguaugcaugugcauguuauggaaggucacauggaggucagaggacagcucaugggagcucauccucucuguccaccuuguggguccuagagaucaaacucaggucauuaggcuuggcacagcuguggauuauccccagcuguggauuauccucagcuguggaucccuuacuagccuguuacuaaguuuaaaggggcucuguauauuuuggauaaugggccuuuaucugauguccuuuguaaauauuuucuauaaaucuaugguuuaccuuuuacacucuugucaguauguugguagaacauuaguauuuauuuuauuuuuaguugguuggauguuuggguuuuauaaaaaaaucauguguagcccaggcuaaucucaagccuacuauguggcugaguccugccuugcccaccuaucccuuucuccagaucacccaggugucuuuguuaucuuguagcaguccgagaccuuuucuucucauacugugacugacucacuuggauuccucuggagcauacaggcugugucugaaccuaacauucccaucuggguguucagucauccuagcacaugaucuguuuuguuuguuuguccaucuuuuauucauuguaucacacaccuuuguucuuuguuaaaagucagucuacugcuaggcacuguggaacauuucacgucaucccugacauguacacacuacaugcuagaaagcucuagggucagucacggccauccagacauagauuucuccuggaagacaaaagucucuguccccuuacaggauacauggaguugaucugaauaugauaaccacauguucuuuuucacccccacagaauuuaaaaccgaggaggagcuucuggcuuacauacaugacaacuaccaaaaggcuguggcuacggaagaaaucacauuguauucaugugcacaaaauauggucucaaccauuaaaauguuccuaaaaucaaaggacaucaaggaauuagaaguaagaaagucuagauaauacugccauaaauguaguguuugaugguugguggguuuagugcacauccuuaaagaauuuccaguacacugcacaugauugaaaaaugaugacuaggcuggagagauggcucauuguaaaagcacugcuuuccagaggacccaggaucaacucccagcuacaugguggcucaaaaucuuuaguaaccaguuucaagcaaucugaugcccucuucugcccucuuugggcacugcaugcaaaagguacacagauguacaugcagucaaaacaccuauacauguaaaauaaaauaaagauaugugaauaguuaaaaaaagaaaagugcugaguagaggauugguacaauuccagguucuggaauaugaaccugauaaaccagaagccagacauucaaguggacuucuguccaaugacacugcucuaauugguguuguguguuuauaugaauuaaacuagcgguuuuaacccuagcugcucuucagaaugacuuuguuguuguugauuuuguuuauuauuuauguuuguuuauuuuuuguguauauaaguauuuugucugcauuuaugucugcauauuauaugcacugaauucccuggaacuggaguuacagacauuuguuaacuaccaugugggugcugggaaucaaaccugggucuucuggaagagcagacagugcucuuaauugccgagccaucucaccagcccuguugguuuuucuuguugcuguuuuguuuuuuaaaagauuuauuuauuuuauuuuauaagaguacacuguagcugucuucagacacaugggaagagggcauuggauaccauuacagaugguuguaagccaccauguuuuugcugggaauugaacuccggccucuggaagaauagucagugcuuuuaacuacugaaccaucuuuccagcccccuguuguuuuguuucgaaugcuagugucugguccuuccauacugacagacuaacucuaggucucuuuguuuuggaaguugggcauauauuuguuuuaaaaauguccugcauaacucuaacuuauugaaaaccacaguuuuagaauaccuuauugccuuuauucauauuuaauggcaaaagcagggcucuuucucuauagugggagagcuguuuacaauuaucacagcuuuguguggaccuucucuuuuaaaaguaaguguauguagcagggugugguggcauacuccuuuaauuccugcacuuggaggcagaggugagggaggggcgugucuuugugaguucaaggccauccuggucuacauguuaaguuccaggacauccaggauggggggugggggggagagacugggggagggagagagggagggagggagagagagacugucucaaggaaaaaaaagaucuuucuuugugguguguguauguauauauguauguaugcaugcacacgugcaugagaaguacuugcagacugcagagagcguaucugauccucaagagcuagaauuacaagugguugugaaccggcuaacauugaugcccacuagcaauccucugcaagagcaagaucugcucucaacccuagccauugagccaucuguacagcccaaggaacuuuccuuuaacaguucaaaucuaaaagcuugcuguaucuauuaaaaaaaaaaaaaaaggaccacauucucuuuaagauaucaaagggaaagguaggcaacaguuuucuccuucauaauuacuuuguauugcagguggccugccugagucaugugaacaguaaccucuuaaaaaccagcaagacccuuagacagaaccuagccggaaagauggauacagaggacaaagucggagaguaagaaaccacuuuauuuucacccggacucuaaaacaggucugagguuaucuuugucaugaucuuuaugauguucugaggggcaguuggacucgccugauuucuuaagacucgcaccagucuuuagagaaaacccuggauuccuucccuuuuuuuuuuuuuuuaagaaagacuauauuauggggcccagcuggccucaaacuugcucucuaacugagucuggccuugaauuccaucuccuacucccaccucauaaauauugagauuuagauguguuuucaccauucccaguuuaucuaguugugggaauuaaaagcagggcuggcgggccucaggcauucuaggcaagcacuuuaccaacugagcugcauccccauucccccuaccugugcccugcuugcuugcuuucuuucuuucuuucuuucuuucuuucuuucuuucuuucuuucuuuugguuuuucaagacaggguuucucuguauagcccuggcuguccuggaacucacucuguagaccagacuggccucaaacucagaaauccgccugccucugccucccgagggcugggauuaaaggcgugugccaccacuucccggcuuauuuuuuauuuuuuucccucucuuuuucaguacuggagauugaauccagggcuuucuauaugugaggcauaugcuuuagcccugagcuacauuuccaguucuugggcauuguuucuacaugaaucaauagcucuuugcucuaagaaagaguuucacuaaauagcaugcaaaggagaugugaccugguacuuuguuuccuccaggugccagcuucagguauuucuucgucuggagaugugugagcagugccccucaguccuggaccgcccagaugagguggagcgcauaguggaggagguaagccauggcugccaccccgagcaugcucucauucucucagcuucccagcagagccuguggcaacuuuuugcaaucucuuucaggugacagauuugcugcgucuggugugucucacuaaggacucagcguaccugucagaguuucuggaggagaucuugagauuguaaguucaaugaguacuggcucaguuuaaaaaaauuuuguuguuguugcuguuguuuguuuuuguuuuuuuuuaacaaccacuacacaugguguuaucuuagaauuauaagguuaaaaggguauuuuuucaugcugguaacuucaguucuaugucuaaccaauauauucauuccacagguauauuggcuccauccccgggacaauuggacaacucuaccacagccugggguuaaaaauuccucagaagcuggcuggaguccuuccuacaggguuuuucagugaugauucuaugucucaagagagcaugucaccaccucccucaucaaguacucacagaucagugucggccauuacugagucugagcagcuggaggagcuucggaccagaucagccaagaagagaagguaaggggugaggcuucggagcaaucaccugcacugugguuaaguucaggguggcaagugugaagacaggcuugccuuugcccaucucauguacuaaguuggcaguugcccuuagaucagaaucaagcaaaacucucuggaguucccuccaaguugcaucauucacuguauaguuuuuccuccaggaauaugugguauuuacuuugguuuauaaaacucuuuacugucuauaaggguugucuaagaacuaggaacuccugagauaagauuaugguuucaguuacuuagaacauuucccuugcugccuuuuauugcuauuagcuagcugaaucuguacuagccauuuuuuguaauauaggccaagcucaagauaaugaacuagcauguauuuaaacaacauaguuuagaugcugguuucacucaaaccuaacuacauauuuacucuguuugguguguuuccuauuuucuauuuuuaaaaggaaaaaugcacuaauaagacauaaaaguauugcagagauuucccagacucuucgacaaauugaaguucccaaaguguccaagagagcuacaagaaauguaagucgucaccaauagaucggggcuguuucuccuguuagcuggcugacagugcagagguguuucuccuguuaggaagucaccuuaucugaaauggcauuucaaaguuuuuggauuuugcaguauuucugcagaguaaugacaauuuaaaacaaaaaacuggugguuggaggcauggcucagugguuaagagcacuggcugcacuagaguguaggcgcuuaugagccaaaagugguuugaggcagaagcaccacuaaaagcccagugucuuuuuuuuuuuuuuuuuucuuuuucuuuuguuuuguucgagacaggguuucucuguguagcccuggcuauccuggaacucacucuguagaccaggcuggccuugaacucagaaaucugccugccucugccucccuuaaaggcgugugccacugcugcccagcaaagcccagugucuuaaucagucuuuccccuguuuagguauagaauguauguguuaucaccaccaaaaauuugaauccauguaacuugaacaguuucucuucucuauccauucuucaaaauguguaauaccaauuauacucuguuguguaugauccuagacuuucuucauaaaauauuccuaaaauacacaucaacaguuuguuuauuuauaauguacccucauauauguguguagccagccuggacuacauagagagucuuguuuuuaaugaaacuaaaaaauaagagagaaaacaaagaucuaaguuacugugcuuaguuuucugaauuuuacgcacacaugugcacacacgugcacgugcucgccgccgcacauguccaucucucugcaguccacacuugucuccccugugcucucacacccccuuugguugggugguuugucuguguguucccagugcacauguccaucucucuguaguccacacucgucuacccugugcucucacacccccuuugguugggugguuugucuguguguucccagugcugcuuuucuggauuacuacucuguagagggaagucuuuggaaccuggcauuucacuggcagagcugugcaucucuuaauugccucacuaugcagaggguuucagguagaacuguuagcuuuuuaucuugaaugaaugccuguugaucguccucauuucucaucuccaggagaacucccacucugcuuccauacagcugccagucccgaggaaagacacaauacaggguauguuuucauuuuucaacaccuagucacuagauugacaaauuaugauuggauguauuuaauguaaguuacagcucuauaucaucauugguuaaaaaaaauacgaauuccauguuuuagggaacaagauaguuuguauagccucaaaauacugcaucuaguaaauuacugaccuaaaauauuuuaaagugucauuaucauggaaucuaaaauuagaaaaagaagauaaaaaaagaaaaaaaaaaagacaaugaagcuauuuuagacagaaggagcuuaaacauguuggccaaaguacauuucuuaacuuuuuccuuuccuuuuuacaauuaaaauguaauuucaucauuuuucuccuuuuuccacucucuuauccugcucaugagccauccaucccuuuggaaaucauggucucuuuuucuuuguuacuguuacauuugugugugugcagcacaaaccuaaacacacaaauauauagcgugucuaguguugcuuguaugacuccaggacugaccgccuggcauuaucacauaaccagucaggggcugauaccuguggaagacuauuccucucaaguucauaauauaguuucuguuuguguugugcuuuguuuuaagacaagcucuuauuucaguuccugcugccuggcacucauuauguaaaccaggcuggcccuggagucacagaaaucugucuacuucuacucugcucuaggauuaacaaauagaaacauuuaaugcauuucuaagagaaaauauugaauucauuauuaaaaaaaauacuuccuacaaagaaauguugaagauuagaugauggcuucacuucugaaaucuaccuggcauuuaagaauaaacacaucagccuggcggugguggugcaugccuuuaaucccagcacuugggaggcagaagcagguagaguucugaguucaaggccagccuggucuacagagugaguuccaggacagccagggcuacacagagaaacccugucuugggaaaaaaaagaaacacaucagcuuggauuauuucaguugauaauucuggacaguucauugaggauguacaaugaugcugaaaugacuguuuauccacaagcaaaagaaugauagugggggcuguagagauggcugggcgguuaagagcacugacugcucuuccagagguccuguguccaguucccugcauccacauggugucucacaaccauccauaaugugauuugaugccuucuucugguaugucugaagacagcuauauuguacucaaaucuuuacaagaaugaugcugggccucuaacucauuauaaagucaauuuaaaaacuuuugaauccuguaagguuaguaguuuugaggucccccaggagugugcuagccaaaggaauaauuuuaaaaccuggcuguagaguggcuuuccuaagcagcucuguguuugggucuggcaugcucaguuaguugacaccagcauaagguuuuuuaaucuccuaucucucuuuuucucucucucugcuuuuagaaguaacaaaaguucgaagaaaccucuucaaccaggaaaugcuuucuccuucaaagagggggcuaaagaaggggcugccucgcagccauucuguaucugcuuuggaaugucuccaccauaaacaggacaaguucaagaagaccaaaagcagcacauuucaggguaacuacaaaauaaggguuuguaacaacaaaucugcuggugacauuguucgcacuucuauucccacauuaguaauugagucguucugguuuuucuugacugguuuagcuaaagguuggccaauuuuauugaucauuugaagaaaguuggccuuuucuccauugacuuucugaccucacuuuccuucccgcuacuugcuuuggguuuuagcuuguugguuuuucuuuuuucuuuuuuuuuaaaguuuuuguuauugguuuuguuugggggcaggguguggacaauaaggugucucauuguggaucucuuuggggucaucuuucuugaagucuauuaaacuugagugguuagguucaugucuuuccucugauuaaggaaguuuucaaccauuuuucuucagcaauguuuucugccucuuugucuuuucaccuucuagaauucccaugaggcaugugguggcaugcaugcugcuauaguguacaagcaugccucagucuuucuucauuuuucuuuuucuuuuuugugguuaggcgguuuaauuuuuuuuuuuuuuuuuuuuugacauucauugauuauucugccugcucaggccugugauugaauucuuaauauuucuuauuccaucuguauuuuuuguuguuguuuacuuaaccuaggcuacuuguuuauuuaaccuaggcuaaccucaagcuugcuauauguaugacuuuuguccuuccuuccuucuuauccaaauuauaucauuucuccucccuuccuucucuccagucccucccauguucuccccacacucccucuuaaaugaucuccuuuucuuuaguuauuauuguuacauacauguguguagauauauaugcacauaaaauauauaaauacaacuugaugagucagucuguuuagucuugcuuguaugugcaugaguuuaggggcugaacaccuuguauuagcuaaccaagucagggacaacucccuaguggagacuuaauucucucucagaagucuuuaguugccaguacuucuuuguguaggccuuguuuagggcugugagacuuccucuucuauguuagcaugucuguugacguuaucauuauucagguuuuuuuaggcauccauauggccuucuuccuuccuuucucccucccucccucccucccucccuuccuuucucucuuuuguuuuuuuuuaaagcaaucuugcuuguaagccaggcuggucuuaaguaagaucaugcuuggcccuuuaauuuauuuuaaccuauggguuuauaagcucauugaacauauuuagacaaguuguuaaaacauuucuguaauuucugggucuaagcuacuuuagggaugguuucugccaaguucuuuuuuuuuucucccuguuaaugggaaauuaacagggaaucaauauccuuuauuguuugcacccuuuuggcuuuuguuaugaacuagcuauugacaaauaaugauguaguugcugugaugacuggauucuucagucccucagagacuacugacauuugcugauugagauauguagcuaucugcuuguaguuuuucaaccuacuuuuuuguaaaacauucccuguuauauguaacauugacauuucugucuuuuaucauuguguaccagcaauucauagaugucuggguucaaaaaggacuagaaaaggcugcaccugacccuuuaaaucuacugauagagggcuagagagauagcucagugauuuagagcacuuccugcuuuugcaaaggaacuguacccauguuggguggcuuacuaccaucuuuuaccccagcuccuggaagaucugaugucucuggacaccacuaggaacaguacucacaugcacacaagcacuuaaaaauuaacaaucgaucuacugauagaugcuguggaacaaagccauugucguuugagaguccugaaaccgauccaaugucagaagccaucccacaggaauuuuuaaaauauuuuacauuggcuuauaucuuuugagauagggucucacugcauagacuuggucagccuggccuggagcuugcuaugcagaccaggcucuccuuaaacucagagauccaccucuaagacauucaacaggcaggcuugugucauuuuuaaucaggcugauggacuguguguuuuguugaguccugaaggcuuagacucuacugagaguuuagcauccucucgcuagguuaauaagccucauggaaguuccgauugcgcccuuuuccuugcugcugccucagaaguuuaagugagguuuauagucaacacugguuuugcaucuuagguuauugcaaacugcugacuaagaguguggcugagaccccaguccacaagcaaaucuccaggaggcugcuccauagacaaaucaagggcaggugagugacagcccuaucuggaucccucauccucccaggcuuccugcagcaccaucucacaggcaucucugugccuucucuuggauuucuuggcuaauucuuuuuuuuuuuuuucccuuuggggaaacuuuauuugcaugugggagggcuugggcugcuccuaugugacugauguccacacaccucucugugggggucugugggaggcuguaguuacgugacaggagccagggacccaggaggcauggcuaaacaccugcugucccaugcagguggaugucaccauccauugggucaucgggguucucuuggcuaauucuuaacccuguugcuuauauuuuauuggcagucaaacgauauacacuauuccauucuuccauuaggcauaauuauuuuaagauuuaugcauauugccucuaucaauccacuucuuuuuauuauuagucaguauuuuuuuaaauagaucgucugcauucuccuguugacagaaaaggugaguccuuuuuuaugccaggcaaggcuggagauccagcuuaccuuugauagagguacaacuaugguuuguuuuucugaagucacuaguuggacuaggguaauuucuguuccuuuucuuaaccuuuuggugucuguggugucagcuucccuagcacccaaucuaagauauaagcagcaaaagauaaaacccagguugcucacugaccuuucuucuucagguccccuuucuuugccuuucuuuccacaucucaguacaaauagggggaaaaaacacacguacuauauacugucacccauccaccuggacauguacagauuuuacacacaggguaauugugaugaguuggaaguccuugucaagcugacagacauugcaccuguuuggcagaaauguaaacauuacagcugggacugugcaaggcuuagcuguaccuuuuuuuuuuuuuaaugcaauaauggacaaaaaaagaaccuucuauuuuuaagcuaauuuuacuauugucaacauacuuccuacaguaaaaaacauucuaaggggcuggagagcuggcucagugguuaagagcacugacugcucuucugaaggucccaaguucaaaucccagcaaccacaugguggcucacaaccaucuauaaugagaucugaugucuucuucucgugugucugaagacagcuacaguguacuaacauauaauaauaaauaaagauuaaaaaaaauucuaggaugauuaagagcauagucuguuacagaggaucugagcucaguucuucacacccagcacccauguagaguaauucacaccagccuguaauucuaguuccaggggauccaggaucucuggucucugugggcaccugcacacauguguacacacacaugcacacaugcaagcacacgcacuugcauagcagugcauguggagguugaggauaguuuuuagaguugguucuguccuuccauuauguguguccuagagauagaauucagguugcuggucuuggcacaagaaccuuacucccugagccagccugcccagccaugucuuuagugugugagccaugagugcauugacucuguguugguugcucuucaaggucuucugauccugguccugauauucauguaguugaagagucuccugaaaaagaggauggugagugcauccuuuguaaucauuucuagugucuccaaaagcgcuucugugcuugucccucagcauauucucaaauguuuuauagaaauugggguggcucuggaucaagcauacauauacauaaauaaauguugcuguacagaaaauguacugaaauucuguagaagaaauacuuuuauauaauggaaauagggcuuaguaucaagauucaacuuccauguuauacaaagugcuaugacuuauuuuaaaaugugucucauuaagggcagguuuuuuuuaaacuuucuuaaauuguuugaguauuucaugcuuuugacagaaaaauuagaaucuagaaaaacguuuuuuaauggcuugauaaucucaucagucaaaaacacuuuucacauuuuaccauguguuccuccuagacaauauauauggaauguauauuuuguauagagaaccuagaugagcugggcaugguggcacuuguccuuaaccccaaugccagcacguggaaggcaggugcagcucugugcguccaaggccugcucuacagagaguuccagagcaagcacagguagagaggagagagaaccacucucaaaauagcaaacaaacaagccuaguguuuuguuuuguuuuguaugaaaaucacacucuuuguacuuuuuuguucuuucugucaugcuuagagguggcaauuuaugaaacuuguaaaacaaccaaggucauggguugugguuucuauuaucuuugugggacuguguaucagucucuuguagauuguucagaaacacuucagaugccucuuaaagccacugcugacucuggugucacagaauggugccugcuuagaugccgugggaagaugcuaagucugaagguccucccguuuaucaguucugcgucugguuuugcagaaaugacuuugagaagaaguccucgaaucaagcagcugucauuuagcagaacgaacucuggcuccuucuauucuguaucucagccgaaaucucgaagugugcaaagaauccacucgucccagcaggagucagguaaggaggccugggugucgaguauggcucuguugacuuggaauauuuugggaaaaagaagcauacaauuugauauuuccccauuagcagucaauaaucaaggugauacuagguaacaguccucggccuauagccauuccucccuggacucuuacagcuggccguccucauugcuuucuagauagcucauucacucccacacagugucccaagugaguggguagagcaguuuguauauuuacucuucauucuuuuauuugugauuagauugacuaauauguaaguuuuuacauuuauacuaaaaaauacaguauauuuauccuaaaaucaguuacuucaguugcucccauuuccuaaaauaagaguuaaauccaagaagacagggccuagaaagauggcuuaguaauuaagaaugcuggcugcucuuacaaagaacugagauucaauccucagcaccuaacaucuguagaccagagugaauucuaggacagccagggcuauauaaagagacccuggacuggagagauggcucagcggcuaagagcaccgacugcucuuccagagguccugaguucaauucccagcaaccacaugguggcucacagccaucuguaaugggaucugaugcccucuuuuggugugucugaagagagcaaugguguacucauacauaaaaaaaaaaucuuuaaaaagagagagacccugucccauccucugucccccgcuguagccucuccccucccccccccccccccgaaaaaagaauauauugggagggcaagucuugaggaagaauuaaauguuauuuuugauuucagaacaaagagaaaauuuuccaguucaaaguauucagucuccuaaaacacuucuuuuuggggcauugucugagauucccagcuccucuaagaaggguucagcccaaauuaagagauccuuaagaagcauguuggauucugagauaucuacaucuuacgagguaaaaaaaucuuuaauguuuaaaauggugcagucuuggggaacauagaaacaugacugaggaagcaacuguugaauagagaugaaaaccggggaucuguagagagcaaaaggucagggguacaguagcguggggcacaccuuuaauccuagcacuugaggcagaggcaggcagagcucugaguacgagcccagccuggucagccagcuccucagagugaguuccaggacagccagcuacacagagugaguuccaggacagccagcuacacagagaaaccaaaagaaucugcguggcugguuuaagccaggugagugguuauugggagcaugggagccuaacacaacaggcuuagcugaggucaaggcagaaaggaggagauagggguguuauugacuucuuuggcugcaucuaccaugugugugaucacuauagaggcucuucuagauuguaccuucuuucauccacucccauuugacuguccaucacuguucaaaaccuggcgguugcucuuuaugucucuuucaggacaaaaccacugaguuaauuccugccucauuuacagacuuuugugcucaccaaauuguccuuuguccccauagucccugaacuccucaguucuaccuggaauacuguaucagccuuccuuaauuugggucaaacuggucuuucugaaagcuccaucugccaucuggccuugcuaaagcaaaguucucuaaguuuuccuaaagcagaacccuugugucagaaaugaucaucuugguuugaaaagcauugaaacugcuucauuguuagaggaugccacagagcuacaugacaaggccauucuccauagggcagauagucucccauguucucagggcuccaccaugcccauaugcuggccugagccuuccccacuugauacaucuccucugccccacuuuccuauccuagucucuuccuucccuugcagaugcccauucuuuuuuucuauuaguacuuacuaagaguguguguguguguguguguguguguguguguguguguguagugauaugcauaugucacagcacaugugugaaggccauaggggagcucuguggaguuagucuuuuguuccuaccucucuaugagggauccagggaucaaaacuuagguugccagucuuacaugggaagccccuuugccuacugagcuauccugcuggcccuaggcauccauucuuuacuaccugauucauaagacaauuuuccuugucccucaguuggguucacagccuccuuugugcuccgauaugcuauaccucacugaacacaaaaaccuguuagauugggcuucccuugagacagucuaguaguguuauagaaagauagguauuugacuuccccauuuuauagaguuuuuagcuacauuguuaauaaaaaggaagggaauuuuugguuugagaguggccuuucuaaguuguuguuguuguuauuauuauuaugucuauguauucugcucuuccaucuccauccucccacccucuccuuuuuugaaucuaggaaaaguaugccaguaaaaucuaauuauguuugggagagggaacaggucacuauucuagauuccaacuuaagaucauucuuuuagcugacuuuaaaucuucuguuuaguuuucuaguggucuuagacuuuacuaagacaaucuuuagagaauauggauuauaauauucaaacucugaaaugaguuuuuuuuucagacucccaaaaagaguaaccagaaaucuccaagcuuuucuaaaacuacaccaagaagauucccucguacagcacagaccuuacuauacacuccagaaagacuacaaaacuccccuacagaaaugacaucagcugaagggaccauuucugaagcaaccauaaaaacccccuccucacacgguuacaacucaccauuugcaucaaaagucacuucucaaaagacagucuccccagcaaaagaagagaccucuccuccccucacaaagcuacccagcacacccagagagucugauguccagccaccucaauguucgucagacugcacauggccacacucagugaauuccaguccagaagguccuuauuacccagcguccccaccuccuauggcuggccaggccaggagucagugucugaccccuauaagauacuccuucagaaccccuccacguacagcccuugcuggcacgucuaagcagcaggagcaccaagagcucccucuccccagggccucucagacacaagaaccuccacagggacuggagaagaaagcucucaaaaucccaaagaaaccagcacacacaaguacuucaccucuuucuccagaggaacauuauucuggaugugaugucuccccacaucaaccuaggaacucuuugucagccuccccuccuccuggagaacugaauuggaaagaacaccagacaucacccaguguaacuucaucugucucuuguccuguuccuucaacuccuccuagaaccccacagagaaugaccugccccauaccaccuucuccaccauccaagcuucggagaucauguagaaagaaguccuguccuccucaggacuucccagagugccauccuggacccucugcugcucccgugcuuagcucagccaccagcccaggagcugucacaggcucuagagaggagcagucucaguuuucugaaggacagaguuaccuaggcacugguuucagaagugacugucauguguccucuccugugcucacugcaagugacacaaagugcuugccacugauugaugaagcccaacuccaugggcuuaaaaaccaagagguaaaaaguggcaucuugccaggggaagaaggugaggaaccagagagcacuauugccgacgagcuucccucugugucugacccugggauucuuguaccugcgccuuccucugugucuagcuccucugagcugcugcccuacccccugugcuguacagcagacggaaagcagaggcaagaugcugcucagcaggggaguccacgagcuuccgaggccaccagcagcccucagaccuacgaaguugagcuggagaugcaagcuucuggccuucccaagcuccggauuaaaaaaauagacccuggaguucuuuuggaagcugaggcccuaggaaaggaagccccccugggagaggagggugcccucccugcucucuguaugcccaaggccagcaaguccuccgggagaacugagcacccuuacuugucacccccuugucuccgccccucacacagcacaccuggcaagaauggaggucaaaccuucaucugccaaucuuguacucccucucgcuguccccccaguacccccucuccauuucaagcagaugcugggguuucuuggacaccauccccuaagcaaagugggaagaccacuccugaaauuaucaaagacuggccccgcaggaagagggcaguggauugcagugcuggacccucugcugggagaggcgaggccaguauggaccuuccuggguccuugucacugcuugagccugagccugagggaaaggagcgaagccuugaacaagaccucucuaagguucucaucucagaggaguuugaacuagagggggugugucaguugccagaccagucaccucccaaagacagugccucugugacagaggaaaccuccuggggacaguuuggauuaggcagaaagagauuccuguccgccaaggaagaaucugaauacaaagucaaaagggucugugauucccugagugaggauccccaagcuagcaagcagaaagagugcucuccacgcuggagugcacuaccacuccacucaguaggggacgacgagguguuuguuucugguaaguuuauuuuucaaaccaacaugguaucauuuuuauccggugagguguuuggagcucuggguggccuggagucuugugggacuacacuuaccuccuggcaucuccuuaggcuccaccccacccucugguugcaugguucgaagcugucucucugccaguggucugcaggccuugacccagucuccacugcuguuccaaggaagaacgcccuccucucauagcacggacaccagagguaaucugccugcuaccagggcugagcucuccugugggugacuugcagaauucucuugaguacagaaugugggaagauguuuuugaccuugcagugucaugugcucuuccuaaagaggcuucauuguagaacuuagggcaucugaagagaaaccugcaaaaucucaccuauuucgggugauggaagugguguguacaccacgacacuacugggcugugguuucgggcagcaaguggauaaucagagccaggcacuucucacagcaggcuuacauccaccuucaucacaaaggcucugccaucaaccucuaggcuuccccaucuucuggcccuuccauaaaccacaagaucuggcugcucaugacacuggguuaggaauauguaaggugagggacuuggguggcucucuuaucacaaaaucauuucagccacacagaguaacaaacccugagacccaaaagaaagccuuuugugcggacacacaagcaauuuucaguugcuugucacugccagcguguaacccuuaagaguggaggugacccucuguggccaugcugucuuuccuuaggccucacugagucugcuuuuuccuagaugaggaaguggauguguuccccucuacugcugaagagucuccguucagccacacccucucccggaaacggccuuucagaaccuacacgagaaagaagcuuauuagcuagcccugcuugagcauugcgcuggaggacucaaaaugaggaacgcugugagccuggcuagaccccuugcacucaggagauguacucuagagcagcuuucucuggguacaguaacaaugccagacucaugccagcaaucuagcauugugcccagaacacgaguggccaggacuucaugggacugagaaaguucacaaguaaagaugacagcagcaaagucccuguggacuuaaagaaauugaagauucugcaggguaugguaguaagccuauaguccuagcacuugggagacggagacagaagauucugacuacauagcauguacaagggcagccugggcuacaugagacccugucucaaaaacaacaaaagacauuaaagaccuuaagccuuuuucccauggucaucugaagauuaccacuggaaugccucauggucugaaaauuccucucuaggucuucauaugaggccaggcccugacucuuuagggggaagguuggaagucuggugggcagcuaguacuauauauaacucagacagcccaaagaucccauuccagaucuugguaauucagaggacuacugccacacugugaaauggaaaaaaaggagguguuuaccaagccuuuucucuggguacaguaacaaugccagaguucuuuuacacaauugguacuucauaaaguaagacccauaagugaaagacgucagcaagaagcaagcuaacaauaaagucauccuggcaacuuagcauuuggcauuucugccugggaguaacuggcuaugguccagagcaaucauacugcagggucuacccugaaaagcagccaccgcaugacagucuuagccagguaugugcuugacaccuguguugcccuauaaucaaccuaaccaacuugcuauggaguguuggcaggagccucauuugcagugagggcugauuuggaaccuucucagucuccccagaagauucaacccuguuguggucccagggcucuuucuguugucagaugccaggugaaaacucccaugucuccuuucagagaaagaaaaggcagcccuggaaugcuugcauggguucaauugccaguaacacugaugaguagagaaggaaggguuucaagcuggcucuaacuaaguucauaguuauuuguccugaguugggagccugugcacaggcaguaggaggggagaggcaggacuccaauaugcccuucaaggauacucuccaauaaccucaccaccaccacaccccagcucugauaggcuccacugccucucagcugaggaccagccuucaggaauucuugggggacauauuuaagauguaagccauaaugagauuacuccuguuuauuauuaaaugguauuuuuuaaaaauucuaaaaaugcuuauuacuuucccaguucucccaucuguauaacaccauugaaagcugugacccccuugccacugacuguuuugugacaagccuuggauuaucuccagaacucugggcacacaggcuuaaagucagaacugucccacaaaugaaaaaggagcagucaaguauuauagcugaaggaauuugcauagauuacaaaaaaaaaaaaaaaaaaaagacugcuaagcaccauaguggggaaaauccaguucuuuggggugugacccaaauuuucggacuccaguugguguaaagaugagacucuggauuuacagugugagguaaggacuguccuucauagaagcaaaacaggcagucucuccucucagcaggacuggaaucugaagcagggucugaccaaggccuacaagggguuuuuccugacgucgaucaucccugggcugguucuucgggguucccaccggggcuugggcaaggguccaaaguuccaggagaggcccacuucacccauagguagcacccgcccuacuggggguucaguugucucccggacccuagacuccucagaggagcccugcucgcugcacaagcuugagcguuuccaugucagggguaguggggcauggaccaagucccgggacucaucccacacacgggacacccccuccaga

SEQ ID NO: 3890 - RNA, 5396 nt, Mus musculus
cgcgauggaugaugcgcguuuccgagcggugucgcggcggcccgcgcgcacccgccgccuguuccucagggacgcgcucggccucuggacgccaguugacuguggcgcgauugcggauguucugagcacggcuggcguaguuuaggguguugagggucucaucgaagucggaggaggaggggcugacgcaggcgaucaucacugucuuggcauucccucccagagagucuuugaggauccugugagcacgaggaugauaagcgucagugccuuggcucuugugagcacugaccuggcaccaucggccuagguuuaaagccaccuuuccuggggggcuccaugaucccacccgaacccagagagaugggccaucucaccgggugaucuuggaaucacgguaagggauguggcugccucggcgcugggggucccccagggcgcuaaugacauuucccagcgccagcagggugcuguuaaucuggaugcucucuuugagccguucuccggugcugccggucuucagaacccucucggagccugccagguccacgaaguggaauuuggagaccagcagguggccagcggcgggucgaggcaagcggcuaggaguccguccccgcugcuccagggucacagugaagacugugugugagcggcuggagaggcgguugaaguguguggcgccuguguggcgcgcagcauugcccaucucuaggaggcucagcaccucguccaggccuucuacauccacuucuuucaccccacagagcacuguggaaacaacacuguaagcaucuccccagaagacaagcaaaaacauccaggacuccuaccugcucuuccucacccagaguggccggagucccugcuuuuccgcacuuaccuuaguguuucccacucuggaaacagaagcccauacugaacucacugcagacagcaaacaaacccaccauccagggccuggauuucccuugaggaagugucucucccagacagguuaagccagcccacccucagagcagacaggcaggcuuugcuugccaaaggccucccucccagucauuagaggauucccaagucuucucaccaacauuuccccgaucaucuucccgaagcuggaugucccggcuggcagugccaacuucuagcagaucucggaacucuuccuuguagaguuccagguaggauacaugcaccaggcaguccagcaggucauucucaucaaugagcuugaaggccucagccauggcccuugggaugauaccuuguucaucuucaugcagggaggcuggggagauaccacagugucuccugccgccaugccccaccccaaccuggcccaaguauccaccaccaccaccacagcagcagcagcagcuugagaaugaggcuguagcguggagaagacaaugacagaggccaaggagagacagccucugcuaggccgugcuccaggauagggaagcagaauuggagacuucaagcaaccucucaugguuuaaucaaccgcuuuccugaugcgcccuccuuaucccauucccaacagauuaucagauacccuggacuugauuacuccuugggacaaguaagucacuaccacggcccaugcacagcuaacugaugggccucuuaauuugcuucaaaaguagaguguucauccuaauaucccauaguaaaguuugcuuaaauauacuugcaacagaaugccaggaaguuaucaaauaaaaaagacuggaagacuagggguguagcuucacggcagagcacuugccuaacauaugagcacccaaguucaauauacagcaacacacacacacacacacaugacugaagaauaguuaaugauaaauguuccuuaucguacauaucaucacauauacggucuuuaucgcuauccccaauucaaaguagacggcuccacauauuaaaucaaaaacuaaaguaauauuuuauagcaagaaaauuucagaugccgacagguguuguggugcauaaaccaugaacauuuaaaauuaaauauuguucauuugugucuguguguguguauggcgggggguggauguugagaaucaaacucauggccuuaagugagauggcaacucuaccagugagcuacgcacaauccuggccccagggcauauuauugagaaaacaaaacaggauggaaaagaguggauaucaaacaacgcauguuuuaucaggcaugguggugcaugccuuugaucccagaggacagaaggcagaggcagaccagccuggccuacagagcgugugccaggucauccagggcuacacagggaaauucugucucaaaagaugaagggaaaaaaaaaaaaaagccaugcuugagguauaaaguauaaucaucuccacagagggacugggaugcucaggaaggcaaucaucgggccugcuauucucugcauguacucuccugcauuuucuuaacuuucuacaacuaugccucugccauugcuauggucuguguaugucuccccaaaacucaugcauuaaaauccucaccccuccugugauaauauuaggaaguaggguggaguuggagcccucaugaaugaauugaauguaagagagacaaaacaaaacaaaaccccucuguggggcuggagaggagguugccgagugguuagagccacuuacugcuaaauaaaaggcuugagccacguaugguaguacaugucuauaauccuagcacuugggaaaacugaaacaauugaaaguuugagguccagccgggcggugguggcgcacaccuuuaaucccagcacucgggaggcagaggcaggcagauuuuugaguccgaggcuggucuggucuacaaagugaguuccaggacagccagggcuacacagagaaacccugucucgaaaaacaaacaaacaaacaaaaacaaaaaaaaacaaaaaagaaaaaaguuugcagucuaccuggacuacacaguaucaggccagccucagacaagccccugccacaaaagacgaacaggcucccuuguaaggugauauggaaacuacugcccuuuaauuuuguugacaacuugaccuugucuuuggagcccccagagucaauuucuguuuacaaugcaccagcauagcauuguuuuagcaaccccacugcaguaaaaacaggagcuaggagaaaauaaaauggcucauguuccuuaaagggggacaguuccugccauggaguggccaaaagagucuuccccagaugcagaggcuccaaucucaacuguuccgaugggaacaugauuccgagcccuuggugacauccuaagacacacuugguuuuccuguuaugaugccaaaaacccauucuugagaaagccauucacccacaaaccccacuuccugccuuucccagccaccugacauggagugcugaccucugcccaggagaugcccacucccuccucagcauccuugccuugggguggggguggggguggggguacagaaaauucagaaacauaguaagcaucacucacccacacuggccucccccaugguauaugucuucccagagccugucugaccauaggcaaagacgguggcauugaagcccucaaagaaagccucgaggaggggcugcacgcaagccugguacacagccucuugcccaguguccucucccaggaccacauggaacccaaagugucggucccgccccagggugauucgaccccgcucaggcuccacacgcaggcaacucugaugaccaugcagcagcuccuugggcagcaaugggcgaacucgaagggccacccucacgggggccuccucagccccaggcagccucugggccuccagccccaucuugaaggacagcagcuacggaaucugcagagaaaagaaaaggcccuugccacuggccuguacuacaggggccagaccacauagcuuuggggagacugacggagggguagucaaaguucagagcaucugcccaaaggggcacccaacugacacaaaccacaaaaccauaaagccacaguaacuuuucuugacauccuccccuggccaaaaaauaaaaaauaaaaaaagccccagcacuugauaucuccgguuuuuguguuccagcugucccacucccccuucuaagucucuaccauugcuccucccugaaacugcuugacaccugcccaucuucuucaaagaagccaaaagauccuucaagaccaaauuccuaucacuaaacucugccaguucuuuuuuuuuuccauuuuuuauuagguauuuagcucauuuacauuuccaaugcuauaccaaaagucccccauacccacccacccccaacucugccaguucuaucuccuaaguaucucucaagauuaucagcuacacuccucauccuguugccaaaaccagucaugcugcugacacccugaagggauaacuucugccugcucccuuuccgaguuucagucuccccgaccucuccaaccgcgcagucuagagcaucuuucaaaaacacaguugugacagucucauuuuuacaccccacuaacaauaaaggaagcuuagaacacacucccuaccuuccccaucuccugaauaccaugccuuuccucucaggccaucaaccucuguguuaccaucuucauccacccacgcuugggcugggcucaccuuccccacagggccagggaagcugcucugcucugucccaucaccacuacagacagcccuuugugcugcccacaucagacacugaccacacggaugccagagccagagucucucuccccauggaaagcaagaacccucuuugucuauuucgaacucuaucaucagcacccagcacaggguacaauacuaucuagcaauccgugaggaccccucccgcccccaaucucgccuucuccuuucucaccacauucuucaaccgcaguaucccacgcuacacuucguuguuuucguauuuacuguuuagcaucucugcuuguauaaccgcucauucauucgguucugguuaggugcuggagccuggguacacagagguaacagugccuggcggcacuccaauccccagguagacucuggagcuguguguggucccggcuucuccuuccccacaaucaaggcuccgagccucaaaggcgcccugacaacuccacccgcgcgaucggccucugggaacaggcccucccggaaaguuugcaaaagugauuacaaacguggacccucgcaggcugcuccuccuggcccggcccgcccagugagggagcucgcaguaagcugaggggcacagauggggggcugcucagucgccucccgggugagcccugucuagcccuccauccccucgggacccacacccaccugccagagugcgagcgcagucccgggacgcgcagccaagcucggcgccccgacccg

SEQ ID NO: 3891 - RNA, 699 nt, Mus musculus
gcuuccuccuuuuuuuuuuuuuuuuggcucuuuucaguuuauugcaugaaggaguuacacuaguccaaguuaaaaguggaccccaaaugauuacauuauacaagcugugagguuuuuaaacuugugacaagggacagaagggaaauucuacucauugcaaggaaauccucacuuaagcuucagagagccacaagcacuuaaacccaugagccuucggcugaucguccuuagccaguccagucucuaucaggagcuggcauauguucuugcgcuggucacccuguagcugaauuacuucuccauauucuggaugcucaauuauaguaccauugcaggcaaauuucuucuuaaucgccuucacuaguuucuuuuuaucguaaucaucagcgaucccuuggacagugguaagggucuuccugccguuucucuguugaauucuuauauggauauaauccucagugccagcaggaagcaggucaucacccuuacuuacuugcaucagcaaaggggucgaaagaguggagguucuggauagcagacauacgauacgauuccuuuuccuagguggaaacggccugcggaaggcggcugcgggagaaggcgggcggggggggggggggggacugagcgucgggaagcgagggggcucgagggggaggcagcugaguccucgguggcggcucagugacuggggccgcu

SEQ ID NO: 3892 - RNA, 699 nt, Mus musculus
agcggccccagucacugagccgccaccgaggacucagcugccucccccucgagcccccucgcuucccgacgcucaguccccccccccccccccgcccgccuucucccgcagccgccuuccgcaggccguuuccaccuaggaaaaggaaucguaucguaugucugcuauccagaaccuccacucuuucgaccccuuugcugaugcaaguaaguaagggugaugaccugcuuccugcuggcacugaggauuauauccauauaagaauucaacagagaaacggcaggaagacccuuaccacuguccaagggaucgcugaugauuacgauaaaaagaaacuagugaaggcgauuaagaagaaauuugccugcaaugguacuauaauugagcauccagaauauggagaaguaauucagcuacagggugaccagcgcaagaacauaugccagcuccugauagagacuggacuggcuaaggacgaucagccgaaggcucauggguuuaagugcuuguggcucucugaagcuuaagugaggauuuccuugcaaugaguagaauuucccuucugucccuugucacaaguuuaaaaaccucacagcuuguauaauguaaucauuugggguccacuuuuaacuuggacuaguguaacuccuucaugcaauaaacugaaaagagccaaaaaaaaaaaaaaaaggaggaagc

SEQ ID NO: 3893 - RNA, 1551 nt, Mus musculus
aaugacacuagcacaaucgguuuauucacaaauaaauaaauacacaccaggcaaagcuugugccugcuucaucuuuagagcguguacccuauugggcgccuccuuccaaggaggguuggaaugguacagucuggaugagggccagcucccaccccgggaugcccauguugguaucacugccgccucuuccaggaucuacucccuccgaaggugccaagaccaaaggaaaagugucugugcucagacagggugacaaucauccguugcauuguccccuccacucuucaggcaggcggccacuccugcggcggcguccagguuucuagaagagccagcaugucgcugcugaagagcugcaggaagagugaacagcgccacaaucaacaccugccccagggucagguccgcgcucauccgcuccacgcucaagguuaagcgagcaagcaaagcguccuuaaucccugccuguccaacucccacccuguucggacacccagggcacacggggaugcgcccaagggagauccugagugcagcagagaggcugguccgcgacguggggcugugcgucgcgcaccaacaguagggggcgccaccucgacagugugggggaagggguuacuaaccggagaugagggacugggcuccauuuccugccuuuccugggaugcuguuucugcguacaggaacgaugggucccacgauucugcggcgacucggggucuaggguaggcaggcggggauccccacgacaccccgcugcagacggccgggcuuaaacggggaccgagcgacugcgacugcgccaggucgcugucggggcacagcgggcagccucgaggugacaccgcgugccgcugucgccggagguuguccucgcugagucccagcacagccgacagguggccaauguagcggauggccaggcgcagcgucucgaucuuggucagguucuggccgguuggugccacggauggcggcaagaagcggcgcagcucgugcagcgcgcgggcgagugugcgcauacguagcuucucccgcucgcuggcgcucugccgcuguccgcuacccaggcggcuaccgugcgucccgcgccuacccggggucccagcacgccgggccgggcgggcgcaggguggugcagggcugcuggccugggcaccgucccacggguccgaggaccaggcuggggagcagacgcuguucccaucggaaggcaucgguggcugccgaccagcgggacucaggauccaggacucggagcgcggcucgcacaggggcugggccauggcagcggaggccugaccauuggguccgcuguagcuuuauccugagcccuaggugugaagcgggccccuuccagaauucaucagcauaucaaagccggcucgagccaggaggggggcagggccugaacccuuugaaccauagcaggggcucugaggugcaggaccccuuaguccagucugcuccaccuggaccauauuuggggccucaguaagucaggcaccuauggccaggacugccaguugaaagaaccaugcucagaga

SEQ ID NO: 3894 - RNA, 1551 nt, Mus musculus
ucucugagcaugguucuuucaacuggcaguccuggccauaggugccugacuuacugaggccccaaauaugguccagguggagcagacuggacuaagggguccugcaccucagagccccugcuaugguucaaaggguucaggcccugccccccuccuggcucgagccggcuuugauaugcugaugaauucuggaaggggcccgcuucacaccuagggcucaggauaaagcuacagcggacccaauggucaggccuccgcugccauggcccagccccugugcgagccgcgcuccgaguccuggauccugagucccgcuggucggcagccaccgaugccuuccgaugggaacagcgucugcuccccagccugguccucggacccgugggacggugcccaggccagcagcccugcaccacccugcgcccgcccggcccggcgugcugggaccccggguaggcgcgggacgcacgguagccgccuggguagcggacagcggcagagcgccagcgagcgggagaagcuacguaugcgcacacucgcccgcgcgcugcacgagcugcgccgcuucuugccgccauccguggcaccaaccggccagaaccugaccaagaucgagacgcugcgccuggccauccgcuacauuggccaccugucggcugugcugggacucagcgaggacaaccuccggcgacagcggcacgcggugucaccucgaggcugcccgcugugccccgacagcgaccuggcgcagucgcagucgcucgguccccguuuaagcccggccgucugcagcggggugucguggggauccccgccugccuacccuagaccccgagucgccgcagaaucgugggacccaucguuccuguacgcagaaacagcaucccaggaaaggcaggaaauggagcccagucccucaucuccgguuaguaaccccuucccccacacugucgagguggcgcccccuacuguuggugcgcgacgcacagccccacgucgcggaccagccucucugcugcacucaggaucucccuugggcgcauccccgugugcccuggguguccgaacagggugggaguuggacaggcagggauuaaggacgcuuugcuugcucgcuuaaccuugagcguggagcggaugagcgcggaccugacccuggggcagguguugauuguggcgcuguucacucuuccugcagcucuucagcagcgacaugcuggcucuucuagaaaccuggacgccgccgcaggaguggccgccugccugaagaguggaggggacaaugcaacggaugauugucacccugucugagcacagacacuuuuccuuuggucuuggcaccuucggagggaguagauccuggaagaggcggcagugauaccaacaugggcaucccggggugggagcuggcccucauccagacuguaccauuccaacccuccuuggaaggaggcgcccaauaggguacacgcucuaaagaugaagcaggcacaagcuuugccugguguguauuuauuuauuugugaauaaaccgauugugcuagugucauu

SEQ ID NO: 3895 - RNA, 2298 nt, Mus musculus
auuuuuuuuuuuuuucuuuuugaaggaagguuucaguauauaguccuggcuggccuugaacuacagaaaucugcuuacuucugcuuucugaaugcugggaucaaagucuacauuuuugaucaccagacuucugcuuccacaugcaaaccaugcacaaggaaggaagagagguucaagggaggaagagagguucaagcaggucagacaacuaacucucucaguuccuaaggagagaagccaggauucaaguccagagcuuagccucuuccuuguccccugccacaaaagguucuuggaaggcaggcgugguggcacacgccuuuaaucccagcacucgggaggcagaggcaggcagaggccagccuggucuacaaagugaguuccaggauagccagagcuaaucagagaaacccugucucgggaaaaaaaaguuuuuuggauauaggagcaagaggauguagagucacaucguugguguccccguaucugggguggcuuacagacuaguccugauggggccuuacccuugaaggugguggggaugugguucuccauaaggguagcaggugagagaucacugugcucuggucugcagcaaagacagagacagagagcgagaaaagggcucaugcccagagguauuuagagaacagaaccaagucccaggaaagaggaaggagucaaggaagaugcucauacucuggugugcacagugcugggcugcagaagguuguuuagcgguagcccagccugaggccaggcugagaucagacuccgggggaaggggaagccauauguucuguagaaaagaacaggaucucagagacaggcuggaaguucaugccuagaauuccugugcuugggaggcagagguauagacaggguugccaucaguuugaggcuaacugagcuacagacugagaccccaccaccaccacuucacaaacccaauaccaaaaaccacgcaaacaaaagaacaucaaacauugguaagauagcuccgugagucaaggugcuuugccaccaagccugaagccgaguucaguccucagaacucacuuggugggagagggagccaacuccaucaguuguuugcugacucaugcacacagcagcaucugggcaccccaacauacgcacgcacgcacgcaggcaggcaucaugcacgcaugcaaacaaagaaaaaguaaaagauuucaggcuuagcaguuagaaaaaccgagacaaaacccucuucgcaggacagaaagauggcuugucucaaacugugugggguccguaaauagcugggaaagacccauauuuucauucuguccuguuaauaauuguuauuaucuuggcucuuuaacacauaauguuuggauguuacuuuucccauuauuguuaugucaucacugucaaaacacauagucauguuuuucuuuuuuuuuuuuaauuagguauuuauuucauuuacauuuccaaugcuaucccaaaagucccccacacgcucccccacccacccacucccacuucuuggcccuggcguuccccuguacugaggcauauaaaauuugcacgaccaaugggccucucuuuccacugauggccgacuaggccaucuucugauacauaugcagcuagagacacgagcuccgggggguacugguuaguucauauuguuguuccuccuauagggaugcagaccccuucagcaacuuggguacuuucucuagcuccuccauuggggauagucauguuuuuugggacuuuugaucacaaauuccuggagcucugccugugcuggcuuccacagugcuggggucaaaggcacuuaccaccagccgacuccucacuguauuuuugaugguugagaaacaagauucuggaguuagaucacugggaauuggcaccuguaaaaaucuuguuagauuaccaaaugguuuccaaaaaggguuguuuugcaucuauugguggugcacgccuuuaaucccagcacucgggaggcagaagcaggcagaucucugaguucgaggccagccuggucuacagagugaguuccaggacagucagggcuacacagagaaacccugucucgaagaaaaaaaacaaagccaaaaccaaaaaggauuguuucagacugcagucucaguaucaauggaggagagaagcaaugccaugcuacuuugaccagaauuggggaagaagauuuugaauaaauauuugauaaagugaaaauuauuaaauauacuuuuauuugcccuuucuucuauuuauagugaaauuaaauguuuuucauuuccuguaucuacuucuuua

SEQ ID NO: 3896 - RNA, 12560 nt, Mus musculus
cagcgacuuguucagucagucaaucagucaaucaaucaauaagcccgccagucuuuuccugaagccucuccacucccaucacuucucaguacucagcauuagguugaucggaaaccauugcagaaaggugacccagccguuccagguuuuaugacucauuggguccuggaagcuaggaagaaagagagaaggcaagacaaagaaaggggggggggggcagggacauucaccugccaucucugaggacagguggauuuugguuacagccauuuugggacagccauuugguuaccagugugugagcauugucucgcccuggagcucgacacugcccaguacagaacaguggccugcugcagggaagagagggagguucugauccaagcccaggccagccaugcuuucuucucccugccucccucccuucuaccaagaguagguuguggcuggguugccacugaccuguggguuuuggcuguguugccuagacugaccuagacuccugugcucaagggaaacuucugccucagccuuccaaguugcuggggcuuauacacuccacacccgugguggcaacucuguucuuucugccuuugggucuugggugacuugggaaaaugcagcgcucugguacaugaagagcaaaccucucugcccauagggccuuucugucccaagagacacagacccaacaguuggucgucugacuguuugucauuccgcuuagucacccuggacagagcaccaucucucugugugaugcucgacaucuggaguaguagacaggccccccccuccuguauccugggacaguggaugaugcucacagguucccagcccaagaggcacaucucacccaugggcucccacucagccaggaccccauaaggggugaccauggccagagcccaggcugggggcagggccagccaacccugcaguagaauguauggcugcugggccaucaagcacgagggagcucuugaggguugcugugaguucaggggagcuucaguguguucucacacuuucagaaauuaacacguagcucccagccuuuccacccccaggaaggagagaaggagaaaagacggaaagcgcguucucauugucccugugauuggcaccgugugugaaugaggggucaccgcuuugggcugcucuuuuucaaggcuccugucuccccugcacgcugcauucacaccggaacguuucucuuuaaaguucugucuuucucucucccaugcuuugucucugcucuccuucgcuucugccuuucacucugggcacuccccaccuccccggggaucucucucucuucucuggaucuuuuuuuuccucccuuuucuucuauucaguuccucauuucuuuucuucugccccuuuuuuuuuuuaauucuuuuuccuuuuuugaauagcgccucuguuuucaaggggugggagaaguuagagaaguggguuugugagguuucccccuccaccacgcuguggcacagaccucccucugcagacacuggugugugcuagacccccucagagggcaggaaguuuggaaaaguccccaucgggcaagacauaccuguuguuacagauaaggaaccccaaauccucaagcggggggaaguccagcaaggccccgagacaguuccuuuucugccuugccugaguuggggcuuguacugacagaggucaggggugaaugcaggcuccccaaacuucuguccucugugggagccugcugucagaccuccuggcccagaguagcccuggugaagccaugggacccucacuuggacugaauucaagcaagaaggccaagucauguuuacgugacagcugucuaggcgggaauccccuaccgcacugucacacugcagaagcaguuguccccauauuggcuggaccugggacaggguugagugcucugcuagauggcucuccccaaauaaagcaucaccugggagcuagcaugcauuccguuuggguccuuacuggguucucucucugcgggucuguuucccuacgaugaagaugggccccuccugagagcuaugcuugguuagcuugguaguguaucuucugaguacugacuccauucuugugcaguccagauaggaccagaugcagggaacuaucacuguggccugaguagccauuaccccaggcauguuuagaccuguguccugucuuuggacuauaacaaauccaaguucccuccuuauuaaguaaauguucuuguuaagucaccugcuggacuucuauacaacuuacaaaacccuacuuagccacccccacccucuuugaucccucagguaguguugaccauauccuaaccagcgagcugugguaguucuacccuucuacuauggcuccucaaggggcagcggggcugccaucuuugucuuucugaauccaaaagagaaaaguguggagccauccauguuugccuaaccuuagcuacucaaaaguggcuuaaaaaaaaaaaaaguuuugaaucuacagagcugaaaauggagcguggcuucagggaugggcaaguugaaguuuaggcagggggucaucaugguugacagaguucauuccucaagcaguggugggccuggggugaggauggaggcuucagagauggcuucccugagggaacccagcaggacaguggcaaggacugacacuuggggaugccagaggcgaagggccagcagagucugccuggcgaggaacagugaccuuccagaggaggacggaggucacacagcccagugcaggaggcaguggauggccccugaucaugugguggagauggaaguugggcagugccugggcuguggucugcugugguacuagaggucaucugcacauggggucagggagggagcaaggcugagggaaggcugggaguuaaacaggggaaagcagguggcagagacugaggcugguucucucuagguggagacaacccugcugacuggaacucauucccuccuggaggaaggaaggccucugucagcucuaccacccaggagaugcuaacuguucuagguccugugaccuggggagccugggcagccggggcuacacucagucuauccugcuagccaggaacaggagcuguuuggaggagggaggcucgggccgcuauagccaaggagacacgagagaagggguuggccuugaugucacacauccacugccaggucuguggguccuuccauuauuccugcccuggccgguaggcaugccucauaccccagccuggguuuguugguguguggauugaaguuaccauuagcaacguagacacaggaccaguggcaugaaugaguuaccacgagguagggcccaucccuguccucaggcuuccagucgucauggaaugggcuacuucuuucccacuagagcagagccaaagauggaggguaucggaagcaaaaagacauaggcaagcaccagagagcagaugucacucagaugccgcaguguagaggguauuagcguggggacuguugaguaccuacugugugcagguucugagaauauucuucccgggucucaaaaaaaaaaaaaaaaaaaaaggcaaagcagacucugugcuaagucugagugaguuggucaccuaaggggagagguguccauuuccccagggauauucaggcuuugugccucaaggaauugauagagaccaaaaaaaaaaaaaaaaaaaaauguggccauggccgaccccuccccucaguggaguccugcaauggguuuugugucugggggcuuaguagggcugccacugcuuccugguuccacaggcuucuugggacaccugcuggcagaucucaccugccaaggcgggugugggugguggguggccuucaaguuauuccaguuugggcaaaaacauuccugaauccuagcaggguacauauggcaacaucucuuaaauguguguguguguguguguguguguguguguguguguguguguuuggggguuggcagaggacaauuuuggggagucagcucucuccaucuuggcauguggagaucaaauuccagucuaagcuuaggcuucaaguguuuuuaucugagccaucucacuagcucucccugccucuuuaaaaacuggcaccaaggagccagcuccugcaggaaccggcuguguggucauggaguuaccaaagccaacaacaguaaaacacucucugggcccucccguuguugcucucggaggcugccaggcaggugcuccuguuacccccacuucaggagggauggacggagucaaagacuccacucuaagccagggcucagcacuccauagcaggcugcggguuuuguuuuguuuuauuuguuugaggcagcccggcuaaauaguccagguuguacuagaauucaauauguaaccugagcuagccugaaccccuuauccuucugcuguagaguccucagucaggaccaccuccucugucuccagccuccuuuuuaaguugcuuuuacuuacagccauggcgccgucucugugagaaguuauauaaagugacguagcacuugcacacagcccacacacauccuucauaugauuuaagucaucucuagaugacuuauaauaauaccuaacacgauguaaaugcucuaugagucgcuggugugcugugcuguuuaggggauaaugacaaggaaaaaaguugagcgcagaugcaaccaucuaggccuaaguacgcaacacacagcugacagcagaaugguucuucucacccuaauugucuccuuccucuuccuccucggggcuucaaguacaucauauuagcaguauacucaguauguagcugaggagggccuuaagcuucuucuuuuauuuuuauuuuaauugcuguuguuugguuugguuguggagguuguuuguuuguuugagacaggguuuuacuagccuaagcuagucuggaacucaauaucuagaccagguuggccucgaacucacagagauccucugccuccagaguucugggaucacagagguguacuacaguuuuuuguuuuucguuuuguuuugcuauuuugagacagggucucaguagcccaggcuggccccauauuaauggccauccugcaccaacccccccugaguguugagaguacaggugugaguccccaugcccacuauccuccauuaaccuucaaaacaauuuuuuuuaaauaaagcgaacuugaaaagaagaucuuuuucuuuauaguuaaaaaauucuuuacaauuucauacacauauacaucuugauccuauuaaucccuaacucuccccagacuuccccuaacccucccugccuccuggcuccccauccuuugguuggguuuuguuuuguuuguuuguguuuuguaacccacugcauugaauuagugcugccugcguggaaugggccucucucugugggcuuaaccaugcgcaggugaccauugcugcccugaguucaugaacgcaguggccaugucguguccaggggacucucagcaacucucagcacuccuccuccuaccuagcucuuacacccuacagugcuccccaauccuugggagaaagaggauaaaaccaaccugcgugcgugcgugcgugcgugcgugcgugcgugcgugcguagaucagaggaccacuugcagaagucaguucuuaccuucugccauguggguucuagggaugccaggucagcaggccuguggaccagcaccuuuaucuucugugcggucucaccagcccucggaauguuuccaauccacuguuccuugagcccucccaugaaggcacuaugacacacagccaaccccacaaguggcugugcaggcuccuaaccgcugcucacaucccugaaaucaggaugacccaggagaccgggcucugagaagcagugcuugggaaccguuuugaauuucccugugccuccaucuccccacuugugugcagucugugccggggccggggggggggggggggggggaguggggggguggggggggugggcugguagggaaauguaagcagugaacuuacauuacaauggugucgggccugggaagggauuuguaaacuguggagcacugugcccaugugaauggauauguucauuccugucuuucuguugugaggugguugcgcgagcauguguguguguguguguguguguguguguguguguguguguaggccacagguggugcugggaaucuucaaucacucuucuaccuuauuuuuugagacaaggucucucauugaaccugcagaucacucauuuggcuagauuagacuagguggccaacgagccucagggaucuuccagacucugccucccagcacuggguugcaggugcccacagcugugccuggcucuuuauacgaauucuggggauccaaacucaggaccucgugcuuguacaacaagcccuugauagaucgaacuaucuccuuaguaaacccagccccuuucuguguacuggaagcugagcucaggccaggcauuccccugauauaaauaagaucguagacagcaaaguuauuugucauuuaggcuacacccauaccucgcaauaucagauucuggacacacacaggaagagucaccaccugcacucuccccucccccaaauaagugccccauccuucgugauccagauagaagaggaaaugcccaguuccucucugggcaucccacauacauccaucagccugccuuccuccaggaaccuccuccaaggccaucuccugcuccuugccugcuucugacuucugucuuuuacacaucccugcuuaccuuucugcagccuguggcagccaggcucccucagccccuuccucuguuagcaucugguaccuggagauccaucagcccgcagugcacuuguccuaauuacaggaccccagccuucuccuucacugagccgccucguccacacgugcggucucuccacaggcugugaggcugagggcagaaugcaugaucuugugaccuuccacuccaugcucaggauuucccccaucucccuguauggaagugcacugggcccacugugugugugugugccugacuucugccuguguguacuccagcugucccucccccugcagaccuaaauuacucuucuccuggcauaaauccagaccugacucgggugugugggugacugcaaaauaaauguugauuccagugccgccuuggcuuggagagaggcagugcugucaggggacguucaaggauggaggccccggggaggagucacaaaggcuuacuggaggagagggaggggagggcugcaggcccggccaugcuccuugccugcccuccaaccccagcgcuucuccgucggcaguuauucugaacucuuucuuucuccacccugugccuccagccucugacagcccuugugccagcugcaucuaucuuagugacagcuuccuaaucaccugucaccaagccuucccacccaccuucccauggugcaccccacaucagucuccauccagugggcuccaguuccaccuccuggcuacccuagaaaguagugaucaugucccauguuagagguuggguggucuuugcuggucuuuuacucauuuccugucugauauuuugcgguuccaguuuggugacucuuaaucuugccucuaagaagcugugaggucccugcuauugaagaucuuugugaccugccggcacccauguggcccuuagcauaggcaugggugaaagcaaugguucccaucccugaggcuucccugcacacaagccucaacugcaggcuucagcacuuucucacugcuuucauuuaaaagcauaggccugagauuagaccuggccaccgcugaaccuagggggcucagccaggucacucaacuccucucugccucuucccucccucccucccucccucccucccucccucccucccucccucccucccucccucccuccagggaggccagcucuucccaggucucuuucuucucuuuuugcuuuuccuuuccuuuccuauccugacuuuuggguuuuuuuuggagaccaggucuuguugcagagcccuggcugccuggaacuuguagcucaggcuagccuugagcuugcagcaagugguccucuugcuccaacuucccaggagugcugggauggcaggugugcaccacaaugcccgcuuguagaagggguuuugucaccagagucccauucucuacauccaugaucucagaagguaaacaucuggccucugucugugguagcuuccuucccuggcaccauccugguuacagacgaggacucacccacaggagcuugagccucuugccagaagaugcacagcucagcucuccuguuuaccugcagagggaggcccuggcuuccucugggccccugucacuuguggcauccuggagagaaccuugucagcuacacuggcaggacagaacacuugggagcccaggaaccagaggcugaaaucccugccaccuccccaccacacaguguuccucagcuacugccaggucucucauagccuuugggccccuucauucuacuccacgacaccaggggacuuuuugggggggggggguguucaagacaggguuucucuguauagcccuggcuguccuggaacucacucuguagaccgggguggccucgaacucagaaauccgccugccucugccuucugagugcugggauuaaaggccugugccaccacgcccagcuccagggggcuugauaccaugucuacugaccucucuaugcugugucgcucugagacccuggggccggcggcauaaucggcuugcuugcuuuucugugguaaaucuguuccuggacuugcuucugaucacuguagauuaaacacagcagugcaguguccuggaggaggcuaggcuggggcugcuguguccuagagugcagggaacggggucuaguuaauaggcccaagccugugugcccucaguuugucuaucuguaaggaaaaccccagcucggucugugggagcuggaaggacccugggaagaagcccuugacccugccuuccucccaggaaaagaacccaaggcgucucgcaugccaggccagcgcuccacuacuaggccacaucccuaaaacaaguggaucuugaagaauuggugauuuccaccucuuugucaccuguuuguagggaagagcgcugagaccauugaggacccaguucuuaagucagagugcgcuggggacaggcccucagggcuguuggaugauugggcuagggcuucccugagaacagugaauuccuaccuugggcagcaucaugggggauucugggccuugcucugucuccaggguacuucaggcuacucuagggggccucuuccagcaagccccacccccaacugugugcuuucuucuuuccacugcugaaaccaaaggagaauucucaaggcaggcagagaaguucccuuggggggcuccuuuccuccuugcaguccuggggccuugaccuuuggcucaagggaaagguggcugggaccgaaccagagagccaaauggacuagaguuucuuuuucccuuucuuuucuuguuuuuauuuuuaagcaagagauaaauagaggucacucugagaugacaagagaacauggggagagauaaaagagagcaaaugggagcaggccagaagcaauggacaugggggagagcuggacucuacccugcgauggugggagagaugaaagaggagaaagagaugagaugggaacgcaagaccgaguggcagagcggagcggaggaugggguugccauggaaacagaagaggggaggaauggagggaggagaagacaggauggagaaggcagggacucugcagaggaggggcaggacaggaggcuagaugaagaggaagggaagccaugagaggucccgguaggcuagcaaaggaggggaaaugugacccugaaaucuguccugucuggacuugaguggggaaacucuggggagccugcuucacccugcccacagggacugccuuagauucugaaucuguagguuggaaaugcuguucccccacucccagagaagcucacauguacucauccaagggcccgacaaaguucaaagccagccagagucaucugugguucuuuucuuugccccuugcacuugugaaccaaaguuuuguuuuucccuguuacauuauuaagcugggagucuugggggccagcacagacagcauccuuguugaggagaccauaggugugcucuuuugcuucuagaauuagagaaacgacaagaagccuuccagauacaggacgccugcugucccuuccccagggaagaggagcugguccugccacucagggaaagggcggcuaggcugggguugucuauguggccacuuucugagcucugcuccacagccgccucuucuuccuugagccucuguucucacaaggugcugcugggguagccacacgggccagguauccacaccuggaaauuggcaucuaacagaucucagauacaaagccaguauuuguccugauaaaaagaucaauaacaaguucuuaaaaauuaugauaaaguccaagaaggaagaaggguuuggguuguuuuguuuguuguuugagacauaguuucaauguguaccuggagucgcaguggaacccaagugcugcccuccagcucccagugccauguuuguagcaccacaccuggcugggaaaugucucagaaaaggauuaaacuuggacuugcugaggacuuagagggugggaccucggcagguggggcagcacaaggaagauuuccugcagaugcgaugcaugaacuaaacgcaaaagguugaggaacgagaaagaguguucuuggcaugugcaaaagucacuugcaggcaaggaucugagacagagaaggggagccgugcacggugaagggccucacaggcacagcaguccagacgggcucacgggcccauugauugcagacgcaauggaaagugacugggcuccagaucagggccaacccugcccuacccccaaccccucuaguuuagcauuugagggcaaggaacagcugucuuggcagacuucuuagguuccaaacacuccacaagacgguugacuggugagacccuugcucugucuacugcccuuacaacccuccaggguggacagcaaugcccugcccacaauccuggggcaggagaguuauguuuaguaugugggagaaaaguguacuaggacuuaaaccccagaucaguucuuguaguguggcgcaggggccuuagggaccccaaaauuccacccugcagugaagacccuaaaaccaggcaaaaugguucaaagaaaggaucucuaccaaaggcuauggugaggugcauguccagcauuugcgguaaagaaaaagguccucuguucacuggggcugugugcugucugguggaagacagccuguaguuuccaggguucuagugacuugagagcagagccauguauugcugagcaucaagggguccuuagcuucucucucucucucucucucucucucucucaaugccuuggauccccuggaacugaaguuacagacaguugcgagccaucuugagguguugggaaugaaggguccuuggaagagcagcugcuacuguuacccgcugagccaucgccagcccccauucauucuuucuugacgucuggguaacgcuccauccugacagagaaguuaguaugggcagaggccccugucaggaaccaucaagcgggagaggggcugagggccggcaggagaacuaaggccagccuugggcagcaggcugaggcaucuaggccauacccaggccauagugggcauccaggcuggagaccugcuacccauggcuccuccuuuuauggucccaauggccuuauuuaagaggaggaggaagaggaggagguggugguggugguggugguggugcacagggccggguguugugugugguacaaaccuguaauccuagcacucaguagggcugagugaguagggauauggugguugucgagggagauaggagcuccucaugagagguuugugcucaggaggauaaggugggaugaucccuugaguccacaaguucgagaccagucuugguaagacauuguccagacagagcaggggcuaauauauaucagaccuuuauguacucuggcccagcucccgucuaacuuguggagcugaaccucuggaaaggggaagcuggggaggagagacuacaguagcuaaguuuccgcugggccuccaugcuguggguggcccauggcugacagaagcgagacuguggcaaggaaccgaggguuugcacaagcuuugggcuuucacuuccucuucucugaggaggauagauaggaucaccuuaccuuugggucugcugugugaacaacaggaggaagccaagggggagguuuugcuaccaggugaauccccaggaguguuucuucagcugugugccaggaacuugcuucucuuucaggcuaccuggacugccccacccuggggccugccucuccucccaguaucacagcugacgccagagccauauuuuggaggucug

SEQ ID NO: 3897 - RNA, 1452 nt, Mus musculus
gcaugguggagcacaucuuuaaucccagcacuggggaggcacaagcgggccagccuggucuaguaaguuccaggacagccagggcuacaacagaaacccuguauccaaaaaaauaaaauaaaaugaaaugaaauaaaauaaaauaaaauaaaauaaaauaaaaugcggagagagggauugaaagccugggccaucuuuaaagucaggugaauauuaucagaguuaggcuaccucugugagacccccacaugacuggcauuuucguuugcacucacgguauaacaguagccaccaggacauugcuuccuggcacauccaggaaagggaccuguccuccuucuuuaaaaucaauaacgugccagcaagcauuuucuucugacccaguggucagauuuagguuccuaagccacucauuggcagaggagggugauuuugacccccagggaauagauagauauaugcauagauauagauaacugggaagauacuccuggcaucagaugggaagagugcaggacccugugauguccugcaguggccuaccacaaaggauuguggccccagauguuagugaugccaagguugagacgcccaccuuggaccuaucagggugagcccugggcuaggucuguuucccccaacuaccaaaguucuucagugggcaggggcaaaacccacuccguuggccagccucagucccuaccagccaacccccacccccaccccaccccccgggcuacuuguucauaccaguccaugucucuucagggggcacucugcuaugucacaacagcaaacuuuauaguaagauuccaauuugacagaauuacaagguaccucucagaccuccuccugucuccagagaugcuuugacaaaccuaccuugcuuggcugaguuuguccuuggagagcccaggaccaggguagggcugguuuggugcaguaauguagaaaaacuacuccugccggugcuccugaaguagagcuuugcaaguucacaggagcacuugugggauggcugggagguugaucagccuuucgguguacacgaugagguugcaggcaaacauuggaugaggugaggucuggggagcacuuggcaugcaguggguacuacaugagucccauagcaaagggggaaccagugauaggcauugcaggugacccaggagggcuuagugaccuagcagggacaaggcccuuccuuguacaccuagcaguaggguuuguaacugccuggauacgaagacggaggaaacagaggcuggacuuuaagguccacccccguuccccccuucuugcaggaugcuggggaugcccagugguuaggccuaacugugccucucucuuauagaccccaugauggagcuggcaggcccugaccccucugaacuugacaaccaucaggagauggaggacuucgaggaaaacgccuacaccuacagcagugug

SEQ ID NO: 3898 - RNA, 20550 nt, Mus musculus
caauggggcggcagguucugcagcuccgccccgguugggucccagccaccagggccagccuagaguccccaccgcacagcccggugcagcggcgugcucggaccucgcgugcucgggauggccggcuaccugcgggcugugagcucgcucugcagagccucgggcucagcgcggaccugggcaccggcagcacugacuguccccagcuggccggagcagccgcggcgccacugugagugucgcaccggggggcgggcucgcgugcagcgcugcgacguggcgacgucccgggagggggacccuggagugccacucgcgacacgccggcggucggggaacagcggcgugcggguuacaaagggccgggagguggccuuacaccgagcucccgcgccccgcgcgccugggccgcugcaggcgcagggguggggacccaggggauaguggcagcugguggccuggggcgggauugcuggguccuaucagggcugggguucuccagguauuccgggggagcauuuccagagguaccuggacccagggugggguaucaugacugccuugggccuuuggaggggacaagcgaccaagaggggcuggagcggccugcugcagcccuaggcagaggagggucaccucgcgcucccggcucagacaaaggcgaggaggagaggccuccacuuccccuucucuccaaucccugcguacucuggucccuccucuccaacaggcccacgucagcuauuuuuggaaccuuuacucgacagcuggaggaauguccuuccauuuuucccgcuuuuguuucucugccacucccccacccuucgcugcgcaggacgcucagucugggcccucuccuggccccuugcugggccaaccacgagcugcugcaugugaguggguccugccuggcauacaagcuguggagaccuggcacugcacgcauauugucauuuuucugcagucagucguucccaugagaucucugcguugccuucagcuuacuucuuagacgugaaggcgcaacuccggacaaaauaaucaggguuuuagagucuccauuacuaacagauugcccaaccuggcaugugggcaucuuucauacccuugcuacucagcgccuugcuacaaaaggcacggaacaauguagagcacuugguggccucuuuugaugccuguugccacggaaauucuauccugaccuggcucaaaaccccuugggguuagccagaggaaugaggaagaggggguggguuuggcuaugggguuuguucuggcuagagugguaaucguuaacucaccgugggagcagcugaccgaagcugggggccaggaggagggagagggcggggcccuugacacuccccuuugccaaggagaaagggacauacauguuuuuguguucuugggaucugccucuaaccucugaagccccaucaagugccucaggccuucaagacccacauauggcagcuuugcagcaaaauaugguagaaguuaaaggcacucagugguuuuccucuuuuucaucuuuucucucuuuugaggagucugguaaaaugguaauaccaaaacuaacuaacuaacuaacuaacuaacuaacuaacuaacuaacaaaacuaccuuaagaaacugcacuaacaagaaaauaaggcuacuuugggauccugaauuuggauacucauuuuguuuauuuauuuugguuuuuugaggccagggucuccauuuuguccuggcuguccuggaacucgcugugcagaccagacugguccaagcuccgagauccacuuguuucugccucccaagugcucggauuaaaggcaugagccacacacccccaccccuaaucuggauacacauuuuaaaaagcagccaguggaagguccuuucugaaggucuccaaguggggaggugauuaaaaccaaaccaaccaaccaaccaacaacauccaaugucuuugcugucccuugguucccacuugcaacuuccagcagccgcuugcuggccccucuaggaccuugggaagagauucggccucuccagaggacagagcauuuacuuagacucccuuuauucuacuccugguuagaaacuuugucauuuccucaccuuaacuuuuuagauagauacuuaaagacucguuuauuuuuauuuaacuuguaucaauuccccugaauuuauguuuguacguaugccaccugugacccuauuugcccacagaggcuaaaagagggaauugguuucccuggaacuacacuuauggaugguugugagcugucaugugggugcugggaauugaacuugaguccucuauaagaacaguaagugcuucuuaauugcugagccaucucuccagccccauuuugaggcguucuugguggcuagaccaggaagguacccugccagucuuguauacuugcaggggacaaauagucccaguauccaagaauaaauuauucaguggcugaucaucaggguuuaaaaaaaaucauuuauuuauuuugguuuuucgagacaggguuucucuguauaguguuggcuguccuggaacucacucuguagaccaggcuggccucgaacucagaaaucuaccugccucugccucccaagugcugggauuaaaggcgugcgccaccacugcuucgccuuuuuaaacuuuuaaaacuuuauuauuuauuuuguaugugugagagagauaggugggguguguguguguguguacuugcuacaguacauguacagagauuagaggacaaccuuguggagugggccuuuuccguuucccuuugcccaccaucccacaggcccuuugucaaguuuugcagacccaggaauuaguucuuaucuguucuucugugagccuuguuucgaccauagcugggaaacuccaggugcccaugcccaucucucagaacugguuucggggcuuguguuagagcuacaacagcgguuuccaaccuguggguugugaccucuuugggguuggguaucagauauuucuauuaugauccaaaauaguaggcaaacuuccaguuaugacguagcaacaaauaaucuaaugguugggggucaaugcaacaugaggaaguguauuaaagggucacagcguuaggaagguugagagccacugccauagaaggacuuggcugcccuaaguuuuucaccuuuagcugaggccucaugggcucgcuuuaucugcuuugcuagauucugggcacagcuccuuguauggagucagggucuguggcuugcuuuggagucuuuacuguauaaaaugugucagagucucacauguggcaagcaagugcucgcugauaaguuugcaguccccagcucuuucuaaacuuuauuuuaaacuggucuuacuaaauuguucuggcuagcuuuaaaacgugugauucccccugccuccaccuucuuaguagguaguauuauaggcauguaucgucacacccggguguaccccucucccccacccagagauucacagaugcuagcuaggcgugcuuucaaucacugagucacaccuccagcccagauuacaaauacucaucuauucugugagcuguucugggcaugaugcccaucacaugagagagaaugcugcuuauguauggcaauggcucuggacagcaggaauggagggaacacgugcaucacaauaggaagugaguccagguagcccugauauacauuuacccuuccuuuaugauguuagcguguuuucuuccuuuugugggucagauuccaugcaagauguagcggauggagcugggaaugggagcggggaagaguucugucuuuggguuuuaauucuaacagggaggagacuggcaccuaaagaguuaguuggccaaugugacacauagaaauggacuaaggauagggucagaaagaugcacaguggaaaaggcacuuacugccaagccuggugacaguuugauccccaggacccaugugguggaaggaguuguccuuugaccucuaaagguucucuacagugcacuugcacaccagaguacuagcuguagaaaauauugaaagagcuaaggagaagaaacaaaggguguaagguguaugggaugguuugaauggggcugacaggaaagacccaagugagugaagcuggagccugggaggaagcuaaugcuuuagauaccagaggagggaggggccuguaggagucuggacugcuugcacugugcacugaggucuggggcaggggcagguuuucguuuucuagguguccacuguggauauuggaguauauuuauauuccuuauggagaugggggugggaggaaucugugagaucuguguuuucauuugcauuuuuucucaguaggacaggggcguggacaaauggacccgagggcuccuuucugcaccagcuuuuuuuucuacugcugaugccauccguuagugugucauaucuuacagaaacgccucucuggcuggguggugcagccugugcuauggaguaaguucaaggacagccagggaaacccugucuuagaaaacaaaaaccaaccaaacaaccaaaccaaacaaaacaaaaaaagaaaaaagaaaaagaaaagaaaagaaagagaagaaaagaaaagaaaagagagaaaagaaaucccacugugauaauucgugugguggacaguuucagcuuccaguucauggucuuacauuuacggucacguguuccccaggcuaagcuuugaacuuccuaguugcugaggauaaccuugaguuucugauuccucugucuccacccuccuaaauguuggcauuauaaacguguccacacacucggucuuugcaaugcuggggugugcccucgacuuguaggccuuuuuuuuuuuuuuuuaagauuuauuuauuuauuauauguaaguacaguguagcuguuuucagacacaccagaagagggcaucagaucucauuacagaugguugugagccaccauaugguaucugggauuugaacucaggaccuucggaagagcagucagugcucuuaacgacugagcuaccucucuagcccuccuuguaggccauuuuugaggacuuugagugaaaacgaaaguccuauaggguuucacagguguauugcaaucagauuuauguuuaaucuauuuuuuacuuaaaauuuuuaaauuuuuauuuauuuaauuuuauuuuauuuaaaaauuuuguucuuugauggaugcacaccuuuaauuucaucacucaggaggcagagguaggcagaucccugugaguuuaaggucuacagagcaacuucuaagacagccagagaaagagcgcgcgcgcgcgcacacacacacacacacacacacgaacgagugcuugccuguaugugcauuaugcacgucuggugucuguggaggccagaggaaggagucagauucccugggaaucagguccagguccucugcaagagcaaccaacuguugagccgucucuccaaucaacagagauuaauguuuaugugcauacgugugugugugugugugugugugugugugugugugugugugugguaugcaugugcuggugcuggcuaggcuggaagagggcacugaauuuucuaaaugguaaugagcugacagauguggguguugggaaucaaguucagucaggucuuuauuucaaagucaucucagcugccauguuuuauuuauuuaucuuuuacaacaguggucaugggaccuaggcccuugggagauucaagcuggcugucacuuuggaaguuuucagaaaggcauggguacugcuucuaguguucacaugacccuuaucuucuuccucucccuccugacaugggcauacacaagcuguggugucauuuuggaggucagaggucaacccuggauuucaucaacucccuccuuauuugagacauuuucucuucagguucuccacugugugacagacaccuacugagucuggcuuuuuuauguuacugauucuauugugguucacuuuacccucccccccccccccgccccgcccccgcccauuucuugugguuugguugauagcccuuagucucuuugagaugggcagagcaugguuuguuugcaaaacuaaacaacagaaaaaggucucaagucccggagaccuggggagcucuagagggugcaggucaggccuggaccagggaggcccucgucagcccagcucugcuugcuuccaaguguccggaguaacucauucuucaaaacaggcugugaucuaagauggagugggguggguuuaaagucuuacuauuuuuauuuugguguaaauauuagccaugccaacuuuugguuuuuuuuuagaauaucuuuuucccuacauugcucaugugugugugugugcaugccugucacacacaacuugcaggaguugguucuuucuuuccaccagguaguucaaucagguguucaggcugggauaucucuggcccuauaucuuuuaucuagucuuuggcguuuucuuuuuauuuuaacgguauauuuaaauguauucuuuaacaaguuucuacauccauacaauguaucuugaucauugguaccuuuccuccugccuuccaccaccuccucucuucaguagaguucagcguuguuacuuuguagccauugccgcagacaucuucagaacguuuuuaucuugcaaaacugaaacucuguagcuacgaaacaguaauuuccuaguucugccucccuuagccccuggcagauaagguuccacuucucugugauuuaauaaugggaccccguuuaguaaaccucuaucuccaaaaguauuuacauuacaauucaaaacaguagcaaaauuacuguuauaaaguagcgaugaaaauaauuuuacccguagggaccaccacagcaugaggaacuguguuaaagggucucagcaauaggaaggcugagaaccacuaacuguucuaggcaccuguguaaguagaauccuacacuauuugucuuuguuucuuuugagucaagguuucuccguguaacccuggcuguccuacaaugcuuuguagaccaagcugggauuaagggcgugagccaccaugcccagcaaaacugucauguuuuauguuauauacugucauuagggcucaccuguguugaaacaugugacaggauuuccuuuuuccuuucuuuccucuucuaagucugaauaguauuucacagacguacagacuacauuuuauuuauucaaucauucacucauugcuagacaccaccuuuugcuuguugugaaugauaacaggcugugugagcaucguuuuccuguuccugcuuugaaugugacgcuggcuuuuguucucuuuuguguuuacuuuugccagugcuggcgauggaacccagggcuuugcccaggcugugccaaugcaguacuauuaaguuccauuccugggcuggccucaaacuccaggcaguccucuagccucagcccccugaaugccaaggucacaugacuacggcaucacacucaguucuaucucuugauauuuuacccuugauuuuaacuaaaagaaugagaagugaacucuccuuggcuuguuuguuggucacuuggaaccuaagugaauucuacauguagucaggggugaccuggaauugcugaucuugcaaacccaguuuauacagugcugaggacugaacucagggccuuguaaauacuuggcaaccacacuaccagcugaguuacauucccaaucccacucuccucacuuauuuuauuuugaauuauguguguauagggguauugagcacauaccaauucguagaggaggcugugagcuaccugaucuggguacugggaaugaacucaaguccuguggaaggaaaguacucuuaccuucugagccaucugucuaggcuucgugauuuaaauaaaaauugcuuuauguauaugaauguuuuaccugcauguauauuuauguguguaccuguguguaucuggugcucaaagcgggucagaagagggcaucagaucuccuggaacuaguguuacagacaacuaugagccaucagaugggugggaaucaaacaggggcccucuugaacagcggccuggccaucucucuagucccucuccugauuuuuuuuuaaauauuagucacuuuauggguauuuuuaaagaaauacagcuaccugaaccaggcauggagguauugaugccuguaauugccauguucaggcauggagguauugaugccuguaauugccauguucaggaggcaaagacagcaaaacauuugcauucgaacucuucugguaaagaguuaaaggucaacaugggcugcacagugcggcccugucacccuauucccaaacuaaaacccaaacugaacagcaacaagaauccaccuccuggaugaugguagagggcuugcuuauuuacgugugugaggccuuaaauucaauccacagcaucaagaaagaaggaagaaaaggacuuuuuaggauggagguuguguuagucacugguuuauugcugugaagggauauaaugaccaaggcaacucuuauaggugaaagcauuuaguuggagcuugcuuacaguuuuagggauuuggucuauuaucaucauggcgggaagcauggcagcaggcaggugugguacaggagaaguagcuaacagccuucccuguccugauugaaggcugagaaaaagagauuagacuugaugugggcuuuuaaaaccucaaaaccuaccuccauugauauacuuccucuaagaaggccacacccacuccagcaaggccacaccuccucauccuucucaaguagugccacucucugaugacuaaguauucaaauauaugagccuaggggagccauucuuguuuaaaccauccuagggguguggucuagugaaugagaguuuggggugaauauacaaagcugcagguucagucuuuaguaucuggcugaaaacccaucaauuucaagggcagagcaagggggccuagauggugugggcucaggucccugccccuaguuccucugggaaucuuuagcauccuuggagucugacaacaguguugcuugcucuguuaccuguuuuuccagucucauccuccuucuugcccccuucccccuuccucccugagugguuucacaucuuaauaucucugugucaacaaagcuuaguuagcaccagguugccaugugaauaaauaggcccuguguuuucuaauucugugaauacacucaugugaucaugacugugcucucccuacccuccaggagggguguggcacucacaugcugcuggcauaggcuguauuuaucuguugaugagguugagacccuuagaacuggcuuacgccgccauagguuuaaauuaaaaaaaaaaaucugacaagcgguccuuagauuaguucucaguagaagcuucuagaagcucagcaaauucuguccagcagacugucucggggcccuucucacuuaagcucuagccuaaagugaaauucuguagcuuggguugaagaucccagugguaucuuggguaugguaauggagccagccauggcugccuuuagaucccaggagggggccaguuugugucuguguuuuugacuuuggcaucugacccaggaggacaaaggugcacugagccugggaucuggauccugucuuucuugccucugacaucaacugcacuccccagcucucuuuucucuccuuaaauagucucuaagagugucugucugucugucugucugucugucugucugucugucucuucucucccaucuaucucugugugucucuaucucuguccucugucucucucuguuucugucuccuauagucauuugcaugccuuugggaagugagcugguuugcucgcuuuguaugagguuucaagaguauugugagucuuggcugggcuguguuguagggaaauuauauguuuaaggcccuuuagacuuuucuuccuucuuuccagacaaacuuucagguaucacagguuggccuugaauuuaccuuggaacuucuuagaauuuaccucuuccuccuccuccuccuccuccuccucuuccuccucagugcugggauuucuggcauuugccaccacagucaguuuguggaauguuaaggauugagcccaaggcuucauguaugcuaaaaaggcauuuuaucaacugaguugccccaagcuaccuuguugagguucucuaaagauauauauauauuuagauuuauuuauuauuauaucuaaguacacuguagcugucuucagaugcaccagaagagggugucagacucauuacagaugguugucagccacuaugugguugcugggauuugaacucaggaccuuuggaagaacagucggugcucuuaaccacugagccaucucuccagcccccuuuaaagauauuuuuaaggagcugaagagaugaucaucaguuaggaguacauacugcucuuacagaggcccgagugugauucccagcaucuacuagcaggucacaauucucuauaacugcaguuccaggcaaccuagugcccuuuucugacuucagauacggcaugcauguggugcacauacauacauacauacauacauacauacauacauacauacaugcauacauacauacaguacaggcaaaauguucauaucauaaacaaauaaaugugaaaagugugugugugugugugagagagagagagaaagagauagagaggagaaagagaagagagagagagugcaauuuggacaaguugguucucuuucucuccuuucauucuguggguuucaggauugaacucaaguugucagucuugguagcaacuuccuuucguugaucuauuuugccuccaugucggggcuuugaugcuuaucuagaaugaccaguuaacguaagccugcuuggcucugagacucaggugccuccucaggugccaaacgccuguguucaaaguaaggaagguccaaguccucugggccuuuuguucccauaaccuggggcaguaaucugcucaucuccuugagccccagcucccucauauuuaaaguggaagcaaugaggggcuggagagauggcuuggugguuaagagcacugguugaagacccggguucaauucccagcauccacauggcagcucacaacuguuuguaacuccaguuccaggguguaaguaauuguauaaaaauaauaaaauggaaucaaugaacuaaauauuguagcaugcaccuguaaucuuaguauuugagaagccaaggcaggaggguuaugaguuugaggcuagacuggcuauagagugaauaacaggccauacugggggacacaugcagaugauauauaaagaacaaacaagcaaacaagcuagugugguaguacuggcaggaaaucccagaaugaaguagguagagucaggaagauccuuuuagggucauccuuuguuauacagggaguucaagggccagugcuacuuguaugcaugucucaacaaaacaaaacaaaacauaauaaaacaaaacaacaaaacccaucaccaccaacaauaaaaagcaaacaaccaaucaacaaauaaacaaauggcacagggacacuucccuugggguuguuuugcaauacauggugacuggaauaaguggguuugcacuguugucaggcacaagcuggacucucacuguggaucugcacauuucucuccuggcuucaaacuuuggggacucccaguuugcagacaacagucaagcuuagugacugugagagggcugcguuggaaggacacaggauuaugugggaaagugaagagcaagcuuugcagaaguugagaguuugcggauuucccugacuuggcacuggagugagcgggccaucuggcugugguucucuguuggccucuucagcauccaaggggagaggaucugauuggccaggcuggauccagcccccuaagcaggguuagcucuaugugaucauccuccauguggaaauggagguccugaaagcaggagaggaagcaauugcuggaccacuagcacacuuguuuuuagucuucccuccuuaaugaaguauugaacugucagggaggaaaagggcucccuugcugcugcccuggggcggggaugugaugugcuccccugaacugucccggggaggggaggugaugugcuccucugagcugccccagggcggggaugugaugugcugugugcccaauucuagaugcugagaagaggaucaagguggagaagccgguaguggagauggacggugacgagaugacccggaucaucuggcaguucaucaaggagaagguagcaccccuccuucaguggguggcaggucuugugggucccugguggacaguuucucccuuucugccccuccucccucgaguaaccacauuagcgguugcuaguucuuugucuucagccagagccuguccucggcagucuggguuucucgcuggugcugaaauguucaggcuuuugaaauccuguuucuuuuucucuucaaagcuuuuuaucacauuugugugcacgagcgugcuguggugcacacauggaggucagaggacuugucaguuccucccuaccaagugagacccugguauuagacuccaggugucagguuuggcagucagugccuucaucucaagagcuaccgagucaagcccagcacucggaaggcagaggcaggugcaucucugagugacuggucuacagagugaguuccaggacagccagggcuacacagagaaacccuaucucgaaaaaucaaaacaaaaccuaaaaaggagaugaauugggguaggcaagauggcccagcagggaaaggugcuugcugacaagucugaggauguaaguucaaucccugagacccacacagagaggaaaggacaaauuacugcaaguugucuucuguuuuccgugugcuagcuguggcacaggcacaucuacacggacgcacacaccaaauacauacauaauuacauaaccguaauccauuaaugugugugcgugugugcaugugcacagaggguguuuggugaccugucacucuccaauaguucacugagucugucucucccagaauuccgagcuuuuguuuucucugaagccaacaagccccagcaguuccccugucugucucucccccagaucuggggcuacaagugaauacaagaugcccagguugcuauaugaaugcuggaguccaaaccgcucucgugguuuugcaaaagugcuccuaaguccugagccaucacuucagcuauauauauauagcugaagacccaauauauauauauugauauaguuaguuauauaguuaguuuuauauauauagcuauauaguuauuucagauuucuuuuauguguauaaauauuuugucugcaugugugugugugcacuacaugugugccuggugcccucauaggucagaauaaggugcuagauuucauggagcugaaguuacgggugggugugaguuaucaugugggugcugagaucugaagacccugggucuuuuguaagaaaaacaaaugcucauauccccugagccacuucuccagcccuucuaccuccuuuaauuucauucuuuguuguugccaaaguuuuacucuguagcucaggcuggccccaaacucauagugguccucuguuucagauuccugagugcagcaauuacagcauguguuaccaaacuuagcugugagacagggcuuuuguuuguuuguuggguugguugguuuugauuuucuguuugauuguuuuuuugagacaggcuuucucuggguagcucuggcuguccuggaacucacucuguagaccaggcuguccucacacucauagagauccaucugccucugccucccaagugcugggauuaaagguauaagccacaaccacuuagcuuuuuuuuuuuuuuuuuuuaaauauuuuagcagggcuggagagauggcacagcacucguucuugcagaagacccaaguuugauucccagcacccacauggcggaucacaacugucuaauacauucuucucuauucacaggcaccaggcaugcauaugcacagacauacaugcaagcaaaacagacauacauguagugggcaugguggugcaugucuucacgaggcauaggcggguggaucucucugaguuccaggacaaccaagacuacacagugagaccccccucaucaucaucaucaacaacaacaacaacaacaaagcuuuauuuuuuauuaugugcaugugugugccuauguguggguaugcacaugaauguucguuccagaggaggcagauucuguggagcugaaguuacagguggucaccuaauguagguucuaggaauugaacuugggcccucugcaggagcagcauacuuaacugccuagccaucucuccagucacagacggaaucuuaacuguguggcuccaggcugucaccuugucuguccauggcacccugcccaagacagucgucuggcuugacacuuuacucuggccuucuucccuagcucauccugccucacguggauguucagcucaaguauuuugaccuugggcuuccaaaccgugaccagaccaaugaccaggucaccauugacucugcucuggccacccagaaguacaguguggcugucaagugugccacaaucaccccugaugaggcccguguggaagguaugaugugugguggggucacagcgaaugggagggucacaggcuaucaugcucagagggaagcaauuggcuaugucacucauuaugggaccgggagauggaagcguccagagcugcgcuucuccgaggcugaugauggagaccacgagucagcccagucucugagaaagccuggcaugcagcagggccugugacgucacuaggaugugccuuggggaggugagauuagggaccagccucauuuccacggccaggccaggcuuuaggucuccuagaagcaggaagguuacgguaugcuugccaugccguauggcuuacagcagcaagaggccucagcaguuacagggaggaaggagacaguucugcugcucucauaguagugaaggucuuuaacagccuggccuucuggccucuuggucuuuugggugggcugguauccagaggcugggcagaagcugcaggacagugggcaucagugaugcuguaauguuggcuaaaggcuaaacuugcuuucccuggaaccgucagcaucuucugaagacucccacucuuuugccauguggcugcuugauuacccccacugcacacaguguggccuuuucucuuccucucuccaucuccuuucuccuggcagcugcugagauuuacagcuugccucucuucuuuuucucuuaaacuaauaacauuguccucaagcuucaaaaacaauagaugacugugcuuuaggacguuuccuuccuaauuucugcagcaugaggaagcuagagacucgccuuccaguugcucuucagagcggagggugcagcucagggacagaguccuugccuagcaugcauaaggcccuggguucaauccccagcacugcgagccgguaacaaaggaaaacccaagacacgcuggcagcuccagaccuguagcacacugggggaucaguuuuaguccugaguucaucgccuuggcaagcacugugccacugagcuacaucuccggugcagugcugggguuuauagcucauucuuuuauggacaaggucuuagugucuugagcaggauaggguggagggaagcugcccuuucucaucacuaagcaacuuccauguggaccugguaaaaacggcagccagguacuauucugggcacuuuacagauaacguauuuauugacaacccagcaugguuggcauuuuauugguuauuucaauucacagcucugguuaaagcaugguguaagccucacagucagagaugcaagguuccagaggccaugaauuuaaacucugcgacaauggcucucagucuuccuacugccgagacccuuuaauacaguuccucauguugcggauccccaaccauaaaauuauuuucguugcuauuucguuauuuugcuacuguuaugaucguaaugucaguaacuguguuuucugaugaucuuaggagaccccugugaaaggauuguucaacccccagguugagaacuacugcucuagagucuagacucuucucccuccuccgggaugacuucuggggcccccguaugguuugagagguagggcuguggugggucuauuguaccucuguucucacagaguucaagcugaagaaaauguggaagagcccuaacggaacgauccggaacauccuugggggaaccgucuucagagagccaaucaucugcaaaaacaucccccgccuugucccuggcuggaccaagcccaucaccauuggcaggcacgcccauggcgaccagguaggccaggcuugggagacacggucuguggacucaugcuccccacaggaagccuuggcuugaacugccucuccuuucugcaguacaaggccacagauuuugugguagaucgagcuggcacguucaaguuggucuucaccccaaaggauggcagcagugccaaggagugggagguguauaacuucccugccggaggcguugggauggggauguacaacaccgacgagguaaggcccuggccauccuccucuccagcccauuucuaucucuaucucugccuaguuuguuauccuugcuucuguuggccucauucucaugccaggaagagguagaagagaccacgaggucagaaaagagcgccuccuugccuggaccaggaugggucaugugaccgccuuugagccaaucacugauggccagggaggaagggcucugauugcauaaguuggagacaggugaucaaucagaccuagcaguaggcggcuuaaacaagccuguaccagcuauaaggucuaggaauuauuagguagagcuguucgaaguaaaguuggcagcaggggucugugcucccagaagucuggugggagaagauuggccaagcauuccgugguaacaggaguccaggagucuuauggaggugcugcuggcccuggcccuggcccugggaccauggcagaguggcaguuuucagccugggggccaugcuaugcccgcucuccccacaguccauuucgggcuucgcgcacagcugcuuccaguacucuauccagaagaaauggccgcucuacuugagcaccaagaacaccauucugaaggccuaugacgggcguuucaaggacaucuuccaggagaucuuugacaaguaacaaccucugaugcuuccugggggcaccacagccccccggcuuccuugcgccauuccuacuucaccuggggagguugcuuuccuagugugcgcuugguucaguugugaguuucagggaggggucuuuaaccugccaacccccugcccucucccugagacaagcccuuuugcccccaggcacuauaagacugacuucgacaagaauaagaucugguaugaacaucggcucaucgacgacaugguggcccaggugcucaagucuuccgguggcuuugugugggcuugcaaaaacuaugauggagacgugcagucugacauccuggcucaagguaccgcucccggaggggggaaacuguuggaauuccaugacuggaaugacuuuuuuuguuguuguuuuuucaagacaggguuucucuguguagcccuggcuauccuggaacucauucuguagaccaggcuggucucaaacucagagagccgccugccucugccuccugagugcugggauuaaaagcaugcaucacuauccagcgauuuuuuuuuuuaauuaaaagauuccaguaugauuguguaagcacaaggguuacgugaaagagaggcucuggggaagaaaguaagacacacccaagagcgugggcaugaacucagagucuucuggaagugugugugugagaucccuuauggaggccagaaguugaugucagaugccuucuauuaugcuccauuauuauauuaauguauaauaauaaucuacauuauuggcuuuaguauauaaggccaagcaugguagcauuauaaagagaggcaguuggauuucuguguguuugaggacauagccaguuuuaaggcagccagacuuacauaauagacccucucuaaaaaaauuuuauguguuuauuauuuauuuuuucugucuacccagcgcuacuggggauuauauauacggccucaugaaagcuaggugagugcacuacuacugagcuacaaguacaggccuuuauuuaucugugccugugcgcaugugcagcacucguguggagggcagagggcacccugcaugaguugacuccuugcaccauguggguccuggagauugaacucagguugucaggcuugguggcaggaaccuuuaccagccgcgcugucuuguuuucccucugccuuauuuugagacaggguagacuagcuggcugggugggaucaccaucagcugucuugucuuguaccaagggaucggccugucuccaacccugugacugcugugacagagacaggcgugcagggugcugagcucagguggcucacauuuggaaucucagcacucaggggauugagggaagcagacugcuaucauuugaggccggcuuggguuacauagugaguuccaggccaaauaaaaauaaacagaaaaaggggccguugagauggcucagugguaaaggcacuugccauggagauugacagcuugagucucauccccagaaucuacaugguggagaaagcacucuugcaaagcuguccucugaccucuacauguaacacuggcccaugugcaccauccccuacacaaaacaaacaaacaaacaaacgaacgaacaaacaaauaaaaaagaaaaccucagaacacaagcaagcuggaucuuuuucuuauggaaguuccccacauuuucucuucucuggccuucacauucuuugugggucugggggaguuuuuugauucuccagaguccuugacaacagacccauuccagcugaagucuggauuuggggacauuugaaauaaaggggcuaacagugucagaaacagggaggcuugcaaaauugcugauggcggcuuauuucuuccugaaauggccuuccagggggcuucagacugaccgccucaggcuauggggucuggaaagggaacacacagaggugacaguggcguggagucuaagcugaaggguucugagcugaagcauggcucugaggagagaucugucccuccccgccaggcuuuggcucccucggccugaugacaucugugcuggucugcccugaugggaagacaauugaggcugaggcugcucaugggacagucacccgccauuaccgagaacaccagaagguaaaugugugcauuucaagguccauagcccacuggcccugaugaccgggaggaugaacccggucugccggucuggagguagauagcugugucuggugcucagcugauccuguggccuguccccagggccggcccaccaguaccaacccuauugccagcaucuuugccuggacacggggucuggagcaucgugggaagcuggaugggaaccaggaccuuaucaggugagcucauggggagggcuugagcaggugcagcccacaguucugcccagcaugccggggccucacucugccgcaucccccgcagguuugcacagacgcuggagaaggugugcgugcagacuguggagagcggagcgaugaccaaggaccuggcuggcuguauccauggccucagcaagugugugcuuugggaaacagggcuugagaccccagcaggugggaggaagccagggggaaccccccccccccaagagucucucucaugaguggguagagcugccuggggucuggggcaggacaaguccugagaaauggcucaggccaagccuuccuugaccaggucugaguuggugcccucuggcaguugcuuaguuccucugcucuccuccuuaaaccuuuccccagcuucuuuuaugaggccugugcccgguagcuuguuacuuuaaacuuucugccaaauuuauugugacccucuagcagugggcuacuagcaaacuuggaccugggccugguggccugaggucuaaugagccugggaauggcuugguugauggccuccaggaggccugagucuccccugauguucucucggcagugugaagcugaacgagcacuuccugaacaccacagacuuccuggacaccauuaagagcaaccuggacagagcucugggcaagcaguagggguggacacuacucagcuccaguggguacucuguacauggcagagggugggccucacagccccucucugguggccuuucuaggggacauuuuuuuacauauauauaugauggagauguuuuuuaaaguauaugagcauuuucccucacgguggacaugaggcaggaacgugugcuuuaccucagacagucaguguucugcauacuguaauuuauauugcucuggaaucacauggugccauauuuagcuacuaaaaagcucuucgcaaaacu

SEQ ID NO: 3899 - RNA, 6138 nt, Mus musculus
aacugcauuugccuuauuagucggggucucauuagcugcaagcucaccauuaggcuagaguggcuggcuagugaguccgggcagggauccuccugucucugcuuccccagcucauggacugagggccucaucuugugaggcagacacuugacuaagugagcuaucuccccagccuggcacugcuuugggguuuuaucuuccugggggucccuuucucuaaagucuaacugauguuaccuggcagaguguggucuuagcauagugaauuccuuucaucugcacccaguuuagaggacagggcaggacuuuuuguuacucuaguguuuuaaguuuucagaugauaugggaaaacugacuuuucuuuggugaaccauucaguaaguucucacacauauggaaaugaacuugaaugucuccaaaguggggaugaucagaggcgccuacauguccaguccugcugcuaccaucauacaaggaagucaaacauuucuaaaccuuuauuaccaauuaguaaacacagugaugacaacagcagugacaagggggaggguccuccccugccagggggccagacucugcagcgcccucuccaggcugggccggcacuggcccugacaccgcaggcauaaccuuggccacaucucagcaguggccaggucuuggacaggauguugguacuuagaagacaucacaggacaaucuuaaaggagcugcaggagggaagagugaguuagguuuggcuuuuugguuuggugcuggggaucaaacccagggccuaacacauguuaaacauguacacucuaccacugcgcuauaccccuuggguuuccugauagaagggggugguacagcccugacuaaccauacccacuucucuccuaugacuuuuuugucccucugaaacaaguucuggcuggcauggaauucaccuagcuagccuugcacaggcaccaagccugccuuugccuucugugugcugggauuauagaccuguaccaccacagccaaagguuccuguuugaggagcuggacauguagcucaguagaguacuugcauaacagguuugaaacuguucaauucuugguaccacaaaacuagacauccuagcacucaggagguagaggaaggaaaaccagaaguucaaaaguccaggcugugugugcugaugcacaacuuuaauaucagucucaaaaaaaaaaaaacaaaaaauagagugggcuggguccccuguguccucugaaagaccauccugaaucaugcccuugauaccaucccagaguagauggguacucagaaugcaggagccccugucacaccuggcaaagucuggugagcgcgagaugacaugcuggaacucggaaagauugauggucccaucccugucaaugucugacucuuccaggaucuagggaagagagggcuuuaugcgucagcuccaacccuucccacccgacaccccaaccuagccagaagcugcagcucacauugucaaucagcugcuucaucucagaagcacugagccgaguguccucgcccucucccgugaggcaauucacaagcuggcucaggucuucucuguccaggguuccaucgucaucaaagucuaggcagcagacacagggagcaacuaggauaugcucaagaggcagucugcaggcacacaccuacccucuuuccugugugggaaggaguggggcccagccauucucacagugcuuaccaaagaugcggaaggcauagugugacuugaugucugggguugcugugucacugaagacacucaggagguccaggaaguccucaaagcucaggcugucucugguaggugauguggagaagaccaugcagauucgcuccuugaaaggguuagccuguguaagaaagccuucugugaacaucacagggcaugaccuggguuacaaacucagccagcucaacuggaaaguccuucugaggcagggucucacaaacccaugcuggccuccaacuccucauccuccugccucuaccucccaggugcuggauugcagguaugcaccaccaugccugauucccuucuggaaacucgaggaagcucauuacaauagcggcacuccauagaguucaggcucgaaggggaggaccuuugaggccaggacauggagggcacuggagggacuacuaagccagccagggaaggggcagucucacucacacacaucacaaguaggguccuagcaggaaaagauaggcacguuaagcauggccacaagaggagcugauuaucauaguugugcaugugcacacaugaguacaggccacuccacacauguggaaaucaaggguaacuuuucauagacuauuuucuccuucuaccaugggcgccagggaucaaacuuagguccuugggauuacaaggcaagugauuuuguuucuggauuuucuuuuguuuguuugaguuggguuucucuguguaguccuggcuguccuggaacucacucuguagaccagacuggccucaaacucagaaauccaccugccucugccucccgagugcugggacuaaaggcgugcgccaccacuucccagccuguuucuggauuuucaagacaggguuucucuauaaaggucuauagagucuggcucuacagaccagacuggccucaaacucaagagauccaccaccugcuucugccucccaacugcuggaauuaaagacaaaaggcaugcacaacaaggcaaggguuuuuaucugcuaaccuaccuggcuggaccaagcugaucauuuguaaaaaaaauacuuaacugggugauuauuuuguuacccagucaggcucuuugcauaggaaucgcagacaagugcaugcuuuuaauucuagcccugaggaggcaaaggcaggcguauccaagaguucaaggagaaccuaguuuacauagcaaguuccagccaggacagccagcacuccacaaugagacccugucucaaaauaguaauuauaacccaggcaaugguggcacacaccuuuccucccaggcagaucuuugaguuugaggcaaccuggucuacaaaucgaguuccaagacagcuagggauacacagagaaacaucuuggaaaauacaacaacaauacuuauuauuacucauagcaagcugggcauagugaugcauacauauaauccuggugcucacaaggcagggaaaggggaacugaagcaaguucaaggucaguaaaggcuauguauauaguaaaagccgggaucagaaagagaaaguggucggcuggcucagccagugcagugcucgccguggaaacauacagaccugcauucgauccucagaacgaaugcagaacgaaugcugguuuuaaacgggaagagugggcugaagagauggcucagggauuacaaguccauacugcucuugcagaggacccuaguucaguuccuggcaccugugaggaacagcucacaaccacguauaaccccagcaccagggaaacucgacaggcaccagcacuuacauguguacacaucccacacaauuccaugucaucaaaauaaaaaccccagggugugguggcaugugcuuacaaucaauaggaaggguuagggaagguacuagcagagagaggguggaugaaguggguagaggacugaaccuugagcucugggaggcugaggaucugcucaaacgauacucgggugugcagugacuccuccacgguccgcugcucugggggaagcagcucacaaaagcgucugugggcucuggcagagagaggggaacuuauugguggccucaagcagucagucucccuguauuuaugacauccccauucugcgguuugaaugcccuauaaaccagcugugaaacuaagucacacacccaggauucccagucauugggcaaucuuuagccaaagaggguaauucacaaaacagcagaggcuugggggggucccuucuuagggugggcaauuauaagaacuuacccaugucugcaagacacuaucugaagggacucugacuagcuuggugagcaugguucuggcaggccuugcucacucugcagggcccaauuccuucuaccuugcuacaaaccuacauugcuaaagccagcccccaaagucuauuccccuauuuggccacuuccuccuccugaggccgacgaccaagguccagcuaucaaaguauucacguccagcaaucaaaagcccccuuuggcuaaaauuaaacaccuccucguagcccaggguuuccccuuauaccuuuauaaucugccauuuuccuauguccaugucugucuccucucuauccagaggcaguccuuucuccuguaggacaaauacuccuuccaccucuccauuguucccuuccccuucuuccugucuucgaacucaugucuuuguuauuucuugcccucugucccucuaaggcaauaaaucuccuuugugcuaagaacuuggucuggggguccugagcugcgacuuucccuuucagugucaggcauucuuugcaacaguccuggcaggaaaaagauaacucuagagacaucugugccugucccuuuggcuauugaacuacagaaacaaugucccccgagaaauuggaauuccccggcaaucucguguugugagaaggaugaauugaagccuguugucuacuuaggagaaaaugucuaccaggaagagauuuuacacagacggcucugguaacuugucagaagaucaccuuucaugagacuagagcugagacaaugaaggagagacuccaucuugcccaggacugcugcuuaauuuuacauacccuugcccuuuauuuaaauauaaaccucacaucagcuggacaugaagauugacuuaaagauggggggaggagcggucauguccauucuuagcuuuuuuuuuuucccaguauggccacauuggauacauuucguuucucugcuuuucaauauugucccuuuccuuggccuacugaggacagguagcacagccuagcugguuaggacugccugugugggccaaguaccuggacucuaacauuacaguaacaaaaacacauguuaccuccacuccagagacuccucucagccaccaccucuuucccaguagaauuucauuguggggcuaggaaccuaacucaagcgcucuggccagcaaaucacuuauagugugcuuuauagucaaguucucagaacucucugaaccugauuccuugaucuguaaccuccuccugaaguaauguguggaucacucaggagcuacugggcagaguaaggguucaguaaacguuaacgguuacugaauuaaacagguaaaguugggauuggagcgagccacguacaagaccucuugguuuugccagagggcaaaguccgcaaagagucacagcaguuccuuuuagaagcgagcaggaagcucggcagugaggaggcuagaggagcucaaacaguucaacuuuuccuggauacacagaaguguuugcguggugcaaaggugaggcucuggagcgggugggacuugcacucugagccuccgacuccagauccagugauccugacaucccagaagcacagccccacccucggaggugagacguccaauccguaucccgcgagaaaaguacccgcaaagcccuccccuggcaaucccgaguuggaggaccggggucagggcagcacucacaggaggaucuccugcuuggucaggaacgucagguccugaaaggcaaauccagacaagggucugcaagccgcccgaaagccacggccgccccgccaccuguuccccgaaccccacuccccugcgcgggcucgcacgcgagcuccgcgagaacuggcgccccgcgcaccugguacucggccagcagcuccuuagacaggcgacugcccgaaccucccaucgccgcggugcgcgcacagcuaggccaacucuccccgggacgccggcaacuuucucacuuccguccucggggccgcguccccgcccaguccccguagcaaccgcugccuggccuccgcccccgggcccgccccugccuacagugccccgccacccuuagcgccgcucagcgggccggcucccggcuccccgcgggcccaggagagcuggagggagggcccggggaggagccggacgcaucggggcggggcccag

SEQ ID NO: 3900 - RNA, 15718 nt, Mus musculus
cugcuguacccuggaugaauuugaggcccuguaccaaguuaacuugucuucgcuucagccaccacccauccucagguaagaacucuagucccggauucgcagaacacuggcagagugcucccgugucuugggcacuguccuugaauucugcagugggagacuuguagcuuccagauuaguggagaggaagucacuaaaucauaauuacaaccaaugcuguaaaugaaaacaaguaacagaagcugcuuugucuuaagggguuuggacgguguuaauaaagaggauuuguuaaucuuggacacauuguaguaggagguuuaauucugaaucugccgcguuugucuucaagguacuugcgagcucccagauuuguaugcaaaauauguguaugcaucuguauuuauccccugcucucgugggacucugggcucugcaaacccugacuuguagcagccaguagacaaccuugagucucuccugucuccccagggguccaggcccgcuccuagcacugggcaucuacacucuacugcugauggcacugaugacuacagauuucgugcacuucugccguggucggggacggagagaaaaacaaaacuccagcggcugccgccgccuuuccuuuagagccucuuccgcgcgcccucuacagguuccagugggaacagacuaggcgcucgugaagcagcccugagccugagccugcgccugcgcaacgcgaguaccccgcccuugcacagacccaaccacuucuuggccucgccuuguuuagcguaacacugacgcauugcuggggcggggcagucgccggcaucucgcggaucccagggacaccuuugcucuaaagacugcgccugcacuggcucuuggagcuuagcuucgugaugacugugaguggcccggagacccccgagccccgaccuuccgaccccggggugcguacugauucuccugugccaucuccccuuucacacaugcgccuucgcaccuggucgccgucaccuuauucuagcccuucacgggacucggccaagacccggcucuucucccaggcgcgcugcucugcccaacgccuuucucucucucucucucucucucucucucucucucucucucucucucucuucucucucucucucucucucucucucucuucucucucucucucucucucucucucucucucucucucucucucucucucucucucucccucucucucucucucucucucucucucucucucucucucucucucucucucucucucucucucucucucucucuccaggccagcucagccgagcagcugcggaaggagggcaacgagcuguucaaaugcggggauuacgagggcgcccugaccgccuacacacaggcccugagucucggcgcgacgccccaggaccaggccauuuugcaccgaaacagggcugcuugccaccucaagcuggugaggggaucggguugcucuaaccugguucuaccugggccugggauugcccauagccgcugcuguuugugcaccaguugggcauuuccuagccacgcacgauugccagaggucuuuaggcguggguagugggggaucaggugguucagcaaaacaagggugccauugccacucucaggcuccugaucuuucucuuacaggaagauuacagcaaagcagaaucagaggcgucuaaagguaggguggguguggguccucauauggagcaauggggucuucuguggugggaaaggacucuggggccaccgagccaucccuuucuccuccucuggacccagucacucgucuuucuacuugcuuucccacuucuucggccuuuccuuuucugcagccgcccucaccuuuucugaggcugaagcaccgagcuccacauucguaccccuaucuuccuuuggcccucgagaucuaucccuacugcucuugccuggagacgguggccuccugggugcugauagaguuccuguuugugcucagccauugaaaaggacgguggggaugucaaagcacucuaucgccgaagccaagcccuagagaagcugggccgccuggaccaggcuguccuugaccugaagagaugugugagccuagaacccaagaacaaaguuuuccaggagucgcugaggaacauugggggccagauucaggagaagguaugugaagguaccaagagaaguuggaguugccugggucugggacaaggauguagacacaguacuccagagaggagcuacugguaacaaauacacauuaauuaauaaugcucagacugauggaggaaaucaaguuuaaagcauguuuuuuucuguguauguauaaguuuguccuuguauguaaguggugugggugcguggacucuuacgguaccuggcgaagguaugaagugauuuggcucuguuaggcuguagugcuuuagcauaucaaaguuguaaaugaauaucugaugaucuaguuagccccucuugaccuuagacucacuaccugcccgaagcuggccuugaaccccugauucucuugcuuccaaaaacauuuuuaguuuuacuuuuuuaagacaggguuucauguaaccuaggcuaggccuggacuuggcugcguagcuguggauagccuugacuuccugccuacaccucccaagggcuggaauuucaggcgucugacuuuuauuucagccuuguuuauaguaagagagacuuggaacuugccuaaaugcccagcaaugaagagaaaaaaaaaaccuaaacagacuaggucagugcuguuucugagaaauggaucauauaugacuagacgcgggcucugcugauugguagauggaaaagcaaaauaugcgguaaucuaaguaggaaaguacuauguucaugagggaacgauccaaacaguggagccugucugagaauaucuggcugaauccgugacaguccaaugaaaaaugucaguaaagcuugacauuaaaagccaggugguagcgcaugccuuuaauccuggcacucgagaggcagaggcaggcggaccucuggguuagaggccagcagggucuacagagugaguuccaggacagccagggcuaugcagaggaacccugucacuaaauaaauaaaauaaaaauaaaagccuguuaagaaugcacaucaagccaggggugguggugcacaccuuuaaucccagaggcagagaaaggcaggucucugugaguucgaggccagccugaucuacacagugagcucuaggacagccaggacuguuucacagagaaacccugucuugaaaaaacaacaaaaaacaauguccacuaaaggccaggccugguggugaauaccucuaaucacagcacucaggagcugaaugaagcagacagaucuuugugaguucaagaccagccugggcuaauuuaaaaagaaagaaaaaaguguguguguguguguguguguguguguuguguuuaucaaaaugguaacauuggaagaaaagaaugggguuaaagagguuuuccaagaaauaccuguuuuaacgcgcacacacacacacacagacacacauacaccaaaaagaaguguuagcagcuaccucaaaaccuuccugcccucuuuugaacgacugucaagcauagcaccauaguggcauuucugugcuguuaacgcugcuauaguauggcuggcacugccuggagcugguuuccucauggcuaacaaaaugccucccaucugaaggcacuuccuuuagcaucagcaggcccucuugcccaagcaggacaguucagagaggaaaacagcccaggggaaguuuaggaggagaugccuggcaagucucuuccugccugccaugguugcuagcuguuauuuguuggcccugagcucugagccacccgggaggagagccagggagaacacauaggaaauaugacaugucaugacauaggaaauaugacaggucugaccaagaaaggugauuuauucugugcuuuguugcuuugucauaggugcgguacauguccuccacagaugccaaaguagaacagauguuucagauacuguuggaccccaaagagaaaggcacggagaagaagcagaagguacggguccuggagugggccacuagagcucuugugcacacuccugugcucacuggccugcuggccugcuguguuguaggcugagccuccgggcacgccuccuguguaggaaggagcuugugaguccuuagugugaagcaaggagcaggaacuggaguucacagagcaccuugguggccacccggagccaggaucuggcacacagugugacugagaugcuaucuuugcuccugagucccugcuagggacuggagucuagcugucacccaggagaacaagcucucuguuuacuugaaguaagggaagccgaaguuccaagagguugaguuuauagcuggcaccucucagaugcuaaggagaagcagugagguccggagcucagggccucucugcucgcccugcccuuggauauacgucgugucgacauuagaaucuacuuccucugguauaggcuucucagaaccuugugguacuggcccgagaggaugcuggagcugagaagaucuuccggagcaacgggguucagcucuugcagcgccugcuggacacagaagagacugaccucaugcuggcagcccugcgcacgcuggucggcauuugcuccgagcaccagucgcggguacgugguguggagaggucuaguuauugcuuuggucuguaugucuguccgcuugucuacuaaugccaucuaccugucugcucuuccauuccucauuuuguuccaaaaccagcuuaaggcacagaaaggucugucuguggcacagacacaaccagagggaaaaauaaaaaggacagaaaagauccacacguugggacagaguaggcccagaaaggacagacuuagcccugucgcacuuugagcguuaccuuuccugaagccaguccacagggacaccuggucacugccucacucaaggcuucucagagagggguguugaaugugcucuaaagguccgacuccuuuuucucuggagaggagagaugacagugaugucaccaacagcaccucucccuuuguucuagugacccaaugagcagcauggacuguuguccucguguagucaguuuggcaaggauagcccugcucccaggccaggaaaguccauggccccagcucuugccucugcugacuggacccaggauauaggaacuuggccucugguucaucugcuuuuuuuuuuuuuuuuuuuauguguauaaaugugcuuauuuagagucagggucuucuuccauagucuaggcugccuugaacucauggucccucugggauuacagcaugugcugcugccaugcugggcucuuugauugcuuuuagaggaagcuccaguuccaagaaggguagauugugauguagucagugaaaugccuugaggccaagccggggcuaugcacaccccauagcauccucuagcucccucccacacaggucugugugagcugggaugaacccaucaggccuccuggcuucucuggccuacaagaaagaugacuaggccuugcagaucugcccaugcauggucacacccucaggcgcaugcagaccuuagugcuggggcugggaagggacuggcauugaucgaucgaucgaucgaucaggaaguucugucacggugagccuccuucuggaggaggcaugagaccaaauagacacucuugaggccuugucuucucuugggcuacagagccgauguggaugaggguucuggaauuucuccuccaacuccuccucuuauucuucuuccuuccuuccuccuuguuuucagacacugucuagauaaguggccuuggcuguucuagaacugacugcuauccagucucuaugucugggauugcaggugaugucaccacuaccaaaugagaugcuuuccuuagacacacccauccaggaagcaaggcaugaccccgggucauaaccauuagacacaccuucuuuccuuagagcugacccuuccacucagauguuugcuuacuuucugaccacacucacacauucaccauuaggaaucgccauggcuccccuuuaccaaccagagccucuguccgacucuuuucccuccuuagacaguggcaacccugaguguccugggaacucggagagucgucuccauccuggguguggaaaaccaggccgugucgcuggcagcuugccaccugcugcagguuaucuuugaugcccucaaggaaggcgucaagaaaggcuuccgaggcaaagaaggugcuauuaucgugggugaguggaagcaggucuggucccuuggauggucguguugugacccggggugugugugugugugucugaccccgcccagccagucuuucagggugauguuuuuuguuuugcugagacaaagucucacuguagaacaagcugguuuaagcugggcaugguggugcacgccuuuaaucccagcacucgggaggcagaggcagguggauuucugaguuugaggucagccuggucuacaaagugagcuccaggacagccagggcuauacagagaaacccugucucuaaacaccaaaaaaaaaaaaaaaaaagaacaagcugguuuagaacuuaccagguagggugccugaggagagagguaggcucagcucagaacccaggagggaagccuccuuugccugaaucucgcaggacugggucagagcccacuaauauaccucucuccguuguguggagggcugaacccauuaggucguggccauugaucacuaauguguauuguugccagauccugcccgggagcugaagguucucaucaauagccuccuggagcuacugaccgaggugggggucucuggccaaggccgcgacaaugcccugacccuccucauuaaaaugguaccccggaaaucaccaaaggaccccaacaauagccucacacucugggucauugaucaagguaggugguacaguuuagaaaaagcugcuugggugucugaggccugcucuucugugagacugacaggaaaaauaauugcacacagcaacgagcuguccuaagccuccuguggucuguguggcuccugugaggccuuccagaugaguguauaugugugucauuguacauauguguacauaugugugaguguacagauauguguacauuggacaguccugaaggucaggauaaaggcagugucauuuuucucuuuugagguugauuuccuaucaugugaguccuagggaucgaacucaggucagucagaguugguagcaagcaccuuuaccugcugagccaucucacuggcccguuugaaguuuuucuuaguguuuauguaucauuaccgagacauguuaagacuauauugcugggcgugguggcgcacaccuuuaaucccaacacuugggaggcagaggcaggcagauuucugauuugaggccagccuggucuacagagugaguuccaggacagccagggcuacacagagaaacccugucucggaaaaaacaaaacaaaacaaaacaaacgaacaaaaaaacaaaaaagacucuguuaagacaaccaagucauaacagcaauuuacacuucuccuuuuccaaaaagauaauaaauaagaaaggacuugcaaggcccugcgugguagcccucuacaguggugcuuugagccugcuucuguuuccuccguggauucacacugucuugccccuguuugaacucugaccuuccuggcugagagagguggccuugcuuuucucugcaucuccugggcugucgcuaucuuuaggggugggcaccaguguucuacugucucaaugggguaucuuuccaggucugaagaagauucuggaggugggcggcucccugcaggaugcugcuggugagcucacggugacggcaaacagccgcaugagugccuccauccuccugagcaagcuguuugaugaucugaagugugaugccgagcgagaaaacuuccaccgacucugugagaacuacaucaggugagggagugugcguuucucuccuugccggggcugcaggcaaggaagcugacgggcuuucagcauggagggcaaccuuaggaggacaaggaagcuaaagugguccccagcacccccaccccaggcacugguuucguuucuauuggugugaagagacaccaugaccaaggcagcuuaugaaaggggcuuacuguuaggggcuuacaguuuuagggggugcguagaauucauaaccaucauggcagagagcuugguagccagcaggcaggcauggugcuggagcaguaacugagggcuuacauguugagacagccaugaggcagagagagagagagagacagagagagcacccacuaauuuggaaggagugggcuuugcaaagcucaucaucuccagugccacaccuccuccaacgcggccacaccuccaacacggccacaccuccuccaacaaggccacaccuccaacacggccacaccuccuccaacaaggccacaccuccuccaacacggccacaccuccuaauccuucccaaagaguucuaccaacuacagaccaaacauucaaauguaugaguuuaugggagucauucauucaaauaaccagagccuaucauuuuaagaugggaacuccugagcuccugaguagccagggcauguaguuguaugccaguguaccaagcuccaaaccuacuucuuguuccaaagugacgacaccagggaaacugcagcagaugugucacgcaugacagaugagccaaacacuuucuggauuucuuuucuaccuaagaacuagaagugacagucuucccuugaggaguuggcagcugaggggaacagauugacaguagcuugcagugggaagaucuuaagcuguacagggaaggaguugggcaggacggugugucugagggugucaccagcuaggcccgaguggagggcaguaauggagcuuggugacugcuuuugcaauaggauggucaggcuuccgcuuccguugguagcuuuucuugcuguuucuucccaucuagcaccaagugcgcaccuaggggaccuaggggaggcagggagaagaggccccuguauguacuuugacgugacagcuauaacucugugccccucaggaacugguuugagggccaugggcuggccgggaagcuacgagccauccagacaguguccugccuucugcagggcccaugcgacgcuggcaaccgggccuuagagcugagcggugucauggagagcgugauagcucugugcgccuccgagcgggaggaagagcagcugguagccguggaggcacugauccacgcugccggcaaagccaagcgggccucguucaucacugccaacggugucucucugcucaaggaccuguacaagggcagcgagagggacagcauccgcaucagagcacuaguggugagaugggagggggcuggucagcugugucuccugggguggccucagcaccguaggugaaaguacacacaggaccucacuggggcuccaggugugggccuggcuccugccacugaagggcuuaugaucaagugggagaugauccagguacaaaggaugccuaggaauguacgcugccucacacuguccccugcugguuagaaaggccuguggagaagcagaaauuguguguuugaggucuuucuagacacccaugagucagcuguagccaacacuguagggucugguucuccuccuuggguauugucguagcuugcucucuauugccgugacaaacaccacaaacagaaacaacuuggggaggaaggcuuuauuucauguuauagcuuucuuugaaagcgggaggcagggcagggacguggggcaggaacugaagcagagaccgugaaggaacacuggcuuguuccucguggcuugcucaguuugcuuucuuguacaccucaggagcacauucuagagauggcaccaccaccaguggccugagcguuucuacaggcuaacugauggaagccauuucucaacugaggucccuuguucccaggggacuccaguguguguaaagugacacagaaagcagcuagcacaggcaaugaguccuggguuucugucuggugaggauuuagggcguggcucaaguacuuguacagggccuuuuuguuuucuuuugagccagggcuggcuuauguagcccaggcuguccccacacucauuauagaccccaggcuggccuaaaacauuugaucauucugccuuuaccuuccaaaggcugggauuagaggucuggcacagagugcuuuuuuuuaugacacaagggacaguguagagcgggaaugaguguggaaaggccagaggcuuagggucaguuucuaccagucacuguguccuguucccaccucgggaggugacugcugccuaacacuccaugugucaccuguggagagucuguugauuaauucauguuugcggucuucccagagcaauggcagagggccugggaagagagccaggcuguagucuccuuccuaggcaccaaccagcuggccuuguccucuuccuccagggacucuguaagcucggaucggcuggagggacugacuucagcaugaagcaguuugcugaaggcucuacccucaaacuggccaagcagugccgaaagugagucguauuucuccauuucugggacagggcuuaagagacggggugggaccuuagaggugcgcagugagggccugaguuugaaucccaagcaccuuauuaaaaaacuggaugugguuuccccuguaccugucacaccuuugcuguggugggcagagacaaaaggguugugggggcuugcugacugcuagccuagcuuuagcugcagccagagacucuccuccaagggaagaaggcagcaggccucuggaugcacgcgcgcgcgcgcgcacacacacacacacacacacacacacacacacacacacacacacacacacacgcgcgguauuuaaaggggcauggauggaagguaaagcuccuuuguuuccugucuguccccggcaggagcugccuucuguuagacaaacccuccuagaaccuugcucauaagugacugugucaaggggagacccaagccccuggcucuccucuuuguccaagcuacuccuucuuucucccacuauuauuugcuguuguguuuuuuguuuguuuguuugagauaggaucucacuaaacacaaaccagccuagaacuugugacucucuugucucugccauccgagugccaagaucacaggccuguaccuguaccgugguuggcuccugcuucacaccucuuauugccauucaugaucauccuugucccuagguggcuaugcaaugaccagauugaugcagguacucggcgcugggcaguggagggccuggcuuaccucaccuuugaugcggacgugaaggaagaguuuguggaggacgaggcugcucugaaggcccuguuccagcuaagcaggguagcucugccaguuccugcuuucagccuaggggcggcgggaucuaggaugagcgcuuaccaggcuuuagcaggucucacccaugucccugugacccuggggaagcagagccagcugcagggugucucuguggugccuguagggucuggaagcacaguugcccuggaggaguuaaggaggcaggauugugagcucugagugugggguuggagcagguucccagucuuuuccuggguuccucacagauggggcuguggaggaugggauggcagccuggcuccgcugcucugagcugggcugccccgcugggacuucccugcugagugccccucucuccuggcagucugaagaaaggucagugcucuuugccguaggcucggcauuggucaauugcaccaacagcuacgacuaugaggagccugaccccaagaugguggagcuggccaaguaugccaagcagcacguuccagaacagcaccccaagguauggguacacucgggagggcggggugagggcgggacgggacagggggggcuccauguuauuggcagcaguugagcuggccgauugauccucaacagaaagcuuuccuuuaagcaaugucuucugugagaagagcucacauuuucccacccacccagcuaggguuccccccccccacuccccgauugccuucucucgcaggacaaaccaagcuucgugcgggcucgugugaagaagcugcuggcggcggguguggugucagccaugacguguauggugaagacggagagccccgugcugacgaacuccuguagggagcuacucuccaggugagccagccugccucugcggacuccugcuucaggcuaccgcaugccuguagggauggguacuggacugugugggucuuagagcacuuggcugccuuacuuugcuuagcuuaagauugaaaugccugccugccacugggucccacccacccacccacaccuucucccggcagggucuuccuggcuuugguggaagagguggaggaucgagguacugugguugcccagggagggggcaagguaagcugguuucugacuccuuccugagccauccaccuguaagacaugacucaguggcugcuggcccugggggacacuaagaguggccagcaggaacuuuugccaguggagugugauacuucuguggacaggcuccuuggaguccuuuggacccauaaagagccugagcuugccuccuuuucccucuggggccccagggcucugcacaacccaugguuagcaccuaaugggugguugaggaaaguguggguaguuucagugagagaccucaaagugaagggaguggagucugagcagggaguauucucagacccaaggagagaguuggggggcugggggagagugcaguaaggaucgauggcuuggaccuugugcucccggggccagccugggugcugacagggcuggggucguuugacaggcucugcucccccuggcucuggaaggcacugauguugggcagaccaaggccgcccaggcucuugccaagcugaccauuaccuccaacccagagaugaccuuuccuggcgagcggguaugugucuccuugcucugacuguggacccccccccccccguuuccucauuaugcccugaggagcccuggccugggccccuucucaugaccaucaggaaguggcaguuuugcugaguccugggguaggaagagacagccauagagccacugucuugggugggcucccugcuggggucuugggauugggugaacacugauaggugcaguucuaucacagaucuacgaaguaguccggccccuugucucucugcugcaccucagcugcucaggacugcagaacuuugaggcccucauggcccuaacaaaccuggcagggaucagugagaggcucagguaaggacccgcugggagccugguauggggauuugggggagccucacucacucacucuguaguuuggaagccaguuccuggucacucuuugugccucacaaugacuccucugcagccuacagaugaagagucaugccaggggaggcagggugaagcucuggggccccgacuuuacccucuauuuccuucucuccccaggcugcugacacucaguggcucaugguauaauccuaagaaagcuuuuaaguccuucugccucaguuucuucucugugaguuaguuauuuaacccgugaaguaggagcguggagagcuggcugagaaaaugcuuguaaaacucuuuaucaggcacaaguggguguuguggcucaugccaagggaggaagaguucuuggcugugaguucuaggccaggcuagguuauaaucuguuucaaaagccaccucccugaccucuccugaaagccauuaguucauaguaucuggcccuggcaguagucacagugaacauuuauuagcuguuaguacuaauugugaccuugaauacaucacucaccacgcggcccaguuucugcuuuggcuaaauagugacgguagccaccucugcacucuacauuaaggaagguaauucaagcaugggguuaugaugaguaccaggugaaauaguucaagcggcucggacagguucagugcgcaaacgguugauguuuacagagccgucuucauaaccacccugcuuugcuaacuuccgggaugcuuaacaaccccaugcuggggcuggagagauggcucagcgguugagagcaccgacugcucuuccgaagguccugaguucaaaucccagcaaccacaugguggcucacaaccaucuguaaccagaucugaugcccucuucugggugucugaagacagcuacaguguacuuacauauaaugaauaaauaaaucucuuaaaaaacaaacaaacaaacaacccaaccccaugcuguuuccugccaggccagaaggcuagaaagcacugcaguuccuaaccagcacagcagagucuuugggcauugcuaggggagcaccugagcucagggcucagccacccgggauagggcggcaccuauggauauggagacucuggucauacguguccuuccaccuucaccccgcaggcagaagauccugaaggagaaggcugugcccaugauugagggcuacauguuugaggagcaugagaugauccgccgcgcagcuaccgagugcauguguaacuuagccaugagcaaagaggugagcguuggucuggccggucgccaugacugacaggugccgggguugguccggugguugccaugacagguaccagcagcccugcccuucggcuaggcuuugaaccccgguagcaugguccuugccuccaucugucccaggugcaagaucucuucgaggcccagggcaaugaccggcugaagcugcuggugcuguacagcggcgaggaugaugagcugcugcggagggcggcugcugggggccuggccaugcucaccuccaugcggcccgcacucugcagucguaucccucaaguggugaguaccuggucugggcgggggaggcugaaggagcuagcaguucccuacauggugguauggcuguugugucggggaguuccuagagcguagaugugguuucugccagucuucacauccgcccguuuccuacagaccacacacuggcuggagaucuugcaggcccugcuccucagccccaaccaggagcugcagcaccggggcaccgugguggugcugaacaugaugcagucuucgaaggagaucgccggcacccugauggagagugagguccuggagauccugucaguguuggccaagggcgaggagagcccagucaccagggcugccgcagccugccuggagaaagcaguggaauauagacucauccaacccaaccaggacggagagugacgaucggcccggggcccacagcucacgcaucugucacccuucacagcucugagucagcacugggaugcucgauacuugccucgccuccacagcugccacaguugcacuuugguguucucaggacacacagcauacagcccugcccugccagcacucaggagggcccugucuguacuguagagagcugaggcugggggacguacaucccauucaagccugaggauuaugggcaucaagaaggaaggacacaacagcauccucacaugcugggagcaucaucagagccugccagcaggcucaccccgcuaauaaauucuguggaacuaaagca

SEQ ID NO: 3901 - RNA, 3914 nt, Mus musculus
ccgacuaaaccucugucuuagucaggguuucuauuccugcacaaacaucaugaccaagaagcaaguuggaucucauggaggcauuuccucaacagaagcuccuuucuccgugauaacuccagcugugucaaguugacacaaaauuagccaguacaauugaccccuugucaacuugacacacaaaaacaucacuaguaagccucaacccuuacaaucuuauucauccccaagaucuaaauaacuuuaaaagucccacagccuuuacauauucuuaaaauuucaaucucuuuaaaauauccaucucuuuuaaaauccaaagucuuuuuacaauuaaaagucucuuaacugugggcuccacuaaaacaguuucuuccuucaagagggaaaauaucagggcacagucacaaucaaaagcaaaagucaaucuccaaccguccaaugucugggauccaacucacgaucuucugggcuccuccaagggcuuggguaacuucuccagccaggcccuuuguagcacacgcaucguccucuaggcuccagaugccuguaccccacugcugcugcugcucuugguggucaucucaugguacuggcaucuccaaaacacugcaugaccccuucaguccugggccuucaauugcaacugaggcugcaccuucaccaauggccuuccauggccucucacaguaccgaaccucagcugcuuugcgugaccccuucaugccuucaaaaccaguaccaccugggugacccuuacauauuaccaagucccacugcagcaggaguacauccuuggccaucucuggaacacugccucuuugugcuuucagaaaacacuucccagaagaugucaccucaaugaugcuggucucuucuuaaucaccgcuaauuucuuagcuccagcuaaccagcaucaauagucccaguaaugcaaaguuuuugcuugguaguucugguaucuuguuaaucacagcugauucuucagccccagcuaaccagaacuacagaaucuucacaaacaaaacagcaauggcccugaaaagagucuuuaauuuucccucugaaauuucacaaaccagagcuccaucuucugcaguguucucaacauuaucuuccaagcuccuacaugacauccgacagagcucuuaacaacggauggaucuucaagcccaaaguuccaaaguccuuccacaguccuccccaaaacauggucagauugucacaggaauaccccacuccugguaccaauuugucuuagucaggguuucuauuccugcacaaacaucaugaccaagaagcaaguuggaucucauggaggcauuuccucaacagaagcuccuuucuccgugauaacuccagcugugucaaguugacacaaaauuagccaguacaaccuccuagaauagucuucuucccuaaggugggaacagaguugcugggucauggagaaguugucagaucaugccaucgcaacucacggccuuguaccaaagccugccaggaaacaggcaaaagccgaugcugcccuugacaccacacaagcagguuucuguccacucuggugcaggauggucagaacaccgaguccaggaguacuucgagugggcagcccaggugguaaaagggcuucaagggacaaaccagcaacuggaagaggcacuaaagcagcuguucgaggagcgagggcugacgcucugagccguucucugugccauccugcagcauggcuccagcaagguccaggaaagaugggauucuuacugcagcguuccagagccuccucauuucccacauuccaucacucaacccugacaucacaggcuaaaaacgucuguguuuuuucacuaaggugggcccggaauauggaaagcagauaugccccuccauccaggcacuaacagccuuucuuuaagucuugggucuguuugcauggugagaccucuggccccucagggaccuaagauuggaauaagcguccgugguuuagucguggaaaauaaagcacuuagguaaaggcuuaaauugcuguucuuccuucucuggucucccgaagaggacccacaugcuaaauagucauuucccauguccuuuggguuaaaagcaucaacccuuggagccuggcguccuuaucaagugggcuggacuauguccuuacgaaggucagaugaugcaguugugggauggcagauauacugggaaggaaugccaccacuuucuggcaacugacuggcaaagacagaaaucccaguaacaugaggaagccuggaagaccuuagugcuccaacaccaacugcagugauugcucaaugauucauagccgaucccuggacccuuaaaaauugcuggcuaagucacaagagcuuccggguauccggaagagcggaaguccuacaguguggguguggcagagaauuuucggggaguuggauuucgcccucuaucauguaggucugagauauccaacucaaguuugucaggcuuggcgggcuggugccuuuacccacucugccgucucaccucaccuucagagccccuuuuuuuggucuguuuuuguuugcuggaggggcauagggcccccacagccauucuacaauacuccugccucugcaauaaagcacaaccauaccaaggcucuccagaaggcuucuuaaaucucauuggcuauacaaaaaucuaguuuuuacacugaagcuaauguuaagcugcacuugaauuucccauuccuagaaaaacaccugaacacaugcacacacuauacacacacacacacaccacacgacagggcagccauccuccacccucuucuggcucauuauuuuuuaugccuguuggucucucaaggcugguccuuccugcuucauuuuugcccuuggcaugguguacagcaaucuuuucacgcuuuuugagucuagcugcuuucugcucacgugguuaucuuuggcuguuucgacauccucacccugcccccacccugcagugucucuaauagacaugccugggucaguuuuggccuuugagugauauucagagcaaacaggcaggagacagauggggucuuuaggaguuuuaggguuuucggcuuuccuccauagcccuuuugggagggacauaauucaucuccagggcacagugagccucauugcuuuggaccauaccuucagacgucaacuuuuccuuuauggacaugguccuccaucuuuugcaacauauuucugagaacuggagucaggguguuucuucucaugcugaucuacagagcaagucugcaugaagaagaugcguaagaacuuugccccgugucugguugggucagacucagguggacagaaccaccucugccugaagcaaacuucccugaguuaggcagagagccuuccuucccuagggugaaguaaaugguuuccucuuuccuuguuuuauaaugguuucccccucccccacuagagagaagccugcaaggcccagucaccucccacagguuccccugauuucauugcacuacagagggacacacauacucaaacuaaagcauucaauguucacauagacacucccggguuucauucucuaagggacugucucacuggcuaccaucucucaucuucaacuguaucacaguuaagaagcccuucuuggggcuggagagaugacucagccguuagaggcuaggcucacaaccaaaaauauaaggagccugugagcagacuauccuaauuaaucagggcaguacaaagacccagcugcucccggcaacuguuugaacuuucuucccauuggaccuaaacaaaacuaguuccauccuaaugucggaagaucccgucucugucaucucucacagugugagacuugaacuuuccguacauuuuuguuaagaacaaauucagagaccucuaguugaacuguaagccucaccc

SEQ ID NO: 3902 - RNA, 22285 nt, Mus musculus
cgcgcggucccccgcgccccuccuccugccgggcgcaccgcucggccccguggaggcgggagcgcgggagcacaggcgcggggcgagcgcagggagcgcgcagcggcccuggcccccgcgggagcgcggcugcggggccgagcaggggcgguggguggccaggcgucccucuuagccugcgcaacugcccgcgcgcgggccgcggucccccgggaugcgagcaguggcggcucggccggccgggucccgagcggcgcggaggccggccgcguacgguaacgggccaggcggggcgugggcgaggacuccagccugcaggccgcgagcguugcggcccccgggugccgguugagccccgagggccggaggggggcugggcgggccggaggagggggguuacaucucggcagguaauugccccacggugacccagcuccugcucccuagcuccgcccucuuuggcccggacccaaucuccagggacuaaaaauauugcccggaggcuccugagcggaaucagaucgcauuaaguaggacgcaggcugaggugacugagcuuuucagcaccagggcccgaagagcagacuccagagagcggucccgcccacgcgcguucagcagcuagcguccucccuccuccggcaggcaaguggggacucgcgggcgguggcggcaggcacugugggucgucucgaguugccccguuucggagccgcugugccuggcuuccgcuacccuggggacuuuaucagucucgccgcuagcuuccuaagagucccuuuaaagcacucuggaagccaggacuggaaguuuugcacagcaggaaucaguacugauggggacaauccuagaacuggguugcguuagaaacaugggcauuucuuuuucucuuaaaagaaauccauucuguauucucugagauaggaucugggccaggcacuguuucugcugaguuccagucagccccaggaggucacaggggaggcagggugugaguguguguguguggggggguugucugucucuccagcuggugauuguaccccuaaaucaaacaaaauaaaaccucuuguauuuauguauacaucugaagggaggaaacacguggcuugggagagccuucucagaguccugagcaagcuguuugcaaucagugguuguguaaugaagugugggucagaguuggggcucuguuaucccuguuuguuuguuuguaauguguuacauuuauuuaugugcauguacgucacagaaaacaugcggcaaucagaggacaauuugugguaguugguuuucaccuuccaccauaugaaucaaaugaaucgcuuugguugucaggcuugccugcaagugccucuuuaccuacugcacccccacacuccacauccugguuucuauagcuugggcugaggggaaucagaacuccucuccuacaggaccagccccaaauauaugugcuacuuguguguugggagucauaaccaagauuugguacuugaaagcuuacuugcuuuuuuacccagagucaagcaaguagguugguucuccuugggaguccacagagcguuuguuaggaacaccaacagaaggguuuugcaugccagaacuacagguggugucucuccugccaggaacgugccuccugggucaguaugaagcugaaaaagcaggugacgguguguggggcugcuaucuucuguguggccgucuuuucucuguaccuuaugcuggaccgagugcagcaugauccugccagacaccagaauggugggaacuuccccagggugagucacaccuuguucucuucuucaaaugcaagucaccugggcucaggagagucuugucagcacaggacaagagcacccccccacccccauugucuuagagauuggaccuagagccuccucaugggcaugcgugcauauaacacuaacgaucuacaacugaguuauguagcuguagcccagggacauuccuaggcagauuugucuuucuuguggagauggaugcccaaggacuggcgcaugcuaaacacaugcucuaccacggagcuaugcuccuggcuguaacaggaagugaaaagcagcaaugcugaaggaggagggagaggaggaggaggagaaggaggaagaggaggaggagaagggggaggaggggaacaagaaauuugccuuguguaauaauagccugacuuaaguuucuggcagacacugcugauugaccaccguauugcuuuuccauuaagcugaacgcaguccuccucagcaccgugcuugagacaggaggaacauguaggucgcugagcacgggcaugugagaggaaauguuugccuuccguggucugagugaugaugccuuucuguucuuguuuuuuuuuuuuuuuuuuuuuuuuuuugcagagccaaaucucugugcuacagaaccggauagaacagcuggaacaacugcuggaggaaaaccaugacaucauaagccguaucaaggacucuguacuggaacugacagccaaugcggagggcccgccagcccugcugcccuaccauaccgccaacgguuccugggcugugcucccggagccccggcccagcuucuucuccgucuccccccaggacugccaguuugcuuuggggggacggggucagaagccagaacuacagguaagaguuggagcuggcagggacccucucccacucagacaggcacugagcugcauuccuccccggcagauguuaaccgugucugaggauuugccguuugacaauguggaggguggcguguggaggcaaggcuuugacaucuccuacagcccaaaugacugggacacugaagaccugcaaguguuuguggugccucacucccacaacgauccaggugaagggccaguaggcccggcugccgcaggguguggggcgggcuuucagauggcaggcaugaggagggugugacugaaguauguggcauauugaggggaccuuguguuggcucccccaggcuggaucaagacuuuugacaaguacuacacggaacagacccagcacauccucaacagcaugguguccaagcugcaggaagacccccggcggcgcuuucucugggcagaagucuccuucuucgccaaguggugggacaacaucagugcccaaaagagggcagcaguucgaaggucaguggugguugggaaggugugggaaggucgaucauuaucuaggacucagauggguagguugggcuugucucauuguguggcugccaagcuggcagggagauugagcuguggcaggaguggggaacugaaggucuguuagugugcagagaaaucggaaugcuuggggcaugagggagaagcgugggaccucugccucugagcacagaaggggguccugaaauaaccaaccaagacagggccuugcgggcugcagggaaaggaggcugagugagcacgcuguucacgugggugaauugguugguggaggccacugcgugcagucccugccauccucuggcugccaauggaaagguccccgucccaucccaagugugcuucauccuuaggcuggugggaaaugggcagcuggagauugcgacaggcggaugggugaugcccgacgaggccaacucccauuacuuugccuugguugaccagcucaucgaggggcaccaguggcuggagagaaaccuggguaagugcaggcacaggagcucgacucugccccagagcugguguggggcaagaugcugugagguccagggguuggcagggaguuaguuguuccuuucuaggcucaugcagccuaucugaugggugaggcaggagcuggccucccaggcaccaaguggccaggggcccguccccaagguagucagggccuuugacuucugugcugugccuuaggugcaaccccgcgcucgggcugggcaguggaccccuuuggacacagcuccaccaugccuuaccugcugcgccgugccaaccugaccagcaugcugauucagagggugcauuaugccaucaagaagcacuuugcugccacucauagccuggaguucauguggaggcagaugugggguaaggccaaguaggggcacgcauggguacuguagcaguggagucauguugaccucugcuggcuucugugggcacaucucccacaggagcugugggccugggagccccauguccuaauucccagccuacauacuugcgaccucagcgucucucagggcugccuguggguggcaugaaccugcacaccucugacgucccugugcccagcuccucaggcugucugccguggcugacccugcgguaugucuucuguagauucagacuccagcacagacaucuuuugccacaugaugcccuucuacagcuacgacguuccacacaccuguggccccgaucccaagaucugcugccaguuugauuucaaacgucugccgggugggagaaucaauugcccuuggaaggugccaccccgggcuauuacagaagccaauguggcagacagguaucugcugucagcccugcuuggaccaggugcuggguuuuggguuugggauuuugagcuuguguauggucucgcuauguagccccagcaggcuccaacuccauccucuugccccagucucugggguccacaggacuuugcugccacacccagcugguguugacauuuuacuccaaagaggaguuagacugaaaccugguuucuggucuugguugugccacaugggacugcauggugcugaccauaccuggaaaaaggguagacuuuggggugaguuuaggccagagucugcagcagugacuccuuagcucuuccaugggaaugggaauggcagaguggcacuaagcaaacaccuuucccagaaugcucuuacuuuccuccgugagguuguccuuauagacuugggaagcaacccuagccccugcugggcuguuugcuuguuuguuuuguuuucauuuuuguuuuuugcuucuguuuuugagauaggcucucuuguauuccgagcuggcuggucucaaaccugccuccaguuccugagugcuagggucauaagcaugccuauaaccaguuaugcccaguuaugcccaaaccagagcucugcuugugaggccugggcaagcaccuuaccacugagcuacauccccagcccuaaacaauucuuuuucaucuuccugagacagagucuuacuguguagcccuggcugaccuguagacugggcuggccucagacucaagaggccugccugccucugcuuuccaagugcugaggcugcaggccuguguugcugugcugggcacccacccuaaacaguucucacuaaacaguucuuacacugggacccuuucuugcaaacucccagcugucguccuucaguggacucagguucucagggucagcucuaggccaggcaaugggccaaagcuuguucagaucugccagagagccucuacccugagaaaaaaggccugucccuuuggagagacuaguaagggacuucaaagauguuacugugacuaaaauuagacuccuauaaaagcgcugguuuagggugaucuaaaugugaggguguaauauguagcagcaguccaagcauugaaggcaacuuuucuggguuuuuuuuguuuggcugguuuuuuguuuuguuuuguuuuguuuuuuuguuuuuuguuuuuuguuuuuguuuuuguuuuucgagacaggguuucucuguguagcccuggcuguccugacacucacuuuguagaccaggcuggccucgaacucagaaauccaccugccucugccucccgaguacugggauuaaagucgugcgccaccacgcccggcuuguuuguuuguuuuuuguuuuugucuuuuuuguuuuugaagacaaggucuugucauacaucucuggcuugccugguacucacuguguaccucaggcugaccccuaacuugcaacaauccaccugccucagccuguaaguguugggauucuaaaauucuuaaaaaaaaaaaaaaagcuuccaaugacucgcuauaagguucuguuggguagauaguauagauuuuuuuaaaagauuuauuuauuuauuauauguaaguacacuguagcugucuucaggcacuccagaagagggcaucagauuuuuguuacggaugguugugagccaccaugugguuucugggauuugaacucggaaccuucagaagagcagucggcucucuuaaccacugagccaucucgccagcccccgauaguauagauuuaaaaaauguucucauacaguucaaguuaggugccauuuuauguguguguguguuggggguggagcucuagauagagucucacuagcugaagcucuccuugaacuugcuguguaaaugaagauggguuugaacuacugaucucuaccaaagugcuggguguauaggcacaugcucccacacccaguaggccuuuuccauguacaccuggcuggccucaaacauggaguccucuggccucaacuuccugccaacugugauuacaagcaugcaccucugugccuagcucuucacagggucuccucuccuuuccuuucccuuuuccuuuuccuuuuccuuuuucuuuucgagacaggguuucucuguauagcccuggcuguccugacacucacuuuguagaccaggcuggccucgaacucagaaauccaccugccucugccucccaagugcugggauuaaaggcgugcgccaccacugccgggcuuccuuuucuucucuugagacaggauuucauuaugucacccuagcuggccugaacuuugcuauauagaucaggccggucucaaacucaccugccucccaagggccggaguuaaacgcaagcaagcgccaccaggcauaguuugcaugugugcgaacccacauuugcgggcguguaugcggguccgugaauguauauggcgacccaagguuaacaucagaaauuuuccuuggugucuucccaccuuauucauugaaaaaguuccucaguugaagccagugcucaucucuaguauuggcuaguguaagcaugcagcuugcucugggauccugucuccacccucuaggugcugagacuacaguccugccaccaugcacguuggcauuuauuuauauguuggaggggagggugccuaaacuccagucaccacgcuuguguggcaaguacuugauccacugagccauccccguagcucccucacuggucuuuuaagccuggggcuucauguuggaccugugaccaucucuauuuccagggcagcccugcuccuggaccaguaccggaagaagucccggcuguuccgaagcaacguccuccucgugccacuuggugaugacuuccgguaugacaagccccaggaaugggaugcccaguucuucaacuaccagcggcucuuugacuuccucaacagcaagccugaguuccaugugcaggugggggcacacauacagaccuguggguaugggugcucccuccugggccuuccuuuaacagccaacccuucugcugagggcuccacugucauuccugagcaagguuucuaggcccaaaagagcaggacacccagagguccugucuuuugcuaggcaaagucgucaccccugucuuuacuagcaucauaggaugaauauuguggccaguguucccaggaaguucuguaauugaugguaguucguuuugggucccuacaggcccaguuugggacccucucugaguauuucgaugcccuguauaagaggacaggaguagagccuggugcccggccuccaggguuuccugugcugaguggggacuucuucuccuacgcugaccgggaggaccacuacuggacaggcuauuacaccucccggccuuucuacaagagcuuggaccgcguccuagaagcccaccugcggugagacuugcccaccucccccugcugaguuaggaggggcugggugggagaggaccccuucaguguguggguggcccgugggagcgacguuggcuagaacagaaaggcucugacuucuuucucuggguaguggggcagagauucuauacagccuggcuuuggcccaugcccgccguucuggacuggccggccaguacccgcugucugauuuugcucuucugacggaagcucggcguacacugggccucuuccagcaccacgaugccaucacgggaaccgccaaggaggcaguagugguagacuacggggucagguaggagccagcccguuucccucgccaugucaaagaacggcugcgugguugggugaucggguggucggcugccgagggcugguccuguuggcagagcagacggccucccuguggccaucugcucucagcguccucuccugcuccccgcagguugcugcguucccuggucagccucaagcagguuaucaucaaugcugcccacuaccuggugcugggggaccaggagaccuacagcuuugacccugggacacccuuccuccaaauggugggcccccuccuaccucugcuugagagauccucugguguggguggguacuaucucaagagcugcuagccguggggaccauuccuuuuccccacuuucuuguuuuggggguccuaguuccaugcuuaaggugguugguggccuggacaggcugggguggggaggagguugagcguaguccucauucgucccuccugcccacgacauugcaggaugacagccguguaagccaugaugcccugcccgagcgcacggugauccggcuggacuccucacccaggugagccaggccuggugagguucauggaggcaccuccaacccagagcggcccuuggaugccaauguaggggccucuuguucuggcugcugcuucugcccuucugccacagcaagcuccugggucagcccaccuuccacccacagguuuguggugguauuuaacccgcuggaacaggagcggcucaguguggugucccugcuggucaacucgccccgggugcgcguccuuucagaggagggccagccccugucugugcagaucagugugcacuggagcucggcuacggacauggucccugaugucuaccaggugaggcagggcacagcuuuccccgcuugucaguacuucuccuggggacucacuccccaugaacaccugccucccacuccccugcuguucccugcuuacucccugggauggaaacagguggccagggagaggcguugcccaaaggacaaucacuauugggauuugagcauccuuaaaaggauauugaggacagugugguaacaguuauagccaagacagcaagcacccucagccaacucaacaaguauuuaguguuuacuacacugugauggggucuugucucauuccugggcuuaagcuucuagugaggauuuaguguguugacuuauuauguauucaugaaaaauaaauguucagauguaguucaugcuaggcucggcucuaagugcuuaauuauucaaugaauaauugaauuauuauuaagcucccccacacugcagaaagucaagugugguggcacgggcuuguaacccaacacugggagguggagacaggagaaucagaaguuaaggucagccuuagcugggugugugugagagagaugugcgucuucaaucaauuuguuaagaaagaaguuuuagccgggcaaugauggcacacaccuuugaucccagcacucaggaggcagaugcaagaggagcucuaugaggccaaccuggucugcagagugaguuccaggacagccagggcuacauagagaaacacugacuuuaaaaaaaaauuaaaaguuuuuaacacaaagucuugcugcauaauccaggcuggccucagacugaagaucucugcuucaguauccugacugcaggauacagagaugcacaaagaugucagucacugcugggucucauuuaaauucucaugagcgcacacagugaugccaccccucauucccccaggaaucgagguuaagucacugccuacggucacucagucugugugaagccugcuccaggcccuaggcugucaccucggcgggcacugugugccuuugcugacgagugugcagaaggacacugggacucagaaccaggguccccaaacagacgggauucuucagauagaaauguagggcucagugcuuagcuucggaaagcagaacgccaaggucagggauggaggguagaaggccugucuggacugaugcugcuuaccgcccaugcucacaggugucaguacccguccgccugccaggccugggccugggugugcugcagcugcagccagaucucgaugggcccuacacgcugcagucuuccgugcgggucuaccugaacggcgugaaacuguccgucagcaggcagucagcauucccuguccguguuguggacuccggcgccagcgacuucgccaucagcaaucgcuacaugcaggucugguucuccggccuuacugggcuucucaagguaaagggccaggccaggggagguggggaggggccagaggaaggcaugggugucagggggcuuguggauagcuguuccugcucccaugugcccuccugucugucaccugacucacagagauuugggugugaacauuagcaguugccaaguguuagucaccuucuacugugucagugacuuguaaagagagaagguuuauuuuggcucacgguucugagcuuugauccuacagucaggcagaccgauugcuuuugggccugugguuaggcagcacguguggcagagaacacaccacagcagaggaaaugacuucacagccagaaugcaagagagggguugguuguugugguacaccugugauuucaacaguggaggggguaggaucagaaacucaaggucaucucuggcuacauggcaaguuugaggcaacaugagacccuugucucaaaaaaaaaaaaaaacagagaaagaaguuguguuuguuggcacauaccuuuaaucccugcacuggagagacugagacagguggaucucuguaaauuugagaccagccuggucuacauggugaauuccaggucagccagcacaacacagugaaauggugucucaaaaaaagaaaaaacaauaagaauaaaaaggggccuggaggcgcaggguagacaaauacucuaccaacagagcuacaagaaucccuggguuugcucccccacacugcagaaagucaagugugcuggcgcuggcuuguaacccagcacugggagguggagacaggaggaucagaaguuaaggucagccuuagcuggggguggggguggggaugugcggcuuuaaucccagcccugggaagugaagcacagagaaacccugucuuaaaaaaagaaaggaaggaaggaaggaaggaaggaaggaaggaaggaaggaaggaaggaaaauauagccgggaagaggugggaggaucccaguuuucucaaccucuccuaguagcaguggugugcgaccaagcccuuauggggaaccccuaagaucccaacuguagcacugggcuuggcucuuugggggaagucagucccugcccucccagggggagaccugacaagcugguguggggccaggggucagggcugugguuuuuggcagagcauccgacggguggaugaggagcaggagcagcagauggaacuggaguuccucgucuacggcacccguaccuccaaggacaagaguggcgccuaccucuuccugccugauagcgaggcuaagguaccugagaggccucacagaaccgggggcaccugcgcauggggagagccugggaggggccuggcguaccggguuuugccuuacuguccuuaugagguuggugggcuguggucuuagugauggcuuugggccugcucaggccagagcacugggacgaugguuucuguugaccagcccuggcuugcuacugcugcuuuguacuccaugcugcggguucaguggccacuugcucuuucuccagcccuacgucccuaagaaaccuccugugcugcgugucaccgaaggcccuuucuucucagagguggcuguguacuaugagcacuuucaccaagugauucgacuuuauaaccugccaggugagcccugcaggcagggaaggucaccagguguaagucccacaggcuggcaccugcuccucuuccacuguugucauggacaagcagacucgucauuugacacggggaugcuugauucucuuaaggaaaaguccaacagugcccugagagcucccgggguguagggugggggagcccgucgcuggaauagucccuuguugugcucaccucacuucuggcugucccuguguuuccagggguagaggggcugucucuggacaugucauuccagguagauaucagggacuaugugaacaaggaacuggcccugcgcauccacacagacauugacagccagggcacuuucuucacagaccucaauggcuuucagguaauucuuggggcccaugggacagaacucauacugcuuauggcccccaaaacuggagcuguguggagggguggggguccugaggacaggugacaaguauagaacaccagugaaauggcucaguggguaaaggcucuugccuaugccuggcagccugaguuugauuccuggagcccucauaaagguggaggagagaauccaguccacagaguuguccucugaccuccacaugugugguguggcacggacacccauacauacauauuauauacauacacacaauuagaaaaaaguagcuggccgggcagugguggcacacaccuuuaaucccagcacuugggaggcagaggcaagcagaucucugaguucaaagccagccuggucugcagagugaguuccaggacagccaugacuauauagagguacccugucuugaacagucagacagacagacagacaggaauaccuuuacacugagaacucuucagaacauaaaccaggcuggacucuaacucuucccuauagauacagccccggcaguaucugaagaagcugccccugcaggcuaauuucuacccuaugccagucauggccuauauccaagauucccagaggcgccucacgcugcacacugcccaggcucugggugucuccagccucgguaauggugaguagggaaccagccuacccuuuguuccagucagcccaugcuguggacuucccuccccucucuccagguccccucaccccagagccugaagagggggaaagggggugagcccuccccuuccucucagucacacuuggcauccugucuuuugguggaagcaguugaguauugaagggugacuuucagcugaaggguucagcucuucuuuuucuuuuccucucucucucucucauuuuuuucauucauuuguuuguuuuuuauuuuguuuuguuuuugagacaggguuucucuguauagcccuggcuguccuagaacucacucuguagaccaggcugaucuugaauucaaagaacugucuaccucugccuccugaaugcugggauuaaaggugaaggccaccacagccugggaggaggcagcucuuaagugguuacaguggaauauuuaggaaaggagaaagauacguauuuuccuccuaauggucaguaaaagaaaggauaacaacagucuuacaaaucaaagguuucuaagcccaguagcacagaggccgaggaaggucaccccgaacucaaggucaguuugggcaacuuuaguaacacugucucaagacaaaaaguuaaaaccaggaggacuugagacuuagcucugugguuggaauacuugugugguaugggcaagaugugagcuuccgcccucaguguggagagagugcagagacaagucaggagcucuccuacccguuugcacagccuugggacaaaaugagcagugauuuacagacucucaggccccagagccuucugucuguggcuguagagcuugugaaggcugaagcgaaugcaggguugaagccuugccacaccguggcgagugcugugccugccuccucugugggagggguauggcucuccuacccucugccaggauuauucgggaucuguccuccucuaaacugaaugcagcccauuguccuugcucggucagcugucugccccucugggacauggccuguuagggagugauuaucgucuacucaaggaacauguuuuagggcuggagauagccuccugugcuugcucagaguacaaagccaaagaaaauacagaaauccuagucaggacugugcccucugggaaaggcugugugggcugcugugggagagccuuccuucacaccggucagcuugucagccaagaccccugucccaugcaacauuccaaacgguuuacagaggugguccucuccuguccuuuaccugggccagacuggaggccuugcugaaccucuaccucaugccuguccucagcacagccugcuucugacaagcaaggccacccacuccagucuggacugcugggccuucgagcugaugcugggcaguguaaaggcaggagagcaugugucaagccauggagucuguccagccugagaaagcccaucucagaugggggacucugcagcagugucacaaagaggccuuucucuuuuccggcugcuggugacuguguucucuggggccaauuccuaagagguuuccuccugcaccagggucccaccccugagucgcagaggugaauggccauggucagugcccccuuucuaggccuccuguuacuuacacccugcucucucauaccaggagucugucauucucucuugaguaccucagcucaucugucucgauggcuccccgcccggggaccugagguggagagucuaggcauggauuuggcggccggagcucacuguuaccuuccuuaggccagcuggaggugaucuuggaccgaaggcuaaugcaggaugacaaccggggacuaggccaagggcucaaagacaacaagaucaccugcaaccguuuccgccuccuguuagaacgucggaccacaaugagcccagagguaagaucugggccuguugcacuguggguaacccuggggguuuccaaauguagcaggaagagggcaaggggcagauuauauauauauacagcuuauuuccaccacugagguaggaggcugucuggcauuuugcuaacucauuucaugcagcuucgcagucccuugucacguucaucuccugccucugucuuuccugccuucaucuucucaccccaagcccgagcacuuccuaaccuugacacaacacugcucaucucacaguuuucuuugccucaccagccuggcuuuuucuccaaacuggcagacauguuuagggacuugaucuuuuccagcaacacaaucaggagcucaaagguaagggccagggagggccuugguggccuagggcgagcggccuggcacuguaguuggagucugcugccuagaaccccagaggugcggcuuagacacuuacucccccuguagacgcugagcccccgcuguguugugggacaggggauacaggccaauaugcugccagcccugggcuccgcuagugagcagggcccggagcugcugugagcgugaggguagaggagcaguagggucucucagggccugcagaggcgaaaggcggcuuccggagacgacagucaccaggcucagccucggugaguggggcccauucacagagucgaaggcaggaagacagaauggaagugggacuaguuguaacuuuaggcuaaaauggugcugacuagcauagccaccgucgcccacaugugccgcccguuuacuuuauuggagcuuaggauugaacccagggcuuugcccaagguaggcaagugcuuuaccacuaaacuaaaucuccaguccgguuuaguuuuuuggguuuggguguuugagguaaggucuuauguagcuugggcuggccuuuugguauggggauauccuuggauaaccuugauuuuagucucacuguugccuaggcuggccuugaacuccugaguuugagugagccuccaggcucagccuccuaaguagcuaagaccccaggcguaugccaccuugcccagcuaagaccccaggcguaugccaccuugcccagcuaccuagaguuggcuguuuacuuaauuuuuuuucuuuuccuuuuucuuuuucuuuuucuuuuuucuuuugagacaaggugucauguagugcaggcuagacuuaauccucaugccucuaucucccaaggguuagaauuagaggucuauaccaucaugcugggauuuauuuucaucuaugguuacugaaaugaauuaagaugacguagguucagguuccgcucauacuggcuacguuccuuggguacacgucucagucucaagauagaggugguggaucucugcgguuggccccuggucugcauagagaguuccagggcagccacuacuacauaguaagaacccugucucaaaaaaaaaaaagaaaggggggcuggugagauggcucaguggguaagagcacccgacugcucuuccgaaggucaggaguucaaaucccagcaaccacaugguggcucucaaccauccguaacgagaucugacucccucuucuggagugucugaggacagcuacaguguacuuacaauaaauaaauaaaucuuuaaaaaaaaaaauuacaaggggcugggggcuccucagcagauaagagccuacacuuggacccccaacacccacagggcagcacaggaccaucuguaacuccaguucgugggauccagugucuucuuuuggccuccaaagugcacagacauauguauagacagaagcacaaagacaaaacucccauauacacaaaaugaucauaauaaauugggguuauuuuuguuuuuuuguuuuuuggguuuuuuuuuuguuuuuuugagacagggcuucucuguauagcucuggcuguccuggaacucacuauguagaccaggcuggccucgaacucagaaauccaccugccucugccucccgagugcugggauuaaaggugugcgccaccacgcccagcaauaaauuguuuuuuaaaauuaccuuuaagccccccccccccuguguuuccagguugucaguagcuaucacagaagguguggccagcaauguuucuguuauuucagaaaacucugugagccaaacugggcuugaacaccggaguguaggacagggcagacccuaaagaucccagugccuggccagagccuggagauggggaagacuggggagggagggauacuggaggaauuaguccucagcugucaggacuacgaggagcagaguggcuguguaggaagacaagguaggggugacaguuucagaugcugaaacaggaagccuuggagacuugaaguaagccaagaauaggaaaaagaaauuggcaaggaagugugcguugaagacuuugcagaagcaaaauggaaggggaacagucccugccugggcuugaagggccaagggagacuguguagggcacucagauggcagugccaggagcagagaugggcacacagaaauggcguggccguggaggaaguccauguaguccugugaguguggccuccugggagccaccugaggaggagucuuaccagcuggggcccauggagcugagcgucuggccgacacagggauguggcaucuuaccucgggacucucacuauuagaggccuguccguagugaagcaugucugucuguuguccaugccuacuccuuucuguggggugauggcaccuuugagaguacauucuucaugauaguguuaaagaaaacagaagcaggccuggucaccugacugucugugagccgggcgccauaguuaguagccaccucugagggauuggagguacagggccugaaaccaggcagucagaguccaagugaccuaggaaagcuguucugaaaagagcuggccugccuccccuucaccuagaggggcucuguccccucauuuacguuuugggucuaucuugcaggugcaucaggagcaggagcguucuacaagcuacccgucccuccucagccaccugacauccauguaccucagcacaccuccucuugucuuacccguggccaagaggcagggcacuagcccugcucugcgcucuuuccacccucuggcuucuccauugcccugugacuuccauuugcucaaucugcgcaugcucccagccgaggugagugucccagucagugcuaacccucaccuccaggcucuggcccuccucccagcucuccucuguccagccuucuuggcagaugugcugcuaacccgccacugcccuugccccugacugucuuccaggacaccuugcccgcaacugacucugcgcucaucuuacaccgcaagggguuugacuguggccuugaagccaagaaccugggcuucaacuguaccacaagccaaggcaaggugaguggggucccggugugggaggcacgggcccuggucaggacagcagagcucuaggcugagagccuagaggaaggcuggcagucaguaggaagaaaggaggaguagccucggggcucucuggagacuaaggggaggccuuuggccugugcuuuugguaauggagucggcaggagccauuucagaccagcauggggcuagaaaccucggguuuccugaggacagaccuuuucagagugaagugggaaaccugagaaugaaaaaccacugcaccuuuucagagcaucgcucaugguguaaacuggcacguugcuugcccuggugacucagccgugaacccaaacagccccuguucucagcucacacagcguggugugagaguuccuacgaggagccugggcaagcuuuggacuugaguggauugcagcagugcccucucugaggcucgcugcuccugggagggcuguggcuuccagcagcccguuucccucuuacuuuauuuauuuauuuauuucucuaucuuauuuuuauucuuuauuuuugagacaaggucacacauaaccuaggcucgauacaaccuuacuguguagucgaagcugaguugaaccccugaacugccugccucuaccucccaagagcuagaguccuguuacaccauuuuagcucuaagaaucugacagaaauccagguguguuggcucacaacacagucccagcacuguggcaggacugcucugagucugaggcuagccuggauuacagugugagacccugucucaaaaaaucccaaaagggcugggcaagguggcgcacaccuuuaaucccagcacuugggaggcagaggcaggugcauuucugaguucgaggccagccuggucuacaaagugaguuccaggacagccagggcuauacagagaaacccugucucaaaaaaaaaaaaaaaaaaaaaaaaaaaaagaaaaagaaaagaaaagaaaaaaaaaggaaaaaacccaaaagggcagcacuccguguaaggaagaacuuacccacuguuagcagcgcccggcucacccugcccccuuucucuucacagcuagcccuggggagccucuuccauggccuggaugugaccuuccugcagccaaccuccuugacuuugcuauacccucuggccucaccuuccaacagcacugacaucucucuggagcccauggagaucagcaccuuccgccugcgcuugggcuaggccagggcuucuuguggccugaagacaggguucauccacagagacugccuccuaacaccaagacuaagcuggacaagccacaccaagucuccccuccgcucugccucagaagugacagacugugcugugcccuuccguugucuauugcugcuccugcguuuggaacaguccuuacaucagcaggcggcgggggcagagagacaggggagaggaggcccuugcccuaggcugugaguagguacccagcugggcacaacucaggcuucauccuuuucccaaaaugggauguaggaagaguggggacaagcagaagaggucagggaggcugggggacaaccucacgcuaggagacugcagguaugagcuugcucugcggggucauauggaccccacagugcugguaugaggguacaggagcagggugauucugggaggagagggguaggcgcccauuauuaguggaguaaaggcguggaaggagucccugguucuccuaagagccuaaaggcuuugcugcuuucugcucuggcucuguucugagugccacugggccugcucugagugccacugggccugcaugcccuggcuaggggcugcugggugcaggaagggcuugcuucagacuccaggccagaggccacggaacacuucaggcacuagcacuaguucucagcugaucauuugguguugaucugugacagggguagggagugucucccccugaucugcuuucuuaucucacacaccaggcuccccacgaguucccauuguggggauccuggcaggauuccuuucucuaaaauggaaacagaguuuccaagagggcugugcuugggugucuugggaaggcauccugugcuggggccccuggugggcugaggagguucacucguaucccaccugcagaaguauuaccugcccgcuguguggacgaggaaggcagagacaaaauuaggaggucaugugcuuggaugaaccuucguuuuugcuucaaucaauagagaaucugucuauaaaugauaagaguugguaaaagcaaaguuccauccuuacgaaaacuuaguaagccaagacuagaaagaagcccguaaucuggauaaagaucucgucaccaguaagcgaaggcgcccaaagcaucggacagagcaggcucugauccccucagucagaaacugcccggcggcacaguguguuggugucacuaacccacacuucagauggaaacaagaauuacaauugccacuguuuuaaaaccauaagcuaccuaagaaaccugugugucaacuagcaaggcauucugugaguugcccuguaacgacugguucuccccaaaucaacccauaaacaucaguguaauucccacgagguuggacacuuucuggaacucuucagguccuggcauucaucuggaaggugacaggcugaggaugugaaguaguucugaauggccgaggugaugaacggcugcugacacuaaggcgggcaacaggcaguagcugucuuaacagaguucucaaacgacuuggacucuucugccagcgugaauucagcugccaugauaggucaggucagacagaccuaggcacguagaaauucaguauaugauuucaggugcaggggaggggagguggauauuuucauagugcuuugagacagcuaccuaccuaugagacuucuguuucaaaaacaaaacaaaacaaccuagggcuagagggaaaaaagcaaaagcaaacaacaaaauuguuauuauuauuauuauuauuaauuauuauuuuagucucacuauguaccucuggcugugcuggaacucauuauguaaaccaagcuggccuggaaaucacagagauuccccaccugccucugccuccugaguucugggacuaaaggcaugcgccaucaucacaccugggaggaaaaaaauuuuuuuguuuuuuugagacaggguuucucuguguagcucuggcuguccuggaacucacucuguagaccaggcuggccuugaacucagaaauccaccugccucugccuuccuagugcugggauuaaaggcgugcaccaccacugcccagcagaaaaaaauauuuuuauaccugauuuaggaaacccuuuucuagacauaacaugaaaccuaauauauaaugggggaacauuaaaaaauagguuuugacacacacacacacacacacacacacacacacacacacacacacacacacacacacacaaagcuugaaagcaugcuauaggaaacagguuaaaucaauacagcuguguggguggaaacgagucugcagugaguucugucacugcuggagaaaaguguguuuugacuucucagagaacgucacuagggucuguccagcagcacccaaagacucaguagugacaaggcugaguucuugcagggucuccaugguuuauguugccaggcucaggccacacggcuuccuauucaugucuuggugacaggaaugagaugaagaguggggagcgcuuagcacagagcagggguugcgccuacagcaagacuuauuugcuaccauaugguuuguaaucaaaugauagggaacugugcagaauaaagaauauucuuuggaggucagagau

SEQ ID NO: 3903 - RNA, 17160 nt, Mus musculus
ugguuuagccagaacuggaaagcuacugccugacgugacaggguccucaccggggcaccagcagccaccagggaagcagaggcaggcaagauggaucuuggauucucuggagcuagauggugacguaugaacaugcuuuuacucaguuuggcaugacccaagguuucauuaauguauuauaggagcuauggagacauuucugaagauucugaaagaaaggaagaaaggaagggaugaaggaaggaaggaagaaagaaagaaaguaagaaaggaaggaaggaaggaagaaagagagagagaaagcaagcaagcaagcagaaagcucuccaucccuuuauacacacaugcuguaugugcagugauuuaaaccaagggugguugcuguuaaaggcuucugggugccucagguuagggagagguuugaaagauagagucccacaguuccucaaggguauaaagggacugacuggauuuuagcacuaaagcucucugugguuacuuauggaucagcuccaaaucuaaggauaaagagagcucuggcuggcccuuccuccccccagcccccuguccagauggcccccucuucucccaucuuaggacucuguaaaauugguaagugucaccuuagaagacucacgucaggaacugaguguuagaggcagcugagcuuccuggacccuuaggcuucaggucaaugguaagaaugauaaagaguacaguaccugccuaugggacuuguugcagaaagauaacagaaucucccucugacgagaaagacuuucagauaauugucagcagaguuauugcaaaugcaaucuaugugaccauccagauucgagagaggcaaaguguaggcaaccgcucacccccauagugccuccacacaggccucucccucaaggaggcagggcugacugcuucccacucaaggcaaggcggcagaaaggcuggcaggagaagauaguugugccuggguugcagccuucaggggucuggcuaguucuucccuccaaaggcccacggagacuccucugggccagccuccaaggaagggggaaaccacgaggcuuucauucugagguaaacuuucaggucacaggacaauugggaggagcacuaggggacucccuugcuagauagggccaacccugucccuauuuccccuaaaugggugauguugcucauagccuaaggaaaaucucugacucacuuccugccucagucucaccacaagaguauuguucucccaaaugugcaugugguggugcuggugggggcuaccccacagugguccccacaggucuuagcuccuucuaagggaaagcccccaaucugggaggaaccagacuuuuagagaccccaugucugcaguguuuuaacggaugcucaaauaacagauucaguuaacuucauacacaucuccauuuucagagggauaaaucggggcucugagaauuuaagguucgaaauaaugcaaaauaguaccgcaaggauuugagcccaacuuuccuggacgacuuuccacacaaaugauacguguguauguguguauguguacuacuuugaggguuuugaggcaaagucucauguggccagguuaucucacagagagcaagaagggaugugcagaggccgcuggcgaccuuggaacaacccagccugggaagaucuuggcccgguuccccucuucuuucucagcucgagcagaaugucaaccuuccgccaaguagcacagccguuuucuagggcaggaacccagggagggaagggcucuggcugguauacuguaaguagcuuggagugaaacgcugccaagucugaggccugcuaaguuguguagcuuaaggaaaauuauuuaaacuuugugugccucaguuuccuuaucuguaaagugggauuaauaaugucauccugagcggauuauguggauuaaggaauguacauaaggagaagauagggugaacugauuggcccagugccuagcucuccguuguugcagggggaaaaaaaaguauugggaaaaaaaaaaaaccauaaaaggaggugggcuauuucuguuuauccaccugucucuacaaaagcaaauaaaacugugacuccucuaacuggaggcacgagggcugcccugccgcugugagauccgaccugagaguggaguugccccagguccgccaucccagggcgcuucccuugacuauccccaaacucaaaacucgggacccaggaaccucgggcaaggcagggccagcuuggacucuccccaaaccccccgacccucggcccuucccucgccaucucgcccgcgggcucccaguccgggucuccgaaaccaucugcccgggaguuugcggggccaagagccuaacgcggugcggaccgaggggccugggguggcgcgcagggaccacgcucccuacccgccccgcuggcagccgcagacagggcgccccgagaacgcagggcccgccgcguggagcucucugaacaccggccgggcccggccgggcccggccugacccgacccgggcggcgaacgggccgggccggcugcggccgccgagcgcggagguggcgccgcgagggggaggggcgcggcgcggaggaggaggagcccgggccgccgccgccgccgccgccgcugugacagcggcccgaguaaacaagccgcgccgccgcggccgggccgcugccccccgcccgcgcccgagcccaggccgagccuugcccuggucgccggccgggccgaggccgcgccgccgcgccuccccgccugcgcgccgugacgccgcugccgggcgcggggaccgccggagccaggcccccgccgccgggcuccgugcucggccgagggguacccgagcggccgcggcgcucguccggaaaaguuuccccgcccgggcuccccaggguaagcggcgagggcgcgcggcccggggccggggaggcggcgcgcuggggaaccgggcccggagcgggcgggggagcgcggagccgggcggcgcagccccgggccucgccggccgccgggcucuggucgcggauucucggccgccgcggcgggaggacgggagccgcgcagcccaccugagcgccgggcuugggcccgcgccgguacuuuuccgcuggggccggggcgagcccuaugaccucaggaagcgccggcggggccccugcuggggcgggcuaggcagagcauuccucggacucugggugcucccgccugcccgcgguccuccguggccccggcggccggggccugcgccugguggggcgcgcucccgggagggcacgggguccucggccgccuggcacaccuguacggccggagcggucgggggcggauuucgcgugcgcgcacaggccggcuugggggaggcucgcuccgggcugccuccugccgaggccuggccgaggccccugcugcccccauccaucggguggcuagccgaggggcggccugcuugccauacaggucugacagcagacacuagucugcucggugccgccguucccaccgccccagggcuuugcgccuaggggaaguggacuuucaucucucugaagcacugggauucucucugacuugggaagugccaagacgacgcaggugauguggcccagugagggcauguggcugcuggccagguguggacauagaaaaggagggugggcgagcagauuagguguguguuuccuguuuugggcuucuaucuaaaauuuguauuuuuuuaaaaagaggauccuauggcuuaaaaaaaguuugaaagccucuguccuaauaguuuuuaaccaccaaggaaacugaggcccagagaguggaaaugacuuguguaaguaguugagcagggacuaggaguuaaaauuuccugggaggugccuguaacaggaccugccuuggggucucugcuggaaagagagaccugauuggguuucccagcagucuuugguggcuugcucuguggcugccucagcugggucuccagguccuagaaacagcagccacaccuggggguaagugcccgucuuaugccuggaaugguugugguuaucucugucuguagguucuagggagagacagaaaggcuuugccuaagaaaagagcuaggacaguacuauagccuauucucuagucaggcccagcacugauggcugggcaaaacugacccagagaggcuagaaauauauccagucuccugguuuugagacaacugggacucagagggugagucagagucuggaauggggguggggagaagccuguucauucauuguucacaguucuuuugugugugugugugugugugugugugugugugguguguguauccuccuaugugucuugaugacgaggcagggcucucugaugucuggaauucauaucccacccuuaccacaguuggggagacuugguguggagggaagcagaccaucuuucucgaggugugguggggguucugucucaguggccccaucuauaguuugcugaaaccugggcuagacccagaccgacccagccauaauuuggaaguuguaggcaggucucaaaacuuggagcagggagucugcacauuucuaaacuaaagagguuuuagauguggcaagaguccuguuucuacguggaggcacggagcucuaacucugaggcaugucuucggagcccuuuggacucugcccuucaggcauggagucugccucguggaugucuccugccaucagcugucagguuauuuugguguaaacugaaaauacuccaggauuguguguggaguccccucagccuauagggugagauggcagcaguuagggaggcuggguagcuaguggcaguuccuggagaaucuuggcguucccaguggcuagcagaucugcccagcuccacagggcagugugcugagguaucuacauuuuaccauuuggccaaguggcuaccucuagggcugggccaugggaaugguaggggcaucgggauccuggcacuuagacaggacauccccagcagccuacuggaaccucuccuagcugccaccuaccccaggagcuuggcuuguggcuagucaggggcccuuuauggggacaguuauguggccccaggcagagaggucuugcugucuguuugcugaaggaggaaaaacaccacucagggcuacugauucggccucaccuugguguuccaggcucagcgccaguguuugcccuggcagccuggcucagauuacgcaagguggugggccuggaacacgccagggggcagcagggcuggacuagcaggagcaaaguugcccaggaaacagcuugggcccugccucuaaagauggcugucaucucagcccuagaggguggcaaaaccucaggaaucccucaugcucagaguguggcuccucagccuccaucccaacucgagucacccacucuuuccucuuggggacugagagucuuuuaaauaacucccuacagcucaccuuuuugcugaaccaggaugcccuaauugaguuggguagacucuguucauuuuuuaaagagccaacauuuauucuuuuauaaaauaugccuggauauuuugagagcguacaguagcacaaagcagaaaguaacaauugcuacucauaauucucagacucuccaaggagcgacuguuaagcaguaacuuguauccguccagauuuuguugugguuuuguauaaaucugcauguauaguuuuaagaaaacaaaauggaauccuguguacaugccauuugauaauguaucuuucuuugguuauuguuugcuuuuuauuuugagcaacucaagccguaguuguauuagugaugggagaaaggcuugggagggggagacugugggcccaugugucuguuuggcugaccuuugggauaugugcuguauuuauuccggagacaccuuggggguuuguggugugugugugugugugugugugugugugugugugucuuugugucuguaugucuaggcugcaguuggaucccugggagcuggaguuauaagcugcugugaaugauccaauacaagugcagggaugagaacucugguccccugcuguccccugcaggagcaguaugugcuccuaacuacuaagccaucucuccagcccuuaccccuauuucugaucuugguuuuuguuuuguuuuaaagacaggucucuuaccaaaccuggagcuugcagacuuggcuagguugaccagcuagcaagccccagggauucuuuucucugcccugcccccagugcuggaguuacaggcaaaugcugccaagccuuuaauguggguccugggacuccaaacucagguuuugaugcuuggguggcaguaagugucccuacugagccaucuucccagccccucagguguuugcugguuuuacccaucucccuugaaacuccuuuuagguccaucuccuuugaaacugcuuuuaggcucagccgugaggcuaggaggggcggcaucaguguguggcugagaggacugacucuuccuuccuccucuuguucccuuagaucuggcccuuacccuguccuccagcccugcccaucucggccccaugcccccaccagucagccccgggacccuggcacugagcaggcacguggcagccaaggcccugugaccaggccagggagacaggcgcucugggguuccagucaccugcccccccauggagcugagauccugguugcuauggguggucgcagcagcaggagccgugguccugcuggcagcugaugcucaaggccagaagaucuucaccaacaccugggccgugcacauuccuggaggcccagcuguggcugauaggguggcgcagaagcauggcuuccacaaccugggccagguaagcuucuuacugggccuguuuguaacuucaggacaugaccuggugguggagagagugagggcagagacucucaaaccaugcagcagaaauuguugagcuugucuuccagggcgucugggcaagaggcagguucugagcggcuggugggaugggauccguaacacuguccuguuugugggcuuuccuguagguugcuuagaaaacccagcacaucuuggggauggugucccucuccauccccugcauguucuuguggguccucagcagggaacagauugccccccccccaggcgcuugccuuugugagccuccccagcagccuuguccacccccaucucugccucccccagggacuggcagauggaaagcccaucucagacucagugcuucauugcagaucuucggugacuauuaccacuucuggcacagagcagugacaaagcggucccugucgccucaccgcccgcggcacagccggcuacagagggagccucaaguaaguguggcccuggcccuuccggcugccacccccuucuguucugagucugcccucacucugcaacccccacaccuauaccauccuccucuccuuccuagguaaaguggcuggagcagcagguagccaagcgaagagccaagagggacguguaucaggagcccacggaccccaaguucccccagcagugguaccugguaugcuccuuggacucugguucucuccccaccacagugagguccugugaguggaugaggcucacccuggcuucuucuguuuucuucucccuucuuucugccucugacccagugggucucaaccuuccuacuguugcaacccuuuaauucaguuccucauguugugaggaccccccccccccaacuguaaaguuauguuuguugcuacuucauaacuguaauuuaacuacuguuaugaauuguaaauauuuuuggagauagauuugucaggggggucacgacccauagguugagaaccacugcucuagccuucccagaaucuauacauuuccaaugggagccagaaguggcauuuuuaaaaaugguuuauuuuuauuuuaugcacauuggugugcuugcaugaguguaugaggcugucagaucccccuggaacuggaguuacagacagucgugaccaagugagugcugggaauugaaccuggguccuuugaaagagcagccaguacuuuuaacugcugagcuaucccuccaguccccagaaauggcauuuuaagcugggauggguagagauagagguuuugggguagaauugauucuuuugagugaacaaccaaacaucucugguaaugggcugguugucucugcagucuggugucacucagcgagaccugaaugugaaggaggccugggcccagggcuucacaggccauggcauuguggucuccauccuggaugacggcauugagaagaaucaucccgaccuagcaggcaauuauguaagggcuggaaaagaguggugggagagcccugggcagggaccucgggggaacuguccuguccuguccugucagcguggggaggcagcucccaaugagggccguguucuucccaggacccuggagccaguuuugacgugaaugaccaggaccccgacccacagccucgguacacacagaugaaugacaacaggugagagugcuaagucccuggucucugagcucucccucuuacccaucaaggacacaaggcucagugugaauggcacauggcccaccuaaaagcugaagucuuuccaggcaugggggcauacuccuuuaaucccagcacuuggagggaaagguaggcaggucucugugaguuugacgacuggucuucacagugaguuccaggccagccaagcugccuuaucucaaaaaaacaaggggauggagagaugacucagcaguuaagagcacuggcuauucucccaaagguccugaguucaauucccaacaaccacaugguggcucacaaccaucugugaugggaucucaugcccucuucuggcaugcagguguacaugcagauagagcacucauauacauaaaauaaaucuuaaaaacacuaacgggcuggugagauggcucaguggguaagagcacccgacugcucuuccgaagguccaagaguucaaaucccagcaaccacaugguggcucacaaccaucuguaacaagaucugaugcccucuucuggagugucugaagacagcuacaguguacuuacauauaauaaauaaaucuuuaaaaaaaaaaaaaaaacacuaacaacaguaaaacuacacagcugaagucuuugucuauaucccugguccccaaagggaguuuugaguuugguuuuuugagacuugguuuccauauguagcucuagcuguccuggaauuuccucuguaguccaggcuggccucaaacuuagagauguuuuugaucaggcgccacagggaagugcuguggacacacauaggaugauggaugcagcccaagggccuucacuccgugcacuuccacuaacgcugugcucuugauccgcaggcauggcacucgcugugccggggaaguggcagcaguggccaacaauggugucuguggcguagguguagcuuacaaugcccgaauuggagguggguaugagccuuggccuuggguacauguugagagugggaggguccucuccugaaguuuucucugcccauucaacaucuuccaugauagauccuuuggcagugugcuagucccugaagaguucuuagccaguggaaaaacuggaaccccagggcugguggcaugguggagugggugcaggccucucagaaaucuuccuaaaucauggcacagccuuuagucccuuguuccugaggcccaagacucuuucuagugaggaccggugugacuuggggagaagguccucuucuugaaaggcagugggagacaauauguaaggggcuuugaguuuuccaugcuggccacuccucucucuuacuccucccugggguccaagcugggccuuugccuaugggugccucuggcagcuggacccacgcagcaccccuuuucccacccccucugcggccaggggugcggauguuggauggcgaggugacugaugcaguagaggcacguucgcugggccugaaucccaaccacauccacaucuacagcgccagcuggggcccugaggacgacggcaagaccguggauggaccagcccggcucgcugaggaggccuucuuucggggaguuagccaggugaaguggggcccugaucuagcucuggaaaucaggcugacugaguucaucuuuuccaucacucgcuuccuuauucuguuuuauuuuuccuaguauuuuguuuguuuucccaguuuucuaagacaggguuucucuguguaguccugguuguccuggaacucacucuauagaccaggcuguccucaaacucagagaugugccugccucugucucccaaguucugaaacuaaaggugugugccaccacugcaccucugcucagaccuuuuuuuuuuuuuguuuuuuuguuuuuuuuugaaacaaagucuucuguauaguuuagacugaccugggacuugccauguaacccaggcgugccuugaacccaugguuccacucuugacauguguguaccacuaugccugguuaauuaauuuuaaccuugacaaaagugguaaaguagaauguaauagaggcuagauagaugucccggugguuaagagcacuagcugcucuugaagacuugggugugguucucagaaccuacauggugacucacaacuaucaguaacuccaguccgggaaacugaugcccucuucuguccucuaagggcaccagacacacauauaguacauguacauauaauaagaauaaaauuauaaauaaaaagaaauauuagaaacuaaauguuauuaaaacaugaaggagggcuggugagauggcucaguggguaagagcacccgacugcucuuacugcucuuccgaagguccagaguucaaaucccagcaaccacaugguggcuuacaaccauccguaacaagaucugacucccucuuuuggugugucugaagacagcuacaauguacuuacauauaauaauaaaaaaaaaaaaaaaaaaagaaagaauaaaagaaagaggaaaagaucuuaaaaaaaaaaaaaaacaugaaggagcuggggacugacagugcaccuuaauuuuauuuauuuuuauuuuauguguauaaauguuuuaauggcaugcagcccuuuggauucccugguacugcgauuauggauguuugugagccaucaugugggugcugagaaucaaacccaugucuucugcaagagagccggugcccuuaacuaccgagcucucucuccagccccauuuuuuuucuuuagcugggcaaagguuugcaguguuacauugaacgaggcauuaccaauguuaggcagguccucugccucagaaccacauccccagccugaggccauggcuuugauuucagcacuacccaaaauaauaaaguuaagugauggggucaaagagacggcugaacagguaaauagucugcacccaggccuaaugccggaguucaagccuugguauaaacguggaaggaaaggagcagcucugcgcagccgcucucugggagccacguggguaccauggcaugcauggccguacacauaccauacagacagcacucaucaccccauacugacgggaucaccccguccucuggggaucaccacucuaagcauuugggugugagccuggucuaguuugauuuuguacauacauagucaucuaugagggaucuuugguggcucuuaagaagugaacuuggaaguccacagagauggaggcucccaucuuucuucccucagcaucguccuguuguaccucauugcccucuaccccccaacacaccaucuugaguaaccuuagcccacuucguucacagggccgaggagggcugggcuccaucuuugucugggccucagggaaugggggccgggaacaugacagcugcaacugugacggcuacaccaacagcaucuauacacuguccaucagcagcgccacacaguucggcaaugugcccugguacagugaggccugcuccuccacacuggccaccaccuacagcagcggcaaccagaaugagaagcagaucgugagucuugccuggcuggggcugggaaggaggccuccugcucuccucagggccacauuaggcucucucugaccucaucccuguguaguugcguagaguagcguggaccuuggguaacugcgcuacaagcaggagauuccccagacccuugcgggcugcaaaaccaucucugagccccugagaaguauaaacucccugaaaauauccccugugcuccgaccucuacuugauccccuaauucccugagaaacuugacccuagaagaagcuauguguguuaguaagguagaagcuggggcucgaguguccuaacugguucacugcaccaucuaggguacccaggucugauaggcagcaggacaggcagguggcuccuuuacuccugccaacacccaugaggucucaacaccauuguccccuggcaggugacaacugaccugaggcagaagugcacagaaucucacacaggcaccucggcuucugcccccuuggcagcugguaucauugcucucacccuggaggccaaguaagugggcaagcaacagccugucccacccaugcucccugucaggcagcuguuuucugcagccacaugccagaaagccugaccccagacguucucuccuuugcagcaagaaccucaccuggcgggacaugcagcaccugguagugcagaccucaaagccagcccaccucaacgcugaugauugggcuaccaacggcgugggccggaaaggugagggcaagguaacccagagguuuaggcucugagguaggauggggcucuccucccuuccuacugacccuucccucccuccacagugagccauucguauggcuacgggcuguuggaugcaggugccaugguggcucuggcccagaacuggacaacaguggccccccagcggaagugcauuguugaaauccugguggaacccaaguaaagacuggacccugagcgggagggaacaguuggggcccgggagcucugggaugcccacugguugcugcuggccugcugacucacggugcuugcuguacagggacaucggcaaacggcuagaggugcgcaaggcggugacagcaugccugggugagcccaaccacaucaccaggcuggaacacguucaggcccggcucacccugucuuacaaucgccgcggugaccuggcuauccaccucaucagccccaugggcacccgcuccacccuguuagcugccaggugcucgccauguucccuuuucauuuccugguucauucccucauuugucccccaagacucuggcaaccaucaguaacagcguggggagggacagcuacgaccuuugggaucaccucaucacaggaauccuugcuuagacccaucucucaugccagcugugugugucccuugugaaaaguguccccuggcuaagaacaucugaaaaacagcugcccuuagaagcauuuccagucuagcagguugccacauggagagaauggcguuugucccauauaucauggcuagauguccccucuaaaaccucagaugacuauauggaacucucuuccuccagaccacaugacuacucugcugauggguuuaaugauugggcuuucaugacaacccauuccugggaugaggauccggcuggcgaauggguccuagagauugaaaauaccagugaagccaacaacuaugguaccguauggaggcacugacgaggggagggugggagagccggugggugcuaggguguuaacauggcacucacacccuugacuccuuucucuuaucaacucuggaauagggacgcugaccaaguucacucucguucuguauggcacagcccccgaggggcucucuacaccuccagaaagcagcggcugcaagacccucacauccagccaggccugcgugggucaguaauggaugugauugaggcugggaaaguggggagaacaggauuggaacaguggagugggaggggacagugaacuuuagauagcuaaaaaaaaaagaacugggcacuguggugaccgcuuaggacuacaggagccugguggagagcucaggcgacuuagagccaccguccccuugacuaacgcuccccuccucuccugugccggcagugugugaggaagguuacucucugcaccagaaaagcuguguccagcacugcccaccaggcuucaucccccaaguccuugauacacacuacagcacugagaaugauguggagaucauccgugccagcgucuguacccccugccacgccucaugugccacuugccagggcccggcccccacagacugccucagcugccccagccaugccucccuggacccaguggagcagaccugcucccggcaaagccagagcagccgggagucucggccucagcagcagccuccugcacugcgcccugagguggagauggagccccggcugcaggcuggguuggccucucaccugcccgagguccuggccggccucagcugccuuaucaucgugcucaucuuuggcaucgucuuccuguuccugcaucgguguucgggcuucagcuuccggggagugaaaguguacaccauggaccgcggccucaucuccuacaaggggcugcccccugaagccuggcaggaggagugcccaucggacucagaggaggacgagggccggggcgagaggaccgccuucaucaaagaccagagcgcccuuugaaaagcccacugcccacccuaucaaaucgaucccuuccucgggcacuuuuuaauucaccaaaguauuuuuuuaucuugcgacuggauuuggacccuagcugggaggcgagaggggcagagacugcuucuuaccccacccuugggccuaccuguuugccugaggugggaucccaggagccucaccccuaccaccccuccauguggaggaaagaggaaaucuuuagggcagcuuccuuggcccagcuggacuucccgcagagugaagaggggcggccucucucugagucccugaccaggcugcagcccugccccuucccuucccugccccucagaaagcaauaaugguucccauccaggcaacagggaggcuggccaggagguacuugaagaaggcagccaccucuccaagggcuuuugcauccccugacccucucuggcucacaggugagccuccgaagaagcugcagucuuaggaagggaccaaagcaaagcaggccccucccagugugccuguacuuucuugcucucagccugccucugcacuccaggccuccaccuccguggaagccaggcugagcuaggccagcacgggccggccgagcuaaagcucugggggccuugcuggugucugaccauccuuuauggcacccuccccccuugccagggcccuguuuucugagcccggggcugccugggcuguuggcaguuacaguacaggagccccugggugggugguggggaggcacgguggcccagccuucuccucccgccucccacccgaugcugcuuuccccuguggggaucucaggagcuguuugaggauauauuuucacuuugugauuauucacuuuagaugcugauucuuuuuuuuuuuuuuuuuuguauuuuuaauggggguagcagcuggacccuugaccuucucaugcccacacccacccugcccuucccauggcugcccagcccugggguauagggaauaacuaagccccauguccugaagaggcaggccagcccggugggcucuaagaaaggggguuguggugggagggguaggcugacaucaucuguuucaaaugggguugugccaagggcuuaugggucgcuggcucuccaagugccaggggugggcagguggcaccaccaagcccuuucuaacacugugcccugguggagaaagcauuggccuaugaugccccccaaacccccucuucugaugugccuuuugcacccuucccauuaggacaaucaguccccucccacuugggcucccccccccccauuuucuuuuccuuagcccuucucaguacccagccuaccuguccaggggugccccuugcucuccugcccaccccucacggccauccaggcugguuuuguaagaugcuggguuggugcacagugauuuuuuuuuuccuuguaauuuaaacaggccuggcauuguugguucuauuuaauggacacgagauaauguuagagguuuuaaagugauuaaacgugcagacuaugcaaaccaagcccggucuccagugucuauagcucuucucgggacccuuagcuguuugacuggggaagggugggaacuaggggccaguuuggcuuaagucagaaggcuuaaaugccucuaagaggucuagggcuuccacugcugaggucugaggggauccugagugaacccagaucugugugcuccuugguuuuaucaugacauaagcuagugucaccugggaagagaagcuucaguugagaaguugccuccauuggauuggccugugggcaagucgguggagcauuuugauacuggcugauguggaaaggcccgguguacugggggugucuaccuucccauacaaagauccuggggugccugugaaagcaaguggccagcgagcaguguccuccgugguuccuguuucagcuccagcccugacuucccuuggugguggacucuaauccuuaaaucagacaaucucucucuccaggcugcuuucaguucugguguuuaucacagcuagccgagcucaccuuuaaucucagcauuugggaggcagaggcagggcaucucuucaucugaggccagccugaucuacauagcaaguucuaggacuacacagagagacccuuucucaaaauaaaagaaaaaacaaaacaaacaaacaaaaaaaaccccagcaaaccaggauugaauggcugggggaaccugagucccucauggggaaauaauuucuccucaguucuauaccccacgcuggcccaggcugccacugagacucaacgcccugccugagagaaagggugcuaccggaacccgggcccgagaagcaggccucugcuuaggauuuugacuuggagauuuuauaugcaaauaguggcuggcgccugaggucuccuuagggaauccagaggagggacaggauuaggcuuccuuccucu

SEQ ID NO: 3904 - RNA, 537 nt, Mus musculus
uagcgugccaguguucuuagugaaacagagagggaaagggaggcaaagccaaggaagacguggaugagcaguggggggauagaugcugacgaaagccgucugauaggguaguggugacagaacccagccugaggaaaggagaugagggacgcaggcagagagagcagcgagugcagagcaccaugagcauggaagcgguauaguuggagcccacugagacaggacucacuggaaggaucugaaccaugaagaacauugcuugccuuacaguagaucuagcagggacuggagcgaucguagcaacauccgagaagugaccguucguauuucucccaacuacagaaucauuuugaugucacuaauuguucacaucacagucuuccuuaacccaccuggccauugcucuugucccaaccuuccuuccuaccugccaacacaggaagcucuugcaaugagcuacccacugucccgguuuucuagugcuugaacuuggccucuguagcuaguucugaaagacagaauccagccaucuaaaag

SEQ ID NO: 3905 - RNA, 55620 nt, Mus musculus
ccucccacagcaaccugugcuucagucagucaguucuuaacagucaaucccuccugacgcugccuucucacuacaaaucugugaguagugugggcuccucuccucuccguacagcagugaaugcgagugcccagguagcaggcaucccccagcccuggcugcaugcuccacaugcccucugagggucugugucuggggaagaucugcuuagccagcugcuguugaguagggaaggccuaaggugugggcaagagagggaccgcaguggggaaacgggaguuugggcucucauuugcaggugagcuaacaucuaaaagcagcuucacugagaaugaggaauguucgguuuugaguggaacaguccuggguagcgcuggcuucaagauggaugaaaugagcacuuccuccccugccaaugauuuucaccgguuguaggaaguaaagauaacuaagggcucuuuucugagccgugcccacaccagugccuacgccauccccucuuucccuuccuggugacuggugacuaagggacaguucacuguuggagcuuacaaggacuugcaucucccaggaucaggagagagggcagaaagggugucucucccacucuccccuucucucucccucucccuuuccccucccccucgcccucccucucugguuccuuuucucucuccuggcccuccuuucggcuguggacccucugugacaucuuugucuuucagcugaagagccuagcacauggcagacgacacaccgaggcaacgagaguccauuucccucacaccuguggcccauggccuggagaacaugggggccgaguuccuggaaauaauggucuguccucuuccccuauagcaccuccucagccugacuggcaucucacagggguguggggugguguggggcucagcuugauuggcaucucacuaggugggguggcucaguuugacuagcagcucauagugggagggccccucagcuugacuggcagcuaugggcugggggacuguguguuucacucugugcucugagcucugcuuguguaguaccuccccagcacaaagcacccccuuuauuucaccccuuaaacauguucugaguacccacugugugauguacccacugugugcugucagcaaaggucccaggagggaagaacaucuggucuacaagaugagaggggaagcagaugauggggugggguguccuuggcauuuaaagaacuugccaucuugucuuggcuccccaaaggccaagcagaggacugaaaagcuugacaugauaccuucugcccucccucccuucccuaacaaggcucccucuucuuuaccaagugcccccuagcccccuacuuggacagugcaguaagaagugcccuggagucaugcaguggggcgggccugccugggaucuuccuuaaggguuuccuucgggucuccaggaagccagagugaaaugcugaggcaggauaugucuguacauaguagaugcucaaugcaugcauugaagaauuuaauuaagaggcaccccauuucccaugcagcaguccagucucuaucucagucuucucaugaggugcuugugugugcauggggcugccagggucuuccuuaucuccgugcucuucagccauaguugucccuuggugggaaggcugacccugacugcucccugucggcuuuaggaggaaggccagcucccacacaggcacucaagccugccagaggguggaggcagcaggagcaaagcaguguggaaacccuucucccgaugguaggugaugucugugagggcauggggaaagcugauggaagccuggccaagggaagucaaggguugagccaggccaggugcugguacccagccaggauguaacccaacacagacacagggcuucucaggccucccugcaaccucccucauuugccuacuaccccauucaguuguugagcugcuuugugaacuccggggcucaguuuguagcacuccuggaccaggccagacuccccacuuuacacagaggugaagggaccagcccacagggucuggugugcgccuagaggguccuggcuggccgaauucugcucugaacagagcaggaagaacacuucaaggacagggugugaugguggugggacgucuagcuguuuagggggauuggagaagauacaccucccccacaugaggaucccuggcaacaguagcagaggguugaaucuccugagcaaccacugugcaucuacuaguugcugggccaacaggaccuucgagauuuggguagcagcccuuccucuauggacacacaagugaccaauggaccccaggccuagaguccauucuggacaucggaggcaaugaggauggccaccugcauauuuucacguguccuuucaggcacugaggacucagaugauaaaggucccuguccaaggggagccaauaguugagaacugcuuggucuuacucagugggcagguagaagcaaggaggagguuggacagccaugaaucuguccuucugaauggccacaagccucuaccuauugguuaguuccuucucucacccaagaucagagguggcccuguagagugaccucaacccccagcaugugcagaaccauggcugugucuuuggacugugguugcuuuucagccuuguaagguagcauggacaacccugccguauuccauuaccacucugggaauauacuugaguagcuucuaccugcagguuuuggggcuccccucuggggugaaaguuucgguuggguacuuaugagccccggccauccucuccucaggaggagucugcagccgacugugcaagcgagaagccucugcagggagcacuggcagcuguuugaguggaucagcaaaggccugcucucuacugguaagcauggcucauccugucucacucaggagacaguuacugcccccucuguucuuuguaucaugaagcaggcucauccacucacccagucaaccaagaaaguuugcugagcaccaauucagccaacucaagauaggagcucaggucuccuucaagccaaacuagaauccauucccaaguccuuccccaggacuaagggaaaaaccuaaaagugcucacacaaaacaacaagccaucuaucugggaggguguuccuuucagguccauggucuugggucaccuggauagaggggagagcaaugaguauugagacccucccagaccccaccccucaaagcacaaaggucagggagcaaaggugaagacaaucagggugugggcuuugauagccuaguguagcuggggcuagguuucugaagggugcccagccugagucuccugagacuggaagacuccgaaaggccugguuaucaggagugaggaagguaguugauauacucaggaacuuggauuugacucugaaguacagagauaucauggauggauuuagacugagguguguccagguugacaucacacugcgagaccaaaaaaauggcugcaggagagacagagaagugagugaggccccagcaugugugaggauaaaguaaaggacagacuggcugagaauggagggaacgaucagugcuugacgacccugggcggugaccaguguacaggauggaggaggucuuagguuaaggcuggcccagcuuccugcuuggaugauggggacacaauggucccuucuacagagcacagaugaaggagauagucuccacagggagagagagaugggaaccauuugcuagggguagaacagucuaagccaugggcaggugaaguuguuuccaaaggaugcuugaagaaugaauugaggaauaagucaaggacagcuacauguaacgaacucaaaagccaaugccuuccgaaagggaaggggagggauaagggcugagcacugcccacuggcuuagggacagggauguaagaggcucauaucuaaugcuaagaaaacagaggcaggcccaugucugaguuccaugccagccagcucuauacggugaggcccugcauuugaaaaagaaaaagaaaaagaaaaagaaaaagaaaaagaaaaagaaaaagaaaaagaaaaagaaaaagaaaaagaaaaagaaaaagaaauugacagccuggccuacauagagaaacccugucucaaaaagccaaaacccuaaaggaggaagaggagaaggaagaggaggaggaggaagagaaggaggaagaggaagaggggagggggaggggagggggagggggagggggaggggaggggagaggaggaggaggaggaggaagaggaggaggaggaagaggaggaggaagaggaggaggagaguuguugguuuguuuuugagacagucuuaccuuguaguuuaggcuggccuaaaauucacuguauagcacaggcuagccucaaacucauggcagucuuccugccuuagauuccuaaguucugagacuauaggcaugaaccaccauucccuacugagagauuuuuguucguuuguuuuuuuuuaugagaagaagggaccccuaggggucagugugugacagaggguggagaugccagguguuauuaaggggagacacugaacauguuugagcugagaguacauuuuagaaagaugaagaagaaauggccacuggugccuggaagaccaagagaaaaggcuagccuuaucuagauagugaauuagaggccagccuggguuucauuagacuuuguauccaaaacccagcacugccccaaacugggaaugauggcauguccugcauccuggcacccagagaugggggaggcuagaucagaauucaagguugucaucagcuacauggugaauuuuuugcccuuaugguaugagauccuggguuuguuguuugguugguuuuauggcuacaauucaagguuuucuuggcucugggagagagagaagaagggagggaggaaaggagggagaaaagaagagagggaaggcgggagggagggagggaggaagggagggagggagaccuuacugcuggaagggguaaggagagcccuucucugcaggagcuccuagugagagaaagagaacuuuauuucuacaacuugacacauacuucaauuuugucauuuccugagugacgggagcuugauuucugucauucuggacuauccuuucagaacccuuucuccagcaggccuuaacgacugucccucaguaucuacugaccugucuacuucugcaacuguccuagcuucucucaggauaggugauucugaugucccuuuucuccacuguguaccugcccugggcccccaccuuuccccuuucugaaccccuauguggggacagcggugucucuuccagagcauaugugcuugcuacaggugugcagagcucaugaguucugcaccccuacaggccacacaaagcaguccucucugaaggccuaugcccuguuggggcuccucucaggaagcaaggccuggguuccucagcuugcccugccacaaaagcccugggcuucagucaguuugugagguucaagccucaaucuuccccuggccccaggaccauuguuguguccuguucuaagugauacgcuaacggguagcaggugaggugagacucacguuucugugaacugcuuccccauauuuuccuuugguuggcuaagcccuucccacucugugaggcccuggauucugaaacucaaaagccagggagaagugucucccuuccacugcugccauguuccuuuugugaggcaaaagcauagacuggcucaguggcucacaggagagucaggccauggaagagggaacucuaggaagaaagcugucauuggugagacuaggagauggcuccauuaguaaagggcuugacauacaauacccauaaaaacuccaccaugagucugauugucauuucagguagagauguauuaauaguguugugggguauccaucagagaagacuacucggacacagguuuaagcuaauagaaaguuuuuauuagcuugcuggugacuacgcugaguguuucaggaucccaguguagcccugggcuuuucucagggugaauguuuaagcacaaaaauuauguccugaacugacauacuucagcuaacaagaacagcuagccagaagcagaacuacagaagcuaaaaagcaaggugaguccauguagagacuuucccagcaccauggacuuuggugaauuaggucuuuguucucauuucggcagguggugcugucuuuguacugaguuuuauggccugagugguacuuccaucauggagucagucaugcuaaggucuaaaggggccuacuaaggucuggagcccaguuaaaguagaguucuuaacuccacaggcaggcagcagcauggcagggacuguguggguuccaggccaggagacagagucaaguuccuuuucuuagagguuuccgagagaggacagucacaugccauguaguuaaugaguaguucauagcgugugcuuguagucagguugccugagcagcaagggaaaggggaagcuauccugcucagugacuguggggucacagcagggggcuuaucaaguucccagaguccaguaacuugagcuugcugaacucugagaagugaggacuacagacccacagacauaguagggcgccugccauuucuuuuauagcagcugugaggguaggggaagaaagaggcuguugaagaugagugugaccuacccaaaccuagcaacacugugcccaccgauacauaaacaaacaacacacacacacacacacacacacacacacacacacacacacacacacacacacacugugcgggguaguggugguggucauugauugacagauaggcuggaggugcuaucuggagucauauagcccugacuuauccagccugauccucuguccaccuagcauggcucuggccagguacucgcuggaugccgguuacauuguuucagucucucucagucucuaccucacuuuauaaugugcagaggccccuuucagacauuugcaggggccucaggcauguugggaaagcuuccaccacugagcagcccccucagcccccuaauaagcuucugauccaguaggaacagguguuuucacuucugcacugggaaagcgaggcuggcaggaacugagcaaguucccugcccuuaacgcucuggguggacaaggcagagccgggggacugggccacaggguuuaagagcaaugucuucuccuggugagccugccauccacuccuccugcagcauacaucggcuucuugaucgucgccugccuccuggacuucccgagggcgcuggcgcuguucgucaucaccugugugguucucgucuuucuggccuacaaucugcuaaagaggcuucugggguccaagcugaagaagugugugaaguuucagggccacucuugccugagccucuggcugaagaggugagaacacccucagccucagagcgugcuccguccugccuguccccugagcccugggcagaggugcuggguggcugcagaagcuuuggccagcucuguuucaacagguuuuuuguuaguuucuuugcuuugauuguugcacccgguaacugagggcuaagggcagacuugugagaguuuccuauauucagagagucuggccaccaagcacagaggccuuuccuagaugucuuauuaggcagauccccuggggcuagcuuaacuccccacuacagagacccuggacaucccuggagcuccauucaauaggcuacauacguugggccaagugccaacauuuuaaauuagccccagggcacucugaugucauuagccagggcccugaauaauaguuuuguguuugaucccuggaguccgagguggaaggagagaacagacuccuaaaaguuuucauuugaccuacguacacacacacacacacacacacacacacacacacacacacacacacacacaccgguacgaaaucauucucuuaauagaccuaggguuaagaaauagcuugguggcuaaaaaaaaaaaaaaaaccaccacuguugcagaggacccuuguuugguuccaagcacccacaauggaugguuuacagcugccuauaauuccagcaaauacucaggccuuagcagacaccugcacucauauacccacuccucccacauacauaauugaaaauaaaauaaaucuuaaaaaaaaaaaaaagcagcucuggaaaccacaaaccacagagauaccauagagaggaaagggaggcuagagugucagaccccugccauucuuuucucuugcuauuacugagcaccgcagacagagcaauuuauaaagaauagagguuuacuuuggcucauggcuuuggagucugagaagucugagagcucgugguuggcaucuguuugaccuuaugcuucagcucaugguagcagaagggcaagcaagggacgguggaagagauaaaauaggagaggccacucagauucacacuacccgucugcucuccacaguagcuaaugcagacuaacccaguggagugagcguucccuuggacccccuaugauuaaccacuuucuucacgagaggaccuaauuaccucuuaaaggccucuccuucuagcacaccgacaguuucauuucaccaugaaaaaucagacaucguggugagcaccuauaaucccagcacuuuggaaauggaagcaggaguuugaagccagcuugggcaauagaagacucugucucaaaacaaaauaaauccaacaugaguuuugaugggaaaaaccacacccaagacauagcacccccuaccccuagcccaaccccugcuucucacauacaugacauggcuucuuauccaaauuguucagucuuuacuuacaucaacaggagaguucagagucaaaagucucaucugacggucagggcaaacuccucuuagcugugaaacuaaggaaaacaaguucucacuuccacaacacggcagauggguaggacgccguccaaaggggugagagagauaagaaggcggggugacaggacccaggcaagugcaaagggcaagaaggugagauccuauuuuuuuuaacuuaucuugauauauuugugugugugugugugugugugugugcaugauagauguggguggcugugaaugugcaugugugaaugccagaagacaacuuuuggggguccguucucucucuccaccacggggagcuggauucagaucaucagcuuuaucugcugagccaacuugccagcucaacauuuuaaaucuucagacuccagaauaauuuuucacuccaggugcugcgucuugggcauccugggguggcuagacaacucagucuuguggcuuuucugggcucagucuacagagauguucccaugggcugggauuauauauuaaagccuguggcuuuccugguccaauguugccuguuaccugcagaucuacuaaggcuacuccagaguagucuuauuucugccacacgcuucuacacccucauucccaagacuguucccagcauccuuugcagucuacuggaggaagccagccucauaguucgugcauccuguguaucugcagaagcagcccuguguggagagcugggauucagucagggauuacuaucugugccuucuacagcgguggcauauuaaacuggauaugaggcuaagagagaaaacuccagagagcuacaggguuucucuggcacauaaugcugaauucugguuggcaaauacuaucccaaaaaaccacucaagaggauagcagggaguugggccuggaauugccaagagccagggagaugauugugcccaacacucugaguaaagaacccauaacccacagggcauuggguagaaucccugggccacuaaggguguguaugugggugccagcaugugcgugugcgugugugugugugcauguauaugugcacauguguguauguguguaugugugugcgugugugugugugugugugugugugagagagagagagagagagagacagacagagagucuuagagagagagagauguuacggcugauagcuuucuaucucucuuaucucucuccuacagaggucuagcccuugcugcuggccugggugugaucuuguggcuaucucuggacaccgcccagcggccggaacagcugguguccuuugcagggaucuguguguuccuuguccuucucuucgcuggcucaaagcaucaccgugcugugaguguucagcuggcuacccaggcugcgagccaggggaugcucccugugggcuggggcuggggugagauggaugcuccugcugggagaacaaacaccugagguucaucggagaagagcaaugugcacugggauaaguucccugugcagcuguuaagggacauacugggacugaagacccuaagugggaaguuauccaucuaagcagaagccuuugaauuccccaggggacagggagcuuucuggggaggacugcugauaucauuccaaacucacaggcugcuggggauauuugucaccucggucauaaacguguuccucgggucuuuggccucaggagucaccuuaccccagaagauaggaaaccugaacuuccgguuccauuagagaguccaaggguauccugaaaucauuagcuuacaauagugguuugaggucagcuucccuaaccagggguuacaacauuuucuuggaauauacuagaaacacugacucuuggccuugacuccucccauauugaguuagaaauucuggggcaaggcuggcccagcaagcccuucagguaacugguauacaugauguccugcccaugcaugagggaagucccugcuguacuggcuggcugggcucuucucucacugucuccauggcaaccauagagcaaccaugccccagaaucaggaccccugugugcuucagaguguggcugcacuaguguccgaugcuguccugugaggucaaggauacauucugugcugagugagaaaugcagcccuagggccugggcucuucuaugucacucgggccaucaagagaccugaggucaggguugcugagagcucauagaggucagccagugaggguccaggcagacagacguuguacacugagcuggagaggagcugggccuggagaccaggcgagcugcacaucacccugcagaaugcuguacuguuucugcuucaccugccgagagccuguguaacuguuggcagcagacccagugcuaggcuggacccagacuacuacaggcaggacaaagcuccuuauguucuuccugcauccaccccaccccauaccauacccugcagcgaaccugugaaucccccccaagcagcucagcucacuaggaccuuucuguuggcuggcaggugucauggagggcugucuccuggggccuugggcugcaguuugugcuuggacucuucgucaucagaacagagccaggauucguugcguuccaguggcuaggugaccagauccggguguguaugucgggccugcuucuggagacuuggggagaggccacuugauucagggagauagauguggaggucacagggagauaguucgggacaaaaacgacuaggacucuauaucuggguugagaauaggggccuggccaggggcuugcaggggccaccagcccaagguuccccagucccucucaucuuuucagaggcugggucuggugauggaauggauucccagauggugaaguucuuaggguaugcagaugccaggucacgugaccugcuguuuuuuuuuuuucagugccuugagauguaaaugaguuaaaauugcuaacaacagaaaccuuuaaaaaucucauccacuuggcauuugaauuuagaaauguuuauugaagucauguuugguuuucuuucuuuuauuuuuuuuuucagcugcuuuuuuuuuuuuuuuuaagacggcucucauuauguuucuauugcugaucuggaucucauucaauagaccagguuggccucaacuuuacaaacaucuaccugccucugccuuccaagugcugggauuaagagcacaugcugccaugccuggcuuacaucaucugguuuuuauuaugcugaguuguuccacuuaaaaacucugggagcuggccuggcuuaguguguguguacuugugcaugugucuguauauugccaugguguguagcuguaggcaugcauguauguaaaggucagaagacaaucuugggugcuguucaucaggcaccacccucuuucuuuugaggcagggucucucacuggccuggagcuugccgaguagaauggcuggucaggaguccugagggauccgccugugccugccucccugcacgggguuauaagcaccuaccaccacaccugccuuuuuuuuucaaagcuauagauuucuagggaucauaguguagguccuuguuaugaggcaaacacggcaccagcugagccauccucauaaauuucagagguuguccuucguuuugcuuuuugagauaguaccacugccaggauugccuugaacaccuggcaaucccccugccucaguuucccaagugggauugcaggcaggagcugcuaguccuagcucuuuaaguuauggauuuuguuuuuuguuuuuuggguuuuuuguuuguuuguuuguuuuugacaaugucugguguaaucuggguagccucagacucacucugauaaagauaaauaacauaaagucuaccauuaugauucuuggucucguuaccuccauuaacacagaggccgcauguagggaccauguuucagagguacaucuugaggcaggaaggccuuggcagccuucuuccaccuguacugggcugaagaucuugcucaccccagccugaguuccuggccauggucccugccucccuucccagccccauucccuguauuucuguuuccuccaggucuuccugaguuacaccgaggccggcuccagcuucgucuucggggaggcucuggucaaggaugucuuugccuuucaggucaguugacuguugccccagcaaggguugauuggcacuugcugcucaggucccagcugugggagccagcuaagcugagaggaggugagcuuggguggggagggcuccugugggcucagacuagugccuaggaagccaaagccuggggccaggaaagacccagcauccuguuuguuggaugauaacugguaaaacgugaggaaguuugcucuuucugcauuauuuuucuuaagcacgagucaccacuugacauagcugcuagaaggcugagagcaagaaauggcgggggugggggugcugagugacaaccccgaugaugcggggacacuggauccauaaauacuguuuccuaucaggcuccuucaccaccccucauagccaaccuccuccacaggcucugauucuugcaccucuccuccuuccucucuucuccuucccccucucucucucucucucugaucacucaacacugcgucuacagucaugugaaguauuauagccgacauuaaggguaaagccauccuucuguuuuaaagacuccauugucccauggcagagcccagcuguaguuuaaaacagagccguucaugcuggggacacugcugauguuccccccacccccucugcuguucuggauggagcugugauuauauuucuucucccuccgggaaccggguaagccucugacauaccuuggcuagugaggacuuuaguacaggccccccuuuuguauagcuuuacagccugaagcucacuccaggcuuacgcugcguuuccaaaagccgggcagagagaguggcagccuggcuccaguuuuucugccucuggugccaaaguaacgaggacacgaaucacggaugccagucuagaccacuaaagccauggggggugucgcacaggcgaugugguagguucuggaguuucugccuuucuacucugcuggggaugaugaacccagggggcuuccagcuucuucuguagacuucugggcucacguagagccaaaugaaguccagaccauccuucuggacaugaacucugaccucuuacuagcuuuucuuagcgcucagugccuguuaugccagcaaucucuuaaggaagauccagccugcccaaaggguuugaaugaugccagugccguagggaaaaggaaagccucagguuccuagagucugucuggcccugggcagauuugccuccccccaccccaugaacuauuguguauaaagauaucgaaagacagccuuggcuauccuacaagcucacccaaauaccauccccauaggguguggggacugcucucuccauaucugcauagccaaguagugugcacccaaagguccagugggaagagguaaacaucugcugaggguaacuucuugagggcaucuuacgguaaagccccacagcuucucagcuuuaaauagcacacagugguucuaccuccagugugcaggggucacgggcgugagacagacgcagagccuguaguagagaagcugccaccagggaugaugaggaggacucccuaagauauggaagagucccaggauguggaggacugagaggugcuggagccagaagcaggaagaugcaguggugagggcaaaggcucagagggacgcuggggugugaaaacaccuggagggaagcugggggacagccucuggguucagcagacucuguuccaaaaaugucucaaugccaggcugaggcaucugagggucuuuuguugagucuguuuugggcuguguuuuguuuugaaacggggccuggauguaguucaaacuggccucaaacuugugaucuuccuggguucugggauaaccuacacgcaccaccauaggugucccacaucuaggcuuucuucacuaacagaggcuccacugaagaguuuugagcaguccugacuauggcauugguuguuuaacaugucaacagcagauaugaaagacagaugcugguguguguguuggagaggggcccagcaaaggagaugcuuugaagucuagggaugccggcuuaggggaagagagaugucaguuacuccucaguuccuuaggugcugucacaagaguguuuaccauuugaggacaaggcuuggccuuacuuuguauccuucauguagccuuaagcccuaaaaggccacagccagagacucugcggcuugcuggaugaaugaaauaaaugaugguucaggagugauucugggaaauuccucugugccugcuagggagugugcucaguuagccccaaggagacagggggugugcucagugagccccaaggagacagggggugugcucaguuagccccaaggagacaggggggugugcucagugggccccaaggagacaggggguguacucagugggccccaaggagacaggggguguacucagugggccccaaggagacagagcgugugcucagugggccccaaggagacagagcgugugcucaguaggccccaaggagacaggggguaugcucagugggccccaaggagacagggggugugcucagugagccccaaggagacagggggugugcucagugggccccaaggagacagagcgugugcucaguaggccccaaggagacaggggguguacucagugggccccaaggagacagagcgugugcucagugggccccaaggagacagagcgugugcucaguaggccccaaggagacaggggguguacucagugggccccaaggagacagagcgugugcucagugggccccaaggagacagagcgugugcucaguaggccccaaggagacaggggguguacucagugggccccaaggagacagagcgugugcucagugggccccaaggagacagagcgugugcucaguaggccccaaggagacaggggguaugcucagugggccccaaggagacagggggugugcucagugagccccaaggagacagggggugugcucagugggccccacggagacagggggugugaucagugagccccaaggagacagggggugugcucagugggccccaaggagacagggggugugaucagugagccccaaggagacagggauaugcucaguggagacagccucuccuggccaggguaccauguuucaaagccuggagucccuggucuaacacaagggcugaacuacuuuguuuguuuguuuguuuguuuguuuguuucuugagacaggguuucucuguguagcccuggcuguccuggaacucacagcguucugccugucucugccuccaaagugcugggguagggacucauguaguccaaacugaccuugaccuuaucacagagcagaggaugaacuuaaguuucuacuuucuacugcuaccugugaaguguuaggauuauaggcaugcaacagcaugccagccuccagccuccauagcaagacccagggcuucuaaucccucaagggccaaaggugacuuugaaguaauucagggauauuauaaaccauuugucccaccuagugcuggcuauuuuagugcagcuguucucaaucugugggucucccucccuuuggguuuaacgacucuuuuacaggggucacauauaagauauccugcauaucagauauuuguguugugauucuuaacaguagcaaaauuuacaacuauauaauuccaacaaaaauaauuuuauggcuggggucaccacaacaugagggacuauauuaaaaggcugcagcauuaggaaggcugagaaccacugcucuaguggaaaagaaaagcucaggcaaggggaagaaaguccugacaacugcuacggugugcagagaggaguuguggcuagacuuuauuuuagucucacaccaacccuucagagaaaacacgaugguuaccccuuuauagacgaggagccugaugguuaggguagcuguguuugugcaaaguccugaggcuaaagagucaagauuggagccccaacacaagguccauauuuuaguuucugugccccaacaucagagccccuuauuuagguggcaaggggcucugggucucagaacauuuguucuccuccuggcuuauaagagguuacauucuuugggaugguugagagugacagaaauccuuugcaccuagcuucccagggaggagaggacuuccuggcucacacaccagacggucagguggagccggcaaaggccagauccaggccccagaacagcugcagccucauuuccucucugcuuagccuucagggucagcuuuaccccucacaccauguuuucuccaucaacaccagauggucacucuuacaacacaucggcuagcauggacaacucucuuuuguagccagacaaguccugggcacgauucugauugggcuguguuagguaauaugaccgugcuugagccaguuagccugcauccagcaaguggggcaaccaaccgagcucuuggucugaugugaagccggggccaugggaaugaaucacugauugaauggaagcaaccuuagaaauguauccuuuagccaggcagugguggugauggaaaccuuugauccuagagaucaauagggaagcaggggcaggaagaucucaguguguaagucaacgcagccuuuacaagacacacacauacacacucaaacacacacacacacacacaccacacauacuacacauaccacauacacauaccacacacacuacacacacuguacauacacacacugcacacacacaauauacacacacaccacacacaccacacacaccacacuacuuacacaccacauacacauauaccacauauacacaccauauacaguacacaccacauacaccacacauaccauauacacacacaccacauacacagacugcacacacacacaccauacaaaacacacacacacacacacacuacauacauaccacacacacacuacacacacacuauauacugcccccccacacacacacacauacacacaccacaucacaaacacuuuucuuucagucuugagacuugcccuuaagguagggugacccuguuggguauugacuugaacucaaggcucuuccaugccucucagacucuggucugagucucuggccaguguccacacugggaagccuucccugagcuccugcagauuuuagaccuaggcugucuccugcugggaccuaguccaaaugaucuucccuccaggaaguagaaucacccugggacauuuuuaguccucugcuucuuuuuggcccagagcucugcacaguccauguaguguccucccccuccuggcuauaucugguugauuagucacccucccaccccugucccaccccugcuuuggcuccaucucccuucuaguaacuuuccacccgaccccucaguccccccuccuuacagcccagcuccugcuuucuugcugggucuggcugacccagggucacacucccucugccucucacaauggcgggcuccagccucuggcacaggccccaccugcucagcuaagcaguguucaacugcuccuccugaggagccccagagguaaaaacaaacaagcaaacaaacaaacaaaccaaaaccccuuuuuaucuccugagagauuggggguaccugccuaaggcagaccuuaauccccucagguaaacaguccucuuuucagagauggggugggaagagagcagagacaggggcaaggcugaaaggaaggacuugggguggcggaggaaggagagccagcuugcauggguuugauuuccaggcaggaugaaguuguuccaaggguguggcacaguggagacucuggagccgugguccucagagugugggaugcucuuauuaaaaacuauagccauacuggcucacaaacaacaggaguccacuccuuagcgcucuagcagcuggaagggacagcagagagcccccagggucauguucugaucaggaaucccucuuccuggucacggucaacuccucucccauccucacgugcucgaagacagagggagcacuuuggggccucuugcauaaggggaacugaccccauucaugagggcuucaccuccugauggcucgucugagccugucacccgggcuuugguuuuaucacaucaaucuggacaauuccgccuauagcagggacacacacagcccugaaugcagagaaucaagcuuucuccagagcagaugccucagccaucugaguggucucugcccauucucaacugugugaccuuggauggguggccugcaccucagagccucaguguaccccauugcuuaaggggagauagugauagccaccucaguugcuuugaggaucagugagccagcacauagcaaugaguaucugacacacaguaggacuuccuuccaggcacauaguaggaguuaagaguccuuccucaguagcacugcccugaguuacacacacugcuuguguaccaccccaggcucuccagaggugguuccugggcugugagaucauacuugccacggggacauuauaacauaacguaccuuagaaaauuggagccugccugccuucccccuucccucuaucccuccccuccugcccccuccuuuccucucccuucuuuucuucucauuuuccuuugugcuuuuuuuccuuaucuucguggugcugcagcuccugcgccacacaugcuaggcagaugcuuuaccacugagccaucuagagacccccuugcuucccuuuccuccgucaccauucacuccuucuccccaaaugaagcuucccucucaccaacagccuccgccuacaguuagaacacacuuuccgaugcccacucugccauccuggacauguccuccuagcuccagccuggggcuguagccagccaguugcccuggagucccucacagagucaaccgcgucagcugaguagacucacaucuggcuucugggagagcagaaugacgucacccccggagcugugagcagcuccagcuccaagccuuagcaaggagggguuagaaggcaggaacggaguuucugaaugcaguaucuaugcucccugucaugugauguccccagcagcaggcaagccacagcaauaggugggaaguggagcaagucuagagaggccugugguguuggugggaagagggaggggaagguccaccgcucuuuucuuucucguccccacagcugggcugugggagcagaucuuugcugccaccuaggaccaucuacuuguucugagagauugugcaagacgcucccuuuucaaaauacaauaaccagcuccugcccuucggcccucccugccagccuggccucccagaagugcugccuguugguaccaucucugggucucuugcucccucucaguguuacuuggcuucugguuuguguccacauccucccucugacacuguuuuuaccuggccaggccugcccugagugccauagucucugucugucucaagacuugucuugccaaagugcugaggcucccgaauaugauuggcugugccugcauggccucuguccuucuccuuuuagccgcucuaacugguguccugggucuccuagacacuaugcuccucucucuuuagccaugcaggcugcaggguccugcucugcacacuucagcggguuucugugagugcuguuuauucuguugcuucaacuggaccucaucaccguuuuuuuuucuuuuacuuuuaauuaauuaauuuucuagguaugcguuggggagguguguugugugugacacgauguauacguggacgucagaggacaauuugugggagcugcuucuguccuacccugugggguucuccaggguagaucuugggucaucaggcuugguagcaagccguuaccugcugagcuaucuugaaagucucaacugcauuucucaugaaccagcuuccaaaugcaguccccacccagaguucccucucagcccuagacccuuuuacccaaugggcaaauuaagaaaaggaaggaaggaaaagaaagagaaagaaagaaaaagaaagaaagaaggaaggaaggaaggaaggaaggaaggaaggaaggaaggaaggaaggaaggaaggaaggaaagaaagaaagaaagaaagaaagaaagaaagaaagaaagaaaaaaagaaagggaaaggaaaggaaaggaaaggaaaggaaaggaaaggaaaggaaaggaaaggaaaggaaaggaaaggaaaaccaaauuccucacagcucuggcauacagggguguaaguguuugggaguagugccuucuuugcuguuuuaaaggauguauucagcaugugugugccugcauaugugugagagugcaggcacacacaugccacaguaucagugcugaagucagaaaacaaugaguuggcuccaccuucuaccaugugggucccaggggugaaacucagguggccagguuggcaucaagcauccuuauuggcugagccaacuagcuaacucccuuuugugauguuuuguuuuuuugaguuuuuuucucuuuucuuuucuuuucuuuucuuuucuuuucuuuccuuuccuuuccuuuccuuuccuuuccuuuccuuuccuuuccuuuccuuuccuuuccuuuuccuuccuuccuuccuuccuuccuuccuuccuuccuuucuuccuuccuuucuuucuuucuuucuuuuuccccccaagacaggguuucucuguccuggcugucuuggaacucacucuguagaccaggcuggccucgaacucagaaauccaccugucucugccuccuuagugcugggauuaaaggcaugcaccaccacugccuggcucaugauauuuuaauauuucagcuugcuuuuuuuuuuuuucuuuguuuuucuagacgggauuucucuguccugaaacucacuaugcaguucaggcuggccucaaacacacagagaucucccugccucugccuccugaguacugggauuaaaggcgugcaccaccaccaucuggcccaacuuccucacuuuuaaaaaguaauauuuuuuuuuuaauuuuauguauauacguacacuguagcugucuucagacauaccagaagagggcauugaaugugguuguaagccaccaugcgguugucgggaauugaacucaggaccucugcucuggaagagcagucaguguucuuagcagcugagccaucucuccaacccaucuuucccacuuuuuagugacagagaauucccauagucuuagcaacucugccacacauuugaacuauugaaaagaaacacacaggcaggacaaacacuccaaugggaagaagaacccaagaggcaaaugucccucacgcccuggcccucagucacucacguucagaugccugcugucacuggucacuugcacgcccuucgaaugaugucccugguccauacaaacuuccugccuuuccuucauguaauaacacagaccguguguccauggugaggcucucccuucuccccuaacagccuaucucucacgugcccagggagcuucucccuccuucucuauuucguaguuuucagcaggagcuugagaggagcgagaggagcuuaggaaagcaccauacacucagaacuugggcaccagcuucucaagagacucccagagcuuucuuguucuucuuuccuggcauuuagcucaccauggguguccaugcuguggguuacuaaaccagcccucugucaagagauacccaagcucugcuuuacaaaugagcugcgguugggggcggagagaugacucagcaguuagaagcagacacugcucuugcagaggaccccaguuugguucucagcaccuguacuuaugugcucgcaccaugccccuccauacacguguaauuaaaacaauaaaauaaauauuuuaaauaaauaaauaaauaaauaaauaaauaaaagggcuguaccaagaaagcccuggagugugcugugcacggaagggaaggaauggauguggagguccuggcaugauugaaaaggaaacagaguaacaagauaagaugcuaacugcagggcugggauaugucugcugcaagccugauggcucugaacagaagcagaaagccacaccaaggaggguucccucauucaggcccauggagcagggagcccaaccagaccagagccaugcuccugagugugcuagaccugagccugcuccuuuagccuuugugacaguccuaagggauuucuccucaugauggagguaaagagacagggggugaaagcagccccucucacgacccagcacgggguuguguuggggaucacccgggacucuugcacaguccucagagcuucucccugcaccuggcagaccucugagagaaggcuuuggaggagugggcugucaccuggcccugccacagcucuaacccaggacccugucucccacagguuuugcccaucaucgucuuuuucagcugcgucaugucaguucuguacuaucugggccucaugcagugggugauccugaaggugaguccucagaccugggcaggcuucuucagagucaccagcucccgggcacagccuuccagcguccccacucucccagagucccaugucucaaggucuaacucccuacccuagaaugucuugcuuucuggauccauacuuucccagaaugcccugcucccagggucuuuauccuccuggagucucuugcuccugaagcccaugccuucccagaaugcucuccuccacaccuuacauucucuccauaucuacugcuagucaaacaucccuucagaaggucucucgcccugacacuaggguaaaauggcacaaaagcuugucucuaugggagggagggaaacggcacaugauuuagggggaaaauuacuuauaccaaaaugauccagagagauuauaauaccgggcuagauaggccauacuuagcugguauaaaugugcuuacuuuaaaaggacuauucauucauucauuuguuugcuuauuuguucacuuguugauauauuuguuuauugugugugcacaugcacgugugugcaugcaugcauaccaggaugcacaugugcaggucagaagacaucuugaaggagcugguuuccucccucugccauguaggaccuggggauuaaacucagguugucaggcaaugaacaccuuuaccagccgagucaucuuggcagcccaacugugcuuagguuuauaaaaucugcaugugucugggaucuaggcauuagcacugcacagcauuugaaagcaucagaccuggcaaaagggucugggguuuuagccaacagagcucagaauaagucagcaccuuugcaugacagcaagaauaaaaagcgaucuaugcuuacgugaaccugcagaauccagaggcggugacugccccuggaucuggaacacauguucaaccgcgggcuuggacaaaugaugcuguaagcaggaaagaauucacauccuccacagccaggcuggagggauggagaaugaugggcuuggaccagaggaagauaggagggaaagcuaauuccaacugcuuaugaaggaagacuagccgaggacaggccgagaggcagcagccgcacagaaacauuccagaaguacaauaugucccaaacccuuuuccagugaacucuagacccuggcgugcuaccaaauguuacuuggacaagaaagucucuaguuaaguaacugaaaaauaccaggcuagauauuauagugaauuaauuuuuucauuaauuuaauuauucauucacuuuaucaaagcccuuucccuccucuccuccccgucccauccuuacaagucuuucucccaaccacacuuuaccuuucaccucagagaaggagaagccccuuuuggguacuaccccacccugggacaucuagucccagcagaauuaagcacagcuucucccacugaggccuaaccaggcaguacaguuaggggaaggggauccaauggcgggcaacagagucagagacagccccuguuccaguuguuaggagauccacaugaagacccagcugcacaucugcuacaaauguguagggggcccaggucuagucccugcauguucuuugauuggugguucagucucugugaacccccaugggcccagguuaguugacucugaaggucuugugguauucuuggcuccuccagcucccucaauccaaucuccuacacaagacucuccaaacucugccugauguuuggccaugggucucugcaucuguuuccaucugcugcuggaugaagccucucagaggacaguuaugcuacguuccugucugcaagcguagcagaguaucauuaauagugucagggguugguucucucccaugacaugggcaucaaaucaaggcagucauugguuggcuguucccugcaaucucugcuccaucuuuaucccugcacaucuaguaggcaggacaaaguuuggguugaagguuucacggguggguugaugucccucucccuccacuggaaguccugccuggcuaugggggguggccacaucaguaucuguaucuccagaagcuaggagccucagcuggugucacccccauagacucccagaaccugccuccuccuaccagaucuccaucucauuccagagaugcccccaucaauuucccuucucucucucaguccccgcuuagccauucugagagguuugagauagaaucucagagucauuuugauuugcauuucccugauguugaacauuucauuaagugcuucucagccauuagagauuccucuguugagaauucuguuuaacacugccucauuuuaaguuggguuauuugguuuguuggugucuaauuucuuaaguucuuuauauauuuuggauaucaguccucugucugauguaggguugguuaagauauuuucccacucuguagacuacauuauggugaaugauuuuuuuuuuuaaagacauggucuuauuuuguagcccuggauguccuagaacucaauauguagaccaggcugacuuugaaaucacagaaucugcuugccucugccucgugaguccuggaauuaaaaaugugugcuaccaugcccagccaacaagguuguuguuguuguuguuggcugggcuggagagauggcucagcggcaguuaagaauuuguacugcugcccuugcagaagaccuuguuggguucccauuguucaccuugguagcucauaacucccugaaacuccagcuccaagggaucugaugccuuuuucucuaagcuuccagcaucugcacacacauacacagaaaacaaacccauauaaauauacauauauguaugcaugccagacuugugucgccgucagaggacagcuagcaggaguugguucucuucccacucuguggguccuggcaaucaaacuaaggucgucagacuuggugacaaaugcaguuugcucaccuuagcugguuugcugacccuccaccucaucuucugagauaggaucucucacugagccugaguuuacugacuuggguggacuggcugccagcaaggcccagagauccuccugugucucccucuacagcacugggguuacauggguccugaccugaccaacugagcuguaguacaaccaguuuuaagcuuauccccgacuagcuuacaaauaaaugagacucagacuauaguuauuuuauuuggcuuugacaacuacugggggccaccccuaaucuucuuuucuaacugcuggccuggcuaccucccuagcaguguacccuagauacaugcuguuucuccuggccacaugcucauaguucaucuccccucauggguagcuuccucucuccucucuccuuccuucucuuccucagcucuccuccaccccaccccaauccaggucacuccaaacacaccuaccucucauuccuccaguaauuggcuguagcaauuuuauuuaaccaauaguuuuaaaucuaggaacaagguuugcacaacaaaaagcuuuuaaaggugagaauuuacuccccuuuaaaagaauuuacagaauuuagcauuacaauacgaagcaaaagaccaaaccuccacacugccaccuccccaguucccugaucaccucuuuuaaaacugcuccaaugcuaauuaagguucaaaccacuucaggguccugggcuagaagaguuggguacuuucacccccaacucuuucugacucuggcuugcuaauggccacucaugaguacgcugguuuuuuccagauugccugguugaugcaggucaccaugggcaccucagccacugaaacccuaaguguggcaggaaacaucuuugugagccagguagguacugcaacuaccccaaagagacuggaggggggcagggauccaaucuaauucaagggagagccauuuaaccuguccccagguucacagaaggcugcugcccagggaugcuacaaguccugccugugucaugccaaccacccacaugguccauuuggcaccucugucacuucagccugggcuguuguuaucagcuuagauacugacaggcuaaccggggaaacugaggcuagggagaugugacuaauuuggccaagauccugcagggauaaauaaagacacacuuagucauuuagucaguugguguuuguuuguuuguuuuuccuugaucaggcuucuuuccacuguaucauuuggucuacuuaguuuugcuuugccugaaauguauuucuuuuuuuuuuuuuuuucuuuuuucuuuuguuuuuucgagacaggguuucucuguauagcucuggcuguccuggaacucacucuguagaccaggcuggcuuugaacucagaaaucugccugccuuugccucccgagugcugggaucaaaggcgugcgccaccacgcccggcuugaaauguauuucuuaaaauaauauaguucugaaggcaccaggacuccugagucucuucaggccuaaccuucccaagaaggagacuauggaagucagggagucccuaagagauacccucgccaagugguaccuuauuauuauuauuauuuauuuauuuauuuauuuauuuaaagaaaguauuggccugauuuuuguuauggugcaagauguaaagguaauuguuauucaucugauuaauugucaucucagagacuuccucuccaaucugcugaccuaggccuugauguguuaauuaauaucaaauaauauuaaucuauaucuaucuaucuauauauauugagcggauaaaccaaacagcagacuaggccaaggugguuccacgugggagagguuccacgugcagagauagaggggcagcgaagcagguagaagggcagagaagaggaaaaagagagaaagagggggaagaagagaagaaagagagaggaaaaagagagcaaggagggggugauccccuaauuuauacagaaaaugaugucacaccagugagggugggaacugagccaaguggauugugggauugagggucauuguccuggcaacacaggucaagggucacauagacaggggcuuggaguguccuggugcuaacauuccucccuucuuguuauuauaaaagaagggguggggggaagagagcggaaaccaauggugaagagggaauaagggcguugugucucuuaagcuacuuccugcuguuuaggggcaucgucaauuuucaggguauaucuggacuucaccaucggaauccauuugguaaucaucugagucaggcucuucuauggacagugauuccuuugugggcagcaaguggcugguaauccuguaacaggagcugauuaaggguuugguuagaaauuuuuuguacuugucacugaaggaauguagagauaagauuaauaagacaagaagcaaauaauuaugccaggaagauggccaggaaagauauuauacgaguggaaggauccacuuccauaugggguuuucaaagauaccagacugauuaucucaugguuacugaaaucucuuaugucugccuguaguuccuagauuuuauuuucacaaucccggauugacugacauagaaacagcauucuucuuguaggaauaggcaaagaccaccuucuuuagcugucaggaagucuaaguccucgccgguuuuaaagcaucacgguugccaaagaaucgaucugcuuuuggauaguaagcaguuucagucauuccuugaaaaucucuuuuaaacugggaagugaauguauuguauggggucauagaagucguuaucccugcuauccccgugccagccccuacagcuauccccauggcugccaggagugguacaaccugaacagcuuuuuuguugugcugagcagcuaccauguuuacaaccaggacugguaggggcucguuucccucaauuacucccaguucagggaaaaggaguaccagcguacaaaccccugaccagccggcugguaggcgaugauacacuugagugccacagaggauugacguguucuggauagcagggcauuguggcagagauguuguaucaagaguuacggucuuguuguagucuuuggggcccagugucuagagguggagcgagauugagucauauuuucucugaauauggaugguacuuacuggggaacuaggcuggguuuugcaguagagcuuaccagcaacuccuguuucccaccugggaucccaugggucucaaauguagaagaagaaugucuugcagaaucaauagaagugauuaauccgugucccuagcauguguaucuaucucacaagaccaguaugggcagcccccccacucgucuggccauuuucuguaauaaucuuuugucugguuagagagaaaacagguaugaaggucauaauaugcggaugcaguaacagauauagggacgauggcaaucuggaucgguuccugacacccggcuauggagcaguuuccugauccuauuuggaaagucugcuuguugucugugggcguuucucgaacuucgaaucuccagacguaagggaguccuugauggaaaugaacagcagggaaaagauaaaaaggccacaacuaauccaaugucuuguccagcgaggucgaguuuggcugccggaauggagucucauucucuaggaugggagacaagacagguggucuugaugucuacggagcacgguccuguuaggguugauguguaugaagaggaaucaucuuuagguggaggaaugaaggguuucaggugagacagguggacacaaugagagagucccucgagcuuagcagcuguaggggucacaaggauuaccuuaaaaggacccugccauuuaggagaaaggggugaaggcugaugaccuggaggagauaaaaggacuuggucuccaauauuaacagguaaugggcaggaaacacaguguggucgagguaggugauggucagcaaaguuccauaggcgagaauggagaugagaaaguaauggggguaagcaaaugaucuggaaggggagcgugcuugggcaagaagccaggaguuaggacuggacguccguacaugaguuagccagccuuucuggcuccuucauguaggaaggagcugccauccguauaucaaauauauguggcuuggggcaaugcacccuccuguaugugugaaggaugaaauaauagcucuucuagaguuucagugcaagggugagacagggagugacuaguauaugauuuaggaagaagguuagaaauauugauagguggacaugauuggaaagugaguguggggucuucuauuagagcuaucuggagagagagaaaucuagagggagguagaguuuguaauccuuuauacguuaggagcugugacagguuaugagaagagaagacaguuauaggugauccaaagguuaguuucuuugauucucgaauaaggaguucagcggcugcuagagugugaauacagggugcccaucccugaaugguuaggucuaguuucuuugacauguaugccacaggugcaaaagaagguccuauuugguggcccaaggcuccaagggcaaaucccuccuuuucuguuacauagaggaaaaaaggaugagucaggucaggaagauguaaggccggggcccuaaggagggccuguugaagccuuugaaagggccuggugauagauuuuaaaagagguucguggguggggccuauugagggcgagaaagaagagaaaaggaagggacccaggaccauaaagggaauggcaugguauuguuaguagguuggcuggcuacaaggaggagcagaggaacugcuggugagcuugaguucaggcgaauguggggagccaaagaaauagaggcucccaauaaggggacagacaugugggcacuaucaaaaaggaaugggugagagguacaccccuaaaaaugcaacugagugguggggucugauauggaaaguaagguuguccuccuaccccgacaauaggaaaacgagagggagaugugggcccccuaaacuguuaagacugaguaaguggcuccaguguccaagaggaaagagaugggucgcccacagaccaugaugucuacccuaagcucucuguucgugauggcagugguagggucgaaggagccugggccucgucauucagccacagccaagccuaggagaucaaucaguuggaggguuaucugggagugaugugccccuguuuuguguaacacaggggcaaucaacagcccaauguuccucuugauggcaccuagggcauggcccccucggcuuucgaggauuagggcagucuuuggcccaaugaccuugucgaccgcaccuguaacaggugcccgguggucccugggucuuaggagaccaugagcucgggguagcagcuggggcuggucagacagccuuugccagcauauuguacuucugcuugcgaacccucucaucucucccaugguacacaccuugaaggccaucgccaagacuucugccuguggagucagggguccccucuccaacuuuuuaaguuuagcuuuuauguugggguagcucugggaaaagaaguaagucauuaagaguuguuuacccucuggguucucaggguccagauugguauacugcaauaaagccccuuuaaggcguucuaaaaacugagauggauucuccuguuuaucuuggacaaccucuugaaguuuuucaaaauuaccggcuuuaacgcugcuuuucucagacccgccaaaagacauguaacaaaccugucccugccuagaauaccaccugcggaauuauaauuccauugaggauccaggucagguucugucucugcuccgacuggauaugcucuaucuguuugaugaaucucgucugcaugcgcucuugcuuguucccaaacucgccugcguuccucgggaagcaaauuguuaguaaguaucauguguauaucauggaaagucaagcuguacgacugagugauauacugaaauucuuugauaaaggcagaggaauuagaaguauaggagcccaaucucuucucugucugagaaaguucgcucagugagaagggagcguguacucugaccagaccaucuaccccgcaacuucccuuaagggaaggacaguugcugggucagauucuucuagggguggagagcuugggguuuuggucguggccuuagagcgagugauagguggugugaaaguaggugccaagguagaacguuuggagggaccugcaguuggcgcagaaggaggagagcuggggguggcaggcccuggggagucucggugaggggaaacugagguagcaguuugggcacagaagcaggccuauggcgaaaaggaggugguucauaugcuggguccaguagcauaguaucguuguacuggcuagcuuugugucaacuugacacagcuggaguuaucacagagaaaggagcuucaguugaggaaaugccuccaugagauccaacuguaaggcauuuucucaauuagugaccaagggggaaaggccccuugugggugggaccaucucugggcugguagucuuagguucuauaagagagcaagcugagcaagccagaugaggcaagccaguaaagaauaucccuccauggccucugcaucagcuccugcuuccugaccugcuugaguuccaguccuggcuuccguggugaugaacagcaguauggaaguguaagccgaauaaacccuuuccuccccaacuuguuucuuggucaugauguuugugcaggaauagaaacccugacuaagacaaauugguaccaggagugggguauuccugugacaaccugaccauguuuuggggaggacuguggauggacuuuggaacuuugggcuuaaagauccauccguuguuaagagcucugucagauguuguguaggagcuuggaagauaauguugagaacagugcagaagauggagguuugguuugugaaauuucagagggaaaauuaaagacucuuuucagggccauugcuguuuugauugugaagauucuguaguucugguuagcuggggcugaagaaucagcugugauuaacaagauaccagaacuacuaaagcaaaaacuuugcauuacugggacuauugaugcugguuagcuggagcuaagaaauuagcggugauuaagaagagaccagcaucauugaggugacaucuucugggagguguuuucugagagcacaguggcuguguuccagauauagccaaaguuguaccuugugcuguggcuggacuugguaauguguaagagucacccaggugguacugguuuugaaggcaugaaggaguugagcagaacagcugaggauuggcacugugagaggccauggaaggccauuggugaaagugcagccucaguugcaauugauggcccaggacugaaggggucaugcaguguuuuggagaugccaguaccaugagaugaccaccaagagcagcagcagcaguggaguacaggcaucuggagccuagaggaugacacaugugcuacaaagggccuggcuggagaagugacccaagcccuuggaggagcccagaagaucgugaguuggaucccagacauuggacgguuagagauugacuuuugcuuuugauugugacugugcccugauauuuucccucuugaaggaagaaacuguuuuaguggagcccacaguuaagagacuuuuaauuguaaaaagacuuuggauuuuaaaagagauggauauuuuaaagagauugaaauuuuaagcauauguaaagacugugggacuuuuaaaguuauuuagaauggggaugaauaagauuguaaggguugaggcuuacuagugauguguuugugugucaaguugacaaggggucaauuguacuggcuagcuuugugucaacuugacacagcuggaguuaucacagagaaaggagcuucaguugaggaaaugccuccaugagauccaacuguaaggcauuuucucaauuagugaccaagggggaaaggccccuugugggugggaccaucucugggcugguagucuuagguucuauaagagagcaagcugagcaagccagaugaggcaagccaguaaagaauaucccuccauggccucugcaucagcuccugcuuccugaccugcuugaguuccaguccuggcuuccguggugaugaacagcaguauggaaguguaagccgaauaaacccuuuccuccccaacuuguuucuuggucaugauguuugugcaggaauagaaacccugacuaagacaaucgucuagugggaguugugcaggauucauggcuaacaggaguugaguuggaaagcaggaagaacacauagcgggauuggaccggagaugaauggaagauuuuacauagauaaccucauccugguuugcuggcaguauguauuaagaucuuuuaaauuuugaugccuuuaaaggaggcaucagcuucaaagacuuaagauuuucuaggagacaucccagugguguauccggggauacguuugaagacauguuguugcccauauucuggaaguuccugguguucauacuggcaucccaagaacaacucagaaaccaaaaaggaaaucagccaggcuggaguguccaagucaucacgagguccucuaguggcuacccaguaaguccuggacuuacugcagaaagugcuccacccuggccagggauuugaggagagagcgagcaacuuucaggagaacaagauccagaugggcaaugucuuaguuucuauaucagcuggagguauugcugugaaagcgccaacccccuaguucucaggcagaacuggcuaggcucuguucugggaacugaaggccccuccccgcugauaagaccuaucaaugguaugcuggugucugcgugggaauuuuuagagaacuggugaacgggagcguggaagcccagccuauaaggcgugugggaguggcacagcucacuuauuuuaaaguucgugggugccgcagcggugggucacgugguggaaauggugggcagcggcgccccuuccccacugguguuugugugagugccaagccguuucucaggcagggcuuuagcagcaaaggcuuaguaaccaaguggauuuauuaaagaggccuucgaaucauccggucucugcuucucgguuugggugggggguggggcaggaacccggagggaaggucggccuugcucggggaguaccuuauuagggcccacugguagggcuggaggacuuucaauguuuaagcggacaugaagcaaagauccuggcuuacucccauaauuguaaaacacaaugccccaggucaugccccugagccacugggcaagaucauacuuuuuucccauuucagugaacugcaauuuuacucggucuaaaucuguagaccugcaucccuuauuuuuguagaguuccauuacugcaugccugccggguccuggauuuuggaaggaaaaauucagcccauccccgguggacucagugguccauuuccaaucuccaccauuugaaguaacgcaacuccaaucacugcaaaaguacccucuggguccuccacaccaggagcucuuuaggugcuuggggcagcuauagaacccuagcuucggaccucauuagggggguacuuccggccgcaggaauaauuuggcggagacaaaaguaaagggucggccaccacgcccccgggguuccauuuuuugaaguggcaaaaaguauuuccccugauugggauaguaccugccaagugagagucaugggcugaugcggguugucacucuuuuucuuaaaaaagcagcaguuuaagaggaucagcagucuuuuccaauucccaaucaucuugggguugcucaggagcucgcuucacgugggaggcguggauccaugcagagaugccuucuacuuuaucagcggugggggugguuagcagcacgauguagggacccuugcaaugaggcucuagauuuccagcgcguuguugucggacaagaacugcgucucccccaagggagacccucacucaaggcucgggacaacugcggacucccaagaacucaggagagaccaagcuugaugcaaaucacaugaggcuuuauucaggaaagccagagcucuggggacaacucguaucccacgcagggauagagaagucaaccggaagggaaaugggacccuccuuuuaugggcccucaagggggaaaaggagaaggggaagggaggggacuuccagaucacaugccccugagcaaccaaucagguaaguuucgauuuccugaucugagauuuacaaggaauggguacgggagggguacaaggaaggaaucaugugcaggcgcagcugugagcaaaauggcgcaggggugaugcaacucuauuggcuaacggcugguauauggggcaacucaggauuggcucaaucuaaaguuuugggggaaauuuuccaaauucagcccagcaaccaaaccgcaaacgucuggcagugggcuauagcgguuggcaagcauagcggauuuaaggaaugguccgagcacucuguacaaacauuuccugaaacaauggagcaaguuaaacuuuuacuuugugccaauagugauguccauuuaggacacaagucgggggcuuacaugaguuucuacuuuaugucaggaucuuucaggucaagcuuacuccugucucagggccucuggucuuucugggcggcugagccaucaucagucuguguaguugacuccuuccggucucaguuaacauuaacccagugccacacccucaaagagaccggugcugauauucccugaccaugaggcuuguuuuucucaccuaucuucauagauucuaucacccucuaaaaucacagcguaucuauaccuccacacacacuuccugcucccaggaaggcguucuuguggcuuccagguauugguugcuuuucuuuucucugugauaaagcacccuacagaaacaacuuaaggaaggaaggagaugccuguggacccacaguguagagguacaggcuaucauggcagagagggccuggcggugugugugaggcagcuggucacaauguaggaaggggugugcggaaaauaugggugcucagcuuacuugucuguggguguaggacugaggaugggagggggaugagcggcgacagaguuaugugaccgaacccagcucaggcaguuagacucuggagaccagcaucagggcacagauccgagauuauuacccagcacauaggcuuagauacaauguuugagccaaucccaagccccuaaauccuuggccaaucaucucucaccacacugucacugggcuccaaugaaagucccgucugaugagguuacucagaagaagugggaggaguuaggggaagcagccaaccccuggccgcgguuccuuuuuguugguucaccgguguucuacgagccaucuuaugucuaaugcugacuacagcagaucaggacuuucugaggagucucaggagccugaggcaccucgcucucuaucccacuuuuucccucacaagguugauuuccacauccccuauaacguucuacuuuauguucauucuggagccccagccuacgagauaguguauccacauucagggugggugggucguccuuccucaguuacaccucucugaccacacccuuacagaugcacuauggagcguauuuccaccaugauucuaagcccagucacguugaacaugaagauuaaccaucauacgcccaucuccccguccugcaaagcaguaccaagaaugcuagggcuccauagcuggauuagauaaagaguagcccagacuucuacacaagccccaaagcaaaugcccagugaaggcucagccccuuugugcagaucgggcuugcaucccuucccaggccucuguuugcuucccuggaaaauaagaguccuuucugucuuagguuguaagcacagagggggaggugccugggugugaggagcacgguaagugucaacacacacggguaggguaggguggugguaugcagguccuaucacagaggagggaggacaauggggcccagagaggcucagcugacuagaaacccacccucugucuccucugagauucuucaucaagaaccaugaccugucucaaaacaaaacaaaacaaaacaaaacaaaacaaacaaacaaaaaaccugugaccaucacccagccgccaccgcggcagcucacugcuugccuucugacucuuuguagacugaagcuccacugcugauccggcccuaucuggcagauaugacacucucugaaguucacguugucaugacuggaggcuaugcuacuauugcuggcagccuccugggcgccuacaucuccuuugggguagguagaacuuuucucugcugggcuaugccaaagcccugaaacugccuuucuggaagccccacaagcuccuaaucacagcagucaugggauguccccucucugucucaaagcccagcuuugccugagcaaggcaggcuugcugggcuaaacuacuugguuagaccuuuuuuuuuuuuuuuuuuuuuuuuaaugguuuuagaguuuuauuguagaaaggcgggggggggggggagaagguagaaggagagagaggcuggccauggccacuugaagagagggggaagggagagagaaaaggagggcuaagaaaugucagagcuuaaagagagcuggcuacacuuuucaaauggccccugggucagauucccagaauuccauuuacuaagcucauauuauguaucaggcacuaugcugggugcuuuaauauccccguuuuauagauaagcaaauugaggcucagagaauaaauuaaugguuaaagccaggaucugaacccagaucugacuccaaauuucaugcucaguuuuccauaggcuuucccuggggaucugcccuccuaaaugauguauaucauaauccucucaugggccaauccaguauuacaaauuggacccuaaauucacauaggcagagaaaaaauuuacuuguguguguguauguguacacauuuuuucuuuuucuuuuuuuucuugaaauuauuuauuuauauuauuuauauuacuuuuucuugaaauuauuuauuuauuuuauguaucuuacauacacuguagcugucuucagacacaccaaaagagggcaucagaucccauuacagaugguugugagccaccaugcaguugccaggaauugaacucaggaucucuggaagagcagucacugcucuuuaccacuaagucaucucuccagccccaauuucauuuuuuaaaaagagcucaggggcuggugagauggcucaguggguaagagcaccugacugcucuucugaagguccaaaguucaaaucccagcaaccacaugguggcuuacaaccaucuguaaugagaucugaugcccucuucuggggugucugaagacagcuacaguguacuuacauauaauaaaaauaaauuuuaaaaucuuuuaaaaaauaaaauaaaaagagcuguaauccuagcacuugggaggcauaggcaggaagaucagaaguccuuggucauuaacuauauguagaacugaaggcuauuuugccucaaaaaucaaagaaaaaaacccuaaacauaggaaauuugaaaccccaaacuuuguugguaaaacgguuuaauagugacauauauacacgcuaccugcauaucuuaaggucuuuaaacaucuuaacuuugcucugggccuugugaucuguuuuaaaaaucaccccguguucuuucuagacacaugagcuuugcagacaccucuagucauuaacugggacuuaaaaggcaaggagguaucuuaccacacuaaaagaaauaaaauaaagccaaaggaggugguggcacacaccuuugauuccagcucuugggaggcagagguuggcagaucucugaguuugaggccagucugaucuacagagggaaagccccaggcggcagccauagcagggucugggaaagcaccuaacagagggaccuuccgcucuacuucuucugucccuggcugcagagaggcucucuucugcccccugccgggccuuagcugucacugccuucccaaggagccucccagguucuuuuccuuuguuuuguacagcuggcuuuuaaacucaggaccccauauaugcuaggcaagccauugagccacacucccaguucauggucucuuuauuuccaaagcguuuuuacuauauugcuuguguaugagcacaggggcacacgugucagaggcacgcuuguguggguaggagggagucaguucucucccuccaccguggguucuggggauugaaccagggcuuguuaugacaagugcucuuaccuacugagccaucucaaugguccccucaguccacagauuucucuuuguggcucagccucugacccuuggccacauccuuucuauugcagguauuuggauaguagcaggaccuguccaacacaguagccaugaacuccugaguacuugaaacaugggcaguuuaagaugagguguccaguauucuuucuucacugcucaagagcaaacccagggccucaaucccaaaugcuaggcaagcccuguaccacugagcuaaguccccccuuuuuuucuuaaugucuaacuaaguuacuuagaccgcccuugaacuggugaccuccugcuucugccucccaaauagucaguguuacagacugguacccccagccuggcuuucuuugcacuuuuaaacaugugacugcuggccacaguaaccguguuggugcuuuucugggugguguuacaugcuauguaggcccaucaccugggagguaaagaagaaggaccacaaacuugaggucaccaucaacugcauagcaacguugagguuagccugggcuacacaagacugaaucuaaagaauguagcaggagugaaauuacagauauggucucuguugaguuuguauuggacagugccagccuaggucuucucuuuugucacacagcaccaagugucacuugacugaaucauuucauuaugaccuccacauacauuuccaauuaugcuguuguuccaaaggcucuaggauagauaccaacuuucucugcaaauccaaacaagcuggucucucagugcagaggucuugaacccaggcuggucaugguaacauucaggaguuggucacucauguuuccuauugauuugccccucaagggaaacaaggauuugcaagauccuguacucaggaucaaagcgacucuguugcuuaguuuccauaucuguaaaugaacagacguacuguuuaccuggccacaaaggauagaugaaaauggucagaaaacacuuagcauggugcugaaaagugaccauauuaagaucagaaggugggcaguggugguguacuccuuuaaucucagcacucgugaggcagaggcagguggaucucugaguuugaggacagccuggucuacagagugaguuccaggacagccaaggcuauacagagaaaccucgucuugaagaaccaaaaaaacaaaacaaaaaacaaaacaaaaacaaacaaacaaacaacccccccaaaccaaaacagaccagaaaucucuccuuuguuuccuuucucacuaaauaccauucugcaagguggugugcucauguccuauuuguagaggguggagggaggccuggguggcugagauggaaggcauuccugacugugcuccuggacgcagggcugggggagcuacaauaggcuggugugggaugaaccagcaccagcuucacugccugcaugcagaaguccugcaucuccaucaagagcaggaacggccacugugggauuugaggcuguggccauauggcucuggaauguguguccccccuaaaauccaagcuuacaagcuggguguacucuucaagcugaaggaagaggucagggucuagacuggcagacggagaaaccuccuauuucaggcguggcaguguccacgauggugcugagcugccagggaggagacaacugaagcccugaaaguuccaagagggcaccaccccgacugcccuccuccaggagggaucagggugcugggcuugccaucuagugcugguggcagggaagaggaguugggccucuugaugguucguucgcauggugugcaagcgagcuuucuguuacuaggacaaagugccccagagagaguugaaaaauggagauguauuuuacuuaugaucaugccuuuagagguuuccacccacuuugccccaucucugugggcuuguguugagauggaucauugcagaggcggugugguagaaugguucuguccaccucaguccaccucagggcagucagggacgcagagagacagaaaagaagagucuggguguaagauguacaggcaugccccagugaccuacuucucccagccagguuuuccucacagucaguggagauggauugacucauuggugagugcagcucccuccaggcucugaggcagcugaggaccaagccuucgugagggacuucauuuucacacccuaggcgguuucugcuucugaguaaggagaaacaagugggguuuagacaaagaaggaggguuucagggccugaagcuccaggccuucagcuucauggauuccugucuguucccugagaacagaugcccucugccuuuauuagccugagcccauguaaccucaccucccguucucucccuacucccgcuugaggcaggggccucacuguguagcucugaauagccuggaauucacucuauacauuaggcuggucuuaaacucacagagauuugccugccucugcugagacuaaaggcauaugucaccauguccagagaagggcaucuaccucaagcugccugauguggggcagggaacugaacucagguccucugcaagacagcaagaauucuuaacuaugaaggcaucucucccucccccaucuccccacccugcccuuuaaaagcagagucucauguuucuaggcuacuacauaaccaaggaugcccuugaauuucugauccuuccacccagagugcuagauuuacaggacuguacccuccuucccagcucacguaguaacuggugacggaacccagugcucccugcaugguuagacaaacacucugcccgagcugcaucauagaacuuucuacuuaaaaucuaaaaacugcuauuggcuuacugcaaaauuuaaggagaaaagaucuauuuugcuuuucuguuuuuuuuuuaaauaguauagaguuauggaccuauugaaagauaucaaaaagcaccaagaaagaaaaucacuucaaacccagcuccccggagacagccagugugcugacagucaggggcccuuccuggagacagccagugugcugacagucaggggcccuuccuggggacagccagugugcugacagucaggggcccuuccuagggacagccaguguacugacaaucaggggcccuuucuggacaucuucugggcaauuugguguuuguguuucccauaguuacaguccugcucuucacgcaauuuugugggcacuuucccaccuuacugcacuacucugagaagcaucaauuuccagagaccauucucaggauggcucagugggggagagcgucgguugcucuuaacagagaacccacauucuguucccagcacccacauggcagcucacaaucaucugugacucccgucucaggacaucugaggcucucugcuugccuccacaggcaccaggcucgcaugcuccacuugcauacguguagcaaaacgcccauugacacaaaacaaauaaacaaauccuuaaaagaacaggcuauuugcuccuuguuaguuaguuagaugguugauucugauuucaguguggugaguagcuaaguggagggacggcuguucaucuaucucgggagcagugagacuguguguucuggaagugccccacccccucagagcugguggugguuuaugaucuugcuggaguacuuguccagugugauuuauagagacagacccagugccuccgugcuguugaaagaggccaauucccuaauacaggagugagacaggcugccuugcaguggugaguucccugucccuguagguauucaaaaauaggagauagggguuauacuccuuuaccgcacagaagcuacgcagagguagggaugggcuagcugcuucauccaucccaacucaguucuuguagaggaauuuuaauccagcaacauggcugcucuggcaguggaucacauccaaagaccuucuaggucugugugaccuggcuggaaugacacaccuuuaaguagaggaagaggcuacgugacagcagugcagggagagacggggugggggaggcgguuuuacugggacacuuuuacagagacagguugcaagugaagacagggugagccagagaauaagaaggagccagacgauuagaacauauugucagaguuaguuugaaaccaagcagagcaguucaguccaaagcugagagaagcugcauugaaucagucagcuuggaagauuagauuguacagaggcuagaaacuuccaggacuaagccuaggguuaguuagaacagagaaggaaacccucugggcuuagcccaaguuguauauucgugcagcuuggguauggcucucaucucaucccaucuucuaaggaccucaaaacaacaguuaaaaguucuggagcguugucugaaucugucacaaacuccucagccagaauaggauuaguggucaaagagagacagucugggcaaggaggagaacccaugaaaucaaagccaaaggcugugcuagauuuuaauucuucucccuuuauuuugagcaggucauaguuauuuuuccggggccacaguuuuuuuguguguagaugggguagugucacuugcuuggccuaccuugcagaaguauuguauuuuuaaggaagcagugaccacucuuuucuguuguuguuuuuaugugucucuuguauguguguauguguaucuuauauguguguauauguguguaucuuacauuuguguauauguguguauauauguguguauauguauguauauauguguaucuuauauauguguauguauguguguauauauguguaucuuauauguguguguauauauguauguauauguguguguauauauguguaucuuauauguguguaugugugauauauguuuaucuuauauguguguacauauguguauauauguauguauaucuuauauguguguauauguauguauauauguguguguauggaagagaacaaccugcaggagucaguucucucuaccaugucaguuccggggacugaacucagauugucaggcuuagcagcaagcuccuuuaccagcccagccaucucaugggaccuugcagaaguacuaggagauugucugaacauaaaagggauuauuaaugaccauaccagauguaguauagugaagucauacuuauaagaauguaucauacacauaaauaugugucccucugccaccucauuucuucuaccugccccucauaaccucccuaucauugauugauagauagauauugugagacagggucucaggcugaccuugaccucgcuguguggcugaggagauucuugaacuccugguccuccuguuuccauguccugaguguggggauuacaagcaugcaccuccgugccuggucacgugguucuggagaucaaacccaggucaugcaggcuaagcaagcucuccacgcucaccagcugcagcccgccaucucugcuguucuugcagauugacgcuuccuccuuaauugcugccucagucauggcggccccuugugcuuuggcccucuccaagcuggucuacccagagguggaggaguccaaguuccggagugaggaaggcgugaagcugacguaugggugagugcagcagggggcuuucugaggggcacuagggccagccguggggacagaggugucgaagaacagcgcuauccuugacucauuucugucuucuauggggcuugggucuguucucuucuauugcuuccuugguguugcuucaugugugaacacaaacuuuuuuuuuuuuuuuaaucauggugggagcauccuuuauucaaaacaagggacaccauucauagagcagugaacucacacagaacacccagcguggagauguuccacaggagucagaggaccaggacacagccccuacuagugauggugcugcuugaacugcaggccgcaguagccacauguccccguuuuuguuucuuuguccaaguuuauguacaccuuaggguggcccagggcaccaccgccuccaucgcaggcuaugauacgaugguccaccucauucacaggcuguugugcuaucaaaucaauggcaaaguucucauucaccucuuucugacgaucuacaaaacgaauccuccuguagucuuuuucaucauacaccuggccgguaugcgugaucuuuuccccgcucggcaacacucgaacccugaaaccccgcgcagcccuggggagagucaacagccagcggaaggucaguaccaccgccaucuugccggugaacacaaacuuuaaaaaaaaagauuuauucauguauuuuauguacaugagugcucuguccucaugcauguaagaagagggggucagaucccauuauacaugguugugcgccaccuugugguugcugggaauugaacucaggaccuuggaagaauacucaaguacuccuaaucucugcgucuuaacacauccuuuuauacuuauuuaucuauuuaauguguaugauguuuugccuguguauauguaccuacaccaugugcuugaggccagaagagaguguagaguucccuggcacauggauggcugugagccuccguguggaagcugggaauugaacuuggguccucuggaagugcagcuaguuacuuuuguuuauucuguuuuuguuucucaaggcaggguuucucucugucgcccuggcuauccuggaacuuguucuguggacuuggcuggucucaaacucagagaucuaccugucucugccucccgaguacucagauuaaagacaugagccacuucucauggcugugagccaucucucuagccugaacacacuugcugaggugauugauguaggagaauagaguucaguggcagccugauuacacagaaaggccaagaccaacuuaggcugcauggggcgacuugugucaacagagcaaaacugcagcagaaacaacaagcgcugauuccacuuuucagaucauaaucuguuucugaccggcaagagaaagggggcuggucaggguucacuagguuggcuuagcacuugguguggccugguguugcuccuugccaccuucucugcauuucugacuugugaccaccagguggcagccucacauuggcaaguggaaugguagauuccuuuuugguuuuuugagacaggguuucucuguguuccccuggcuguccuggaacucacucuguagaccaggcuggccucgaacucagaaauccaccugccucugcccccaagugcugggauuaaaggugugugccaccacugccuggcuacaucccuaauuuuuauuuuagauuuucuaguaaugugugugugugugugugugugugugugugugugugugugugguuuugccugcauguacguaaguauacugaaugcaugucuggugcccacggagaucagaaggcaccagaucucccagaacuagaguuagagaccauuguaagcugccaagucagggcugggaacugaaccuggguccucugcaagcagcaagugcucuuagcugcugagccaucucuccacccccuagauaucuuuuuuacugcauuuuauuuauuguguguguguguggaggggugguggugcaugugugacauggcacguguuuggggguugcaggacaaacgcaggggccccauuuucuuucugaggggggugcugaucacagaggugagaaacacacagguuucucggcugaccuucaagauaagguagcaguugagagcucagugcaucuugaaagcaagcugaucccaacagcucccguggaagcucauucucgcucaaagcauuagguuuauguugucauccuuagcagcaagcaucuuuuuuuuuuagacauagucuuuccuagcugacuuagaacucacuguguagaccaggcuggccucaaacguacagagaucugcuggcccucaugccuggcuucuggccugauuuuuuaaaaauaagagaaacauaugcucucaauaaaaucuuuugcuuaguccaauauaucaaaaauaucuccauuucagcaugugaucaauaaaaauaguaagaguccagacauggcagcacaggucuuuaaucucaguaucuggcagacagguggagcucugaguuuuaggccagccuggucuacauaaugaguuccaggauaaucaggaaccaagacauauagagagaucaugucucaaaaaaauaaaucuagccaggcagugguggcacacaccuuuaauuccagcacuugggaggcagaggcaggcagauuucugaguucaaggccagccuggucuacaaagugaguuccaggacaaccagggcuauacagagaaacccugucucgaaaaaacaacaacaaaaaaaacaaacaaacaaaaacaaaaaaacaagaacaaaacaaaacaaaacaaacaaacaaaccuaacauaccccucccucucccucuucucaaacccucaaacucugagggguuuacuacauuuacaacacaccuugguuagacccagcuugauuccaguggccagagacacacugaacuucuaucuugcagcacagccuaaaaaccugggugcuuucucauucuuuggccaggagcacccccccccccacacucccucucucuuaaagucauuuaucuccuugucucagaaaaaaaaaaaaaaaaaaaaaaaaaaaccuccuugguuuugaaacccucuguugaagccccuuuccguauaagguggggacauucacugaucauagggacaugcuaguaaugacaccuguugaucccaaugguagagaugcccagaaccucguggaagcagccagcgcuggggcugccaucucagugaaggucguugccaacauugcugccaaucugaucgccuuccuggcuguacuggccuucaucaacgcugcccucuccuggcugggggacaugguggacauccagggacucagcuuccagguguggcugugguggaagggauggucucaggacauaccuggaagagcccuccaucucacccaguucucuugccuuuuuauccucagcucaucugcuccuacguccugcggccuguggccuucuugaugggcguggccugggaggacuguccaguaguggcugagcugcugggcaucaagcuguuucucaaugaguuuguggccuaucaagagcuuucccaguacaagcagcgacgccuggcaggggcugaggaguggcuuggugacaagaaacaguggaucucugugaguguccugauccgcuucuugccucuauuuuggaaagcggguuauuaacauuuauccuaaaaacacugccaugaacaaaauuauguaagccaugcaauuauaaaauuaaccuuucugaaagaauacagagucauaaccuaauguuaggaauuuuuuuuuaaaugucuauaauaaucucgcuauccuuagacaacagcgauugcuuuuaucuguuuucuucuuuuucguguguuguuuuggggauauggauucauguagcccaggcuggccaaagauauauagaagaauggccuugaacuccuucugcgucugccuuccaagugcugggauuacaggagugagccuucauggccagcuguuuguucuaagacagaauuuacacaguugcuuaucuauguuacauuguagccagcuuuccccauccucauuaggguguaucuauugagcuuuuuauuuucaaugcuuaagauuguacuaggcccucaugcacaccaaacacugagcuauacaccauuagaaauuuacuuaucuuuuuguuugguuauuuauuuugauuuugguuuuuguuuaaagagacaggguuuuucuggccuggaacucccucuguagacuaggccagccuuuaccuccugaaugcugggcuuaaacgcauuugccaccaugccuggcuccaaaauucauguuaucuuuaaaauauauaauaguuauuucagugugugggugugugugugugagagagaaagagaguauuuguguguauaugccuguguuucucuguguguauguaugcccccucuucuccccacucuucccuccccucucuccccuccucccucuucucucucucucucucucucucucucucucucucucucucucucucucucuucucucucucccauaucacacguauggaagccagaaggugauuuguaggaauugacugaccuuagaaugucaugcauaaugacagcauuucaccugcugagcuaucucacaggcccaaacuagagugucuaccauauuuuccagcauugugcucuuggaucaucagcugaacuccuugucuggcuauguguaugacgauguugaagugaauaucucaguguagaacuuucccugcuuccugggucauuucuucaggagcuuccugaggugugguuaagcacaacuccaugccaagcccuccuggagcaacuuuccuaacugcuauaguagaggcuaagugccgccucagugugccucacuacaguuacccccagaaauaaagcugcacuggaagucuguauuugaaggcauguugagggcugaagaugaagcccauuuggcagaauguuugaauggcaugcacagagcucuggguuugauccccagcacugcacaaauuguuaagcccaauccucaguuagcagaggcaggaggaucacaaauucaggaccauacuuggcuacuuagagaguaccaagaggguuggaaagauggcucagcaguuuaaagcacuaguugcucuucuagagaaccuagguucaauuuccagcacccacaugacagcucagaacucuauaacuccaguuccgagagcucugauauccucauauguaugcacaugcaggcauaacaucaaagcacauuuaaagaaaauguguuuaaagaaaagaauuccagaaaaauuuucuuaccuuuagaauguuuccaguuuugcuuugagacaaagucucauuaaguuacccaggcaagccuucaguucauaguccucuaaccuccaucuaacuaggaguucaaggccaggccaccaggccuagauuauuucuguuauggcuuucuguaauuucccccuauuauucccuccucuuaauuuuguuugaaagaauuuaauuuuuuuaaacaauaauuuuuauaccaaaccuuucucucugaaagauuucccuuuuccauucccuucuuucuaaucuuauaaagugguuguguaaguaucaaauuccagaaacaaaaacaaacaaacaaaaauuccagaaacaacgagaugaacugguaagaccuugagcugagcuggacaggacuggaugccgccaccucuggcacagcugccuugucuaugugagcuucugccacuggacuuugugagccuuagcguauuuagucaacccccaaaugaguaggacacaacuaccuugaagcuauagucauuauccuaugguagccuaugguuuuauguuuaaaauacgucuuuucuucaguggucuaaaauuuacuuaaucuauggugugaggcaugaguagcaagcaauuacuucaaaguguuccauuuuuguuuguuuguuuuuguuuuucgagacaggguuucucuguauaguccuggcuguccuagaacucacuuuguagaccaggcuggcuucaaacucagaaauccuccugucucugccuccugagugcugggauuaaaggcuugcgccacuaugccccggcuguuuguuuuguuuuuaagcuccuaauaaggagagguuuguaucuuuuuuguuuagacuuguuuacuuuauguaugagggcucuaucugcauguacaccuacauuccaguagagggcaucagagcccauuauagauggcugugagccaccagugguugcugaauucagguucucuggaagagcagucagugcucuuaaccacugagccuucucgccagccccuaaaguacagguauuugcagagaccagaaagaagcaagagacugcagagaugggagaaaagguggccuuuggcacacuugaaccagccugaaucagaacccaaaaagcugguaauuggacaggggauguagcuuagcugguagaguggccuagcauacaugaagcccuggguucgauuuccagcgcugcacaaguugggcacagugcuguagauuacugucuguaacuucagagguggaagcaggaaggucaggaguucgagaucauucuugauauaaugagcucgaggacagucuagggcgacuugagguucugucucaaaaacacaaaacaaaaggugugucuuaaggacacaggcugaaggacagcugagagagaggcuuguggggggugggggguagcugaguacgagcugacuuagagugggagcauguggccagcagagcucuaucacaggggcuccaagaccaaggccauaaaggaacugagugaaugaaggccagggaugcuucauguccuggagggaggccuccuuguaaucugcauuuucaggucagagcagagauccugacgacguaugcccucuguggauucgccaacuucagcuccauuggcaucaugcuggggggucugagugagucccgggcugggcagcucccaggggacaggagaacuccaggggaggguggggaggguuggugggacaauaugcagaguaaaggguggaggucacagguaaauggaggacagacacccucaccgcagccccuuucugcucccuuccccgcucccuacauacacacacacacacacacacacacacacacucaaaaaaaaugugaguuuucuggcuuaccucugcuucucacuaugcucucacagccggccagggagaggaaggucccucaugaacguggcucugcaugcaugggcacagcagccuuucaggguagagaaaaaugaggugauggccaggaagggucuuggccuggaccuaguccuugauuugccacauuggggacucaucuuccuagcugggcauagugacauacauccacaaccccuucauccagaagaaugaaaucagagaauccugacucaaagccaaggcugggcuguaugagaccuugucacaaaccaaacaauagcacacacuccaagggcugggguguagcucaguugcuagagcuugcucuacaugcucaggguccuguguuuuaucuccaguaccacguagacugggcacaguggcucaugccugaaaucucaacauuuggagcaucugggagcagcaggaagaucaggaauuuaaagucauucuugacuacaugggggaaguucaaggccagcuugggcugugugagacccugaugagagagagagagagagagaacuucuaucuuuccuccugcuacagugggugauggugaagaggacauaauuggaugcugggccagagagcaaagccaggagggcagugccagggcuucaggaaaugggcaaagggguggguggcuuccuuggcccuaagcucucuugcaccccggcagccuccauggucccccagcggaggagugacuucucccagauugugcuacgggcacugaucacaggggccuucgugucccugguaaacgccuguguggcaggugagugcugugcagcggccucagaauuccgaccccuugcuuucuacccccucucaggcagugcuggcuccugagccaacucuccagguuguuuccuuccacagggauccucuaugugccccggggggucgagguggacugcaugucucuucugaaccaaacugucagcagcagcagcuuugagguuuaccugugcugucgccaagucuuccaaaagugagugccugccugggcuguaugugagagucauagagcaaaaaacccaaguacccucuugcuuuuggcacuaggagccaggguaccuggguacgaaugucauggcugcagcagccuugaccaagagaggaagaaauaaaggcuuaaagacaaaggcuggggaggaaagguagacuagagauguggagugacuuucccagggcugcacagccuauuaauugcuauagaagcagccuggauaguguacugcuuucuuuucagcaccagcuuggaguuuggccaagaggcacugcacaacugcugucgauuuuacaaucacacagucugcacguagcugggaccaaauaucuuccuaaccucaaggcucauccauccuggauaaggccaugggacucaccacgacuuccaucccacagcugggaaaaggcgcugcagugaaugacagacgccucacacccuggucccguugcugcuccccauguccuaccucuccaaguguggguucccagugucuagucggcccccucgcccucugagagcagacauucugguccucucuauuccucuuucuuugggacccucaugugcaccugcccaaagccuccucccugcucccuuccaagcaccggacuugcugggugcccccagaagcugucucuagagaccuucuuccgcccagucuccaagagugcuuuccaccccaguguccuguggggcaccaucucauuaggugugaugucagaguggcccaggcuccacucugacucgguaaaguuugaugcgagcuugguggguuuguugauguucuagaugggucucauguagcuccuucuagcauugaccuuacucuguagcugaggucacccuauuccucuguccucccgccgucaccccugagugucaggaguacaggugcgcacuaucacacugcggccauaaggacuucuuguuugggcuguugagagaucucaguggguaaaggcaucugcugcuaacuugaugaacugacucugaugccuggacccccaaggugaaagagggaagccaucucugcaugcuguccucugaccucuacauaugugcguggcacaugcucugccccucccaacuaaaaauaaaguauaacuuaaaaccuuuac

SEQ ID NO: 3906 - RNA, 510 nt, Mus musculus
guuuguguucaccggcaagauggcggugguacugaccuuccgcuggcuguugacucuccccagggcugcgcgggguuucaggguucgaguguugccgagcggggaaaagaucacgcauaccggccagguguaugaugaaaaagacuacaggaggauucguuuuguagaucgucagaaagaggugaaugagaacuuugccauugauuugauagcacaacagccugugaaugagguggaccaucguaucauagccugcgauggaggcgguggugcccugggccacccuaagguguacauaaacuuggacaaagaaacaaaaacggggacauguggcuacugcggccugcaguucaagcagcaccaucacuaguaggggcuguguccugguccucugacuccuguggaacaucuccacgcuggguguucugugugaguucacugcucuaugaauggugucccuuguuuugaauaaaggaugcucccaccaugauuaaaaaaaaaaaaaaaguu

SEQ ID NO: 3907 - RNA, 122757 nt, Mus musculus
uggggaagguacggaucugucuuuggucucuagcuagccuccuuuccucagccccacccugcuauugacaucaagcucaaggaucccuaagacaaagcagggccgcugugagccaguccgcgaggggagggccggggcuuccuggagcuucacuagcaaggucacuguggaguugucaaggccagacuuuuggugggcggagagaagagccuuagacuuguacgugcaucuuggcuaaaggcaauuucucuagggauccagcuaccagcugaaaaaaaacaaaacaaaacaaaaaaaaacaaaacaaaaaaucuacccucuaagacugcuaguugaaaacaccacagacuggguggaauaacgggugucaguacaaaaacuuuuccuguuuuucaagacaccuuggaggagccagucauauuuuuauaggacagcgugcuuuaacuugacaaaggagccgcgugccaaaggccagaaaagagaaccaguuucuaaagcugcuccagccuuauccgcuccggaagccgcccuguauccuccuuugguggcgaagaucgaugcucaaggacguugcagcugccacagggaccaagcaccugugucugucacagcagggacuucagcccggagcacaucuccgggucuuaacaguagccaguccgcgggcaggagucucagccacucagggucgcacccgggugcguguaggaaagguguggacugaggaaaggaagcuacgucccggucccgccagggucccgguggaccuagagagcaaagaagggcgggaaggcccucgaaguggcuggcucuggguaucagaugcacacccaggggcgucgcccuccaguuucagcuaccgagagguuaagagacucaucuggagucacacagcuagcuaucugguagcacuuggggggcugcaguucugaucccugcuggacggacgcacaacucuucauuugguucggauccuugggacugucgaaccuggaaucguccuuugguuaagaggaccggcuuucccuaaccaacuucgaaauauugcagucccacaggucugagugcaaccagaggcgugacgugccaggucuuggagcaagggcuaucccugguaauaacgccugggaccuggaguguaguuccccauggacuucggaacgcuucggacugagguccuuccaacuggucucuuaacggacgauagcuccaaaucucaaacacagugaccugacagugaacgaacucgguagccccugaagcagaauggcucuguauccuucagcaaguccuuuccuuucuccggacgggcuggcuaggugccccugcggucgcggccgcgcaugcucuuggacgggcgguacagggagcgggcggcgggcgccccagcugcuuugcauugacgccagcagccgcuggaggucaccgcugggggcugggcgcggcgaguugcccgcaagacgcgguccggagcacggagcgggagucucggaugcucaacuccuggcucgcgcagccgccucggcgcuucucgacggcgcggcccgaccggagucgaggcgcucgcuccgucagcgagcggguccccagcucggagugcgggcgccgagggcugggcuccccuacgguagcccgacuaggggcgcucacccagccguccgccgggccgaggagaggcaccgccaggcgagcgagcgcccguuuccucgagagucagacgaggcgagggcggcggugcaaacgcggcgcgggcucgcggcucccgguggcgagagcgcaaaucuccacccccgacauuuccccggaagcgcggcggcugcggcgcgcgcggcgaugugagggagacagcggcggcucccgccucaggaagggcauguucggaggggcguccgcggcgcgccucucgccccagcgcccccuccccacggccgccgcgcccgcagcgcaauaaaaggggcggccgcgcuuccugacgcgagacccgcgcuugccgccgccgcccacccgccugcccgcccgcccgcucaggccgcgaugacacggcgcccgcggcggccccgaggcgccgggcgggccguuugcugaccggaucgcggcugcccgccagcgaguccgcggugccgccgccgccaguaugggcugcgccccgagcauccacacuuccgaaaaccgaacguuuagccacagcgacggcgaggacgaggacguggacguggacgucccgggccccgcgccgagaucuauucagcgauggucgaccgcgcccgggcucguggagccucagccucgggauaacggcgccucgaaggugagccgcacugggagggcggggaaacaaacgcggggcacugggggcccucuaggcagccgcccuggcguugaccgacgccagccgcccgcguuugcgggcugucgcggaccgaggcuuaacagggcuaugacgcggcgccgcgggauccgccguguccguuccuucccggccggggucggacgcggcgagucaguuuucucccagcggggugggugggggacccgggauauccccggcacguuccugacaugguaaaccagagugcacuuugcucuggcauucccagaguagaaaggcaaggguuguccgcacugggaagggucuuagaugccaccaguucccccccccccucacccccugccuagcuuaucccaaccucuguccucucauugcacaagcaguuucacuuuuccacuuuuuugggggccauugaaauguaaccuggaacauagguuuggcuucacugcacgcuuuaucugaaguucagguuuguuagcauacgugugguauuuaaagccuguguaauuagaaaauacuacuggagacgugaccgugacccucgaaggauucagcagggcgaaguuaauuuuguauggaggcagucugccugggacuugcaggguuuucuguuuuguuguuuguugcguggcuucuccagcgccuuuugccucagcuuuuaucaaaaguuuccagggcgaagguuuucugaaggaaagauaaaaguucacagaggcacccgcagcagcuucccacuuacauuugggauuuuggagugacaucucaggcguuguaaaacaaacugguaugcugggcugcaguguuugaacauagacuccucuuuacuaggaaguuuuaaguauuuugcaauuuuuaaaaauugcuuacuggguacugcacacccucccagauuugaacgauguaguugacuuacuuaacugucuuaacuuucuagcagucauagaaauaauccuuuuuuguuggaaagagacgauguuguucagcuuugcacacuggagugcuuacccugcccuaccaauugcucuaagugaaaauucaacuguguucugauuauucucaguugaauucuuucuccugggguuucuuuaaagaaaccugugauggcuagaguuuagaaggcuaggccaaacugcuuuuaauggcuuauauaacuaagucuuaacaggcuuacaaacaagcaagacacuauagauaaaguugaaugugggaaccuuaacaacugucacauuucuuacccaaaucuaacauuguuuucuuuuucauuagccaauauuaaauuccaaagccaucuuucuucagugagacaccuuucuucuuacaggccuuuuugugguggcuuagacuuccuauuaggcguccuguaaaccucuccugugcagcaguccaccucugccauccacagguccuauccccgaguacugcugugcccacagaucuuuucuugucaggacguagacagugcguccaaccucacaguguccaaccucauggcaggcacagacuaggugcuaaagaucuguuggcuuuauuuuauuuuauuuuauuuuauuuauuuauuuauuuauuuuuacuguuuacucguucauacuucugucugugcuauuuguguccauagaacauuuaagauagacuuaaagauaauauuaacaucuacagaggaggagucaaauuacaaauuacaguagcacagucaauagaaaugaaagucccucccauacuuuuaucugugaguuguuccuagugcuaccacaucucaguuacaggucagugaauuuaggcuuagagcagagcuaaucacaguuuuucuuugguuccguuuuuuuuuuuuuuuaauuaagauauaaaugugcucuggaaauuggaaaauacauauuagagaagaaaagcuuuggcaagaucaaauugcaaguaauuugcuucuuuauuaaugaaugucuuaggagccuauucuagcucauuaacaauuccuggagcugggaggagcugggaggagcugggaggagcugggaggagcugggaggagcugggaggagccaggagacagcuuggaugauagcaucaugccugucaggcaagaaugaggaccuaguauggauucccaauacccacauggaagcuggcugguccacagcccuaguguuggggcuacaggcagaucuccugagccugcugcccugauggccuacgcagucagugagcucuggguucagugagagaccuugccucaaaaccaaaguagacaaccauagagguggccuuccugccucuauguaggcaugcaagcauaugagugugucuacauguguguguguguguucuuuaaaaugcgguaauucuggguacucuugagaauuuaaacaagacagucaggggaggaagucuuauaucccuauagcauacaauaaagaguuccucaaaguugcugaaagacuggugauuaaauacauuucagauugagcaguguaugguuuacacugugauauaguucauguguucuguguagcaaucuguggacuuauuaauagguguuaaugaauaaagggcccuaugaucaaaucaguuggaggaauauuggcuggaucagcaaagccccuccuaccuccccccucccugguuuuuucuuuuuucucuuugguacaguguuuugcuguguuacccacaguggccuggaacuugggguccugcugacauagcuucccaccuuucugugaucaccaggugguggcccgagucuucacuugggaagcagaggcagguggaucugugaguuuguggccaacuuggucuagaguuccaggacagucaaagcuauacacaaaaaaaaugcugucuugaaaacaacacuuuauaacucuaguaauaugucuugugaucuuccagaagguguuuagaguugcauuuccuagaccucuuugaguauccacuccuuucuuuggguucuguugcaggcaaaccaugguaggcucugaguccuucuaugggauaacaauauucaagguacagaaauaggcuuaacaguagaauucaacaaauacgauuuaguucuuaauuccaaaggcaguuuaagaucugguaauacacuaggguggugaguguaugaaccuauuuaaguacuacugaaaauacucuggcuguuuguuuauccaggcguuauauagccugugugguuacagauaaugaaugcuguguucaacuugaacacuuacgcuuuuauuuuuaaucggugugaguuucaaccaacauuucaauauugucuugucaguuuuuagauugacucaguuucgccucuccuuagcugggacuugaggucccuuugaaacauuugugcauggggaaaggagagauagagaucuauuccuagacacccagugggcuacugcugcugggcgccucugcucucagccgucuucaucagcccugugguggucagucuguuugcugucucucuuaggccuuccagaaacaguuguugaauuauaggauugagugaaacaggcuguagaagugcaaaauauuuccuguucauguaaaggaaccaguuuuaaccagauuggaggcugugaaguucagauugcuuuugugggagucucugguuauuguuccacagagaguuuuucccaggggauaaaauauauccaugcuaaugagcauuguugguuuuuguuuuuguuuuuguuuuuguuuuguuuguuugagauagggucuuacuauguagcccuggcuguccuagaacucaccauguagaucaggcugucuuugaacucgcagagguucaccugccuccuccucuugagugcuggaaucaaggguguguaucaccgcccuuggcugcauguugguuuuuacagguguacggacagugugcagacuaugcagcugcacacucacuaugaccaaacguuagugucaccaucagagauccugcaggagccgcaggugugcuccucugagucuccauuucuccucuugcuuuccucugaccuucccugucuuuucccucuccacagucaucuuguguguguguguguguauguguguguguguguaaauacaauacuuacucucauuaccaccauaaauuuacguguaauucuuacagagauauuauaucagaauucuaccagcuucccugagucaaccuugaccuuuuucauacucaaguaaagguuaugauggggccuguggucccaucuggcacuuccacccccuugaaauggucugggaacacuggcucucccuuacaugauuggcucauugggauugagcacugaaccagggagagguucaugaugugaggcugaaucucagaauaaccucuaaaggacagaguauuucagaaaguuaaaacaacaaauacaauuaaagggcagaaguuaggauaggaguaagccucagucuggcccgagguccauggcuucucaguggagugagauagauaaugaggcaagggacucguucuuagagugcaggccauuucuguuaauaacccuugccauuucuuggaugcgcuucucuuuguaagccuuguacuagauguguuauagaugauaucuccuuuaaucccugcaaccuugugagagggcucaugcuauuuucucuuuugcagauaagguacaagagguuugagacucacccagggccauaaaaucaagcugggaucagaacacauuauucuuggcucucaacuucuagacuguugcucucuuaacgccuauuucauccccaccccaugggcugggggucaaacaacccuuuuacaagggucaccugagaccguuggaaaacacagauauuuacauuauaauucauaacaguagcaaaaucacaguuaugaaguggcagcaaaaauaauuuuguggcucugucaccucaacaugaggaacugcauuaaagggcugcagcauucauuaggaagguuggggaccacugcauuaggcuauaaaugaauugagucacuuuuuuuuuuaauaaaagaucauuuauuuaauguguuguaagcuacugauauggauggcuaggaacugaaccuggauccuuugaaagauccugaguucuuagccacuuagccaucucuccggccccagucaccugaguuuuaaucagguguccugaauuucuauuaucaugauguuguuaggccuucacuuacugaggaagguggcuaugguccuacuaaguuccuguguuuguggaaguuguccagugcggucccagcuguuuacaaaagcagcccuccuuucucuaguuuguccucuuugcugucugaaaccaguggacagagucccuaaggacucuuucccuucccccugcucaggcuacagaagccuuccuuagccucuccccuggagcugcguguucccuuugaccuuugccuugugugcucuuccucccgcuugcacguaggucuccucccagaguuacuccagguccaaccgaaaggucucuugagcccccagcagggcuugcccuguaaaggccuuugccuggaguaugggcugcuugaggacaagggcgguguccgcuaagcugggcauauaggacuuuuucuucacauucccugcaucaaucucaucuuacuuaaaguuuacaaaaauuguuagggugugucgcacgugucuuaacaaaaagccaaaauacccuugagcuggugauuaaucugucagguuauucguaaagcuuuuucuccaguuucagccauguucaaguugagcaauguuucugggucuccuccuguuguacuuuuguucugcucgguuugguaggaagugguggaauaucauguuagaguauuguuuugacaaguuugauguugcuguuucucagcuacaggcaugaaaaguagucugcccauccacccauacaggaaggauguugcaaauuucccugagcuuuggugugacuucagaggccucagguggggggcucaacaguccucugacucugucuggcuuggaaacauaacuucauguuccuccagguccucugcuuucacucuguucaccuccuacaugacggcugcagcuccuuccuauugcuagugggauagcccagagcaucucucgugcaguccucaagguguuuggaguugaugacagcucccagggaggugguguugaaagaguauaggaggagaagcuagagacauggcgcugacauccacuucaucaggaaucaguuuucauuuucuccacugcuaggagauuagagagggauaaggacauagcuccauaggaaggcaauugucuagccuguggcaggaucuagguucagucuccagcaacucuucucacacacagauaaaagaaaaagcaaggagucaagaauacaugcugacuuggggcuuccauugcugugaagagacacuauuaccaaggcaacucuuacaaaggacagcauuucauugaggcuggcuuacaaauucagagguucaguccguuaucaucaagccaggaagcaugacaguauucaggcaggcauggcauugaggagcugagaguucuacaucuucaucuaaagggagccaggaacagacugucuuccaggaagcuaggagaagggucucgaggcccaccccucacagugacacacuucuuccaacaaggccacaucuccugauagugccacucucugggccaaguguauucauaccaccguacuugccuuguggugagauuacuuaacaucuuugaaaguguuuuauuauagcguguaaggacuauuuucauuuuucucuccucugucauugcaggugaucaaaccuaggacuuuguacaugcuaagacagaucucccccuuuuaauuauaauaagaguugaauaguugcauacacacacacacacacacacacacauacacacacacacacacacacacacacacacacacuucuuuuauuuauuuacauuccaauuguugccccccuugcucccccuccacaguuuuuuaucccauucuuccuuccccuugccucucccuuccuuggaacaucaagucucucaaggauuaagcauagcuucucccacugaagccagaucaggcagaccucugccagauacgugcuggggccucagccuggccuguguaugcaccugguuaguaguuuugucucugagagcucccugggguccagauuaguuaagacugcuggucuuccuauggggucgcccuccccuuuagcuucuucaauccuuucccuaauucaaccauagggguccucgacuuucgucuaaugguuagguacaaguuucugcuucugucucagucagcugcugguagggcagcaaaaacauuuuuuaaaauuucuuguguguguguguguguguguguguguguguuucugcauacauggaaugcauguggaggucagaggacaguuugugguuauugauauguuuuucuaccaugucaaucccagggacuaagcuuagguagucaggcuuggcagcaagugccuuuaccuacugagacacaggcagaugaauuguucucucucuuucuuuuuuaaaaauuuauuuagacuggaaguggugauguacaccuuuaauccuggcauuuuagaugcagaggcagagguaggcauaucucugggaguucaaggcuagccaggucuacauagugaauuacaggucaaccagugcacacacauaaugagacccugucucaggaguaauuuuuuaaaaauuauguauaugugugugucugugugcaccugagugcagguauaagaggcagccagagguauuggauccuuucgagcuguaguugcagguaguugugagccaccugacauaggugauaggaacugaacuuggguccuugcaagaacaguacuugaucuuaguuacugagccauuuuaccagcccuuucuuaacuacaccuuccuuuuuuccuucuuuucuuccucccucccuuccucccucccucccuuuuuuuuuuuuuuuuuuuuuuuuuuugacgguugagugucacuguuauuugcccuuugguccuuuaucuucuaagcucauauacauucuuuaagugguauuaaacauuuauuuugaucacagaugcaauccaagcaagaauaaauaaacucaguauauuuuccacccucugagucucuuuuaaauagaaaaaugugcuaaaugucucuucauggcccgcuuggccgugaagucccaccuaaggcuuuaaacagacuguaacuugaucuucugaaacccuacugaacgacaguccgccugguuccaggaauccugggaaccaaguccuacugauacugucgguggucuccaaacagugaggauggcaacuggcuggaaggcaacugggagugaucuucagcgaauugagggccauugggaaacugugcagaggcaaaucuugucagcaagauaccagcuccuucaauuaaagcuaggagaauggcgcccauugcagcggacccaaccauggcuaccgguccauuucuugcugccaggauggcuccuguuaaggcaccgcuagugauggaguuccaggggucuucuuugccucguauuugaaccauacugcagucaaucguggaaaacaauccuccccaaacugcaaagcuaccucccaacuguggaguccugguuuuaauagcugucaaacucccucggagucugugguuuauucccacuggagaauuucgaaaaccuuugaaggccuggaagaugccgccaccuauggugcccauaaacguacugccacagucauccacaauuugccaggggcacggcucucucacguauuccuccaucuuggcuccaaccuaccccuauuuuuuaaagauuauauguauguauguauauauauauguacaccauugcucacuucagacacaccagaagagggcaucagaucccauuacagaugguugugagucaccaugugguugcugggaauugaacucaggaccucuagaacagucggugcucuuaauugcugagccaucucuccagcccauacuccaccuuuuuuaaagacuauauuuuuucuuuaaaaaaaagauugauuuuuauuuuuguguguguagauauuuugccaggauaucugucuguacaccauuugugugcagugacuguagaugccagaagaagguguuagagcuucugguacuggaauuacaguuguuagccacuguuugggugcugggaauugaaucugggauaugugugugugugugugugugugugugugugugugugaugcauaucuccaggaagggaagguuucaguaaacaaguuacauaaggcuuuuuuuuuuuaaauuagguauuuuccucauuuacauuuccaaugcuaucccaaaagccccccauacccucccccccacuccccuaccaacccacucccacuuuuuggcccuggcguuccccuguacuggggcauauaaaguuugcaaguccaaugggccucucuuuccagugauggccgacuaggccaucuuuugauacauaugcagcuagagucaagagcuccgggguacugguuaguucauaauuuuguuccaccuauaggguugcagaucucuuuagcuccuuggauacuuucucuagcuccuccauugggggcccugugauccauccaauagcugacugugagcauccacuucuguguuugcuaggcccccggcguagucucacuagagacagcuauaucaggguucuaucagcaaaaucuugcuagcguaugcaauggugucagcauuuggaggcugauuaugggauggaucccuggauaugguagucucuagaugguccaggcauuuuuaaugaaggaaaaguugcuaaaauucaacuaacuuaaaaauacagaucucaucaaaggagaaugaaaagcaggccacugacucaaaguuauuugaguuauuguaucaauaaaggauuaguauucaaaauauguauggaauuuuuccaguaagaaaagacagcuauuuugaaguggaaacuucugguuucuuuggaaagucaguuauaucaaaugauguuuugcuggggcauacaccugaaaggauguuugcuaaagcagacacauaaaaggaugucuuccugaagcagacgcaggugaagggauguuuugcugaaguggacacgugaaagcacacgugaugugaugagggaauguaaaugugaccccacagacugugggagcuggaacacugguuugcugugcuccaccuuacuauucuucauuaacuacacacauguauugguuugccauacguugcuauugcugagcucugcuugucaagccagaaacucaccaaagaacuucuugugagguuccugcggcuucuugccgacuccuuggccuugggccaguuggugagccuuguggcuucuucaggauugaauugcugcugucgcugguuugugcauggugucugccugcagagaggccuggacuacagccgccgauuagcauuugguguuugcuacaagacucagcugcugauauccugacaacagagauugaguucucccacaaagagcucuauacccauaaguuuccauaugcuggaucauauggugauucuucguuuuuaaagguaccaccuuuaaauaaaugcauauugcuuuguauuauauuuuuucaucguauaaucugcauauuuauguuucauuaauuuaucaaaauagcauuuacugucuauaucauauuuuacuaauauccucuauaauuucauaaaugucuugcauugcaucugcuuacgauucuuuacuccuuuaaucuggaacauauaccuauucuucuuaaggagacccuaucagucaugccuugaguuaucauuuaucuuuuauucuaccuucuguaauuauuuuuuuuagaaacuuuuucuaauuauuuaugugugcaguauauguacaugugugugugcugcugugcaaggcugugugugagcagacuugcucugaauacugagucauuccaucaacgaaaggccuuucuuugaaucuggagcuugcuucuuuuagcuaggcuggcaaccagcaaguccaagcaaucuuccugucccugccccacacagcgggucuuacagcaugugugagaccauuccuagcuuauaguggguacugggaccugaauuuggauccucauaguuggcacagcaaguucucuaaccacugaguucucuuuuuagucccauacuucugcauuucuuauaaauuggaaguuguaucuaaaauagguuuagguuaaauauuuuguuuagacuauauuguugguacuucaugaauuauaucagaaggcaaaaucugauugagccaguguuauagaugcucagucuggguggcuucgaauagcugcuauguaucaucuacuauugaguccuguuccucuucugguuuguauaacugccccaguggugucuggugcucuggagaagugauaggcccuguaggagguaagcauuuaggaggaaggucggugggugagggcgugcccuugaaggagguauuggaccucggccucccuuuucuccucuguucauuuugucucucggcugccugaggugacccgugugcucuuccucugccaccacccaugcacugccuucccccuaaccuacgagaaguagugccaacuggccaugaauggcagccuuucaaaccauaagccaaaguaauccuucaaccugaagcguuguuuguuucaaggguuuugucacaguugcaguuggcacugugugaauguccucacuagcuccucaucuguggcuucucccuuuucuuuaagaagggauugauaaucucuuaucaaaaguaauucugguuagaguucaugagugauguuucuuuaauucaguuacuuuucuaaguacagauuuuucuuuuuuauauuuuauuuguguauauauauuacauacaauauucaugccaguacgaccucuuacuuuuccuaugugcacauagacauuguaaauuaaacuaaugucguuguuuuggugcugggaaggcuugaaguacucuaccacugagcugugucaccagaucuagauguaacauuugaguaaauacuuacgcauggcuuuaugucuuggcuuuaaaauuuagcaauaaauugcagcuauuucuuguaccauuauuucuuuuaaagcauaacucaugauacugacacugucaugaaugucuuuucauagcuaugguccuuuucuuggauuuauucuuuuuuguuguuguuguuguuguuguuguuuugagacaggguuucucuguguagcccuggcuguccuggaacucagaaauccgccugccucugccucccaagugcugggaauuaaaggcgugcgccaccacugccuggcucuuuuuuuuuuuuuuuuuuaagauuuauuuauuucauguuugugguuauaccaucacugucuucagacacaccagaagagugcaucagaucccauuacagaugguugugagccaccaugugguugcugggaauugaacucaggaucucuggaagggcagucagugcucuuaauugcuaaaccaucuuucuagcccccucuuggaucuauucuuagauguuucaaucuaucuuaauuucaaaauuaguuuuguuaggucaaauuuuaaaacauuuuggugcagucuaaugaaaaacuuuacauuuuauuuaaaaauaauauuugucaacucaaaugaguuauauuuuauuggauuauuucauuuuuauaagaaauuuauuccuuaguagaaucuuuggcuugaccauauuugagaggaaccugaaacugugaaguguuuagaaucacacauguccagaaucacacugcaugcaaugaggagcugggguaaaaaccucauguuaacauaacacucugccuggugcccccggugcuuuguguguuugugggaaauggaccaagucaguuaucgccucucgucauuucuuuaaaaugucagggauugaggcgaggcacaugaggucaggcacaggugcucugcacuggcacccauggaucacuucaccgaggcacauggaggcacgccugucucaucucaggcucagagguuuaaacucugcuguuguucuguggcuaacacaucucgggagcaaucaaguagcccaguuacuagaauuccuaagcuuaaauaucuucauuuccauuuuccuggaaaguauaugaaauacuuuaaaugaauuaaagaccuguacauauaccuguuuauuuauuuacuuuuuuaauguauauuuuauagagaguguugaaauugucgcacagugaagauuaugcuauauaaucaucauucauaaaguacuugacuaguuuaauugcuuuaacauuuuucaauaaaaauggcaguuuuauucacuuuucuucuuuaagccuuugugcuaugucuuuugguguucuaggguuacacaacagggucuugaauggucacuagguucagaugaggugagcuggaguaaaacuucgcuuggcaauaaaaaugacagaccugguagucuggcaggauuuuuauaggcucagaagaccuucugcaggccuugauagcugacuacgagaguagaauauagccguuuccaguaauggaaacuagcacuucgguuagacagugcucuccagugagguuaguuuuuggagacuaagaacuagaaagggcagauggcuggcaagcucacaaucaccuguaauguacacugaccugacaccuucuucuggugugucagaagacagcuacaguguacuaccuauuauaauaauaaauaaauauuugggccggagcaagcagggacugagcgagcagaguugacugaagcaagcagagguccuaaaaauucaauuucuaacaaccacaugaaggcucacaaccaucuaugcagcuauaguguacucacauacauaaaauaauaaauaaaucuuaaaaaaaagacaaaguaagggcuugaacucuauuguaggcuuuuucuucccacuucaucucugguuucauaaauuuucauauagggaggucacuaauuuuguuauuaucuucuuauucuuugacauaauacauuccaccaccacuccaccccaccccccaaauaggccagguacuguccuaggucuuuuuuuuuuuuuuuuuuugagacaggguuucucuguguagcucuggcuguccuagaacucacucuguagaccuggcuggcccugaacuaacagagauccuccugccucugccuccugacugcugggauuaaaggugugggcuacucugcacucuauuuuuuuuuuuuuaaaguuugaagaugaauagcauacucagcucagaagacagguuugccucucccugguucugcacuguguguucauaaaucugaacauacucuugucacuguggucaaaaaaggcaggugagggggcuggagagauggcucagcgguuaagagcucuucagaaggucuuuaguucaaaucccagcaaccacaugauagcucacaaccauccguaaugaagucugaugcccucuucugggaugucugaggacagcuacaguguacuuacauguaauaaauaaguaaaucuuaaaaaaaaaaaaaggcagauaagguggaguuggaguugaguuuuggacuuggcuauuuaacuguaggcuggacaaaagcaugcaauucuuuugugagccauaauuuccuguauuaagacgcaguaugagagaguguauguggacauaccucugaucugcuacgcuccauaaagcugcagacguuuaucugugugcguaauccaccguuguugaccagagagucaguggagaaagaugcucuacugugaccccuuuagugcugcugaacauucugauaauggaaauguaaacaaggaugugcugggguuuggccuguaaaccaaaaaaaucauuuucaaugccaacaacuauguuagccuggagaugccaaagcuguuuguguggugcaggauaacuucaggccccaccggcaagcucugaguggucacguggguuugggucaggcucauuuguuuauggagucaguuucauugugaccuccuggcguggagguggucuuuggucagggcaggugagaacugaguguuucuaucagugugaagacccucagaaaucagaaugauguaccuguccugcauccaggacccuagcaggccuccgagugugucuguccugugaguugugccugacauuucccugccaggcugauuuggagccaguaguuucucaaugguggcagugaaggccauccuccuuucuugaccaccauggaauaagcagauuuuacuggaauacuucugucuuguaacagaccuaaaagcaacugagucagcugaccauggacucaauccuagaacggaaucaacuuuaauaccuccuucaucaagguguuuuuuuaucuguguuuugauacagugacaggaaaaccaacaagggcauagcagcucuugcuccagugauguaagguguaccaccuucuggacuuauggaugcauucuguuugaauaacuuagaaggaugcuccgagaaugacauuacucauacauacauggggcugaagaaggagcugaggguucuauaucuggaucuuugggcugcaaaaagaaccaaacacugguccuggcuugagcuuuugaaaccucaaaacccacccccaauggccccacccuuccuucaacaaggucccaccuaaucuucaaguagugccacucccugaugacuaagccuucaaaucuauuagccugugggggccauucuuagucagucuccccucuucucucccccucccccucccccucccccucccccucuccucuccucuccucuccucuccucuccucuccucuccucuccucucccucucccucucccucucccucucccauuccucuccgagaggagcuugaacauuucaacccuuuagucacauguuuguuuccccaggcaacuagcuccuugucuaagggcuuuucauaagucaucucucuaacauaaaaucagguguaaucguaagaggaucauuaugaauaacacaaaacauuucuuauaccuuuauuuuuauuuuuaauuuguaucaaacugggacacacacucguaucccagcuaggcuuuaguuuaggacuuccuaccucagcguccugagugcuggaauuauaggucuucuugccucaucuaacuuuuugccuuugcuuuaauuuuccuggagcugcuccagagcuguugcaggacaaaagaccaaccaaauauaacaaaagcuguaagccagcgacugaccgcgcucauuucucauuauaccacagcuauacuuugcugugucuguauuuuucacuugacuuuuuugagcuuugugagauauaucacaaauauuuuuugucauguuuugagacuguuuccagaucacagucaucucucauuaugaaagggcauugguuccaacaccuuagauagcagguuugggaauguucaagguccuuguguguguauucccccauacacuuuaaaucauucguaggugacuuacaucuaauacaguguaagugcugugcaaauaguuauuauuugccuagggaguaacaacaagaaagagaagucugcacguguuuaguacagguacauuuuuuuucauguauuuccuauccaugguuguuuaaauuugcaaguuuagagccuacagauauaggaaguaccaacuguaaaauggucaggauuuuucugaaugcuagugaggccaaaggaggaacuugugugccacuguagccuggcuuaaguaacugaacgaagggaaagcuauggugugcuggccuuagccuauggugugauaucuucugccuucuacacuugccuuauguuauucaacaggcagugaggccggcucacuuguuuuucauagcuuuaauaauggaaggccucucuuuuuuucuuaauuccagauugaaaauuccucaggaggaaacaagaugagccugccuggcauaacuauuuucaguggccaggagguagccuccaugauuggcagcaguauucuuggaaaguaggcaguuggaaugggaccaccuuacacaggaagaagggaggguuggaggccagagaggccaguguugccuuguauuggggcuuaggccucccagugcuugucagcuaagaauuaauuccacuuuuauaaguaaugaccauuauuccuuauaaugauucugaagcaguuuucauguuguguugcuagagaaacuuuccauuuagucuguuugcuaagagaagaccggauaguaacaagggaaaauuucaucuggguuugacauaaaaggagugugugucccaguuugacuuuucuucuuucuugggaggaccuuaacccuccuaaaacauacucaguuguucucuuccccucccccuucccuucucucuccccacauccuucacacucuccccuggugaguacuguauccucagcccuccuuuuuauuuugagaagagccucacuaagcuggccuugaaccuacuguguagcccaggcaagucuugaacuugugaucuuccucucuuagucucaagaguaucuaggauuacuaggucauuucuucucauuuuaucaguacuuucauaguuacugucugaugcuuuugcauuccaguggcagggucacugcaugcuguguucuaaucuguaaacugucauuuggaacaaauuauccaaucuuaugcaucuuaauuuccuuaccugauaggcugggcugacuguugugauaaaccaaacaaaacacaaaggaaucagcugugagagaaguacccuaaaauuuaauucaugggguccucuuuuuaaaguagcuucaggaauaaaggucccuuuuaucaguuguucaaucaacuucaauacguaggucucaaggucacuucauggacaaacuccacagaauggggaaaacuauggagggucuugggagagagguuuuccagugguggggaaaagucuguggaaugggucuguguuaguuuacucauguuuuguuggucucagucacacuucacaucaccaaaaauuggaaagugcaauuuugucuaguacccaggaaaaggagaagcaggguuugaagggguagcaugcaucauuaaauccacuucaucacaugauaauuugagguuauuucuuuuuuaacuugcaacuacaaguuuccugacugacacagauuauaggaaaaagaucagggagagggaaaggauagauccugguucucccaaguucuacuuccugucccuacuaacauuccuuugauggucuuagagcuugcccaagcaggguuugaacugaggcuaucuuauacuucuccaaacucuggaauuccagguaggauuauggcguccuuuccuccuccuccuccucuuccuccucuuccuccucuucuucuuccucccccucuucuuccucuuccuccucuuccuccuuuuccuucucuucuuccucccccucuuuccuuuucccccucucaaguuuucacaaugacuucucuacaaauugaaugauaugaaguucuuuuuuccuuuuaaaaggucucacauaucccaggcuagccucaaacuaaggguguuuggguucccuguucuaaacuguuuugagugguuugugguauauguugauuuuauagcacauccaacuugagaaaaaaugcuacaugacauuucugaaaggauacugacagaauuauguguuguucguuaaguucauuggaaauaaccugguaaguauguagggacuguugcucaagaagcuugcuugcacaaccaaaagcuguuggcacaacacacagacaacuucauccaccuuuggugacaaauguaaacuguggaaguccagccugacucacuucuaucagaauguggagaacagcagaggggugagagccucaguacagaauggcucuaggcucuaccuagcuuggguucaaacaguuugaagcaacguaaagauuagagaugugggguggggagaggaauaggggagggggcaucagggccaagagaacacaaagguggacugaucagguaagucaggagccagucaguguguggaaaugcaugccacagggauagucaugguugccuggggcuggucacauacuugacuccaagcuucccacagccucaccaaauaagaaaaccaggaguaaguuaggagagcagcuucugggcugaggacuaaaggaaucacuuucuugagcucuuuugaagggacaggauucuuaauguucccuaauuagugugcuggugaggggcugaggaagcagugccaagggcauagaaguuggagcccugcuguugugggagguuugcauugagaugccuuuccacaaacuccugcaagggcuugcaacucuugugcuuucuuggccuaguuggaucuagaucuagaguuuugcacuuuacagaauaucuauuagcuaacuauugagauugaagauugagggaaugagagauaggugggucuaguagaagugaaggaagggccaguaagcauuauuuaaagggaacagauagugaugugcuuaagaaguacaugcccuaaaagguggaacugcccagcccuguuaauuacacacaugacagugaagacugcagaagucagcaaggcagccacagaggccuaucagacaggcaaacagaccugugugcccuuagcagccagcacagugugcugcaggucggggagugcacaggcuuaaauugcuucuccaccugggugcuggcuacacagagguguucaguuuagaagaugcacuguugguacacugacgcucuguacacauugaguggaguguaacaaaaugaaaugguguacauuuuaguuacacaucacuuguuuucacaucccaguuuuaccacuuuauacuugugggauuuuggcaaauuacuuaaccuuucugugcccuagauuuuaguugaggcaaaaaaccaaaauccccaccaucagaggagugcucugaggauugaauaaauugauauucuucaagcacaggaguggugcuuaguaccuacagaauauuccuugaguauuacauguugcuaguuacauucauucauacugguucuuaucuaugagaauacauacacacaaauaccuauauacacauacaauuauguaugaauugcauuagacauuauucuuggauguccugaguguggucaugcagugggaccuguguggguagaaauggucuacaggccacagaauuaaaaacagggaacugugagggagggcugugacucugugugagggaguacugugacccugugugagggggugcuguugucaugugugagggagggcuguggcccugugugagggagugcuauuguccugugugagggagggcuguggcccugagggagggagggcuguggcccugugugagggagggcuuuuguccugugugagggagggcuguuguccugugugagggagugcuguguccuaugugagggagggcuguuguccugugugagggagugcuguggcccugugugagggagugcugugguccugugugagggagggcuguggcccuguuugagggagugcuguguccuaugugagggagggcuguuguccugugugagggagggcuguuguccugugugagggagugcuguguccugugugagggagugcuguuguccugugugagggagggcuguggcccugugugagggagugcuguggcccugugugagggagggcuuuuguccugugugagggagggcuguuguccugugugagggagggcugugcccugugugagggagugcuguggcccugugugagggagggcuguggcccugugugagggagagcugugcccugugugagggagugcuguggcccugugugagggagugcuguggcccugugugagggagggcuguggcccugugugagggagugcuguguccugugugagggagggcuguuguccuaugaaucuugaaguugccuggggagaacuugggguauagaagguaagcaggaggccugaaaucuuuaauggaacaggagacccagaggucaggugacagggugacacuguuggguggucccagaaggcugggauggggguggguggguguugucucuaagcuagaaugggguaacaaggaacauccucuuuggaguaggagucuggaagagauagcuuuggaguccuguuccagaacuuaaaggaagccuauguauguagucgccuagucacuggguugugauguuguaauacugguuaguuacuguuuccaugcuuuuagauuucuagucccagccugcuggcaccugcuguagucagcuuggcucuuugguuccuucuuucuucuugaaccuuggcuagguuugcucucuucuagacacuuuuccccguuguccuccucucccuccacucccaguucagcugguggagguuagagcccuagcuccucacucugcgucuuagccccauuucuaauaacuguaccuuguggcugcacacaucccccugggaacaucuccagccucaccauuccuaugccccugucaucuccggucuccacacauuugagguugucucugaguguuuugcuaacuaauguucugacccuagaccugaaggcugagauccugucaccugacuuggaguuugucccuuuuccugacacuugugcuugaguccuucacuuccaucuucauuccaccccacccuguguauuccauccugccccugucugcuagggcaguggccuuugccgacucuccuugaggccugucaggccacugucuccuggcaucuggccucccuuuacuugcucggguaauuaaguaccugcccacuucagugagccugagagacuacuugggcaugucccccuguuuagccugcccuucuucuucaaaaccucuguccuaacagugaacacacuugagggacacaguuucaguucugcaaaagaaaagagagagccagaaagaggccacagcagguaagggugccuaccgccauucuugaugaccugaauuugaucccuagaacacacuggaaggagagaaccaacucccacaagcuguccugugaacuccacacaugcugggguaggggcacacagacaugucccaccagcaaauguuuauuuuuaaaggaaauguuuuucacacagcuuguucucccuccucauacuuucuguuaguuuuauguuugguuaguaugaggauauucaaagugaagaaggauaggagaguugauugcuaauuuuuauuucauuacuaaggcaaaggaaaucuacucuaguccuuuuacuuacuaauaauauaaaguaggugauguaaaagugacuguuaggagguucucgggcuuguagaugauauaaagauuaucaucagauccacccuaaugugcuuuucuccugugaccuagacauaacgauagcucggucuuucucgguaacuacaguaacaguuguaauagcuuaccaguuguaaagcuuaggaagggugggcaggaaacacggaauuuauguaaaggagugcacauaaggauuugaggcacauaaggcuuugaggcuagagaagggacuaugggccucauccaacguuuaguuguuccccagaccaugagagauuaucuugucuauuaugauaauccuccacuaaccacagaacagauguuaucugcuuuuaguaggaauguaugugagugaaauuacuuggggaaacuacuggcauuauuuaaugaaccucagcacacucauuuucucucgccuaccaauucucucuguaggcauguagguagcagaaauguguaaauaugcucacuacaaaaauuacauauuagagugcuaguacacuaucauucauacuaguuaacaacuagaaauaagcguaugaugaagugccuuguaacaaugggaaugaaagagccuuagucacacacaaaagacauggauggauuucauaagugguauugagugaagguagccagacaacaccuugugucuucugugguuugguuuauacacagcucaaaagcuggcaggugguuuuaggaggucaggaggcuccugacucuggggaggaggggagggugugguuugagaaggcacaaggguuucuggguucugggaauauucuguuucuugacauggugguaguuacacacaugagguuaccuaagccauaguuuaggacauaccuuuuagcucaauauagaguuguacuuccaguacaaauuucuguugaacccaugcaguacacacuacagcugagccuguucucaaacucagccggucugucuugaucauuuuuguaccacucccacucuucccuugggaaggaaacauucucucguaagcggccccuuccuauccucacugggaucuguuucccagcuguauguucuauugacacuggagccccaaagguaccugugguguguaguugguuucuguuuccugauuugugagcuccaggagagcagaggcuggcuggguggguggugccagucauuguaucuccugaugcugccaaggugccugugcucagagacaccugucacagggagcacuguuuuuccuccaccuuucaacuuuuaguaugggggacacgagcuugaaggagcauaagcuugaagcccuaugacauugccuaaaguguuuuugagaauauggucauuuuaguaggcuuaaagugugaccuguaggaagacugggcugacagugggacagcugcaccgucaguguuauguaacuugguucuguguccaccaggcauguuccuaugagagaauaauuuauauacgaugacuucauuuguucugccuuugcucaugacaguucuaagaucaagacuauuuucagccugagaaauagguccugaaauaugucagcucuagagucguuaguuucuuuuuauuuaguuuuggccauccuucccaacuccucuagagucguuaguuucuuuuuauuuaguuuuggccauccuucccaacuccucuagagucguuaguuucuuuuuauuuaguuuuggccauccuucccaacuccuccccggaaaaaguuuguaucaugaauauucucuauuuggauuuucuuugcaugucuguuuucuuuuucaauuagaucucauuuauugugcucacuuaaaagaauuaggccaaaagacugguucagcuaaugcaguaggaaaaagaacuuagauauguagguugcuuucuugggugguuuugugguuuguuuguuuguuuguuuguuuguuuguuuuccuuugugguguauaugugguuaaucaugucugggaccggguggugcuaguccaucucagccuuaccacucccuacucuuugacuuuuggcaagucacauaacucuagcuuucuuuuuuguaaaaucagguaguuauuaagaucuaaugaauuaacuuuaaacgcucugcucaauguaugaaaauuguaaaaauuaagagagaaauuucaagcuuuauuguuuuucuaaacaaaugauucaauuauauaauauuggggcuagagauaaaucucaguggaaacagcauuuccuguucuuguggagaacuggguuugguucccagcacccacauaacugcuuacaguuguucauaacuauacuuccaggggacccagugcccuccucuguccucuuuggguuuuacacaauauucauuuuauaaugcacacugaggaugaagaaagaaguuauaucacauuuaucuauaauuauuuguauugauucacugcauccccuuuuugcuuuaggaacaaaggauggggaagcagagagauaacuuuagagaaccugauucucuuuaaacacuucccaaagagccccaucaaaaguuguagccaaagcugaggcaguucaguggggccuggagaucuuaucacuuuuuuauuucuucaccaauuucuuacaaauuugcuucacuaguaaagacuacacuaaauaaccuuguauuuuuucagugagaaagggguaaacaacauuguuuuucaaaggauaggaacuuuuguuuacauacaacucuggcuuuaaaggguuguaagaucagaagggcuuuaagauguauuggaaagaacauuuucuguccccaaaacugcacuuuaaccaaggcacugacuucuuugagucagcaugccaaccuccucucuguuuccccucuuauaucauuguuuugauauuaagaaauauugcuacuauagauuuuauauauauauaaauuuauuuauauauaaaugauauauauuauauauguauguauguguguauagaauauauauauauauauauauauauauauauauauauauauauauauauaauauuucacauuucuuuaggauaauuccugggaauagaauaaggauuuggaacaauuuguucucuuggaagguuacaucuucugcagagccauguuuuagccaauacugaauuuuuuuuugacaaaaaaaguuggucuagguagagcaacuuuauggaaaugagcagcuaggucucaagaguguucuagguaccugggugcuucacaauucuguuacccauccuuagagaggaucucgacucucagugcuuagugaauguuucagacaaacugcuccugccucccugcuaugcucuagacaggauauuagaagugguauguauguguuacuguggcauaggucauaucagcuggacuaagagccaagauugcucuuuaaagaaugggugaugguggacgggggaggguauaggggacuuuugggauagcauuugaaauguaaaugaagaaaauaucuaauaaaaaucguuaaaaaauaaaaaaauaauaaaaaaaugggugauggcaugguagcaugucaaagauuugugaauaauaaagucaagaaaagauuuauaguuuuaaaugggggauuuauuaguuacuuuucuuaucaauugcugauaaauguaaaaaaaauucuccuggaaaagagaagaagaauuuuugugugggaaucauugagaggucacggucaucaagggggaaaggcauggcagcaagagcucacucacauaugacaugggugggucaucgggccagccaagggcaugcuuccgcuaucuacuguccugcuuuucccagaauccuuuuauucagucuagucuucccgcuuacgggguaucagucagauucaugguggguguucccucuuuaguuaauccuucaaggaaacgcauucauaggcuucauagcuauaaccagagguauuucucuuaagugacucuaaauccagucaguugacagugaggauuagcauauaaauauguucauauuccaagagagagagagagagcgaaucauaggaggagaaaggaauuaaugaaauauguaggauuagcuguaagaggaaggauuuuuuuuuaagaccuuggaagguagugaauaauacuuuuauuuuauauuuuaauagguuacacguaaguacaaguuucaagaaguuuccugucgggcagugguggcgcacgccuuuaaucccagcacuugggaggcagaggcagguggauuucugaguucgaggccagccuggucuacagagugaguuccaggacagccagggcuacacagagaaacccugucucgaaaaacaaaaaccaaccaaacaaacaaaaaagggggauggaguaaccaaaaaaaaaaggucuaucaugagauaccugaaaauacuucaaugauaauauuaauauauuauaauauauaauauauuauuauauauuaauguuauaauauauauguguguauaugccauuauuacaccacuagggauaucuuagugggauggccauucuugugguuuauaggcuuuaugaccaaaaagaauuuuuguuuuuuccccuuuagacagcuugcauaacaccuuuagauacuaucagagguaguccucagagaggacgcuuccagcuugguuccagccugauuccuccaaguccuuuguuagaaguguguaaugucuucaucaauaggcucuuguuuucauguucugggagaugaccaauagcaauggucuauauuguuuaaggagucuuuuuggacuccuugaucagcaacuggaauugucauuucucauacccauuacugggguuuuuguuagucuguggcuuuugggggguauuaccccaaguguuauaacaucauuuaaauuacauauauauguauauacauauauaucucuaaguaaccaugaagcauauguuucccuauggcuuuugcagacaucuguaguauugucucccuaccucccuuuuccucugcauuacucucucucagggaguuaaaguucucccccauuuucucuauuucccucuucauaccacuuguguccuccucuccuccucucuaaagcuacuucuccuauccauggccccuucuuauuucccuguaucuaguuacuccuggguaaaaccucauagguaaagauucagagcuaggauacacaaguaagagagaauauguggcguuugucuuucagccgcuagguuagcucacucaguaugcuauugucuaguuuuaucuauuuaccugaacauuucuuccuucuguuuuucuuuuuuuuuuuaaauuuauuuauugguuauauguaaguacacuguagcugucuucagacacuuuagaagagggagucagaucucauuacggaugguugugagccaccaugugguugcugggauuugaacuccagaccuucggaagagcagucgggugcucuuacccacugagccaucucaccagcccccuucuguuuuucuuuacagcuaaauaaaauugcagugugugugugcgcgcgugcgugcgugugugugacauuuuuuugugugcauucaucagugaagaacauuuagguuguuucugucuccugguuauuguaaguagcucagcagugaacguggcugaguaagugucuguggaguaggauguugaggccuuugggugcaugccaaggagugguugguauaccugggucagauggcagaccuauuuuuuggcuuuuugagacuucucuaugcugauuuuccuagugacucuaccauuucuaguccuaucaucagugaacaagcuucccuguccccagcccucaccagcuugggguuuuguuuuucaguccuuuauuugucauuucaucuuucuguagauucccccucucacuucagauuugguccuuuuuccuuuccuuuccuucuuuauuuuuuugaguacugggucucacuguguagccuaggauggccuggaauguaccuuuuuuucuuuucucgccaggaucucauauggccuaggcugaccuugaacccacugugcugccgaggguaaugaacuucugaugcuccugucuucuguucccaaguauuuggaguuuaugugauacuguaacugaaacccagcuuucauacacacuugucaaacacugcacccgggcuuucauacacauuugucaaacaccacauuacuugaacuucgucuuccgauccuaguuucuuucuuucuagugugucucauaguggaaucuguuggcuuaaauauggcaauaggauacucuuguuauuguugccaacaacucuuuuaaauggugauuauagcuuauuaauuacagcaguaguuucugcaaaccuaaugauccacgugcucucuacugaagaggaccuugggcaacauacuacaauccauacuacaaucacacaucagauuuagcugaugucuuacauaacauguuuucaugguugggauuaacaugccuugauaaaaucagguauguucuauguucgugucaguuuaggcuuuuagaguggacucccacucagccuuccucaucagucauguugucccgccucuguguguguguguguguguguguccuggcugccccaucccuaccccaguccgucugucucugccacucaaacucagaacuauuuguuugugcuuuuguguuuacuaagaguguaacaugaauauguucuucauaccccaaguccacucugucucccagaugaccccucuucccuuuacagucaccuggauucugacaaagguuuuuuuuuuuuuuuuuuuuuuuuuugggcccucauugccacagccuuuccgcauuaagccuuccauuuuaaggggaauuucuuuuagaucaguuuccugagaugaccugcuuucaggaggacauugcuuaaagaacuuccucuuccuuggagaguuuuucucagugcccccauucccaggcugcccuuccugggagacuagccaugaauguuccuuuugaccucagugcuaguucuuucuuuauuagcuugacuagugacauuuaaagcaaggaccucuagugacugcauugcacuuaaguuuccugguuggaggguagcuagacacucugcaucuaccaggcuugcuuguuuacccuucucauuuucucuagauucuguugaucccuaacagguuaaucugaguuuacauguagacgaaaguuaucaauuaacagaaaagccugaugccuguagacaaggcugacugccuuuuaaguggcucgaggucagcauucagaccagaagguuuucggcaggaagcuguauagggauaugggccgucccuaggaagccagcaguuccuugaacuacaggacucucagccacuuuaaugcuaauacauacguggaaaaucccccuccagcccacuuuaccuacagcaccugucccauucauuuccaugaaagacuuuugacugucugaaaauauagagacuguggcagcuauggguguugaguaccaggcuccaaauaggaauauaaugucuuuuaaaccaguguuuguuaaacugcccuuuaguggguccagaaacaucaauuuaauagguuacaucuagcacuguuguuuucguuaccauugcuguacaauaaacuacauuaaauuuagugauaagaaacaguugccauuuaguaaucucacggauccuuccuaugggucagaaauauggacaggguccccagaugggauggcuuaucucuguuccgugacagcugauggaccugggcuggggcuacuucaaggcugguuuaucagcuaauauugaugacuaggguguauguagucuuuccaggugguuggagccucucacagugugggggcuggguuccaagagagcauccuagagaaaccauucagagagccaguguucuaaggacagagggagauacucgcaucacacugaauagcuguggcaucacuucugcugcucuugacagaagugguuguagaggaagguauacaagucuucugcuuucauauuugcagcucuuuuaaaaacuacucggacuuugcuuuagaagaacauagaauagaaaaaagugugggugucgggaggacuaaggacugugaaguauguucuagcuguaauguacacauucugguguuuuucuucuguagaggacaaaaaacuuguaaacauuucuugacuauagauaauuugguuccuuaauaccaaauuuuaucuacuaauacuuaauuaguagauuucuacuaugaccccaguuguaaagaugaaaacauaagggauugauuaucauucauugccuauagaaggacaaaaggaagccuuuucuuuuaaaacucacuuucucacccacuaggagucccucagagccccauuuaacugcaggauaagcuuggguagucccugcauugcgagggggcugugguccagaccagcagucagaaccucucuagaaauugaaccuuugccaguuuccugaaggugcaaacgugugacaugaagaggguguccugccuguugcuuugcuuuguuuuguguuuuuggccuggagcaucacugcccuagcaccugcucuguagaccaggcuggcuuccaacucaagagaccugccugccucugcuacccaagugcugcuauuaaagguguguauuuucacgccuggccagaacugcauucuuuauggcugaaaaaaaaaacuccguugcagaacugugccauaguuucuuucuccauccucuguugaaggacacagguugguuccaugcuucagcuguugugagcagugcugggauccacacugauguucagguuaucucugugguauaccgacugaggaauggucaggcugagucauauugcaggucuauuuuuaguguuuuugaggaaccuccauauuccccuuguaguggcuggauuagcuuaugucccugccuagcagguauacaaggguuuguuuuguuuuguuuuuuguucacaauuguuguuuucuuaaugaccgccauucugauuggggugagauggaaucucaguguaguuuaauuuaaaugucucugcuagcuaguaagggugaacauuuuuuauguuuuuuuuuuugggggggggcuauuugacugauacuugcuuuuaucauacaaauuacuauccuuccauuauuagaaacaguuuguugucuuuacauucuauagaaauaguuagacacuuaacauuacugacaagguuuaacuauuauuauaaacagcgcuguuguaacucuuuaguccauccuacaauuauucuuaaauauuuuagcuuuuagauauauaauauguacaugguacagaauuuuuccuuuuuggguguuaauguaacuugaacugcuaagcccaagaguggacauuuaaaaagguuuguguaugcagugcaaaaccgucccugacaacugccccucuuuacacuucugcccaaggugugauuuguuccuagcaugucccaacugaauagagaaaaaccaaacaagacucugcuugcuagccugugucauuuguuugugcucuauccuucucucugaccccuuuccucucuuaccuugccugcccucuaagcccgucugcacaccgcugccugcccugcacacuuuuuguacacagcgaagacggcccuugugcuccgcaguguuguuuucucucauucuccucaauuucacuguaguuuacuuagcagcauaagcaaauccuagccacccaugguggcucaaagcugagguuccagcagagggagacugaggacccccuaaauucaaagucagccuaccuggguuacugcauaguaagacccugccuuaagcaaacaaacaaaacauugugucuugcagauuucuucuuuugucuucuuuggaauuuagcaacuuugauagauuuaaacucauuaaauacugagguaaauuagaguuugccaaauugaugaguagaaaauagcuuauugagagaaauguaaagaauaaaaauguguaucagauugagugcagaauauacagagcugcucuggaaaagacaauucuggcaguuuauuuaggcguacuagcccagaguucugcauaaaagauggcugacauuucgucaauguuuuuaaagcuaaagcuaaauucucugucucucucucucucugucucugucucucugucucucucugucucugucucugucucugucucucucugcaaaccugaguguguuaauguuuguaugagaccagaggucaguagcaggcaucuuccuuaugugcugccaccuuuuuuuccucugagacaggcucucucauggaagcagcugcucacugacuguccagugagccccaggaacccuucuagcucugucucucuuacuuggagauuaugcguccuuuacuaagcccagauuuuuacaugggugcuagggauuugaacuaauguccuuaggcuuccaucacaagugcuuuauugacugagccaucuuuugucaauauucuuacuuuaccuauauguagaaggaguucccuccaaaccagaauucuuuuuuuuuuuuuuccccgagacaggguuucucuguguagccuuggcuguccuggaacuaacucuguauaccaggcuggccucaaacuuaaaauaaccuucuauuauaagauauuagcucaacaaaucaguaugggcuguagucaggugguuacuuuccuguuuguauugccuuucuuauuuccuuucccccaugcuauguucacuuuaaacucuuuagauuacuucuguccucaugcaccuugccucuuuccuccuccucugucuuuucuuccuucugacccugccuuuuaaaucucucuuccauuuuucucccuucuacuauguagcccagguuggccugaagcaugacccucucaagugcugggauuauagguguaugcuacccuugugucaauaacuuaaauuuuagaaugugacucauacauuuacagagaucauggcucuuuuacuuuauuauuuuuaaccaaaggcuuuucuguauuuauuauccagcuuauggucauucaccucuuuuauaaauauauaucauuuuaauuccauuuauuaauuuuccccuauugugugugaguguguguguuuuguuuagugaaauugagaguauguuaguaauauaagcugauuaaaauugagacauucucuggugcagacggcaccgcauaguucacuugccuaggcuuugccagggccuuugaagcugcccaucuuuucauugcccagcuagacagucagagcuucaguuguaagaacauucacuauuaaaagcugcuuaguuucuuucucuugaggaaagauuaaggacaguaaguuccacagcccuagaauaacuucucuuuuccugacugugaggcagcagcucacauggcagugucuaacaggcaggaaaggacacucaucuucauuuaacaggaaagaagaaauugccuaugaagcuacccccaccccagcaggucucacugccuaugaaguguuucagagaaggaaugaguaugugcaucugguaguguccugccaucaagggagggcacagggcgagagucugcuguuaauaggauguguagaaggugugcaguaaauccucucacagcucuccuuucuucuguggaguuguaggaauauuagaaaaccacucuggcucucccuggguuuguccccugcuuggaaugucuucagcuccuuuaaucuguggugugguuuugucuccacugacucagccaugcugccucccuguccccagccagucucuuuccuuuugugggggacuagaauugugacucuaucuucagacccagcuauaccacuccugggcauauacccaaaagacaguugcucaacuuguuuguagcagcuuuacuuguaauagccagaaacuggaaacagccaagaugacccuuaacugaagacucgauaaagaaaauguggcucacuuauacaauggacuacuauuauuccgucacugaaaacaagggcaucaugaauuugcaggcaaauggauggaacuagaaaauaucaucgagugagguaacccagugagguacaugcaugcuauguacucacuuauaaauauuauuagccaucaacuacagaauaaccacacuacacuccauaggcucaaauaagcuaaguaggaaggaaggcccaaggaaggaugcuugaaucucagaaggaaaaauaaaauagacaucagagguggagggagggagggaucugggcaggagaggugguagggaggggaacaggagugggggacagguguagggaggagugggacaagagggcuaggagagagaagggaaauugguguggggggcaucucugcgaugagccagagaccuagacggggaguguacacguuaggucugguucuuccucccagccccaugcucccagaaaugagacucagacucaaaauauauuuacaaguacucucuagguuccucucugucuaaauuaucacuaaaauaacccguuuauuuuaaccuacauucugccacaugguugguugcuugugcucaguaccaugaguccauuuccucacaucuucccaagcagaucucccacaccugacucuuucccagaauucucccugccucuggauaucucaccuucuagucuacccuuuaguauagacuacaggcuuuuuaaauuaacauccauacaaugcacaugauauucucucuauaggggaggcucucgagagucuaugagggucacgcuagcugaaacucaucuaucaaugguggggguugggagaauggugguaguggucaccuccuguagccagacaggacuucuaguggagggauggagacaccacacacccacaaaaccuucaacccaaaauuuguccugcucgcaagaugugcagggauaaagauggagcagggauuuaggggaucgccagcugaugacuggcaaaacuugagacccauuccauggaagagagccaaccccugacacuauuaaugcuacucugcuguccuuuaagacaggagccuagcauaucuguccucuaagaggcguuauccagcagccaauggcugcaaagacccacagccaaacaucaggaagaacuggggggggggggucuuguggaagaguaggauauaggauugugagagcuggagcgaucaaauauacccuaagaccuacagagucaacuaacuugagcccaugggugcucacagagacugaaccaccaaacaaagagcaugcagugggcggaccuaggucuucuacauauaugaggcagaugugcagcaugguuuccauguggguccucuaaaauuggagcgggggcugacucugacucuguugccugcuuuuggaucucuuuccccuauccuggcugccuugucuggccucagugggggaggauguaccucuuccugcugggacuugaugugccagaguggguugguacccaugguaggggcuuuccuucucagaggacaaguggggggaaugugagggugggccugggaggaggggggcugcgaucagugauggugauagagagccugcgugugagccaccaggucuguaacuguuguuugcaacugagugcuugagugcucaccuggcugaggcacuguuaaccccaggcccucugucaucugacccucugcauccuuaucucagccacccuuucccauuuacuguuuuugcacaugccugguggagucauccucccauacauuuguacauguuuucucuuucuagaaugcucuuccugcucagcagagccauacuuuuucuucaaggucuaguuguacaggcaagcucugaaagcuuguauguguguuguguucccugacccccacaucuuaggcagaguuaaucagucacuuuuuagucgcacucuguacaaguucucaugguuaaacauuuacaaaaugcuguaauugucuguuuguauuugucuagccuucuguguuuagcuucuggaggauaggauccauaaucuuaauuccguauucguacucgagguuuaaugcauaaaagggguucucuaugaaugguagaggaaaugaaugaaugagugaugauuuuacagguaacucugcuaauaacaauuaucuugaugauagcaagucuauauaucaaaggauuagaaguuguaaaccauauaagauacuauguuaucuagaacugaguuugacagacuauccauuucuuaguugguaggcuagauacaacccaggcugucuugccuucacucuucuagauuuuugccucuuaagacucgucuuuucuguaacaguuugcaguuagcaucugguauagcugucagagacuugccuuggcuuuccucugcugcaugcucgugcacgugugaaccuuucuccuccuuuauacuugccagcgucuugcuugccauuagacucaccuugauuguugccuuuucugacugcuccagcccaagucacaugcuucucugacuugcucucuuugauuuagcauauguaguaauacaguauaauaaauaacugaacuucuggcuugcaaggcacgcaggcuuagguccagguuccucacuccaauuaguggccgugugauugaugagcaggugagcuucugagagucucuucccaaauccuuaauugggaguagugauaccaguucuuuugaggguuggcuaaggagugcucagagacaguaaaugcucagguguuagagucugcaguguuguuggugguaccuggguaagucaugguaccugauuccuggucuagcuugcugagugauggcuaugcaguuuuguaaggagcauguuuuaaaccuacaggcuaacccucaaaagcuuguuuggauauuuuuguaaagaacauuaacuuacaguuuuccucagcaguuuuuguuccuuggcauauaccaguccuuugccauccuggaugcuuauucuuuagaguacaagaugucucuuuaaaaaagcguuccugaggucugucuccuucgggcaaggacaggauguuuccucucucugcuucauugauaugaccagcuuugagcuugaguguuuguacagcucaaagucucuacuaauuaaagaaguggauuagaugagacgguuugaugaaagcccaugggcuguaagugguuugcacauuucccuugcuggacaccaucauagcaguccaucuguucaugcucucuuccugaucaauaguccauggaaaucauccaucuacggcaggagacuugggccauuuugcugcuugaauuuuauccacuuuguaaaugaaggaccaagauaauucaguguguuuauuaugcaaggaucaaaggucuuagaaacuuuuuuuuuaagauauuuucuuuauuuacacuucaaauguuauccccuuuccuaguuuccccuccccccuuccccuacucaccaacccaccuacuucugcuuccaguccuuggcauccuuggcuuggauaaaauucaagcagcaaaauggcccaagccuucugccguagauggaugauuuccauggacuauugaucaggaagagagcaugaauagauggacugcuaugaugguguccagcaagggaaaugugcaaaccacuuggcaucccccuauacuggggcauagaaccuucacaggaccaagggcuucuccuuccauugaugacuaggccaucuucugcuacauaugcagcuagagccaugagucccaccauguguuuucuuugguuggugguuuagucccagggagcucuggggguaucgguuaguucauacuauuguuccuccuauggggauucagaccccuucagcucuuuggguacuuucucuagcucauucauuggggacccugugcuccguccaauggauggcugugagcauccacuucuguauuagucaggcaguggcagagccucucaggagacagccauaucagaucccugucuaucagcaagcucuuguugggauccacaacagugucugcauuuggugguuuaagaaagaacccaccgugcagggcaugguggugcacaccuuugaucccagcacuuuggaggcagaggcagacggauuucugaguuugaggccauccuggucuacaaagugaguuccaggacagcuagggcuauacagagaaacccugucucgaaaaacaaaaacaaaacaacaacaaaaaaaaaaacccaccauuacuuagcuuuuaaagauguuuuacuucuaaauacuucuggaaucaacuccuuauuuugucuguuuuacaaagaacugaaaggugggaaauuugaucuuuaagaggcauggcuuauggugguuuuuaaguuuaaaaauuuuagugucucaugauacacuuaguuaaaguaaagguaguucucuugaaugucauguagcuacugaaauauauaauuuagaucuauauuugcaaacuuaaaagauuuuguuuuuuuuuuaaauuaugugucuaugugugucuguggauggguguguguacaugagugcaggugccugcugagaccugaagaugugagaucuccuacagcugaaguuacaaagggcuuuguaagcugccugaugugggugcuaagaaccaaauucagguccucugcaagaacagccagugcucuuaacuguugagccaucugagggucucuuuuaaaggguaaaagguugauuucuguguacugggaagaaaaaaaaagguucagucuuuaacacuaaaaaaaaaucuuggucuuuuagugagugugcauugauuuauauuaaaaauauuuuaaguugaaaaaaguggaaaaauauuugaaaacaguaaagucaucuuuucuucgccucaccagggaaauuauccuaaguaugagacaacagugagaacaaaugaaaauucuguuuuugaagaaaugaggaaugucugaaauuccaggccagagaauaggcaguuuuuaaaguguugaaucaggcauaggaaagaaaguagacaaaacacuuaaagcuacaggauucaggaaaagagaaacaauagagcaagauuccgucugacugaaggcauuuuccauagugaaagguguacguacccugggacugaaaaccgaagcucuucacuugcaauaguggccgugagcaugugagccagugacuugggcuucucagagucuagcuucauuccaaagugcagcgguggcuggauggacaagcugcacuuagaagccucacuguguaucgaucggcaggaagagacuuugugcacagcccacugcuguggaggagcuuaaucuugggagggagaacagcucaagaguaccucccaccuguacacaugcgcgcgcacacacauacacacacacacacacacacacacacacacacacacacgccauaguggucaggugagaacuaaaggaguaaauucucuccuuucaccaugugggucuuggggaucaaacuuaguuugucagccuugguggcaagugacauuacucacugugccaucugcagaggcagcacucuugaguuugaggccagccuggucaaaagaguucccaaauagccagggcaacacugagaaucccugucuccaaacaaacaacgaggugauggggagagggaaagaaagaaaaagaaaagcauauuuuacagcaggaccaucaccugaccacacagaaggaaacagagagauuugucuuauuaccucauuuuuuucuaggcccuggugaacccugggaacccuuggaguuccuuggcuuuugugaguggugcuuucaacagcagucagauacugcauucccuuuccucuucccuuauauccuacugcuucauauauuauuuccauucaaagacucucacucucaguauacacugaagcagugagugcaguugcuuucuuagcugccuucccuaaaaauggagaauaaacuggaagcaucccaguuaauuggcuaugucagagacauugaaggacaaaguacucaagucaggcagucacagccacuuuacccuaaaacuaguggaaacacccuccaccccaacccccaauaaaccaguucucagagcaaggcugugagacacacacuuggcucugagcauguacugaaucuagacaggcuauuaagcuggggcuguucucaaagaguauuuuaaccuacaaaguugagcagaccucagaaccaaaggugauauaaucuguauacuuuggcaggaaauggagaguaaguugggaaaugucagauagacgacauugcucaucugaugggaguuguagaagggacaggagaaucuccagagaaaccacaaaaugcaccccauaagacaaaguuuuaaaaucuguccuguuccaagaaugcaaaucuaccuguauuggucaagaaacuucccuaguccuuuccugcucucccugccccagaaacagcagcuugucuauagaagugaaggaggagggacuguagccccaccccuuucccugaggguaagcuaccuaccccuggggcccugucugcagggagagaagucuuuucuaccagugaaaacagaaaugcuggcaagauugaacuggucauuuuugcuuaaaggugaacuuuuuuggggaaaauuuaacuuguaacaacugcuauguaacucauuaauuaguacaaauuaaugaauuaucaaaauguagcuaucacccaggucaagaaauagaguauucuuggccuuccuauucucacagaaucuucuuuuauuaguucuucuugauuugagccuaauuuaaaugagcugaucccuucuugcuauuugaauugggaugaaucugugaaccaaggccuacagugaggcucuccuguccagcucagggaugacucugugaaccgaggccugcagugagacucucccuuccagcucacuuccacuaaaacucagagaguguucugacuuggacauugggccuuugccaguaguuaagaugaagucauauuggauuagggugggcucucagugggaugacuagugaaaggcagugugaugacagaggcagaggcuggagugacuagacacaagcugaggaaacuaaagcuaggacaggugugugaaguggguccaucucagagccuccagaagacaccgacccugcuugugcuuugguuugauuuuuugagucaacaugcaauaggcauuuaucucacaccuagaaacaccucaaguauaccaaagguccauacgagucaugccaccauaaaaaccacugugugcuucccuuaugguucaagccauuauggacauugucuauguugcccaucaugauagcuauaaucacuuuacuuuuggcaguucagugaugccaccuggucccugcuacuugaggcccaauuaaaccugucacauuuaauucauccaauugagcagccgcaucucuaacccuaaggucuggcacaaggcaaagaacaucaacaaagcucuucaaauguguuggugccccuuucaccauuuugugucuuaggauuaaugaagggcaugucuucuuggucuucccguuguggagaauuagauucacagcauacccauucuagcauugcuauuucccugaacauuaaaauuccucuaucaacuaagccaaaggauaucaagcaucuccaacuccuuuuuuuaauaggccaucuuuugacaaaugcuuuaccuaaccaaauuuuugacaucuuuuuaacugugaucuuccagauuaaaccuagacucaccacucagcaggcccaugucagcacacucagcuaggccugguuucaaguuccauccacuauuaucucacaccuuuaaauccaauccuggugcuagaauuaaaggcauacaccacccauacccaguuauacuugauucuuggauauuuaggucucuugaacuauaagaggauaauuuuccuuuuuaaaagccacacagcuuauacuaaggucuuuuaucaguccuaggaaaugaucacaacacaauucuaggagacuguauuggaaagacuggugagaugugaggugugguggcucauaccuguaauaucagcaaucaacuucugggcuagccuggacugcauagccacacccuucucauuaggcaagaaauggggaugaagccuagugguagagcucuugccuagugugugcaaggcccuggguuccauacccagcgcagaaacguuuugagaccuuuucagaguuugaagguagaggcagcaccaguccuacugaacaggacuuuaaaaaaauuauuauuuaugucuauggguguuuugccuacacaugucuguguaccacaugcuugaaguacccagaaggccaggagaaaauauaggauaucccugaacuggaguuacagacaguugugagccacugugugggugcugggaaucaaacccagaucuucuggaagagcagaaacugcuauuaacugcugagccaucuccccagcccccuaaauggguuugaauaguaaauucacuuaaaauuaauuuucaaacccuucaaggacuuuguuuauccaauccaccaauuauagaggcaaaauguuggcuaacuuuaauaugggauccugaauguucacucuccagaguuauuucgucuauggcgauuuacugcucagcucuuuucucucugugagucaaaguacauucagcugugaaguagggagguucucugcccuugcacccacugaggcccaaaugcugccaagcgguugcucugccuuggagcagcagggcaagucaaaguuaaagguuagaaaacaugagugcacacaucuaaacuucuucuccuggguugccagucuuuuuuuuuuuuuccagaucuucucugauaaggggaauaauucagcccagugugcuuaccuuguuucagaguccuuccgaggaggagagcagggacuccaugcucuuccucaucucccucagccaccauuuacagaaaacugcuuaggaaaaauuagcauguaguaaguaaaaacaguuucugcacggguggucugccucauuucacuuucugagaacaauuauauauauauauauauauauauauauauauauauauauauauauauauauauauuuuuagguuuauuaaacauuucuaccaucuauguucaguccuuuauuucuaguaaguccuaagugggaacauuucugauggcuauuaaaucaauaucaugaaaucaaaauuauacuguagcuugauguauuauaaaaaaucauuuuaaccauugcauacacuagcaagauuuugcugaaaggaccaagauauagcugucucuugugagacuaugcuggggccuagcaaacacagaaguggaugcucgcagucaacuauuggaugggucacagggcccccaauggaggagcuagagaaaguacccaaggagcuaaagagaucugcaacucuauagguggaacaacaauaugaacuaaccaguaccccggagcucuugucucuagaugcauauguaucaaaagauggccuagucggccaucacuggaaagagaggcccauuggacuugcaaacuuuauaugccccaguacaggggaacgccagggccagaaauggggaguggguggguaggggagugggggguggguauggggacuuuugggauagcauuggaaauguaaaugaggaaaauaccuaauaaaaaaauuuuuaaaaucauuuuaaagaaaguguguauggguguguaugguguaugaaugugagugugagucugggugcauuugugccaugguguguauuuggaggucaggggacaacuuggggacuuuguucuugccuuuuuugucgaagcagggucucuuguuguuucuccugcugcacuauguauuucaaagugggcugaccugggagcuucuagguaaccuugccucuaccuccauguccgucugugucacugaaggagugcugggauugcaggugcacacgacuaugucuggcuuucuacguaggucccagggacuggacucugguggucaggcuuguacagccaggauuccccaggacacaucuccccagcuucaggcccugucuuuuaaggacaucugaaacauguauaauaugcccucauccuuuauuauuaaucccauacauauuuguucuuugcuuuuauaucuacaaaacgugauauuagccuaacauuuugaugugaaaauugugcuuuuuauugaacuggagggcugaguuucuauauuguuuuguuuuuaucuuuccagucauguauauucaaaaccaauacugucuuucacuuauagauuauaauuuaaauggaaaacagacuuaaaaaaggaauccaaacacuuucugaucucugccuaaaacucaguugaaaauaacaguugauauggaaagcuaaaaugcccaaaguugcaacaaaauaaaaaaaaccaaucaagugaaucuuaaauauuaaggaaagucaagguuaagucaaggaaauacucaaacaaaaaugaagagauuauaucacuuccuuauagguuuuugagaaugaguaucuauucagcuagaaguaguucauagugaaauuagaaauggaguagaaugacuuacaauagcccaucagcagcacaucgugccugcugccuagaggauaacccauggauugguuguguguuacacugggggauccgggaaucaagcaggucuucagguuuacauagcuaucagcuuugucuguggagucaccucauuggcccuguuucccccccuuagacauuaaccuuaaaggacagaugagagggcucauaagucaaggcacuugcuguaggugauccccaggacccacaauguggaaggagaaaauugacuccaacuuguccucuagugcgcacgcacacacacacacgcacaugcacacgcacacgcacacacacacacacacacacacacacacacaaugaaugaauguaaacauuuucacagcaugggaaaauguuagggucuucauuuauucaagaauugauugauucuguuaguagcagcaagucugggacacaucuccaaacugguggugguaucacucugagauguucuccucaggacauuuacuccagagacccagaguuggagaagacauuuaacauagauuaaugugggaauuaaccaaaaaaggaaaaaaaaaaaggcuugugucuuuaugauagcaaaugugauuuuauucuuuuuacuuuucuaugaauugaaguuuauuaguuuucauucacuccauucauucauucauucauucauucauucacuuuacauccacccucacaauucccucccccauuauaugugaguacauaccauuugugucuuagaagauuuguguuacaucacucaggauauuugguaguuccauccauaucuacaaauuucaugauguucuuguuuuuaguagcuguaugaaugugccacauuuucuuuauccauucuucaguugagagacaucuagguuguuuccaguuucuggcuauuguuaauaaaacugcuaugaacauaguugagcaaauauccuuguaguaugguggaacauccuuugguuauauacccaggaguguuauagcuaggucuugagguagaacuagaauaagggucugccaaauugauuuccaaaaugguuguacaaguuugcacaacugccagcaauggaggaaaagagaaagcaucuucaacaaauggugcuagucaacugucugcauauagaagaauacaaauagauccacauuuaucgcccuguacaaaacucaaguccaaauggaucaaagaccucaauauaaaaacagauacaguaaaucuaauaggagggaaagugaggaacugucuugagugcuuugguacaggagauaacuuccugagcagaacaccagcagcucaugcuccaagaccaacaguugauaaaugggacaucaugaaucugaaaagcuucuguaagacaaaagacacugucagcagugaacaaaacagcagcuuacagaaugggaaaagaucuuuaccaucgcuacacugauagagggcuaauauccaaaacauauuccaggaacucaacaaaucaaauaacccaauuaaaaaaugggauacagagcuaaaccaaauucucaugagaagaaucucuaauggccuagaaacacuuaaagaaauuuucaauguccuuagucaucagggaaaugcaaaucagaaaggcucugagauuccaucuuccacccuucagaauggcugugcucaaccucagugaaagcgcuugcugaugaggaugugaagcaugugugauuuuaguggcugcugaggcuacuucucaaaagguugcuaaggaacuuuuucagucaaugagaucauaggguguuuucugauguacgcuggauaggauuacagcugguaaaguaaaaccauggcuugaaagguugugggcauuuaagaaguuuuacuguaaacaaaaguuuacuuugaagguguugucaugcaguaucaaauauucaaccaaggucuaauucuucauauaaaaauaaacaggcacacguaucucagaaaaacaaacaaaagccguguuuuaucuucuuguugguuggauucccagacaguuucagguuucaucuaggcaaggagugaggccgggaacacuuaauuguaagaacgggucacugcuauuuaacauucuuaucugcaacaccuccauagcacuucuagaauuuuugacucaaaagucuccuuuuccuuuccauguccccuuagcuuccccugccuuucuaucugccucaacagagagcuagugagcacaguccuuugagcucuggcuuugugcaaggguauaagacagcagcuugguuugguaggagaaaaagccaaucugugaucagagucccaccacagugaagaccaguuuggggagcacggagugggaaccacaggcauaggaggucuccccuacacauaagaccugaaaguugagcagaaauuaggggggaagaagaagaaaacaggaguuugccaggccugugguacuguaguaagaccacagggucuucaaggaauguugcaagugauuuggggaaggugaaauucaagcuucaaggaguccugaacuuuaaaugccacauccagucaucuggucuuuaacuaggcaguguggagucccugaggggucugcccagguugcauuuaugaauuggaacauucugaugcucguccucugugggcccaggugcuaaugaggaaccagcugggaucagcuuggcuugcucucagaugcuaaagaaugcugacauguaagaggugaaaugagcacggaaagagaggcugcacuguccuguguuugcuggcuuggucaguauucuuggacauccuguagaaauaugucacucgcuauauuuccaggcccuugugaggcugggagggcacacauuuccuuuuagagcauguguagauggguuauuucuaacugucacugaaguaaagaggaaaugaugucaccagauguacggagcauuuauucacacugaacgcacucacuguucauuuaaacaaaaagaccauuucucaauucaaaucggaauauucuaauuuaaggccuaaaucaguugugucauaaucucuauggaaacaaagcguucuacuguguguaguaguugcauaaguaacucguuucucuuuguagaugacaaauuguggaugugaauacuuuucucauuuuucucuuaagaacucucuuuaaaauagagacuuuagucagugauacuugcuuaaugucuuaugaaauugagauuuccauucaacucuuugcccaguuuaguucaggugaaggagaauacauuaucugguucauuuuauauagagcuacuuacucugucugagguacuaucuugugggauuguuucuuuuuauugaucuuugagaguccuuuauauaugaaucuuuugucaguuuugcagauauuggucuguuuuucagauuuucuucuucacauuuaggguucaccaccuuuucuguacuggcucuuuuaaugaaugauauccuuaauuuagagucuaauugucaguccuucccuugcuugcuuuuuuguaccugguuauguaucccuuacgaugaaaguagaaauguacacaaaagaauuuucaucaaaugaaguauucaucauagcaaagaaagagugaagagaugaccugaagaauggaagaaauacuuacaaauccucugucagcuacggugcuaauaccuaaaauauacagggaacucaggcugcucaauagcaagaaaauaaaccaguccuauuagaaggcaggcagagaaccugagcagacauuucucaagaagagauacugaguaucaugcauguuacaacaaacaaugcugacuguaguggcacaugccuuagucacagcacucaggaggcagaggcaugcagaggucagcagaggccaaguuugaggccagcguugucuaaauagugaguucuaggacagucagggcuacauagagaaaaccugcuuuaaaaaaauaaaaauaaauaaaaacaaacaaaaauccuuaacacacugaauugucaggcaaauauacucauagugagcuauuauuagacuggcuguuaccagaaggaugaaugguagcaaguguugguuaagauguggaggaaaagauuauacacuguuggagacauuguaaauuagucuaacacuuuggaaacacauggagcauccucagaaacuagaaguuagaguggcagagacucagcagucucacuucuggauagauacucaaaggaacuagaauuagugauugcuggagauagcugcacaaccaucuucccugacugcccacuaaugaacagauggauggauuaaagaauauggucuguguacacaauaaaauaucauccagucuuuaaaaaguggcaaauccugucauuugugauaauauaaaugaaccugggagauacuaugcugagaaaaauaaggcagacaaauaccauuaaaaaaaaucucacuucuaucuaaaacagcagaacucagaagcacagaauagaaugauggaugcuggcuucuguguggggaguaggcaggaaaggggagacuuaggcauaaguucuaguuuguccaugaguagguucuggugauuucauaagcagcaugguaguaacaacuaaugcaacacauuaguccuguacauuugagagggacugaggggauggagagauggcuaaguuaagagcaauggcugcucuucuagagguccagaguucaaaucccagcaaccacauguugguucacaaccauuccaauccaauguccucuucuggugugucugaagacagcuacaguguacucauauacauaaaaugaauaagauauuuaaaaauagagagagggggacugaaagagaggaugugcuaccacagaacggagaaguaucugaggugauggguguugugagucuugcaucaaggccacuuuguuuuguuugugauucuuggcucccuuucuuuccuauuucccauggucauccauucugaugugcucgaugugguacuuuguuuucuuguguucuuauaaagcauauaucgugcuugugugugugguguguguauguagguacuucuauaugugcauaugugaauacauacgaagaggacagagcugauaaaaaaugaugucuucacccacaguucuucaccucgcuaucgcucucuccucuccucuccucuccucuccucuccucuccucuccucuccucuccucuccucuccucuccucuccucuccccuccucuccucuccccuccccuccccuccccuccccuccccuccucucucucccuccuuuaucaggguaccacuauguagccugugggucuggaacuuucaguguagacaagguuggcuuggaacucagagauccacuuccuuccaccucccuggugcugagauuagacauggucugccaugccugguuugaccuuaucuuuugagguagagucucucacugaacuuagaguuugcgaauucagauagacuguccagcaagccccugggauccuccugcuuugccuucccaguccuaggugugugcaccaccacacacaaaucuuuuauagggcugcugaggauccaaacuugguuccucauguuuacacagcauuugcugacauagccuucuccccagugcuuacauauucuuaaucuauuagaugauauuguauuacuaaucucauugguuuuccucuuuucacauggcaguuguuuuuaagauccucgugucuuccaugcccccacucccagcuaacuagacuucaaaugccacaacuuguugcugucacccauaacccuggacagacauuuuugcauguucccuuuugugaauaggcacaggcuuacuacuucuggguuaugguuuggcaguacagcuacaagaauuguguguauguguguguguguguucuuuuauaauuaguuuuaaacauuuucuuauugaaaauuucaaccaggaaucauuuauuaucuuuuuaaaaaaccuuuucauuuguuccuugugaauuuuccaucaugcacccccaaucccacucaccucucccucccauuguacccacccuucacccuugcaaccuccccccacaacagagaaaaaacaucucauuguggaagcuguagugugucacagugugucccacaguauccccuucuguccacaguucuuuguuugcaaauguuuguugcagugacuuguuggucugguaugaggccucugccuucuguuacucuauuaaaacuggaaccucacugggacuccuguuggauagccuguugucacccugugucauggagauccuguaauuuuggaucuguaggaccagacccuucauguacuucagcaguucaucuaugggauaggcuuugggguaggccaauucaaagcccuggauuuaggccggagagaaaucugagcuggucagccugacuggcaccccccccccccacacacacacuucuaccccacucccugcagucagggugcucuacccacugcccaggcaagguguuacagaguguuacagcuggugagggaugggccaguuuucccaccuucaugggccaagucuccccacugccauaaguggcaagggaugagguuaggggaggagggcaucucucccucaucugugccacugcugcaguccauacagaaagcaugagagccaaggccugcucaccuaugacaucacaucauggccagcuccucuguguugcucuggugaggggcagggcucacucuccugaguacugcagcagaugagcucuuaugaccccagggccagcucuccugucugccuauuuuaccuauuuucuacagcagaauaaaacugcauaaauagaauguuugaaugcaaaaugcuauugacaacauggccauuaacaaguguuuucuuugaauacacugaggggaguuugccugcuuccucaggaccugcccaaaggugggcagagugcccuggagaaugguugugggugccccugugguagcaccacaugagacgcacggcucucuugacaguucgugcuuuucagacucuucauccaguuaugacuacugugcucugcuagugaggauauuugaguugguauuugagacuuccugccuguucuguuaaauagguauugaguuuuagagacuauaaauauucauuuuucccauuauaaacacuagacaauauuugacccugggaagacauuucuucuguaaggagaguuuuagguuccuuauacacugaacccaggcuguguugcucuuuguaaugaggagcugcagacagggcuaaugcaaggccaggccgugcauccucuccugcucccaccucuuccucugaccauaaggucugcauugcuccagggcuucucacagucucugcugauguuagauucuuguauacauucccacuuacuuuuaguuuuuuccucuaaaacucaauguuccagccuaacauaagcaaaugguuucuuccuuuauguuucuaugaaaaauugaaacuuagaacuagacaaaauagucguagaaacaguauaaaaguaaacuuuaaagagaaaccaauauuguucuuuagaggcagcguaggccaauugcugaggaacuuuguguagcucuccuggaagaagacaagggcuggcugggcagagccucagcugggggcugcagucaggucggaacagacucucagagagcauucagucugaaaacugucucaaacuuuucuauaacauggaauuaguuguguguguaugugggugggugggugggugugcacuugccacggugacuguguggaggucagagggcaacaucuaggaaucuguucucuccauccaucgugcgagucuggggauugagcucagguggacagaccuggcaacaaguacuuuuccccacugagcugucuuguaggccccgagcacuuuucaccagagguauaauuauauagcaaguuccauuuguuauagcaguuaacgucacuugucagcuuaggcucuggaucacuugguagaccacauuguguuaacugaggaucccugucucggucucuuugcuucguaaguggagaaaggcggcuugagcagcagcaugugaccaucggcuuccagauguggcuguggugcacccugcguugcuuguuugucagcuuggcacaggcuagggucaucugagaagagggaaccucagcugacaaaaugccuccaggagguauugucuugauugcugguugauguggcggggcccagcgcuguguggguggugcuggcccugugugggugauucugagguuuguaagagagcaaguggagaaggagcaaaccagugagcagcguuucccaguggcuucugcuucaguuccuguucucaggcuccugccuugagcuccuguccugauuuuccucagugauggaguagaaccugagagcuguaagguaaaaauaaacucuuuucuuuucaaguugcuuuugguaaugguguuuaucacagcaauagaaaugguaacuaagacauggugugcccaacugcuucaagcugcugccacucugacuucccaccaugcuggacgguuacugugagccgugagccagaguaagcccuuucucccuuaaacugcuuuugucgugguguuuacuauagcaacaaggggaaaccagcagaacaaggcuacggcaccuccggugcucaaggacuucuucugucuucuagagccagagugggcaugugagaaggacaguuugcauccccuuccacuaauaguggcugacaugacagggaacugggcugagcgcuguuaaucagagagugagccgcaugucugccagcucacuucuucaaagccacggagcagcugcaugguugucuaaaaguaauacaguuuaucaggcauagggucagaauugaaagaccucucuguugaaucuucacaguacugauccuggaagcugugggcugaguauagaugauccuguuguguggauugccacucucagugcaaucugcuuuguaucucauugagucuuauucacuagcuuagaagaacccaggcuucccuuugcugucaggaugcuaagggugaucaggugggcagccugccacuguagaacauugugaaugaggcucacugcuguaugggaagucuguuguaggaugaccagauccccggacuguaagacuugagaacccuugauccaguagguucauauacaugacugagagacagagagaauguuuguuuguuuguuuguuuuuauucuuaucauucuuucuguuguucagagacaggguccuugaaagcacuguguaucucauguuggccuugaauccuccugccucagcuucacaagggcugggauuacacacuugcacugucacaucuggugcugauuuguuaauuaaugauugggaguaugcucauucaauauccagaccaucuauuuuugcuguguucuguuucccuuggugagaaauccauaaauagcaggaucuuccaucucuauaaauucuccuuuuugaucugacaaguccuuaagccagugaucacuuugcacuuuuuaggggccaugggaagccuguaggcugcacuucagggcacugcaucucacauuuccacuacuggaccaggguccucggcucuuacugucaugggaucuggucacccuacaccagacuucccauuuuuuguuguguguuuguuuuuaaagguuuguuuauuuuauguguacggguguuugccugucugucuguuugugcagaauguuugugccuguugucuaugagguuagggguggcauuggaggcccuggaacuggaguuacaaauguugugaguaaugauguggucuucugagaucugaacaugaguccucugcaaggcaguaauugcucuuaacuaugccaucuuuguagccuugcuccuguuuuuauuaauggguucauucucaaagcugauuuuauucuaauauuucuggaaagccuuuaguuguccccaauaacaaauguauugacauaucuaaggaugagauucaguuuuguauaauauuucccauuaagaacuuaauggcuuuuauuagaaguuauugccuuagaguuguaaaagaacuaucucuaggaaaauacuguuuauaaaaugccuuauaauguguuugcauaaagaaugauauuucauaaccaaacucucuaagaacgucuuugcuguaagcauucaguugcucauugucaggcacugaguugauuuaucauuuaauucaaacacucuuguuugcucaacacgguggguucugggggaaggaccugaaugguuucauucuagcgugaaguucuuugaauuugagugagaggacacacaaggcuugcaguaaauauuugccauuuaaguugacugaggggcaaguggcagcagguaaauggaggaaaaaggaauuggggaugggucuggcagucaauaugggagaagguccugggccucagcauaguucuugugccgucuugugggcaaaucugggaaggacuaaggaagcucauacggucuacuaggaugccagcagaauggcagcucucccacggccugcucuccauagacaaccaaagagacuuucauuucauuuuguuuaagucagacuauaccauggaaggacaaagaauaugaucaauauauugcaugaaaaaucaauaauaacuagaucagacuguacugcugcuuuguaauaauaucccguagcuuuucaggaaauuuagaguaaaaugcagauuucuuggcuugcauaaggcuucguuugauauggccucugcuggccuagggccucaucucucggucuucuucccuuguuucuucuaaugccgcaccauaaguccucucccugguacucuucauuggcuggugcuuggucauucagaccccacuuccacagcacugucccagggaggccuuccucaaccucucauucauuauagcagccaagcucugugaaccacagcucucacgguuguagagguauuaucuaucugccauguucucuggugaucuccaaagccuaggaaaaccccucacgcaauauggaugcucaguuacaauuugucaaguaugugaggacuguuagccaguuucuugaucuuauuucaccuggauguagauuaggugaguuaguccuugcccuauagaacacgaaagagcagacagaauuaaguuuuguuccugcaauuguugcuucccaauuguucuguucuaaacuuguuucuuuacugcuaaaguggaguuaaugaacuuaacuuacaaaaguaagaguuuggggaugaguuguccuuggcuacugugcacaaaagccucucucugucucuaacaucaguaaucugagcacuugggauguugaaguaugagaauacugaagaagcucuggguuacccuuggcuacauacuauguuugaagcauaguaaaugcacguugucucaauugugauugggagcuaagaaggaaaaauaaaagcaggcaagggauaagagagaaggcugcaggaguagacauuucuaaugcacuggaauuacuuauauccucugucucccccucccccucucccccucccccucuccccccucccucuuccucuccaugaucuugcuauguaguccacccuggccucagacuuuaggcaauccucccaaagccucccaaauguugagauuacaggcgugugcuuaugccuagcuaguagcuuucccuuuuuaccucaaguccucaacucaugacagaguaacuuugccucauagugucacauguagccaauauuaacucagucaaauaaucaaaaaacaucugauaugguucaucaaaacuaauaauaauuuuugucauuguuuuaaguaguuuuauuuauuuauguauaugagcacucuauuugcacuuaugccugaaugagggaagagaggaucagauagaaaagggcauuggaucccauugcagaugguugugagccaccaugugguggcugggauuugaacucaggaccucuggacaagcagccagugcucuuaacugcuaagcgaucuuugucauuucuaauccaucacauuugucaaaaaauauuuuaaauuguuaggauacaaauauaugucuuugucuucugacacucuaguguuuguguguguguguguguguguguguguguguguguguguguguauuuagaaacagccucauuauaugguccuggcugucuuggaacucacagccccagcgcugggguuaaaggcauacauaugccaccaccuauucuucaauuguaacuguguguauuuguuaugugucauggcauccaugaggaugucagagaacacacgugcagauucaguuuuucuuucuacuguuaccugguccugaggguuaaacucaggucaucaggccuucaggguauguguuugaccuaugcagcccugcugcccuaaaucuuacaaaaucuuuaaaaacaaaucuuuuuaaaaauuaauuaauuauuuaauuuacuuuacauccugaucacagcuuccccuuccucccuccacuccaccgaguccguuccuuucugcuucccaccuuccuuucucuucaggaagggagggcucccauggaugucagcccaccguggcauaucaagcugcaguaggacugggcacaucuuccccuauugcagccagacaaggcagcccaguuaggaggaagggauccaaaggcaggcgacagagucagagacggcccugcuccugaugaaaacaauaaaucuuuucuuuucuucucuuuucuagaauuauuuauuuauuuauuucauguaugugaguacacugucacugucuucagacacaccagaagagggcaacagaucccauuacagaugguugugagccaccaugugguugcugggaauugaacuuaggaccucuggaagagcagucagugcucuuaaccacugagccaucucuccagccuugaaaacaauaaaucuuaauaaauuaaaaaauacuuaaaaagauuuuaagacuaaacucaaaaauccuuuuuguuuuguuuucagacaaggacuuguguagccuaggcuggccucaaacucacuauguaaucaaggcuggcuuugaacucuucaucuuccuaccuccugaaugcuucagguuacagguguguaccaccacauucgucuucaguaacuauuaauuugugacuaauaucuugucagcuugacacaaacaaggaaguuugugucugggaagaggaaaaugccucuauaaucuggcuuguaagcaaaccuguuagccauucucuugacugaugguagaugugggagggccaagcucacugggugguucuacccugagcagaugguccugggcuguaugauaaaguaagcugaucuagccacagagagcaagccaaucaauagcaucccucuguagucccugcuuuagcuccugccuugaguuccugcucugacuuuucaucaugacaacuacaaacugcaaggugaacuaaacccuuuccccacaaaguacuuuggugaugauuuuuuuuuuuuugagacaggguuucucuguguaacccugccuguccugcacucacucuguagacaaggcuggccucgaacuuaccugccuuuuccucccaagugcugcugggguuaaacggaugugcugccaucacuaccccagcauguuuguaguuuggaucagaguaauaaaacacaaauuaggacacaacucuuuauuguuguuaacagugguuucuagagacaagguuucucuguguagcccgggcuguccuggaacuggcucuauagaccaggcuacccuugaacucagagaucugccucccucuucgucucugcuacagugauuaaaggcgugcaucaccaugcccaucaggacacaacucuugaacauacugugguuuccuuauuaucuaaaacaaucuaaaagugucagcuacauuugaagcugaaagauaaaauaaaagcuauguuauuaaaauugauuugaaaaaauuauuauacacuauuauuaaaaauuauauaauauauaauauauauuauuaaaauuauauauuauauuauauauaauauauuauuaaaauuaauauacauuauuauuauaaauaguaaugcaaaaccuagauuaaaguggcugugaccugaaggucaguugacuuugauuuugaggcgugagaaaaggauggaugcaggaaguccaguggccccucccuuuucuggagcagacagggagguguuuacucugagaaccugucacuuacaucugcucacugagugaugucaucagauuuccuggaggggguaauuuuuuugcuaggugguaaugguagggaaggaggugugcgcaggggucaguagcugucugauugucuggcuggacugauacugugcuccacagagguccuaagauccggauauucccuguagacaggauguaaggcuaaaugcagucuaguuauaaauaaauaaaauguucaguggagauuugcugaaacauggaccuuguacagugaugcuccuaaaacucuacaguggcuguaauuuggucuuaaaucuuguuuguuuguuuguuuguuugcuuguuuuucgagacaggguuucucuguauagcccugccuguccuggaacucacuuugaagaccaggcuggccucgaacucagaaauccgccugccucugccucucaagugcugggauuaaaggcgugugccaccaccgccuggcuuuaaaucuuuuaaagaaugaacauauuauuuucuuuauuuuucaaaguuacuccaguaaauggguuaggcuaguuuuauaaguugagacuauauaauuauggcuucuuucccaaaaguuaccucaccaacuuuuucaaagauuuuuuuuuuuuaauguaugugagcuugugugcuacauuuauguagggggccuacagaggcacaggaagaugguaucagauucucugaaauuggaauuaaaggcgguugugagccacgaugugcuaggaaccaaaucuaagucuccacaugagcagugagcacuguaaccaccgagccguccucuccagccugcugucucagguuucucuguguagcccugguuuuccugaccuugcuuuguagaucaaucgggccuggaacucagggaccugucugucugccucccacugcugcucaccgaugucuggaguaggucacgugcuugguguuauuugccucugugcuucuguccuggcccucagcuugacuuaacaauguaaguuuauuuuauuuuguguauuuuuuuuuccugagauaggaucucacgaagaaaauacacaaaauaaaaugaacuaaccauccgguggcuacugugagugcuuagcugagagucacaugacuugucacccagccuuaaaacauuucugcuuagugacaauguuucuacacuuaagaaacacaugucuuuccugcauaaggggucuuguagugcuuccgacaaauuguaacacuccaauuuccauagcuuuuuaucugccuuagagugcacaguuucccaucaucauuuguugaagacuguccucuuccccggugaguugucuuggcaucuacagauuauuugaggauaugugcuaaaugucucucuagucucucuguucguuucuuugucuauaccagcaccaugugacuuugauugcuguaguuuuguauuaaguuuugaaauuaggaagugucuugcaggucauucauccauuugcaagaguguuuuggcuaguagggauccccugaguuuccauaugaguuguagaaugcauguuucucuuucugccaaaaagaaaagaaaggaaaaucacagagaucuuaauaaggacccugaugacuguauggauugcuuuagguagcaguggcaucuuagugauguugucuuuuaaucuauaaacaugugcuuccauuuaguuagugaaaagcuuuugguguguauguggcaugugugcaugguguguguguguguauguguguguguguguuaacucaggaggucucaguugguacugccucugucaccuuccuccuccucuuccucuuccuccucuucuucuuucuacuuuuccuccucauuauugugguuuuuuugagacagucucacuguauagcccuggcuggcuuggaacucacuguguagaucaggugggccuacacauaaagauucaaacuccuaaugacucaacugccccugggauugauuaaaggugugugcagcuacacccagccuuucucucucucucucuuuuuaaguaccagagaccugggaggugagagacucucaggacucaaagggaggggccuuagaugaaaugcccaaaaguggggagagggaacucguaaaguccaccuccaguggaaagacggggcaucaaguggagggaugggguugccaucccacuuguuccugucuaaaagaacugcaaggacauaaaaggagaagagacugagggaaaggagguccagugaccgacucaauuugggauccaucucaaggggaggccccaaggccugacacuauuacugaugcuacggugagcuuacagacaggagccucucauguccucugagaaguccaacaagcagcugaaaauucagaugcagauacuuaaacccaaccacuggacugaaguuggggaccccugugguugaauuagggaaaaagcuggaagaagcugaggaggaggguaacccuaugggaaggccagcaaucucaaccaacccagaccccugagaucucucaaacacugaaccaccaaccaggcagcauacacuagcugguccaaggcccgacacauauacagcagaggacugccuggucuggucucagugggagaagaugccccuaacccuagagagacuugaggacucagggagugggaaguccuggcuuggggguggaaauaaaaguaauuaaaaaacaacaacaacaaaagaugcugucuccuugaaccuggagcuuacuguuuuacuuaaacugguuggcaagugagccccugagacccgcuugucucuguccccacccaguacucggguuaucaauguacaacucuugccugacugugccacagauucaagcuggcacagaacacauuugccgacugagccaucucccuagcugaauauuauuuuuuucacuucucuaucaagugcauccuuuccacauuccuuucagguuacuaagucugguaauguaucugauguuuauaacuuguaugcugcugaauucauuuacuaguucuagcaacuuuccugugggauccucagguuuucuuuauuuaagguugcaucauccaugaguaaagauagcuuucuccuuuuccauuuuaauggcucauuugucuuccuugccucauuguuuugucuagagcuucagugacuguugaacaaaaguggagaagcaggcuucuguccucguuccuaacguuagaggaacugcuuccucucuuugccugcugggugugcuugcugagggcuuguuauggcuaguaguucucuucuacuccuagauaaccacuguugucaggaaaagauguuuauuuagaaucuugucagaugccucuucugcaucagcugggauuaucauaugguauccccuccacucgguuagcgcacuguaugugcugauuuucauacauuagaucauccugauaucccaagaauaacucucaucuggugaaugguauaucauuauugguguguguguguguguauguguguguguguguguguguguguguguguguuguacacauguauuugugugaguguccauguggaagccagaggucaaucucauuguuuuucuucaggagcuguuuagcuuggggcuuuguuuguuuguuuuguuuuuuuguuaugcuuuuuauuugcuauuugugcaugggcaugagcacauggguggaggcaggcauuuagcugucuaagaacuacuucagagagcaguucagcagaccuuaccuaucuccuuccaccuuuauguggguucugaggcucaaacucaggucacugacuugugugguaacaucucaccuuaugagguaggaucugccgcugguccagagcucaucaguuugucuagaccagugaguaccagggauucaccugucuuugccucugcagugcuggcuuuuuguuuuuguuuuuguuuuuuaaggaggaugcucgguaucaagcucagguucucaugccugugcggcuaccacuuuacccagguguaaccauggaacuggacuuugggcugcuuugugggcuccuuuucugccaccuuucuccaccccuauuccaccuuuccaacaccacaacacuagguaggagagaaugaaggcuagcagagaaagggggugucgauaucguuagacuacuuuucugauuaggggcauuugaguuccuuggggcaaaguuuaaucuuugcugucagguuauccaauuucuucucaucucuuugcacaugacuauugacaaaccacaacaacagcaaucaguaacagcugcugcugccgccgccgccgccacugccacaccccucucagggcucuagcauuuguaugacccucccaagagucaccagaauuucagauaucauacacuugcagaaacuggcugcagcuggugaaaucacgcuccugcuagagcgugcggcaaaucauagucagcugcuguggacaaucuaaggcagcuccguauuccacaccugggaugauacucaaaacacauuguuguaacaugucugcuuuuaaagaaaccaaaauucucacuacauaaccauucuaauaugcuacuggguugaguuugcuagcguuuguugaggauuuuuauauccaguuccuauggaauauugguguauagcuuucccguaucucugucgaauuugggugucaggguaauacuacauuuauagaaugacaugggaaguauuuccaucucuucaguugucugggaaacuuugaagaagauugauacuaauucuuuaaaugguagaauucaucaaagaagccaucaauccuaggauuuuugucuauucagauuuucuguauuggugugauuuaaucucagauuuuguguuucuaaaaauuugucuguuagauccagguuauccauaauuaaauaaaggugcauaacuguucauuguauuucuacaaucuuuuuuauugacagauaauuugaauauaucugcuuucauuugugauuuagugauuugaggcuuuucucuuuucucuuugucuaacuaaagguucaucaacguguuuuuccuaauaaucacauuuugguuuuauugguuucuucuauugucuauucuuuauuuuacuuuagcccuacacuaaucuuuauuauuuccuuucuccugaaagcuuugguaauguuuuuuuuuuuuuuuuuuuuuuuuaguuccuuaaaauauaaaguuagguugacagcuugagaucuacugugauauuuaauuuuuuuaauuaaguaucacuuguggaggugcaggugcccuuggaggcuggggcagcagauuccccuggagcuggagucacaggcuguugugagcugccugauaaugggggcugggaaccaaacucuaguccugcaagaacacuaugugcuguuuagugcugagccacuucucuagcccccugugacucuuaauacaaauguguauagauaaaaauuugcccauaacaccguuuuuacugcuaccugguuggucagaagucagugaucauaagcaacaguuuugauuggaacaccaguuucugagauuuggagggaagaggccuauauauccaugcucuuuccugacauuuauauucagaucugucuggaaaugugugcacacugccugccauggagcuaagucuggcaggcuggcacuaagagugaaauugacugaaacugacuacacgggauaacaaagaguuauuguagacacgguuugccagagcagcauugccuagguagaaagcuucugcuguuucucacacugccaucuuccccuagucugucauuugacuguccuggacaguccugccuucagcauucauuugugcccauugucacugugguaucccauggugacacgucccaagacgauagauggcuccuccugcaccugggcuccauaccuuucacuuuuccagaaaguuccucauuccucagucuuaggucuguaacagugaucuucauuucucuaauuccuuuugagaaacaaaacaaggcaagucaggaacuuaaugggugguucauaauuagugaauauugguguccuaguuaguguuucuaccacugugauaagcaccgugaccaaagguaacuugggggggaggaaaggguuuaguuuacuuuacagcuuacaagccugucauucggggacgucagagcaggaacuggugcagaagacgugaaagagcacugcuuacuggcuugcucacucguggcuugcuuagccugcuuucuuauaagaaagaacaaccaagaacaaccagaacaccaagaacaaccaggccagagguggaaccaccuacagugggcugggccuucucacaucaaucacuaauguagacuugccgccuagaggaggcauuuucucaauugaacguuucuucccaaaugaccugacuuauuuaaaauggacauacaacuagucaggaaaaucagcuuuucauaguuaaaauuauauguggguuacuuaagcauguuuuguuauauuuucuuuguacuugguuuauggcuugagaagaguaguugacggagaauacuuuauaggaaguaucuaguucuuggguggauguucuaaauauggaaucacagcaucacccaggggcuuaggguagggaucucuucaguacagagaaccucagauuagauucuaaauucuaucacuuccucuaugccaccaggcuuugucucuuucuagacaaaaauauuagaauauguguguguguauguguguguauucuagaagauuagugcaguauauauguguuuguguguguguuucagccccaacuucucccacucuuagauuucuuuguaaaaagcauagacugcauaaaccuuccaguggcucugaauuugcaucuaggggucuggagcuaaacugagaauggaaaauggcaagcaugccacauccuagccuuguggccauaauaaaggacuuaguaccuguuuccugcugugugcauaaugaguaauauccccccaccccucacuggcuuuuggguuuugagacaagguuucucuguguagcucuggcuguccuggaacucacccuguagaccaggcuggccuaaguuggaacuaagaccaguuggaacuaagagaucugccugccucugccuccaaguuauggaauuaaaggccugugccaaccauggccuguccuuaagugucuuaaaguuguaccacucuagcaaaagacagcuaucagauauaauuucuuucuccuuuccugauuuuuuucuacaacuuacaaaauauccuguguuuguggggaguggacaccaucacacaucccaucuguagaaaugagaggacaacccugcgaagcuagaguucucuucauauuuacauggggucagggaucaaauucagcuugucaggcuuacauggcaagugccacuaccugcugacccaucucauaguccuccaccuuacuuuuuugaagcaauaguucuuaaugagcccagagcacauugauuuagcuaaacuggcugaccagugagcaccaggauuugccugucugcaucucccugguauuacagacacuuccagauuuuuauguaguugcugaagcucucagguccucauucucuuccagcaagcacuuugcuaacugaacuauguucccaggccugaugcugcgugucuuagugucuggugguuaaugucagccucuccuaugcuuuagacuggauuaaccaaggcuguuauacuccucgguaaaagaagaaucaacuauuucucggggaagcuucuuugacugacauccguuguucugaugacuagauugcauuauucaugugccauuuugcauguaauuucauuuuccuccaggagaagguggguauggucuauagggacugcaguguuuauuuaguaucuucucuuguauuauaauccuacuugaucuuuauagcaacugagaaacuguggcuggggaaggacgagaauuaucuggaaguucuacugggccagcagacggcuacccugagaucggauacauuuucauucugcuuuccuguuuucauuucuccugggaguuuucaagugugguugcaguuccucuuacuuagcuaauauuuguauaaauuuuagaguagauauuuuacuuuugucugugacauugaguugagagagaauaauuuaagcauaucacuuucuuacagguaucaguagcugaugugcaauuuggcccgaugagauuucaucaagaccaacuucagguauuaugcuguaaugaucacauuucaauuuucuuuagugaggaggguauuuaaaaugauacauuuaagauaauuucuuuuucuauuuagauucuagcacuggaucaugguuacauuucuuggacuugguaacagugcuaucauccuuuccuuaggaguacacagugagguuaaaauuuaggcuugcaauaggaagugauuaauugugcacgcagucacaugugucauacauugagaggaaggaaaaccaaaguggcaaaaggcaaagggcugauuaaucuagaggaagaauguuuaaggcauugucauuuauaacuuuucaguaaguuugaauuuuuccaaaaugaaaaguuaaagcauagccucuuccauuacagcaaguuuguuguuuggggauaaggucuuauauaacccauguuggcaucaggggaccggagagacagauuagugguuaagagcacuuacugcucuuguagaggaccuagguucaguuguaaguacacacagaguugauuacaacugucuauaacuccagugcuaagggccuuucuucugggacucugugggcacuuuuacacauauggugcacacauguacaugcaggcgaaacaccuguacccauaaaacaaaaauaaagagaucuuuaagaagggauaagaugcagccgaguuauuugaagcucucugcacaugaacuaugucugcuguuguauuuuaaccuugugaagggggcugacaggcguguguucuugguuccuugcaucugugguauuugaacaguugggcaaacuuucaaggaaauaaaggauagcuuccaguuuuguagucaaccucugacugcaaggcugcuccaucaccacacaaccucugucaucuauggagucuagcccugaaggggaugaucagaggugcuuugacccugauuuggcugggagaccugguugaauaggggagaggcagcagauccaggcgucuggugguuuaggcuaggcaccaagacaagcaguuaccagccugacauuggcccagaugguacgcagguugccugggcccuguguccauaucaccuggaaugcuguagugcucaaaucucucaaauucagaaugacuuuucaacauggaggcauugcauaaccuuugugucaaaacacguuaaguacaucauuuaaggauggcgugucccaacaguauuucacuaaaauacuugcauuucccaucugaggaauuucacuggaauaccaaccuugucauacuuaguuaacuuucuguuugcuaacauaaauauuuguguuuugauuccauuuuaaaauaaaaauauucugacaagucuuuauugcguccuaucgaaggcauuaucagcaaaagaaguaagcauauguuccaagugcuuggacuuccagccuagacauuuuagcauugacuggccgaugaaugcuaaugucucugagucauauguaagaaaagaauguguauuuacagauguuagguucauaacuugugucuuaaacauuuaaggauuuucuguggcuucuuuaaaaaugacaguuauaucaagauuuuaaaaguguguuugugcucuucugguccagguccuguuaguguuuaccaaagaagauagccaguguaacggauuccacagggcaugugagaaagcuggguuuaagugcacagucaccaaggaggugcagacuguccuuaccuguuuccaggacaaacuccaugacaucaucaucauagaccacagauauccccgacagauggaugcagagacauugugcagguaagccagcaguccgugacugaguuccauggguccuuaugacagccuauaaacacacuaaguuaaauucaaucgcccuuuccuuguaugcaaaauaagcaaggcauuauaacuuuguuguuucuagggcuaaucuuuauuucuuaauugucuugcuugcucuauuuaaaacaguaagaaauugucuugcaugcacaaagccuugggcuuguuucccaacuuuaccaaaaaaaaaaaaaaaucaaaccaacaacaauaaaaaaauaguaagaaaauauaaaugacaaccauuaggguuaagaugaaaccaacauucauuuaauccaaacuaccacuugaauguuacuuuuuuuuuguuuuuaaaaaagauuuauuuauuuuuuauauggaaguacacuguagcugucuuuagacacuccagaagaggguaucagaucucauuauggaugguuaugagccacuaugugguugcugggaauugaacucgggaccuuuggaagagcaguuagugcucuuaaccacugaaccaucucuccagccuuuuauuuauuuauuuauuuauuuauuuauuuauuuauuuauuuauuugcauuuuccccuuuccccacuucucuuucucccucuugcucugggcugcucacucuggcccauagguuuuuuauuuguuucucauuacaugguuguaagccaacauguaguuguugagauuugaacucaugacuuccagaagagcagucagcacucuuaauuguugagccucucaccagccuaaauauuacuuaaaaaagggaaugacuauaauuuucuagacuauuuuaaaagacuuucuuuaugugguauauaugugugugcuuaugugacaguauauauguagaagccugaggucaacacaggugucuugcauuugccacuuguuucuguuauugagacaggaucucucacuggaccuuagucucaucuuuucaucuagguuggcaggccaguaaguuugagggauuugccucuuuccaccuuccccaaguccugugcuuauagaugcgugcugcaugccagguuuuuauacuuggguccucaugauuguaugacaagcccucuaaaaacugauacuuuuccuaacugguaacuuggguaacuccagaacugaacaguacgcagugggcgugacuggccagugaagaacagaccuuuaaaaauauggauccuuuucauauucuuuuccugauaggcccuggccaagaaucuugggucuuucuuguuagcuuucuaccauuugaucuuguggggugagagcggggauuugugucaucccuagugaguuuccuggaggcaagagcaggcccugacaguuuuuaagccagccuuaucuugguuucaaccucuaucugguuugucucucuuaagaucaucuuuacaaaggcaccuauguagaaugaacuguuucaucaagacauuucuccaggagcucauuccucaacugacuuuccuugcuuucaucagaccuuugaagcccaugagaccuuagccugauagagcccuguucuuccuuuaucuucugguuggggguacuuauacagugccggcuugugaaaauauuucaucaguggcugaccuacccaaauuaucauuugccuguagcucuuuaccaguguuuggaacuccuugcacgccugugcaguaccuucuugaaggccaaauucuuuuguuguugcauuuucuuuucuuucuuucuuuuuuaaucuuuuuuuuauuggauauuuuauuuauuuacauaucaaaugcuauccccuuuccugguuucccuuccagaaacucccuaucccauucccccccccccccccgcuucaaugagggugcuccccugcccacccacuccugccucucugcccuggcauuccccuacacggaggcauugagucuucacaggaccaagggccucuccucccauugauguccggcaaggccauccucugcuacauauucggcuggagccauggauccccccauguguacucuuugguuggugguuuagucccugggagcucugggggguugggggucugguuggcugacacuguuguucuuccuauggguugcacaccccuucagcuccuucaguccuuucucuaacuccuccauuggggaccccaugcguuuucaaauccuguuucagagcuuuacugacugguuuggacacuacaugugguacuagagcguguggaugaacaaagcaugaaucgggccucugagggacugaugcucucguuguagagcaugaugauaaauuucagacugucaaacuguccaccugaccugacuaaggcaugcugaaggcaguaguaagauaccuuugugagcgucugugugggcauuuccaaaaaggauuaauugagggguaagacacacucugaguguggguggucccgugccauggguuggaguccuggaguaaggaaaaggggaaaaggaaaaggccacugaguuccagaacuccuccucucugcuuccugauuagcaagaugaaaguuaccuuugccauagcugugagcuccugcugcaggccuccccacugugaugggcuguaucuucugaaccaccgauaaaaacgaagaacggugcccagaaguuguuucuugucaggucauagcacaagaaacauaauucauacauagaauaucuuuguuucaugugacuauaacauaaagcuugagacuagauaauugauaaagaacacaaauuagccagcuggaaagauggcucaguggcuaagagcaccuguugcucuuccagaggaccugaauccaagucuccaagcccaggucagguggcucacaacugcccacaaagcuccucucaccccugcccuaccagagacagggccucacuauguagcccuggcuguccuggaacucacucugcagaccaagcuggccuugaacucacauaugccuacuucugccuccuaagugcugggauuaaaguugugugucaccacacuccagcugaccgccuguaacuuuagcuggaggaugggguaagggaauccaaucuuucucuugacuccacuguccccuauacaugcauggcacauacucacaagacacacauguauacacauaaauaauaaaauaaaaucaaguauuaacaacaacaguauagaacaaaaauuauuuuuuucauaguucuccagacugagaaaaccaggcuaaagguucuaauagguugucuggcugcauccucuggcugugugaaaucuccuuuguaagggccuuaaugucacucaccagagagcagccugaauggcccaaguucuuagggcccuacuucuugacacugucacauuggcaacacauaaauuuuggagggcacauagugaagccagagacaggcagguguucaggagaagagauuuaggagggaaaggcggcuugagagaagauguuugaguugaauagugagggugggcaggaguuuugaagagaauggugguggaggaagggcagcauaaggaggagcagcagggugccuaggccccucugccggugcucacaccacuggucagagagcuggagaggucagggccacagacaaaggccagaugcaaaggccuacugugccgagccagucuuugaacucuacucuggguagguaagacgcuguacucugggcgugguagcacauaccucccucuaauccuucaugugugagguagaggcagacauucaggauucugagcgcaaucuaagcuacauagugagccucuguagcugucucugcugcauuagagacugaucagaagcaagcuguacgcugugcucagcaugcaccagcagcugcagcgaaaguaccagugaagggagguggugagaaggagauguuauucucucccacugcugucugcucuaccugagaugcugaguuguugucaucagagaaacaugguguugcccugaggaguggcaaagccucagugagcuugucggaggcaugugcuccgacuccugaugccccgucaagacaggcuggucagcugugguuucccaaccauguuggcaggagggacagaaugaaaacagugcuucaaacugugcaguugcaguacaguaagccgugauucuagguguggcuugagaacuggagagagcaagccaggcgcccucugcagcaggcacacugcacacacagugcauuccaaaccuguugacaagaggaagguggcucugacaccugggguucagugaagcgagcuaagaaaacugauggcugucagcagccuggauaaaagucacuuccgaucaagggugacugacaagaugaagaaucggguaggggguguaaaagcugcaucaacauaauggcccagaaagaacagcacuaaugacugugugcauguggugcauggacauauuugugugggggugggagggugcaugcguguggaggccagaggcugacacagggacugauuguucuucaccugauuuuuuaaggcagggucuuuuacugguccuggagcuuauccauuagacuagacuuguuggccaucgaacucuauacccuccgccccugagugcuggggcuauagacaugcacugccccuccuggcuuuugcuuggguccugaggaucugagcuagguacucauuuuuuugagacaaauuggugccauaggggcauggcugcauaacagaagggaagauuucgugaaggaagauggaggaaggagagaagcccugggagaaaccccggcauggucuaguuuagcaguucuacccuuugggguugugugugucaaacaacucacucacaggggucaccuaagaccauuguauuagacagauaguuacauuucgauucauaaccauagcaaaauuacaguuaugaaguagcaaugaaaauaauuuuauggcugggggucuccacaacauaaggaacuguauuaaagggucacagcaauaggaagguugagaaccacucuuguagcagaauuaaaauucacauggauacagaagcaaaagcaaacucaggagaaggaauggcuccgugguacagauguuaccgugcaagcaugaaaaccagaguccagaccgccagcaccuauguaaugguggguaugcaugacccaccuguaaguucagccuuagagggcagagauggcucccuggaacaagcugcuuaucuggauaagcugaagccugagcuucagccucaaccgagagacccugccucagugaacaagguggagggugacugagaugaugccgagcauuggucugggaccacacaccgcacaccccacaaacagaauuauguuccuccugucaaaaaaaaaaaaauaauaaggacagugucaagacacauucguucauacgauuucuugauucaccuugaucuaaagagcaagaucgcugugaaccuccaugguaaccccuuccucgguguuggugcugagaccauuaucaggaucauuuggaguucucucgugugaccagagacugguaguuuccccaguacaugcuuaugguucuuuagcuaauaaucaauucucagcaauuucacagggcaugaagccaccuaaagaguauguugccuucuuuagcuuuccuuguaacuauccauuggaacgguuaugugcuuucuagaaaguauccuugacgggaggggucaugcuguuuuuccuaaugucuagcauguggaaaugauggcuaacauucagauaauuuuaaaccacaaagaccaaauauuauuuagauaauaauagggaaauacagagugaaaaaaauccagauuccugguucugcagagugucacagcagcuccgaguucucacugcauauucucuauucucucucucucucccucucucucucucucucucucccucucucucucucucucucucucccucucucucucucucccuccuucccucccuuggucugucaaucuaucuacuuugaggcaggaucgcuguacuggaacuugcuuuguagaccaggcuggccuuuaacucacaaagauccaccugccucugccucccaaugcuggaauuaaagauguguaccaccaugccugacagcaaaaaaaccuuaucucuagcuauauauccauccauccauccauccauccauccauccauccauccauccuucagauccacaucacuguuguuugggguuuucuaucauguguaaucaaggguaguucugagaaugccccagguuucuuggucuuuagagucuccugacuuugaaaucugucuuccuaguguccauuuugauuauuucaaaucauuucuuuccuaguuucaugauuuuuaaggcaagaauauuaguuuuaauggccauugucucucaugccauuuucugugccugccauuccuauuucuagccaguuguucauuuucacuagaggaagucaaguguuugcuucugucuucacauacaguuuagcacugcguugacgggcuugugggcuggguggacaugcucccucuccuguuucuuccuugacacagagccccaugucuguuuccugcagugauaggcagguuguccacagcuccuccucauauauuacuuggaugguugcccacuugccacuauauuaccauaacuguuucccccacuaaaaugcugagaguguauuugacauggcuggcuggaaacuuaagucucccuuucccucuccaucgcuguuaugaugaagggcaugacgggaaccucuaagaacagauggagugucccuaagagucacaugggcuuuguuaccaggagugcaccagcuuuguacaaauaagggucugcugcaccaaugauccuucuggagcugagagacccuccucuagccuuucucuccagaaacugagucuggucuucuccuagcaggaagaccagggcuggacaccuagccagcccuacaguccccuguguggaaagucuuuuccaguagaacucuacaguguccuuuaggugggcuccuguggggaagaaggacagaugagagcuaguagagucgaguggacauuaggaaacacaagaauguugaaaaaggaugggaagagcuaugugcucaugagagauuagcugggcccuggagcugcuuuucguuuuugcacagcucucacugagaacuagugacccacagccucagacccacaggaaacugcagucugcaugccccaagguaagagcgagcaaaggauagaggcucugccuauucugugaucacauuccugcugcaaggguaaggaauuguuuuaguuucauuucuguugcugugauaaaauauccugacaauaguaauuuaguggagaaaggguuauuuuagcucauuccguuuuauggucuaucacuguggugaaaucaaggugacaggaauuugaaacagcuagauacauuacacccacaguuagaagcagagaaaaauggaugcacacuugccuacccacuugcuugcuuugugcucagcacuuaaggcaauccccuacagacaagucuguaggccaacagagugcugaccaugucuuacugauacacucucuuuccggggcauuguggguuguggugaguugacaauuaaagcugauaaucacuagucgucaacugggacaaaacacacacggauacauaaagccugcaaaucuuaaaauggucuccgucuggcucuuuacaggaaguuugugaggaucagugcacacacuguguaugaugauucccuugcugacaucuagaguaguuguguuaugugccaucucuggagaaauugggaaguagccacucugugauucagacguggcucagccuuuuuuuauuuuuuaagagcugaagucauggagucagccuuggcuaguuucuaucccauccugaacacauugucuuccaggaggccggugugauugucucuuaguuaggacagucugaauauggcgcucuuuaccacucccauccaagauccuucuucuccaguggguggaaggagauaacuuagauaaauccaccuuuuucucaguggaaguugaguucaaagcugugguaugccuccagcagaguguuccuuuccuuuugcuacuccucugcauuuccuauaugccuucccucugaucucuucgcuagguugucaucacucguggucuauguaauugcuuccccuuaaaggguugaggggagagccucauacuccuugggugaugucaguggagcagugucucauacucuuccccaccaaaccuccgucuuaacccucagucacaggugauggcucuuuucauugcgacugacaacaguaucuuguauuuccuggucuuagucuugugguggugugauuuuugccuccagauuaccuuagaauucuucauucuuguuaggggacccacauggagacuucugcuacauaugugcggggagccuagguccagcccaugcaugcucugugguuggcaguucagucacugugaguucccaugggcccagguuaguugacucugcaggucuucuuaugguguccuugaccauucuggcucccucaguccuuccucccacgcuuccacaagacuucucuggaguggggccuuacucugacucuguugccugccuuuggaucccuuuucccuagcugggcugccuugucuggccucagugggaggggaugcaccuagcuugaugugccaggauggguugguacccauggggggaggcuucccuucucagaggagagugggaagggaaugggaggaugcauuggaaggagaggaagaaguggggggcggaggggagugcugcaaucggaauguaaagcaaaugaguaaauaaauuaaggaaaagaaaaaaaagaauucuccguucuuugacaagcugaucccuguuugcugugaccugcagucugcacaggcaggagaagcuugcacuuccuuccaggggaggagacaagugauuguggccccuuucuaguaaguacaguguaggagagagugucccccgggcuaaugcauaaagagucuccuuagcuguuucauuugugcaugauaauugucauggguauuacgguccacugaugagggguuuauccccaggaaagaucaaauaacugagaccaugaauccacagugugaagggagcccuuccucuucuuguuuuccuccccaacuguaauucuacagcuaaaacuaugaaaguauauuuauuuuuaagaauuguuuuuauacuuguuuaaaauuuuguuuuuuaaaggucuaucagaucaucaaaauucucagaaaacacaguuauuguuggcguaguacgcagguaaacauuuuuuuaauguugaaauuuauauaucaaugcaauguuaucaacagauggcaaaauaagggcuugccugugacaggagagccccuuugaagucuggcuuucauuacucuguggcauuuuauuuuuucuucuuugcuugaccucagggaggaaguuugcuuucagguuuaguuuucuaaacuuugaaccuccauuugcaggcaaacuauuaagaaaauuccauucucuuaagggugaagguugcgaagaggggucuuuguagggccuuuaauucagguaucuauaaggauucaggugccacauaagugcagggaaucuucucacauuagagcaaggagaagagacuauacaaggaagagagcaacccuuaacuaugcacgauuuccagucaguauagacagacaugcuucugugcucuguaaucuucucaguauggaagagaggagaauuuaauaguuucaguauauagagauuuauauauuaaguauauaccuggacacuauucaguuguuaacauaaucuuuguauuuaaaguauuaaaauacuuagauggaacgccaggcaccugucgucuaguacuuggaggcccaggaaagaggaucgacagcuugagccuaggagucgaggccagccugagcaacagcacacccuauccccacuaaacacgcuaugaaaagauccugccaaaaggcuaaacacuaaauugagacaaggaauucauuuuuaauuucauaugcauauaucuaauucauuugaaaguauauguuaugugacuguugaagauuauguaaauuagugaacacugucuaacccuuaccauuuuccuuugaaggguggacaaagaagaaucaucuuuaaugcccuuccuugcugcuggcuucacacggguacguaccuacuucuuagauggacaaguguaauucagagaaauuuuuaccucaauucaguguccagcaaaaaauuuuaaauuauuuugaagaaaaauuguuccuguacugugucacaguuuguuuugacuuugaaaacugauagucuaaucuguaacacuucauuuccugagucucaaaacuaggccugccagaguaauaaaacgaccugcaccgacagacuccuuuacaaaguauauuagaaugcuuuuacgugagcuggagauuuaugaagucaauucaguucaaugauucuggaagagaggcagcccaagcccuggcuccucgcccuuuacauccaccuuagucuguuguuucucuuaaaacagaaggcugcucaggauuuuagccagcugguuguagaugagcuauaggauuuggggacagagugaguggaagaaaacuugcuuaggauguagaaggccuuggguuugaucccuagcuccgaaacacaaacaaaaucaaagggcguagagagaacagaugguugcgggguacguacccggaaucccagcuuacugaggguaaagaugguuugguagauauauaacauuucuacccagugaaaaaucuguuacaugguaggcuauuuauugcaggggacaaacagacacgauuucugucucugccccauauugauccggcuaggauuggugguagacagacguguaagggcucuaucuccuccuccucagagugaucccaaggucucgcuggcagagcaguuaaugauccuugucugucucaaggccucuaccccaucugguggagcagcaagagcacuguacccagaaauaccccccuugcugucccuggcuugucaguuguaggcaccuauaugucccuggcuugucaguuguaggcaccuauauguauugagcgccaucuugguuguucccugaacugcugcucugggaagaagguccaugcucuguaucugucaggaggugagagcuagaaggaaagucauccugaucucugggugagaagggcucugccuguaggcaugcagcccuacugugccccuggcucaguccuugccccuucccugcuucaauaguaccagcuuucuuuucuuuuuaaacgauuucuaucuguguuguggguguuuugccugcauaugugucugugccagcagagcagaaagagggugucagauuccccggaacuuacaggaugguuguuagccaccauguagguguuagugauugaaauuggguccucuggaagagcagccagugcucuuagccaugaagccaacucuuuagccccacuaccugcuguuuucauuccuguagcaguugggaggcagaaugcuuccuccugcugucucuguucuuccggaggucugugguggguagaaacagcaguacuugucauuuguaagugcggaggcaagcucaggcagagugccucaguagggucauacagcuucuaacugguauguccacaugaccgcagauugcuugccacucagacaagacacagaucaugcacaucugccuucacauuggcagcagagggaccugcucaagcagcccauguccuguuuugaucuggcugggauugggucagcagucuaagagcucgguuuccccuccagccagaguuacuaugcauuuacugugcagguaaaagcaaagagcucguuucagaaacgggaguaaaccugcuugugagugucucccgucagaaugauacuacaguuagaccucuaaccaugaguccugucagccagcucuguauccguagacuguaucguagaccuaaaguauucaugagaaaacauuccacgugugauucuagaggucauuagaguguacagaaagauagcauuuauaugucaauacugugccauuuucuauaaggaaguugugugaucucugcgggcacccugagacuuguagguaugugacagcauaaugacuucuaagauaccauaaugaaauacauuauuuaauggugggaugaauccaauuucuuguaacucugcagucuacuuuguuggauguuuccaugauguaaagguuaccauauagaauacuuaauguccacgccuuccccuggugccuugcuguggggaaugauuacgggucagcuccuuuggcaguuaguggaaaauguuacucacauaggaguucccuccuugagccacagauguaagcagaagugaaaauccuaucagcaagacuuugguuaauaaauuuacuuucuauagucuagcccuagcuuuauaaaugacagggagauaaccagagaaucuuaguguuucuaauuuuaaagcuaauuugguacauuuaacuuuaaucucucaucuucuguuguacauuaaugacuacaaaguagguuuuuaaaauuugaguaggcaaauugaaaggcuuguuuaggauuucuuuuguggcaugcaucaaaggugcgucuucaccuacaaagccccccuuucuguuuauagagguuuauagagaaccccaacgucauggccuguuauaaugaacugcuccaguuggcauguggagaggugcgaucacagcugaaacucagguaauccugcccugcuaaaaagcccuccagaccccagggcaaacuugcaagcaaaggguuuuuggccauagcugauagcaguuaaaguaggguaaguuuaaguuggcuguuaguaaagugcuuaccaugcaaacaugaggacccgaauucacuugaauucagagccccauauccacaugaaaagcuggggugccuguaauccccgcucugaagauacagaggauccuuggaguucagguucagggagacucugacucaaaaauaagguggggagcaauugaggaagacaaccagauguugacuucuggccucuacacauacgucaucgucgucgucguugccguuauuguuguuguuuuguucuguuucguuuaagauguaauagaagacuuucuggaauccaucucaaugucugaugagugacucccauuuaaacuugagaccucagagcaguaguaaaugagaaaaaaguaagauacaaaaccacacaccuggauuuucaguuuucugugcuaaagggaaaauacuuuguaccauacccaauagagugccauuuuucucugacaacugauauguuuuccuacucuacauuaucaauauugucauuaauucucuuuuuguuuguugagacaggcucucauguagcauaguguagccuggaacuugcuguguagccaagguugaccuugaacuugaacuuggaauccucaugucuuagccuccugagugcuuggaucauaggccuucgccaccaugugcagcugagacuuuuuuuuuuuuuuaauaagaaacaaguagaagccuagauauuuguagaucaaguaagaaaaaguuuuuaaaugcuccuagguuuaaagaauaaaaccagccauucuccuuauucuguaucucuucuguguccaacuauuuagcauucuuuuuaaauuggggaucaaagagagaagccauugcucuguaucuguaugccuaaggcagauaaaaagcuaucgaaauuggaauguuacaauuuguaggaaacacuacaaggcccccuaugcagaaaagacaugugcuucuuagaaugaaaugauuuacuagaaucaguguagaaacgucacuaagcagaaauguuuaaaggcugggugagaaaagucaugugacucucagcuaagcgcccacaguaggcaccgggcaguuaguucguuuguuugugacucccauuuacuuguaugagucuauucugaguuagggucucacucacugucucucacaggcuguucuugaacucacagagaucugccugccucugccuccugagcugcuagaaucaaaugugugaucccagcacaccuggccuguaauuuacauuucagauacuauaguuguuuucuuuccccaucuccugaaguugauaacuuucuucuucaguaucuuaguguagugaacacuguagcaccagcauauaguccugggucuccuuuacccacuccuaaaucuuguucucacugagucccaacucuucuggguuucucuggacucuagucaauuauuuuugucuucacuuacucuuggaguaaggucacugucuuuugucuggauuguugaauucucagccaggcucccuaccauuaccucagacuuccucuugucuucacacggcauuuguguuucugucuugaaauccuccacugaguuuaagucgaaguccagauccccagauguggcccccaccccacgacucuccugagucugucucuccugaaucuacacucgcuuucucaacucccaucaugccuuguucuggcugacagccaaaagagauguacauuacaaaggaaaagaggaaaaauaugaaggggaagggaaauguggggcuggaguggugaauagagggagaccuguucugcugggugcuggaagccggaagcagcagccuuguuccugcggugucauugacuagaauguuaagacaggcugaucagcaugguaguuaaauaacacacggaagugagcuuuucagagcauaggauuaugacagcugccuaauuacuugaaaaagaaauuaauguacucaguuucacucccuaccccaaauaaccgccaaugaacuaaaaccuuaauuguagagccaugcuaaaugcucaaaaaauauaagcaaaauauuugauuggaugaugaagucauuuuagagucaccaucccauaaagacuugaguuccacaaaggaagagaaaccuaucaaguaagagaaaaacauuaggccuuuauauacuuaaaagggaacaaacccugaaguaauguuaagguuauaggaaaacgaguagaaaaaauuauuuguugcauauccagcgaacauuagucaggucaauauccuaaauaagcuuuaugaauaugaaucaaauaaugaaauaauccaguaaaaaaaaauauuuaaagcuaugcacaagcaauucacaagucagaaaacaugaaaagaagcucgccugagcuagcagucaaggcaguaaggaugaagaaguguagugugccugccgcaguucugcucugcuugaggaagaguggcgucucaguggggcuuccuacaggccucugcugcucugggagcuccugucugugcuuuguuguuguuuaacuuugaggcaggaucucaccacguggccuugacuggccuggaacucacuauguagacuaggcuggcgccugcuucugucuccucaguacuuuuuaucaacugagccaucucaccagcugcuuuuguuuuguuuuuacaggguuuuauuuuuaauuauguguaugggggucagggguuguguaaaugaguacaggugccugcaggagccgguggguguaacaggcacuuaggagcugccugaccuggguguggggaauugaacugauguacugauagagcaacacaugguuggaaugcuaagccaucuccagccccuucauuuaaaaaaauauauauauauuaauuuuauuauuuuuaauuagguguauaugaguguguuguaccuggggugggggcauugugcauaugacugcagcuguccucagagcccaggggaaggugcuaagucccauggagcugcacuuacaagcuguugugagcugucugauauggaacagggaaccaaacucagguccccucgaagaguaguaagugcucuuagccacugagucaucucuccagcuacuugcuuauauuuucuuuuuauuagaaauugaucuauuuauauuguggguuuguguauaugggugugggcaugcacaguguauauguggaggucugaggacaccugggggugucuucucucucucucucuaaccauuugaguccuggagagcuuacucagguuguagagguuagcaggaggaccuucacccucgcagggcucuuucuguuuucaauaacagcuuuuuugagcaagaagaaugaaaaagcauuguugcuuuuaaaguuuguacuuauuuauucucugcguuuuguguaugagguggcaguuaggugugucuuaguguggugacucugcuuuaacagccuggagcagccugugugccuccucauggugcaaccuuacaauaaaauaauguggugauuaaacauggcgacagagagccaucauuauugauaugcucagugagaaaaagagaugauaaagcuguaagaaugacugcauuucuauaaauacacauguuaacauauauguuuguaaaagaaacuuccuagagugcuugauguugcuuugucuaagcuugggguuucagauguucucgucucauuuauggcacagccuuaugagauggaugucacaugccauucaccccauguucccguuuaaggcuuacucagugguuuucuugugucccagagcugugcacucaccagaacacuuccagaacauuuuuacuaaguccaggcccacacccuuauuuugcuuucuguauugggauuugccuguuuuagacaaagacauuucauauaaauggagucauacaguguguggucccuuguaacuguccucuugcauuuaaaugucuuuguuuguuuguuuguuuuuuguuuuucgagauaggguuucucuguauagcccuggcuguccuggaacuugcuuuguacaccaggcuggccucaaacucagaaaucugccugccucugccucccgagugcugggacuaaaggcaugcaccaccaugcccggcuuaaaugucuuuuuaaggcacaucuaucuauaccauaccauagauagcaggacuucacuggguuuuauaucuguauaguauuccauuaugugcauauaucacacuuucucauucauucuuugcuggugcacaucugagcuguuagaacuggccagcuguuaugagcaagucucagugucaacagaugugcucacuuuuauuaaguacauaaucaggaauagauacagcugcaucauaugaugacuuuaugcuuaaccauuggcagaauuucuagacuguuuuccagaacggggacaguaccaauuuuacaucucuacaagccgugcaugauggcaccacuacuauuugucacccuucuuauucuuagaguggagugaugagcuauuuuacuucuaucaucuagcuggcuaccuccccucugccagguugggcaacaaccuugacucucuucucucauuuaucccuuaugaagguucuuucaugcugaaaaggacauucuaagugcugagggaaccacgacuacagugaugcauagcaucccguacacaguacgagggcugcagaggucuucuuuaugcuguuaguuccucuucugaaugagccaggcacuccaguacccgcgacuguguuagacuuggugacugagacuaauguaaauacgcucaucagaccuuuuguuuucguccuaaaagggcuuguaacucaguauucacugcauuagagaaaagucaagaagcaauugaaauuacaagugaagaccacauuauacagguucguuauucuuggaaaucucugguucugcauuuauuuuguuuguuauuguuuuuaggauuguagccccacaauuugauuuucuuuuuccuuuuggaaguccaagagcccauaucuuccucccuuaccccucccagaugauuguaagagcaaaaucaauaaaauaugcaauuuaaaauaaauucucuagauaagaaaacgaucucuuauggaaguagaaauguggcaguggccgaucuugucucauuauucuuccgggguggcuggguguuuucaccgagagacuuacuaaggaggcgugcccgggcuggccacacacaagcuuuccucacuggguuuacauuuuuccuugcuguuuuuggaggcaguuuaaacuuguaaaaauuuaccaaaaccagaaaauaacagacuaggcuaccauuauucgcaaagaugguuucuauaagagauaaauagacaucuauaaauauaagugguucuuauggcuccacggcagcugucccagggaaggaugccuuuuaucugaaaaugaaauccauuuugauuguaguucauuggaucuuaacuuaaggcuccuuuuguuacuggugcuggcauuugggagucagugcuaagagguagcuugggccaggaguugagggcccaggcuucugucugccucagacagcagugcaucuuugggcaagucacuuaaucuaacugaauccacuuugucuuaguacaaaugggagugagaguagcagccacccccugcugugcuacgaaagcggaacccuucauaaggcuuuggggguugccggagcucacaugugccaugugcuugcuucaagaaucuaguaaggaaaacagggccugcuaguggcugucagccucugcuuuaucaccaccuacacaugcucaguguucuuguggguuuuccuugucuuuuaauuguauuugaaacgcaucgucacacuuuucauguauaacuacuuucugcgcuguagcugcuuugcccucguuauuuaugaaccgugccagagaggcauugcuuuuauccuccccauccaggugagcacaggggugaaguuacucacagagguccagagggcagagccuggguuuuuaaagcccagcuugguacaugauuucacucgagcugcaucuggacagcucuggguuugugcugagaacaugccuuccuuggucuucauugaaguuggggugagccugcugccacucuggagucucagaaggacacagcaggaggcccagccaugucaccuaagcagaagguuccccagaaugcaaagcucuuguggcuguagaacauugacgaugacauccaaguuucuggguuuccagaaggaggggguggaacuuagguagaaaauguuaauuuuuuccaaacaucuuuaaauucacuucaucuguuuuuuuccuuugucucuuuucaguaugcaaacccugcauuugaaucaacaauggguuaucagucaggagaauuaauagggaaggaguuagcacaagugcccauaaaugaaaagaaaggugauuugcucgaugccauaaauucgugugucacaguagacaagguaaguaagaugcuagcuggcacugucaucacuugcggguaaggccggaagccugguguucagugagcaccacauguagcaguggccucgacugcacccucuugccagaaguccugucacucucacuuuacagaugcagagcugaagccaaggaugcacugugauuaaccagcaagcauaauuacugggauugaccuuaaaauuaguguuuuuaucugagcggugugaaaaaguugggguguguguguguguguguguuuguguguguuuaaggaaggguuucucugugcagcccuggcuguccuggaaagcugguauuccugacaacugagcuuuuaagugguagauguuggcacaugguucuggguagggacuuccagggaggcagcacacccuuagagcaugucugagccccagucauucauugagcaaguuuuaaauaccagcugugugccaagcacugugcugaauccugucacagaaggauggucaaagcaagaacauuugccuuggagaacucauuuuccagaguuggaaacgaaggggucguuguugacagugagaugcauacucagagcuaaaggagcagacagaaggggcagacagaagggguaggugcagccugccaggccuucccugauugucagcacugcccuggugccgggcugcgggaagaugcaaggaaagaaccucagguaggcauggcuuaaguccuacuugccuucauguuugcaguucagggugcugucuugucuuacuggaaggagcagaaggucuuugaggagaggaccaacgggcauagagaccucagugccuggcacgugggcuggaagacguguccucuucagggcuuucccauggcaugcagucugucauuuuucccccuugguaauauuuggagccagagguuuuguuuuauuuuguuuugagacagggucucucucuauagaccagguugcccgcaaacucacagagauccaccagcaccgggauuaaaggugcuuaccagcaugccuggguuguuuuguuuuguuuuguuuuaagcuagugguuuuguuguugggcuuaucaacuagucuggacaccggcuaggcaagcuggaucccucuuacugggaagagccauugguaacagguuauguggucaguauauaaguuugugugcacauugucucacuucuacugggguaacauuguuggggaccaguggcaaaagccucaaguccaaauagcagaaacuccucucuagagacaugaagugguuaugaacaaaacucgggaagacuuccauguuauugccuguuugcuacucuauuucuaagaaggagucuggccauuuacuuaguguauucuagagguuuuggggagugugaaaaggugauucuacccauucagcagccugcugguucacugaggugagaggacagacaucugugcaguuccaucucuguaggggaauggcuaguggagggucaguggccuuguggaaccacgaugcugugaucagcaaggagagcucaaaaguccaccagggacccagcguggcagaagagaggagacucagcaaauggucagcuggucagaacuguaggcaucagaauguuaguuuggaaacccugggccagaggagagaucccccugcuguuggggcagaguauugcagacacucaucacucuacaguccuuucugccugcugucccuuugggguagauagauauguuaacuugauuuuuagguucacauucaugccucccuguaucauuuuucuucuucucauaacuccccugucaggggaccgacaagcuccucucuuccagcuagccccugucuauacgucucuacuuuuccucuuuuguugccccagcccugaaacccacacauacacgcacacacgcacucaguguaggauaaguauuggcuaugcuuaugcccgcccgagcugacugugaccucagggcucuuugaccugcuuugucuccugugacuuccuuccugugucucccuuccucacagcuccacuucccuacuccacugucuuguuuccuccacaaauuaccuggucuuugaccuuugccuucuuguucuuguuccucaguagccugcugucacucaagauuaaauugucagagaaugauuuuccucuugccuuuuaugaauaaaagucccaguaugucucuuagucacacucucuguucauaggcuguccucguaccuugccuagaucucuggaauaaacugaucccucugccuuugccuccuucaaguucaucgauccuguuggcugcuaauuuccuugcuuuggagugugcacuguuugccccugaccugauccaggucuucuucacauucccacaguuauggugggcagaucccaucuggucuccucaucccaagacuaucauguugcucccuugguauaauauucagauugcuuagucuggugaccaagauucuguaguugacuucagucacucuaaacaaaagccucguguguuguuugauuguuuaccauugguaagcacagugccagccuuggggacaggacagcuggaugacaaugacuuaauuuuaugacagugauugccaaaggggaccacaucaauagcugguauguagcuugugccagagagcagcagagugugcaguggggagcucauguggggacaggacugugcgaaagcacccgcaccccgaacuggcuggcuccugaacccgcuggaugucagauugaccaacuagaaaucucucugaccauggucuaaggaaguauucuuccucuuaggaauuccaaccuucagugauacauagcuaaauuuauauuuauaauuuuauaguuaguaaauuaguauuuauaauuaguaaauaugguucgugcuaaauacauuuuuuguuuaccuuggugacuggaaagcuuauauuuaacauuguucccccagccaggacacuggcuugaccucugcuccuucuggggaccugugguacugccguggccuguuagaccucggcuagggucugucugaguuucuucaggagcuggaguaggacauucuccaucuaucuuucagugugcugguggcuuggcccugaugaccuacuguuucuuucucuuuucuucauucccucuuuucuuuuucauguaauggaacaauucuauugagacguaauucucauaccauacagucuacccaucaaaaguguacaguucauaacacuugggaggccaaggcaagagggccauuacaagucugagaccagccuagucuguguagccaguuccaggcuggccagagcuacaucgggagagcccaccucaaaccagcaaaaagagcuagcuacacagcccagugauuuuuaaguauauuuguguagguguggcauggcggaggaggaaccagggcacaccuuccccuggggugaugaggguaucuagggacuugucacaguuucccacauugucuuggauaguccucuuagagcuguuuguuuccagggugacucuguggccauggaagugaggacugccuacuccuuccugcuaggggaucccugguuaguguuugggcauagucugucccugggcuagcuguaccaagagcuaagcuguuuauaaccugcucuuuucucugguuacuacuaacugcagacagagcuagcugguuuugacauggucuucuuaaaaaaaaaaaaaaaaaaagauugcuuucagaauuacaucauccaguaaucagacucaguaucuacuggguaucuuagagcucuggguucaaagaguucugaagggccaagaacauuaugggcaccuuuaguucagcauccaacaggaggguugggagauuuucauagcuuagccucgagugacuugccagaugggcuggcugauaaagacaaguccccuagccacccuuaucaccaagggaagaugugccggucuccuccucagccaugcuugucuguugcaaggaucccugccgauggucacaugagcuccuaaaaucacaacccgggcuuuccagcccagcugcuguagcacccuacccugcagaaggacugacaccccagguccucaagggcuaaagccauuugcaauaagaagcuaguaguggccuagcacaguaauggccacacgcugcucuucugugcccuaguucugaguacaccugcaccaaguaccacgucagacucggagucccuccuucaugcagccagugagagccaugagagacugaggugacuuuagucaagugacuugacagggugaagaagaauauuggcuuacuuaaauugcauuuggguuugugaucauuuuuauccuaaguucuuucauggugauuaauaaaucagaaccaaaauggaaaauguuccuggauauaccaaagcauaauaauacauauucuauucauaggaauggcaaggaguuuaccauacccaaaagaaaaauggagauaacauacagcaaaaugugaagauaauaccugucauugggcagggaggguaaguggaaaaaugcacuucugugucucgaauucucuuugaauacuuaaguaaacgccacauggcucauggaaguguaaaagguuuaaagcaaggccaggcucucacagggcacggccuuccaggguggucguucccugaggaccuuccacuugcaguccagagccacuacucuggagacagucuucuuuaugcuguguagauuugcaagaaagagacuucaauguuuauauugaaaucacgucuaccucuguguuuguaagcuuuguaucuaauuggaaguagcuguuucugcaaaggucuaucacagaauauuuugaaugcuaacagauguguucugggcuggagagcuggcucagugagaccggugcuuacugugcaagcacgagaaccuggguucauaucuccagcaccccacaaaagccaguguggcaucaugcauguaacccugccaccgguggguagagaucugcggucucacuggcagccagccuagcuguggaaugcugagguccauauucagugaggagcccugucauaauaauaauaauaauaauaauaauauaaucaugauaauuaauaguauggaggagcaauugaggaagauguccccaugucaccucugucugauccacacaugcucacacgagcaagcaugcaugugcucaugugcacauacuguaaauuuauuaagagccuaaaauuuuuggaggccuugucucagaccuguucaaaauaacagagaaaguuuccagaauguucugagugugaauuauagcauacccaacaguaaaauacacacuuuaauaaaugaugaucagagaaaauuaaacuguaaggaaagcccuuacugugcaaaacauaaagucagaccuaguguaggauacggagggaaggagacacaaggaggaaguguggccauggccuuaggaacugcacuucccucuagccaggcuccugcuaaugggcggcgacacuucauuucauccuaaaugcagcuuguuuggucagcacaaggaugucgcuccuuuacacauggggaaacugagucauagagaggucugguuuccaccccagcucuggcugccaugugugauggugccuggugcagcccucagugccagcugaccgcacagcucgccugcugugucagccgacuuugcugccaguuggugacggcuucagggaggcggaucugugugggcucucuguucugagucuuugcucuuuuauguccuuuccaaauuguucuugugauuaguauauagggauuugauuauggggcagggcaaaagaaacugaagggacaguaaauaaauggagcaagccagcagcuucugugcccagcccucguuccuuugucuuagacauuggcuagucaaggcuagcagggaccucagccuguguggccuguguggccugugugaccuguguucaucucugugacugacuguaagcagacugcuggaacuugagagcaucaguaucaacguagucaaacgacucacuaggaaaugagagacuaauguaguacacuguaaaaguauauguguguuuguauugucuguugucaaaacuagggcaguagccaggcagugguggcacacaccuuuaauccuaucacuuuagaggcaggaggauuucugaguuugaggccagccuggucuacagagugaguuccaggacagccagggcuacacagagaaacccugucucaaaacaaaacaaaacaaaacaaaacaaaacaaaacaaaacaaaacaaacaaaauccuagggcagugacuguagaagucacuucuuuuuuccccaaggacauaaagugguaucuguaaaguuugguucguuuauugauggcuuucacacacacacacacacacacacacaauuuuuuuuagaagaaaaugcucugaaagcauuucauauauugcuaaaaggaaauauucuuuucauaaugaaaaacuacuaucuaucucccauauuagagucaggagaaaaauaauguauuguuuucuacuuacagaaaaaucagacacuauguguccauuaucagagugugcaauggcaacaauaagguagguaaagggagcccgggaugcgagugcacaagcaagcucuacacaaucaaaacuaauggcuuguaaaauccauuuuuagguugagaccacaacugaguguguucagacugacagucaaacagguaugaggcccuauucauucucaagguugagcauuuggggguggggugauucacagguccuuccugugauuggccugcuuugugcaguggugggacccuauucuuguggcccagcccagcccagcccagcguggugugaggacuggagugcugugggcaucuugaccagugccugggacgggugcagccuguguggagagaaugauuaccuacugcgugguguaugugcaggcagacacguaggaugaaguaggacuuuauaaccugagcugagcuuuagggcagacaggguugaguggauuaccaaagugcauuagcagggacaccguccacugggcuaauguggucacuaccagccaucggugucaucggaguugcuucaucucgugucuucuaaucaugccucagacaccaucuguccuacugcacaggcuucucucugccucggagggcuugcuucccucacacauaagucauggcuuuggcaagcuacuuguugcucuugcccacacagauaaggggaugucuguaaggacucgccaucagguguuuuggaagagggaacagucauuggagacuggaacaaagaguaagucaggauaaggagcuugaauuaaucaugguccuuaaaggccaggaaggaaaucaggcuuuuuauccauagagagucucugaggguuucagaacuucuaagaaguccuuacauugugucugcagcugcucacauggaaggaugugcucucacaucaagacugagaggagaggaaacauugaccagaaaaaugagauaacagugaggagaaggggaacaaguguggugacacaggacuagagagaagagugaagaaaaggcagaccagagagccgaucugagugagcccagggaccuagggguggccauaggccugggaagggugaguaugggccucuucaccguguggcccugguauuggugaucuacuuugaacaucugauagcuagcgguuccuaggucuuucaaagaggcaaggacugaagaugcagauguuucugaccagaaaaagcagcauugagugcugaggauaaggcggagcccagguguaaagggaagagcaucaagguuacugcgggacagaaugacaggcagagugggaggcaaaucccugcaagugagugccugacagaagaggaggggcuaagcagggaagagcuggauggcacagaggacguggagcaaagagacacugagaccugucagaguucaggcucagagaaaaaugaggcagaagccaagccucaggggacuagacgugguagacagagccugccacgcaguucugugcugccgcucucagagcacaucacuugauuuuguuguuagugguauuucguugguuuuaguucuucagagcaguccugagaagugggcaugacuguuaucaacacuccuuuaauacagauggaaaaacaagugccaagagaguuaaaugacacuuagagcuaggcacaggaaaugacagagcugggcuugggaggccaucaguggguggccagggcaaguacaggugagguaggaggcucccgccucagccucgugcgcuacaccguuugugcuuggacuugaugagugcuuccguaggagcugcugcugucacccugaugagccacugccugauccaucuucauuccucggcgggcaguggaauaguuguauuccugaggguguggggcuguuuugccacaguggggcaguuggggcuauuaggcccacaccagaaguccucaagcagaaguggggcuuauugggaggaaauagagccccuuacagauugggugagggaguccaagaaccaguuugggaaggagucgggaacccagggguacugggaagcugucucccucugagcugagcaugccacaggaacaccgugguuggccaccacuggcgcuggcagauccaggcucaagaccuugcuucuaguuucacuugcucauuuggcuaggccuaggcuaccugcuacucacguguggagccaggcagucccuggauuccccccuucuguaaaaggagauccuggaacucccuagucaagagaauggacauugagagucugggugucuaggaaaauaauaaaguccccacacguuacauuuuucuuagccuguguguaauuuucagaucgugcuauagcucacuaaagauacaaaaugguuguagugacaguguauagauuuugauuguucuggcuugcugucacaugauaagcucugguaccauugucuaauacugggacuggcagguuggcacuugucacaggccucuuuugcugggugccugaucacauguauuagcagugugccaagaucacagcacaguaaccuguggguauguugaguaagauaaccugacuucaacuuucucacauucagacuggaauuccugcuuccaggccaaaggguccaugccauuagggugcugacuggagacagugacuucuauugcccaacacugcuucuccagaauuuccuggguuguccuaucaggcuacagaaaugcuaauaucucugaacagaguuuaaggaucccauuuuauagaccagaaaaccaagaacagaguugcagaugguguuaagcccaggccucauggaggccuguuuggaguuauuuccauguauaagcaugguaccacaucagagugguauguuaucuauugaguguccacugcugugagccccugggcauggugcuucuucagagcuugcagucuuuuagaaaugacucucaugcuuacucauugguccccugggugugugugcccuaagggcuacaucugggagcugggccaggucaaggcaugccugcccaccugcagccuacugcaggguggaacuugcucuagagucauguacagagagcuaagggacacaguggggacagcauucuugacagggcuguugggagcagaggaucuaggauauacauagauaauuagcuuuaaagugucucuguggaaauuggaucuccuccucucucuccucuccauagccccauccugaucgcauggugcuuucugccuuguucugcuccagcucuccccucacugcaaagucauuaauaauuguguucccugccuugcuccccacuagaccccacccccuuugaggacauaacucuguccuauccauuaucauauccccaauacugcaaaggacuaucugaaauaacuaacuuauaaagagaaaaggcucauuuauuuuggcucaccauuuugguggguucgguccaucaucauuuacccuuguuggcuuuaggcuuccagugaggcaacacaugguaaaggggagcaugugguaaaggggaaccgcugcuucuuggccagggggcaaaauagaggaaaaggccagggccugagcagauggccugacucucuuaaaggcacuauguauaccuugacccugugccucauugccuggcucucagagucaauccucaagaaagacauaggggggccaggcguggugguacacgccuuuaaucccagcacuugagaggcagaggcaggcagauuucugaguuagaggccagccuggucuacaaagugaguuccaggauaucaggguuauacagagaaacccugucucgaaaaacaaacaaagaagaagaaagaaaggaaggaagaagaggagaggagagaggagaggagaggacaggagaggagaggagaggagaggagaggagaggagaggagaggagaggagagaaacauagggaacaaaugaacugugagguucuuagacccaaaugcaccguccugguugggaggggcagccuuuuaccacauaguacuuugagggguagucaagauccgaacuucagcuccagccguagcuguggcuacaguguaagcacuugggaaauguuugcugagaggaugaaagggaacagaaacaauucacagcccaggagggggaaucacugcauauggcugagaggaggugcuaccugaaggaaugagcaucuggggccuggauacugucacuucacagaugucaaggcugcucccgagaugugaguaguugggcugagcuaaagaccagaaagaaaugccaggcagacugcaccugccucugaaggccagggaguugauacucuggcuagacucugagugauuaugcuuggcaguccuuucuucugugcacaggauagugcaggggucaugcaaagcaggcauguguuuacugaguaucugcuaugugcuagguauauucuuggccauccagggaagacuguucugaccccagauuauucacaguuggcaagacagacaguaaagcuaguuguuaccguacccugaugggaugggaugaggagacauacagggaagguuucccaaaguuuacaguaccuaagcugcaucuccuagaggaguagaguaaaggagggaaaggaggcaacaugagaaacguguauuccaaaaagcagucuguaccaagguggagaugugugggggauggacagacacagcauaaagccuugcccagagucagggguagcucugcagggcucugaugcuacccggggagugggaggcugacccugaggacgacgagggaagaucugaagauaggguuuauuuaguucugcugguugugggagagaauuggucagguggguacauccugucuagugcuuggguauaaagagcagaguuagcaaaagauaaguucauuuuggauaaugaguuaacuuaacaguagcugaaaaguguccaaauggagcuggccaguggcccaucaagauguaaaucugauacucacucgggagaggaugggguaaaaccgcacgugggaauuagacagagcaggaagcaggcaguggggguuguuuguuuguuuuguuuuguuuuaauuuaauuuuuuuacuuauucacuuuacauccuguucacuucaccccuccucuccugcucuggguggggguccccuggguaucccccaacccuggcacuucaagucucugaaggagguugugccuaccuaaaagaaaagagugaggccagaagguuuggaauccagccuuuggaaaugcuaggggccgaggaagaggauagcaugcaaaaguggaagaaggaauaguaagguggacagaaagacaggagagugcagcuucugcagauugaaguagccagaaagaggaccccccggguccaguaagaugccagcaauaaggagauacccaucuguagccuuugcaaguccacacacgugcacguagaggagagacucugccuuuguugggccaggaagcuaagagcagaguugugccggagcacgcucgccuagcacgcucaaggcugggaguuccauucccagccuucggaacagaaaugggggaugaaccuguuccaugauguggagggaggagcacuugaggccucuacugggaucgugccuugggcagaggaaaaagaauuggauaagggugccaggcgaggccgagagcuccaccacaucgugggcagagcagacucugcccuaugcucccugcacucacacgcuggcugcucugggacauaaguuguuguucacuaagcucucagccccacacaaggcacccacagguacgcagaggggcagacaggaaguggccguucggggcaaggacuagagaggaguuccuagaacuccuauuuggagccuagaauagcagugaaaacagucagggagaaagcaaaugauccuaacacugcacccacacuuugugcuccacaugugacccuaggaaagagaagaacuuucucccgggauggugcugagaaaauaaagguuugguucucuuuugggacaaggguaaaugaggaggaacugccucuguuuuauguaaguacaguaggagagccucuacugaggucgucuggucuggguauuuccucaugucuuuggacucuguaaaauuugggcuuugagaaaauggagucacucaaaaccaagguguguguagcccgugucugugcacagugcuggcuuccgugggguuguaaugccugccauccagguuugaauaccuguagaugcuuaauauuuaguuugcugucuugugcucauaugucacugacaucucuguaaagauguagcuuaauuguuuccacagauaaccaggcaggcaaacauaaggacaggaggaaacauucgauggacgccaaagcgguuuccuccagaacaagugacggugagugggggcugcacugugugaccugagcacagggugcccaacccuggagcuucacucccugucuccaugcacugcacagucacagcaagagaaggccccccguaugagugcuccacacagguagaccccacugugagccuuugaaaugagucaagaauaaggaaagauggaggaagcaggcacuagguacucuauaugauuuucaaacuguuagcaauagauuugucugcuaaucugcuguccugaugggagccacauauuugguaauuuggaaggauagauuccauuucguuugcaguuuacuguggaaacuuacccuuuggaaguuguaagccuaauuuggagauuguaaaacucuuacuaagaaaacauuauuuagccuggagguggugguacacaccuuuaaucccaguaucugagagguagaggcaggcagaucucuuguuugaagccagccugagaugucccaaauucacacccccuuccuuuucuuuuaaugaacccucugaguccauucagugcucuggcaucuccguggucauagggccugccaggaccucguuccauccucccuuccugucagcugccagcagcuccucggcuagggcuuggccuugggagcucccccugcacaggaaaccacuuucccuuccaagucuucgacaugaguguguagagaugcaguggguguaguacauuggccucuacucaguaacucggaggacuuacuuacuggaccuaagaaccgaauagugaguacguucgcagauucucaaaaguccucuguagacacagacauuuuuguuucuuuucuuuaucucuuacuucauuguauuuaugcuauuugauuuuuucaaauuaauuuuaaaauaaaguuuucucuuaguugacagauuuuagaauuguguauauuuaucacagauagcgugcuauuuuagacuguuuauauauuguggcaugacuaaaucgagcuaguuaacauguuuuacuuuacaucccuaaaaaucccucuuagaaauuuccaagggugcaaugccugcuacccacugcucucuauucugauccugauaagcacuuuuauuauauuccuaaguaaggacaaacccuuuucugaccaugauaacaaaguggggggcuuuguuuagugacuuuccuguauaaaaugucauguuaguagccaugugcaguuuuguugguccucuaaacugacagcauuugaggcaucguggccuggguagccuuggccaauaucucuuugggccuguuuaucugaaggcaaguugaggcugaggcgccauauuucuggacagucucuaauccuucucaacauuuuggaaccuuaacagugggguguccauagacacgcgggacucugggaacauacuuuuccuggugcgcauuauccaggcuucccucaucgcagagcagccaugccugaccaugaccacgagagccugccugugguguugcugccugauuagccuagauuaaacaccauaaggaagcaguagagagauccuugggcauuugaaccagagaugaauugauaaggcuuaauccagugccuuauaugguauggagcugucuuccagagcaucauaugugcauccuagaagugaaggaagcagagggaggacagaaggggaagcucugccagggugccauuacuccuaccuaugccucuguaugcagcugagcgcacugacacccgggaagcuagacguaugcccaagguugggcacacccugauuuuucaccucuuucuccacaguuuccagucagagaagacauuccucuuuggcccggauacauucuaugaugauugaggcacccaucaccaaggucggucuucacugaguaugcaggccccuggacccccagaaaaauuguuucucugacagaaaagcaacaaugagaaugcucuuucaguuguauaauguugucucgucuggagaaaggaugggugacagagacagauggguaccuaagauuaacgugugucuguggcacaaucacagacuauuaucagccugacgcuagauugcucucuguuucgaagguuacagaacucaaguuuucuauuuccacgaugcagguaaucaauauuaucaaugcugcccaggaaaacaguccugugccugugacggaagccuugaaccgagugcuggauauucugagaaccacugagcuguacucgccacaguuuaaugcucaggaugauccccaugccacagaccucguugggggcuuaaugucuguaaguccaucuccuaggcuacuauagcuuaaugucuguaagcccaucuccuaggcuacuauagcuuaaugucuguaaguccaucuccuaggcuacuauagcuuaaugucuguaaguccaucuccuaggcuacuauagcuuaaugucuguaagcccaucuccuaggcuacuauagcuuaaugucuguaaguccaucuccuaggcuacuauagcuuaaugucuguaagucuaucuccuaggcuacuauagccugucuguuccuguuugcuuucucugagguugucuggacagugcuuuaaaaagacaagcagagcacccguguaggacucgguaaagcacaucuucuccaugguuuguguucugcuguacuuagacuauggggcugccugcugcuuaccucccagggaauccucagcuuggagcagcagaaagcaacaguguuguagacgguccacugauaacccucuccagggucacauaggguuuuacaagacauuucaauuguauuaaagugucguuuguuguuguuuucuguugguuuguuuguuugaggcaagguuucaccauguagccuuugcuggcugcaacuugcuagguagaccaggcuggccugaagucauggagauccaccugucucugacaaaguguguacacuaccacaccuggcuugucuugggaagacgaaaaaccauggugguagggugcaaauccuucaguucuauccucagcacaaaaaggagccaacaaagcaaacgaacaccacacaccuuugccggagugcuacacgaugcacugcagaguggagacuagcuccugccuucauguguuuaaaaagggccagggcgccccacuagccuuuggauaacuguuuaggaagaaggcauuaaggaugugccacuaccaccaggcagugguggcacacgccuuuaaucccagcacuugggaggcagaggcaggcggauuucugaguuugaggccagccuggucuacagagugaguuccaggacagccagggcuacacagagaaacccuguuucgaaaaaaccaaaaaaacaaaaaagggacaugucacuacauggggauucuugaggagcccaggcaccaccucagccagugcagagcagcacucucacaagcgaagacaacuaccauuguucugcugccgucuuagaaauaaaaguugcucccucccgauuccuguguccuggagcucauggggagagggcgccccgagagcacaugggguacugagugguuagucccauccucagggacgagggaggcguccacucagaaggugagagagaaguguuccugagacagcugaguuuggagaagaagaaaaugggggugaccugagggcagagggugguugucacuauggugggcaguaguuggucagcucacuggucauccugccugagccugggcuccagcaguagggcagcucccaggaggugacuaaauuuggaguuggccacaguggucagccugcugggcugggcagccuugcacugggcugugcuggacuguccucucuggggcuguccaucuggguuaugcagucaggaaggaagaccaugugaccaugccuuuucuugucuucuugauuuucaccaggauggcuuacgaagguuuucaggaaaugaguauauucuugcaacaaaaaguaaguucucuguuuuuaaucucuuacauugcuauaauacucuggcccagauuagaugaugcucgcucucaucaguaagcucuggguacgccgugaagccucagaagcaaagcagccauuucugauauagcacggccuaccccaaacaccaaaugccacgaaccuguuaacgucgucgucguuuuccaaauucuguuacuuugcagaccucccaccacuuucaaacaauuuggccacccccgucucccuucaugaugucccaccacggauugcccuggccauagaaaaugaagaacagugggacuuugacauuuuugagcuggaaguagcaacccaaaauagguagguagagcuuguuuccaaggccugugcagggaaccgcccgcccaagcagcagaggugugugcagagccauuccugggguggggacagaggcugaggaaggaggagagggacuucaaguugagucaguaggccccaggcagaguuugcccagcucugauggcuuccuuaaauagcagguuuuccugugacacaagucccuaauuucucuaguaugugguauuauauaagguagcaacaaagagucuccugcuccaaaccuagaaccaauaugguuaguuacacauuugauaaaacuagccucaaaucuugguugccauauugguggcccacacaaagacuccacccuaguuauguucaucggcuuaugguggcugacugggaguuuggguuuugcugaguaaaagcuguuaaccacaggaucuuggcacauagggcugggcacccacagccagugccagccaggagugcgguucaguuuggggaggguggcucugcuagguuguggaaugauucaccggucucaccccacugggugagcugucuacacugagacucccacgcacacagccuagcaguggccaggcacaucccauagcaaugagccccugagccccugguuuacauuccgagccaucacagcuuccaaaguguggaaggcaggccaggucgaggucugugaugaccucugagauggcuucugugggcugauuucuuaaccuucuaagucaagucaguaaaucuaaggaaggcaugcuugcuaguagcuggucaauuucucgagguaaagucuaaacuuuagacuauaaaguugcugaggugauuagucaccugagugugucugcgucugguuuaugucacacuuuggugguauuuccucuagguaggccaucagaaguaacacgugaggguaggauuacagguagccuguauagucuggcaaaggcaggguucugaagguuguacuuaugcaagcagggugggaacuucaccccagcaaaucaagaugccuaaagcaggcuaaggcagaaagaaaccguuguguggccuccagcccacauggaauacagugcagcagugcagaucaguugcccugguacucugcacuguggcuugaauguacuuugggucucuucagaacucggguaacugguuuuugcucuauuuuauauugugcauauuuuucuuuguaggccuuugauuuaucuaggucugaaaacguuugcgcguuuuggaaugugugaguucuuacagugcucugagacaacgcugagaucuugguuucagaugaucgaauccaacuaccacucuucuaaccccuaccacaauuccacacacgcugcggaugugcuucacgccacggcguauuuccuuuccagagacaaaauaaaggugagcuagcguuccuguuccucauucaacagcaacagugggcagagauggggcuuccgccucagcugcccucacugcaccguaauaaccagagugguccucacccgugcagcgugcagcauggaaggcgaggaagcagcugauagguuaaucugcagucuccgccagucuaugaguccucaaggagaaaccaaccgagacagaacagggcuguccccguggaggagagggguuucaguuuggaccuaagggcacacugagccucuuuuaagccccucaccugugcugugaguccugaccauuccugcccugccccgccccucagccccucagcugcuggcuaaccaucugacucagacagagcuucuaauuuuccugccccaggagggaggucacuccucucuccuggucccucacagcauucgcacagugcugccauuguguucuuuccagagcagcaugucugcccaucacugccuugagccgcuuccugccccacaggcacucagacuucaaacacugugauacacugccgugccacaccgccaugaaggacuccccuuucuucuucacucccugugccuaggacaugcaggcaaaccauucaggucauacgucagugucugaagcauuugucuggggccaagaauggcuacagccacacagagccaggugcauccuacaugauacaccauggagcugguguguggagaacaaaauggaggaugcccuggcacagggcggguccagcgauguucauuucuaccugugagggucggaccacuuagaucuaagucuuuuggguccuucugugauagcaccaauuucuuguuguuuuuaauauggaguuggguauuuguaccaguuaguuuuugucaacuugauugccuccaucagaguguccaguuagcaugaauggggacauuuucuugauuaaugauugacaugggagggggaguucccagcccacuguggguggugccauuccugcacaagugguccugagguguauaaaagaccaggcugagcaagccaacgaucaguguuucucugugcuuucugcuucaaguuccagcccuggcuucucucagugauguaucuauaaaguaaaaacacucccuugcuccccacagugguuuuggucaguauuucaucacagaugaaagagagcuaggacaguguggacuaugugccgugugcuugcugggcaaguaauggcgcuaaucucgagcccagugccuuuauauuguaaagaucaauaccaaggccaaggccggguuaaggauggagagagaaggcuguuucccugagcagagacaaguagccagggaggggguguguguuggggacggaguaugggcuaaagggacacuuuuugcuguaguuuguugcugaccuaagacaguagcuauuuuugagauaggaucuugagcuuguguagcugaggcuggccuugaacucaugguguuguggaggcuggucucacauccuccugccucuagcucccaaagaagugaaacaaaaaugacagauuuuuuuuaaaaauguguuugagacagucuuuucauaugggccagguuggcuuucagcucagagauccagcggccucugugucccaagugcuggaaucaaagcugugcaagagcaucccuggcuccagcuuuuuuggggggggggggguauaauuacaacauuccuaccuuccuucaccucccuccaagccuucccuuguuaccuucaacuccacggccucuuguccaucaacuuagugcauacagacacguauuugucuaugcauauauuucuaaguauugccuguugaguccauuuaacguuacuuguauguauguuuucagggcuggaccccucguaggugugcucuucccgcaggcagauucccagcucuccuguugccugugguguuuacacaugguugaggccuuacgggcuuucccccccccccccccccccguccaguuuggcacacucauuugucauccuacauuugagugucaugugcuuggacaaauguugauauaaaaugaaaagucuuaucaaaccuauugagugauuuggcuagagagagagcuuagccaguaaagcacccacaagcaaaagcugggcuugguggugugguccaugcuuguacucccagaaucgcuaaggccaacacagguggaugccuggggcucugaagcuacccagccucaccuagcuguagagccccacccaggucccagggagggaaaugugucccaaaggaauagguagaugcucucgacaaacaucugagguuggucucuggccuccacaugugugugcaugaacacucauguguuuauacucauucacauacauguacacacacacacgcacacacacacacacacucucucucucucucucucucucgaaagcugagcauaguauaugccuguaaucccaacacuugagaagaagaacuccagaaguugaaaaguacuuccuacauuugguuuauuuacaacucaaaaauauaaaaguugaugguuucuuuauuuuuaaauguauauacauuuauaagaguagaagaaaaccagcuggaaaccaauguauaccuguaaucauaacuucagaaagguaaggucgggucaagaguucaaggcuagccuuagcuacauggagagaccuuaugucuaaauuaauaaggauaggaaggagucaaaccuagucagcuaaacaagauagcaccaaaaaggagaaaaauaguugggcgugguggcgcacaccuuuaauccuagcacuugggaggcagaggcagguggauuucugaguucaaggccagccuggucuacaaagugaguuccaggacagccagggcuuuuuucagagaaaaaagagaaaaguaagcuaacucucaguuaauguaagccgugguuauuucuuaguuugacuggcucugacccuguuugcaguggaucuagagaaagaccaccuguguguugugugagacugaagauuggggaguuguucugucagccaagcacagaaccacaagaggagggaagacaggaucugcucagauaaugugauucuucaggagucagauaaauuguccaaggaaaaaggcagagagcagcucuggugaaggcagacccugguguucaauggaguucuuauuuucaggaaacuuuagaucgcauugacgagguugcugcccucauugcggccaccguccaugacguggaucacccugggagaaccaacuccuuccugugcaacgcgggaaaccagcuggcugugcucuacaacgacaccgcugugcuggagagccaccacguggcacuggccuuccagcugacgcuugaaaaugaccagugcaauaucuuuaagcaaauggagaggugagaacagaagcuguucacucuacaguucaccagggagaaggcugccccagcauccacacccaaacaccuccauugcccacaccgcccucacacaccgaugcugacccagcccgaaccugcaucuggagaugaacagaaagccuggggcauguggagcgcgcacauguuuugcagucgagcuccauccgcagcccuuacagcucuguucugaggcaggucuugcccaggcugaucaacaugccucccuguugcugcugcucuucuguacacagcacaugggccauugucuguuuacacauggcuccccgaggaagcuuuuccccugagacacaaguucuucagcacaugucgucgccuagugcguacaaggcuuggguguucuaucccaaaacuaauguuuaauguccaguuagcuguugugagcuggugucaguacguggcagggcuggccuaaacuccaccucccauggaagcugcacagguucugggauugcacagguucugggaauguccgacucaggugacauuccuaacacugccaagucucaggcaguacugccucuguuacucaguuuacccuucauguuuagcccagugccugauacacagcagagcucagcugaagagagagaaggacauagugagaaauacuuucauuuggauuucaaaggaaauuuuucuauuaaauuuuuuaagaguaccuugauuucacagagcuccuuuguaucaugucuuagaauuucauagaugggcuuaauaaguuuuacucauauuugccuguaaauacacaauuuacauauggaaugcauaagaccugucuuugcuagggcuucuguuacccuagcaaauuuuaaaaaucaugaccaaaaacaacuuggaaggaaaggguuuacuucaucuaacgcaggcagguaacagugcaucccugagggaauugcagcaggaaccugaagcagaggccacggaggaacccugcucagggcuugcucagcuuucuuaggcaccaggaccagcugcccaggggcaguaagcugggcacccaccccccaaauaaaauaucaaucaagaaaaugcccaauagacuugcccacaggccagucugguggggacacuuucucaguuaaaguuuccucuuagagaauaccuccagcuugugucauguugacauagaaguagccaguacaagauccuacuaacucuggaccacagagaaggggguggcuggagaguccacuucauacucuuuuguacuuuuuaaaaaaaagauuuguuuguuuguuuauuuauuuauuuauaaguacucuguagcugucuucagacacaccagaagagggcaucagaucuuauuacagaugguugugagccacuuugugguugcugggauuugaacucaggaccucuggaagagcagucagugcucuuaaccucugagccaucucucuagcccucuuuuguacuuuuuaauuuuaaauuauaugguucaucuucucaaaaacuaagacuugagaauaucaaaauauaaacaaggguuaauggaaaugcuaucagaaggccugcccucauggucuucuaaaucucagaagaccuccauacaaggcagggcgcauuguuagggcuaugaagauguggguauaaagaguaguccugcugggugcagugacacacgccuauaacuccaguccuuagaagccccauacaagaaggucgugaguuugaagucaucuuggacuaugugugucuuuagugagggagggagaaagacagggaaaggucuuuuuguucgucccuguuagaaccuaucuagccccgagaacugugcgacuuguauuaccgaguuaucacuaugaugggaagcuauaguguccuguuagcugacuggugaugcaggacguguaacuuccagugaugcuagauugacagcuacagcagacacgcacccugagaaacaggcuguguguggggagccuccuagucugaaucaguaaccugcagcagccucuguggucugaaacaggaaugacuaccggacacuacgccagagcauuauugacaugguccuagccacagaaaugacgaagcacuuugaacaugucaacaaauuuaucaacagcaucaacaagccuuugacagcccaggagagugaggugagaggcugacuccgaggcugcaccugggcuccacgcucaccgcugcugugaggagcucggauagcagggcccuuuucuuccugucuuucauuugauuuguuuguuugcuuaucuaucuagucuaucaaucauguaucuaaucuaucauuugucuaucaucuaccuaucuugaggcgggccccacucuaagaacuguaaggcuggcuaagaacucagauucucaggugcuggauuagagcaccuaaucucucuuccuugcaagcaucaggccuggcugaauuuguuuuucauugguuuaaaaauuaaaucacuaacaugcaaaacucuggcagaaaaaaaaugcagauagacguauaaacaagagcucucacauuggccauucuugugcuugugcccucugucagaaugcccccucccucggggaauuuuagggccaguuggagcucaagagggcucucucucugucucucucucucucucugucugucucccucccucccucccucccucccucccucccuuguuuugacagucucuaacuauguagcccuggcuggccuggaauucaauaaguagaccaggcuguccccauacucagggaggccugccugucucugccucccagcugcuggggcugaagguacacaccaccacacaggcuccuugggcguuccuaacagccacucccuagugggcguguccaccgugaggugccagcagcuguccuugcagagggguugggcugggaaggugcuucuguuggaaucaccaaagugacaguacugucacugcucauuucuagcaaaggugaccuugguguccugccgucaggagaugccugccgugagugagcagguguccguucuggcauccucugcgcuguuucccuguccguaggacacuaggccccaggugcagguccguguagaacaggaauugcugagcacugggacagcacagcuuccauuugacucugguuccccuggguggcccuggaugcaucaccucacuccgaaucccacccuuguuuaaaaauguaaucguaaugauacuucccccacaucccacagaugcuuuuuguaaguacagauaaaaacaaaggacuuugugcccucaguaugucauagguauugaggcaaugugagggacugucacuuaacauugucugcguucacugaaggaugauucugagaccagcuguugcaaagccuggugaggacuaggcugcaggacugguagaccacaaacugcuguuguugugagaagagagcauucuauuuuuccaacucauuuuguuuuucaguaaauauccuaaacgaaacaaaacaaaaaccaaccuuaaguucuuaccaauaggaagggauagaaaagaagggaaaggcaagggcuccugggagaggaaguaauaggaagaaauggcgagggagagaaggcggauucgccaggcccaguccugcugaacucccgagccgugcuuccuuccuccuuuagagaggaagcccucggugcucagagcauccacagcgcucugcugaagucuucaacuucauagauccugguuagccauccugugcucagagcccccugggaagguaccugggcacgagagcccguucugauugcuuaacuucacucaugguucaggaaccugacagaagucuggaagacauaaaagcuaugcucaagacgccagagagccgggcucucaucaaaagaaugaugauuaagugugccgacguguccaaccccugccggccgcuggagcacugcaucgagugggcugcgcgcaucucagaggaguauuucucucagguaagaugcugcaucuuacguguauacacgcgugcgcacacacagguggacucgggaacaccauaaagcuaccaacuuaaaaguaggaaagaacacucuagaaggaauucugucuuagaagaagauuuauuauuuuguacauuuauugauagcaaagcaauacauugucauuaucaaauuuauuuuaaagauuuauguauuuauuuuauguauaugaguacacuguagcugucaucagacacaccagaagagggcaucagaccccauuacagaugcuugugagccaugaugugguugcugggaauuggacucagggccucuggaggggcagccagugcucugagccaccgagccaucucucucuccaacccccaauuguuuuucauuauguguuacuuuuuuuuuuguccucauucuugucggacaucuuugcuggguuuggaacccuggguuggcagguuccucgacaucuuccugagacagcaggagaauaaacugcugaaguguuuguaaaugugggaguggacacugauaugcagugggggacagugagggccagggguguaacaguggcuuuugccugaacuguggguuugcacaucuauacacuuaggaggcagaggcaggcaaaucucugugaguucaagcaucuugccugucuacaucagagaguucuaggcuagccagggcuacaaagugagacucugccuccaaaagggggggugggcauuuauuaugucuccuaauuuccugucagaaacuuugaaggucagaagguacugaaacaucauguuuaagcugcuguuagaauaaaacugucaaucuagaacuguuuguagugaaacagccuucaaggaucagggcgagauaaagucacucucagacagggaaagcggugagcucaucccgggaggccugccguguaagcggugcuagaaaggaaggaagaggcccaggugcagaagaagugccccgaaaggucagugccuggguagcuguacaagacgcuaaauucucuaaacuugccugucuuaaagcacagaguuauuuugagcaaaggcucucacauugcaccauuacuuagaguguuggccauaaguaauaagauagaaacaggcagccaggugguggugcacaccuuuagucccagcacucaggaggcagaggcaggcacaucuuuaugaauuugaugccagcuuggucuacaaagcaaauuucaggauagccaagguuacacagagaaacacuacuagaaaagauauuuuaaauaugaagaacaaauggaugguggacucaaucagguauagcauucaaauuauaaacaaguagaacagccauaccauucagaaaaagccaucaagacacaagauagugcugcaaacaggaggguauuuccuaaugagaaaagggcccauagccauaaugugugcauuuaauauuagcagagccaaagucauccgcagccagcaccuggcagaacacucugaagacagugauuagagugucaaugacagaagugaugccagccuacaaaucauaugaaaacggaaggaggcagcugacuccuuagccauuuucaaugcccggcaggcagagucagacagaugcugguuagaggauacugugucaucaccaaguagcuuuguucccaaguacaagguggguugaguacuaggaaagucacuuauuuucauaaucugucauaccccuuguauaauagaggaaagcuugggauuacugcuucaguuacagaagaggcaugucagcucaccaggcaccuuagcagacacuucucuguguagcccuggcugucuggagcuugcuauggagaucaggcuggucuuuggcuccugaugcugggauuaaaaacaugacuuaaggugcaucuaaccacaugcuauugcccaaauaauggaaacaaagcuggaggcccucuguuaucacgcuguuaacacuauguaggccuuucuagucucuguacuacacaagggauagacaacauauauaaaaaacagaaaauaguacaucuuacaauuugcagauaaguugguggcuuuuuguuuguuuugggguuuugcuuuuguauuuugguguguguguguguguguguguguguguguguguguguguguguguguaaaaauuaucaagguacagaacaucccaguaauaauuacauuuuagcauacaggacaagaagcucaacauauuaaggucaaguuggauuuuagagacuaacaaccaggaaauaaaauguaaacagugcuauuauuuuaaaacuuaagguagcaauaaaaagcaaaaauugcuuagaauaaauuuacuaauagauggccagaccucauaaaacugcuacaaacuuaaagagcacaugaauaaauagauaucccuuggucauguauuagaaggugcucucccaagauucuccaguuggcguuggaaagagggcauccauccguucgcagcuccccugccuuaugcacagaccugucaguuaacaguaggaucuagaaaagcuaaaccaugacacuucuagagaaacuacagcagaauuuccccagggguucugaaauggacagaccuuuagguucagaaagcaacagcuauggaaaaaagaaaauauacauugugguuuaaauaggcuuggcccagggaguggcacuauuaggaggagguguggucuuguuggaggaagugugucccugugggggugggcuuugagacccccccccccccacacacacacacagcugccuggaagccuguggaucaagacgagaaugcucagcuccucuccagcaccaggccuccccgcuuccuguguaaugauaaugagcucagccucugacgcuguaaagccagccccaaugaaauaccacuuguaagagcugccuuggucuuggugucucuucacagcaauggaaacccuaacuaagacaauuagaugccauuagagcuuaaaaaauuaugcuaaaaaaugaguaagcaggacagauugugagaaaauacaagucacuucugacaaaggacuguccucaguagugacacaagccacccaguuagaaauaaguaaauauuucaguagccauuucauaaaacauaguaugaguugcaaauaauuacaugaagaaguaccuugcaucaucagagaaauuuuaaaaagugaaauuguagcacauaccagaagaaagguuuaaauugaaacuacugaggccagcuguggcccugugcaaaugggaucccagcacuuuggagcuggaggccaggaggauuaggaguucaaggucaugucaguggcaaacugagucccauuauaaucugagcuagaaauuaaauccuguauuaaaacaacacacacacacacaccccagaacaccuaacaacaugaacuguugaugacaggcguggaacagauaucaaaagcugcagaaaaagcgcagcugccacuuuggugaccagaugaacaaacucuuuugucgugacuuaagauuuacccuuucgggguauacagaacuguuuuuuguuuuuguuuuuuccuuuuugagauagggcgucacuauuaacauuguaggcuggcauuaaagcuuccugcuuuccacguaauuaaacuacacaugugccaccaccccagccuggugugaccuccauuacccaaggcugacccuccugaccaccaugcuccauuuaucugauucuggggauugaauccagggccuugugugcuaagcaauugcucagccauccaagccguaaacccuuagaccugccuuacuugguagcucaggcuguccuggaacuaaguagccaagccgugaacucggaguccccucugaggacugaggccuuagccccacccucccgccucugcauucuguaccacagugcagugaagcaagcccgaacucaggaaacccagucaugcccaacuccucccacaugcucaauuuguaccaguaucuuggcuggaauuuucuuuaucaaucucuacguggauauugguuuguaggguuuguuuucggggucugucugucuguuauuaggcuuucuaaggugaaugagaaaugcucucucugugauuuuauuuuguuuuuuuaauuuugaagaguuugagaaagauuguugauuuuacaaacucuuguuagacuuuacaggugaggcagucuccugccuucucuccacugggagguuuuaggaccagugaagucuccuuacuaguuaguaguaguuacuaguuaguaguaguuacugguuaguaguaguuacuaguuaguaguaguuacugguuaguaguaguuacugguuaguaggucuguuuauaguguguccaacaaggcagcacugucauagcugaggcccauccagggacagggccauguuucugcucacauauggcaccagugugggcacauugggcauuuguggcuaggaggauguuggguagcgagugacaggaccugagagacauuagcaaggaagcuuccagcuaugaaaauguuugggguguccucaggguucucacucugggaccagcuugcugucuggcagaucugguuugccuggcuggugcuacacugggcucucaagccagccugugggguucucagguacuuggguggggcugcuccaaggcaggccaggacuccuaucugagaccacugguguucugccucacagacugaugaagagaaacagcuggacuugccuguggugaugcccguguuugacagaaacaccugcagcauucccaagucucagaucuccuucaucgauuacuucaucacagacauguuugaugccugggaugguaaggagccagcccagcacuucuuccuuaagagucaccacuaguuaggaagaagcaugugggguuuagacuuucaggauggaauggagagaaaguagucauuccggaggguugguacccagaagaggguccgaaggcuguccccagcuccugugccuugagggcugugcuccuccagaggaggaguugcagagccugcagacaggggugggcugagaagagguuucccuguacuccacaguccucccagacuuuggcaucacugccagcucccuucugucccucguaaaaugcugggacagggcagagcucugugguagauaguccaaguuccauuccuagaaagaaaaugaggaagcuggaaccuuucauaaagaaaggcugugaagacacugcaucccuguuucucucgccagccuucguugaccugccuaaccuuaugcagcaccuagaugacaacuucagguacuggaaaggacuggaugagaagaagcuucgaagccuccgccccccuccagaguagcgugauguacacgccuggccuguggcuguccugccuggucucugcaguuucuuagcccuuucacuguuagccagagcugcccccucaucugcagagccuuugaaagcccaugggaugcccaccuucugugaccacaucuacaccauagcuugcugcaaggcucuuuagugaggcccccaagagcugugguuuguaucgacucuggacucuguguuaccacagcccugggaacccugcagaggugaccauggcucuccuagcagugaccaugugccugcagagcagcaucuggggaggugugguugcagguuguggaacacugcugcaagggacgucucucuuaaguccacuagcaaacgaggcagacauuuaagguugauucucccgauuauuacauguuuuauuuauuuuauuagacauuugauauuuucuaugaauuuaaaaauacuucaaagccaauuucagaugccuugaccaaauucaugacuugugugugcgugauuugguuacagaccuauuuucauaaaugcagauuuauaaguuuaaaaugaugcauuuuucccacacuauggaauauguuaaacccuccucuuugauguuaguggggaaggcuuuauguagugggucucacucuaguguguaacagagaagccacgucugcagacaagcucugagcagcugcugucaggaguuuuacaggugccuucucagagaaaaauuggauuugaccauuuuuuuucccuaaaauuuuauaauugaauuucuaaaagccugccucauuuuauaccauuucuauaaaauaugcccugcaaagcaaaccuggguaccuagcagcugauauuuuacaacuaacaugggguauuugagucuagaaauauaaagggucuaucuccucacauuuugaauaagcauaauacuauaaagaugauauucaaugacaugucgaaauguuaguuucauuuuaaacuuguauuuuuuucuggaugaaauuaaacuauuuguuuuuaagaaguua

SEQ ID NO: 3908 - RNA, 852 nt, Mus musculus
agggguagguuggagccaagauggaggaauacgugagagagccgugccccuggcaaauuguggaugacuguggcaguacguuuaugggcaccauagguggcggcaucuuccaggccuucaaagguuuucgaaauucuccagugggaauaaaccacagacuccgagggaguuugacagcuauuaaaaccaggacuccacaguugggagguagcuuugcaguuuggggaggauuguuuuccacgauugacugcaguaugguucaaauacgaggcaaagaagaccccuggaacuccaucacuagcggugccuuaacaggagccauccuggcagcaagaaauggaccgguagccaugguuggguccgcugcaaugggcgccauucuccuagcuuuaauugaaggagcugguaucuugcugacaagauuugccucugcacaguuucccaauggcccucaauucgcugaagaucacucccaguugccuuccagccaguugccauccucacuguuuggagaccaccgacaguaucaguaggacuugguucccaggauuccuggaaccaggcggacugucguucaguaggguuucagaagaucaaguuacagucuguuuaaagccuuaggugggacuucacggccaagcgggccaugaagagacauuuagcacauuuuucuauuuaaaagagacucagaggguggaaaauauacugaguuuauuuauucuugcuuggauugcaucugugaucaaaauaaauguuuaauaccacuuaaagaauguauaugagcuuagaagauaaaggaccaaagggcaaauaacagugacacucaaccgucaaaaaaaaaaaaaaaaaaaa

SEQ ID NO: 3909 - RNA, 62346 nt, Mus musculus
acuccaugacaucaucaucauagaccacagauauccccgacagauggaugcagagacauugugcagguaagccagcaguccgugacugaguuccauggguccuuaugacagccuauaaacacacuaaguuaaauucaaucgcccuuuccuuguaugcaaaauaagcaaggcauuauaacuuuguuguuucuagggcuaaucuuuauuucuuaauugucuugcuugcucuauuuaaaacaguaagaaauugucuugcaugcacaaagccuugggcuuguuucccaacuuuaccaaaaaaaaaaaaaaaucaaaccaacaacaauaaaaaaauaguaagaaaauauaaaugacaaccauuaggguuaagaugaaaccaacauucauuuaauccaaacuaccacuugaauguuacuuuuuuuuuguuuuuaaaaaagauuuauuuauuuuuuauauggaaguacacuguagcugucuuuagacacuccagaagaggguaucagaucucauuauggaugguuaugagccacuaugugguugcugggaauugaacucgggaccuuuggaagagcaguuagugcucuuaaccacugaaccaucucuccagccuuuuauuuauuuauuuauuuauuuauuuauuuauuuauuuauuuauuugcauuuuccccuuuccccacuucucuuucucccucuugcucugggcugcucacucuggcccauagguuuuuuauuuguuucucauuacaugguuguaagccaacauguaguuguugagauuugaacucaugacuuccagaagagcagucagcacucuuaauuguugagccucucaccagccuaaauauuacuuaaaaaagggaaugacuauaauuuucuagacuauuuuaaaagacuuucuuuaugugguauauaugugugugcuuaugugacaguauauauguagaagccugaggucaacacaggugucuugcauuugccacuuguuucuguuauugagacaggaucucucacuggaccuuagucucaucuuuucaucuagguuggcaggccaguaaguuugagggauuugccucuuuccaccuuccccaaguccugugcuuauagaugcgugcugcaugccagguuuuuauacuuggguccucaugauuguaugacaagcccucuaaaaacugauacuuuuccuaacugguaacuuggguaacuccagaacugaacaguacgcagugggcgugacuggccagugaagaacagaccuuuaaaaauauggauccuuuucauauucuuuuccugauaggcccuggccaagaaucuugggucuuucuuguuagcuuucuaccauuugaucuuguggggugagagcggggauuugugucaucccuagugaguuuccuggaggcaagagcaggcccugacaguuuuuaagccagccuuaucuugguuucaaccucuaucugguuugucucucuuaagaucaucuuuacaaaggcaccuauguagaaugaacuguuucaucaagacauuucuccaggagcucauuccucaacugacuuuccuugcuuucaucagaccuuugaagcccaugagaccuuagccugauagagcccuguucuuccuuuaucuucugguuggggguacuuauacagugccggcuugugaaaauauuucaucaguggcugaccuacccaaauuaucauuugccuguagcucuuuaccaguguuuggaacuccuugcacgccugugcaguaccuucuugaaggccaaauucuuuuguuguugcauuuucuuuucuuucuuucuuuuuuaaucuuuuuuuuauuggauauuuuauuuauuuacauaucaaaugcuauccccuuuccugguuucccuuccagaaacucccuaucccauucccccccccccccccgcuucaaugagggugcuccccugcccacccacuccugccucucugcccuggcauuccccuacacggaggcauugagucuucacaggaccaagggccucuccucccauugauguccggcaaggccauccucugcuacauauucggcuggagccauggauccccccauguguacucuuugguuggugguuuagucccugggagcucugggggguugggggucugguuggcugacacuguuguucuuccuauggguugcacaccccuucagcuccuucaguccuuucucuaacuccuccauuggggaccccaugcguuuucaaauccuguuucagagcuuuacugacugguuuggacacuacaugugguacuagagcguguggaugaacaaagcaugaaucgggccucugagggacugaugcucucguuguagagcaugaugauaaauuucagacugucaaacuguccaccugaccugacuaaggcaugcugaaggcaguaguaagauaccuuugugagcgucugugugggcauuuccaaaaaggauuaauugagggguaagacacacucugaguguggguggucccgugccauggguuggaguccuggaguaaggaaaaggggaaaaggaaaaggccacugaguuccagaacuccuccucucugcuuccugauuagcaagaugaaaguuaccuuugccauagcugugagcuccugcugcaggccuccccacugugaugggcuguaucuucugaaccaccgauaaaaacgaagaacggugcccagaaguuguuucuugucaggucauagcacaagaaacauaauucauacauagaauaucuuuguuucaugugacuauaacauaaagcuugagacuagauaauugauaaagaacacaaauuagccagcuggaaagauggcucaguggcuaagagcaccuguugcucuuccagaggaccugaauccaagucuccaagcccaggucagguggcucacaacugcccacaaagcuccucucaccccugcccuaccagagacagggccucacuauguagcccuggcuguccuggaacucacucugcagaccaagcuggccuugaacucacauaugccuacuucugccuccuaagugcugggauuaaaguugugugucaccacacuccagcugaccgccuguaacuuuagcuggaggaugggguaagggaauccaaucuuucucuugacuccacuguccccuauacaugcauggcacauacucacaagacacacauguauacacauaaauaauaaaauaaaaucaaguauuaacaacaacaguauagaacaaaaauuauuuuuuucauaguucuccagacugagaaaaccaggcuaaagguucuaauagguugucuggcugcauccucuggcugugugaaaucuccuuuguaagggccuuaaugucacucaccagagagcagccugaauggcccaaguucuuagggcccuacuucuugacacugucacauuggcaacacauaaauuuuggagggcacauagugaagccagagacaggcagguguucaggagaagagauuuaggagggaaaggcggcuugagagaagauguuugaguugaauagugagggugggcaggaguuuugaagagaauggugguggaggaagggcagcauaaggaggagcagcagggugccuaggccccucugccggugcucacaccacuggucagagagcuggagaggucagggccacagacaaaggccagaugcaaaggccuacugugccgagccagucuuugaacucuacucuggguagguaagacgcuguacucugggcgugguagcacauaccucccucuaauccuucaugugugagguagaggcagacauucaggauucugagcgcaaucuaagcuacauagugagccucuguagcugucucugcugcauuagagacugaucagaagcaagcuguacgcugugcucagcaugcaccagcagcugcagcgaaaguaccagugaagggagguggugagaaggagauguuauucucucccacugcugucugcucuaccugagaugcugaguuguugucaucagagaaacaugguguugcccugaggaguggcaaagccucagugagcuugucggaggcaugugcuccgacuccugaugccccgucaagacaggcuggucagcugugguuucccaaccauguuggcaggagggacagaaugaaaacagugcuucaaacugugcaguugcaguacaguaagccgugauucuagguguggcuugagaacuggagagagcaagccaggcgcccucugcagcaggcacacugcacacacagugcauuccaaaccuguugacaagaggaagguggcucugacaccugggguucagugaagcgagcuaagaaaacugauggcugucagcagccuggauaaaagucacuuccgaucaagggugacugacaagaugaagaaucggguaggggguguaaaagcugcaucaacauaauggcccagaaagaacagcacuaaugacugugugcauguggugcauggacauauuugugugggggugggagggugcaugcguguggaggccagaggcugacacagggacugauuguucuucaccugauuuuuuaaggcagggucuuuuacugguccuggagcuuauccauuagacuagacuuguuggccaucgaacucuauacccuccgccccugagugcuggggcuauagacaugcacugccccuccuggcuuuugcuuggguccugaggaucugagcuagguacucauuuuuuugagacaaauuggugccauaggggcauggcugcauaacagaagggaagauuucgugaaggaagauggaggaaggagagaagcccugggagaaaccccggcauggucuaguuuagcaguucuacccuuugggguugugugugucaaacaacucacucacaggggucaccuaagaccauuguauuagacagauaguuacauuucgauucauaaccauagcaaaauuacaguuaugaaguagcaaugaaaauaauuuuauggcugggggucuccacaacauaaggaacuguauuaaagggucacagcaauaggaagguugagaaccacucuuguagcagaauuaaaauucacauggauacagaagcaaaagcaaacucaggagaaggaauggcuccgugguacagauguuaccgugcaagcaugaaaaccagaguccagaccgccagcaccuauguaaugguggguaugcaugacccaccuguaaguucagccuuagagggcagagauggcucccuggaacaagcugcuuaucuggauaagcugaagccugagcuucagccucaaccgagagacccugccucagugaacaagguggagggugacugagaugaugccgagcauuggucugggaccacacaccgcacaccccacaaacagaauuauguuccuccugucaaaaaaaaaaaaauaauaaggacagugucaagacacauucguucauacgauuucuugauucaccuugaucuaaagagcaagaucgcugugaaccuccaugguaaccccuuccucgguguuggugcugagaccauuaucaggaucauuuggaguucucucgugugaccagagacugguaguuuccccaguacaugcuuaugguucuuuagcuaauaaucaauucucagcaauuucacagggcaugaagccaccuaaagaguauguugccuucuuuagcuuuccuuguaacuauccauuggaacgguuaugugcuuucuagaaaguauccuugacgggaggggucaugcuguuuuuccuaaugucuagcauguggaaaugauggcuaacauucagauaauuuuaaaccacaaagaccaaauauuauuuagauaauaauagggaaauacagagugaaaaaaauccagauuccugguucugcagagugucacagcagcuccgaguucucacugcauauucucuauucucucucucucucccucucucucucucucucucucccucucucucucucucucucucucccucucucucucucucccuccuucccucccuuggucugucaaucuaucuacuuugaggcaggaucgcuguacuggaacuugcuuuguagaccaggcuggccuuuaacucacaaagauccaccugccucugccucccaaugcuggaauuaaagauguguaccaccaugccugacagcaaaaaaaccuuaucucuagcuauauauccauccauccauccauccauccauccauccauccauccauccuucagauccacaucacuguuguuugggguuuucuaucauguguaaucaaggguaguucugagaaugccccagguuucuuggucuuuagagucuccugacuuugaaaucugucuuccuaguguccauuuugauuauuucaaaucauuucuuuccuaguuucaugauuuuuaaggcaagaauauuaguuuuaauggccauugucucucaugccauuuucugugccugccauuccuauuucuagccaguuguucauuuucacuagaggaagucaaguguuugcuucugucuucacauacaguuuagcacugcguugacgggcuugugggcuggguggacaugcucccucuccuguuucuuccuugacacagagccccaugucuguuuccugcagugauaggcagguuguccacagcuccuccucauauauuacuuggaugguugcccacuugccacuauauuaccauaacuguuucccccacuaaaaugcugagaguguauuugacauggcuggcuggaaacuuaagucucccuuucccucuccaucgcuguuaugaugaagggcaugacgggaaccucuaagaacagauggagugucccuaagagucacaugggcuuuguuaccaggagugcaccagcuuuguacaaauaagggucugcugcaccaaugauccuucuggagcugagagacccuccucuagccuuucucuccagaaacugagucuggucuucuccuagcaggaagaccagggcuggacaccuagccagcccuacaguccccuguguggaaagucuuuuccaguagaacucuacaguguccuuuaggugggcuccuguggggaagaaggacagaugagagcuaguagagucgaguggacauuaggaaacacaagaauguugaaaaaggaugggaagagcuaugugcucaugagagauuagcugggcccuggagcugcuuuucguuuuugcacagcucucacugagaacuagugacccacagccucagacccacaggaaacugcagucugcaugccccaagguaagagcgagcaaaggauagaggcucugccuauucugugaucacauuccugcugcaaggguaaggaauuguuuuaguuucauuucuguugcugugauaaaauauccugacaauaguaauuuaguggagaaaggguuauuuuagcucauuccguuuuauggucuaucacuguggugaaaucaaggugacaggaauuugaaacagcuagauacauuacacccacaguuagaagcagagaaaaauggaugcacacuugccuacccacuugcuugcuuugugcucagcacuuaaggcaauccccuacagacaagucuguaggccaacagagugcugaccaugucuuacugauacacucucuuuccggggcauuguggguuguggugaguugacaauuaaagcugauaaucacuagucgucaacugggacaaaacacacacggauacauaaagccugcaaaucuuaaaauggucuccgucuggcucuuuacaggaaguuugugaggaucagugcacacacuguguaugaugauucccuugcugacaucuagaguaguuguguuaugugccaucucuggagaaauugggaaguagccacucugugauucagacguggcucagccuuuuuuuauuuuuuaagagcugaagucauggagucagccuuggcuaguuucuaucccauccugaacacauugucuuccaggaggccggugugauugucucuuaguuaggacagucugaauauggcgcucuuuaccacucccauccaagauccuucuucuccaguggguggaaggagauaacuuagauaaauccaccuuuuucucaguggaaguugaguucaaagcugugguaugccuccagcagaguguuccuuuccuuuugcuacuccucugcauuuccuauaugccuucccucugaucucuucgcuagguugucaucacucguggucuauguaauugcuuccccuuaaaggguugaggggagagccucauacuccuugggugaugucaguggagcagugucucauacucuuccccaccaaaccuccgucuuaacccucagucacaggugauggcucuuuucauugcgacugacaacaguaucuuguauuuccuggucuuagucuugugguggugugauuuuugccuccagauuaccuuagaauucuucauucuuguuaggggacccacauggagacuucugcuacauaugugcggggagccuagguccagcccaugcaugcucugugguuggcaguucagucacugugaguucccaugggcccagguuaguugacucugcaggucuucuuaugguguccuugaccauucuggcucccucaguccuuccucccacgcuuccacaagacuucucuggaguggggccuuacucugacucuguugccugccuuuggaucccuuuucccuagcugggcugccuugucuggccucagugggaggggaugcaccuagcuugaugugccaggauggguugguacccauggggggaggcuucccuucucagaggagagugggaagggaaugggaggaugcauuggaaggagaggaagaaguggggggcggaggggagugcugcaaucggaauguaaagcaaaugaguaaauaaauuaaggaaaagaaaaaaaagaauucuccguucuuugacaagcugaucccuguuugcugugaccugcagucugcacaggcaggagaagcuugcacuuccuuccaggggaggagacaagugauuguggccccuuucuaguaaguacaguguaggagagagugucccccgggcuaaugcauaaagagucuccuuagcuguuucauuugugcaugauaauugucauggguauuacgguccacugaugagggguuuauccccaggaaagaucaaauaacugagaccaugaauccacagugugaagggagcccuuccucuucuuguuuuccuccccaacuguaauucuacagcuaaaacuaugaaaguauauuuauuuuuaagaauuguuuuuauacuuguuuaaaauuuuguuuuuuaaaggucuaucagaucaucaaaauucucagaaaacacaguuauuguuggcguaguacgcagguaaacauuuuuuuaauguugaaauuuauauaucaaugcaauguuaucaacagauggcaaaauaagggcuugccugugacaggagagccccuuugaagucuggcuuucauuacucuguggcauuuuauuuuuucuucuuugcuugaccucagggaggaaguuugcuuucagguuuaguuuucuaaacuuugaaccuccauuugcaggcaaacuauuaagaaaauuccauucucuuaagggugaagguugcgaagaggggucuuuguagggccuuuaauucagguaucuauaaggauucaggugccacauaagugcagggaaucuucucacauuagagcaaggagaagagacuauacaaggaagagagcaacccuuaacuaugcacgauuuccagucaguauagacagacaugcuucugugcucuguaaucuucucaguauggaagagaggagaauuuaauaguuucaguauauagagauuuauauauuaaguauauaccuggacacuauucaguuguuaacauaaucuuuguauuuaaaguauuaaaauacuuagauggaacgccaggcaccugucgucuaguacuuggaggcccaggaaagaggaucgacagcuugagccuaggagucgaggccagccugagcaacagcacacccuauccccacuaaacacgcuaugaaaagauccugccaaaaggcuaaacacuaaauugagacaaggaauucauuuuuaauuucauaugcauauaucuaauucauuugaaaguauauguuaugugacuguugaagauuauguaaauuagugaacacugucuaacccuuaccauuuuccuuugaaggguggacaaagaagaaucaucuuuaaugcccuuccuugcugcuggcuucacacggguacguaccuacuucuuagauggacaaguguaauucagagaaauuuuuaccucaauucaguguccagcaaaaaauuuuaaauuauuuugaagaaaaauuguuccuguacugugucacaguuuguuuugacuuugaaaacugauagucuaaucuguaacacuucauuuccugagucucaaaacuaggccugccagaguaauaaaacgaccugcaccgacagacuccuuuacaaaguauauuagaaugcuuuuacgugagcuggagauuuaugaagucaauucaguucaaugauucuggaagagaggcagcccaagcccuggcuccucgcccuuuacauccaccuuagucuguuguuucucuuaaaacagaaggcugcucaggauuuuagccagcugguuguagaugagcuauaggauuuggggacagagugaguggaagaaaacuugcuuaggauguagaaggccuuggguuugaucccuagcuccgaaacacaaacaaaaucaaagggcguagagagaacagaugguugcgggguacguacccggaaucccagcuuacugaggguaaagaugguuugguagauauauaacauuucuacccagugaaaaaucuguuacaugguaggcuauuuauugcaggggacaaacagacacgauuucugucucugccccauauugauccggcuaggauuggugguagacagacguguaagggcucuaucuccuccuccucagagugaucccaaggucucgcuggcagagcaguuaaugauccuugucugucucaaggccucuaccccaucugguggagcagcaagagcacuguacccagaaauaccccccuugcugucccuggcuugucaguuguaggcaccuauaugucccuggcuugucaguuguaggcaccuauauguauugagcgccaucuugguuguucccugaacugcugcucugggaagaagguccaugcucuguaucugucaggaggugagagcuagaaggaaagucauccugaucucugggugagaagggcucugccuguaggcaugcagcccuacugugccccuggcucaguccuugccccuucccugcuucaauaguaccagcuuucuuuucuuuuuaaacgauuucuaucuguguuguggguguuuugccugcauaugugucugugccagcagagcagaaagagggugucagauuccccggaacuuacaggaugguuguuagccaccauguagguguuagugauugaaauuggguccucuggaagagcagccagugcucuuagccaugaagccaacucuuuagccccacuaccugcuguuuucauuccuguagcaguugggaggcagaaugcuuccuccugcugucucuguucuuccggaggucugugguggguagaaacagcaguacuugucauuuguaagugcggaggcaagcucaggcagagugccucaguagggucauacagcuucuaacugguauguccacaugaccgcagauugcuugccacucagacaagacacagaucaugcacaucugccuucacauuggcagcagagggaccugcucaagcagcccauguccuguuuugaucuggcugggauugggucagcagucuaagagcucgguuuccccuccagccagaguuacuaugcauuuacugugcagguaaaagcaaagagcucguuucagaaacgggaguaaaccugcuugugagugucucccgucagaaugauacuacaguuagaccucuaaccaugaguccugucagccagcucuguauccguagacuguaucguagaccuaaaguauucaugagaaaacauuccacgugugauucuagaggucauuagaguguacagaaagauagcauuuauaugucaauacugugccauuuucuauaaggaaguugugugaucucugcgggcacccugagacuuguagguaugugacagcauaaugacuucuaagauaccauaaugaaauacauuauuuaauggugggaugaauccaauuucuuguaacucugcagucuacuuuguuggauguuuccaugauguaaagguuaccauauagaauacuuaauguccacgccuuccccuggugccuugcuguggggaaugauuacgggucagcuccuuuggcaguuaguggaaaauguuacucacauaggaguucccuccuugagccacagauguaagcagaagugaaaauccuaucagcaagacuuugguuaauaaauuuacuuucuauagucuagcccuagcuuuauaaaugacagggagauaaccagagaaucuuaguguuucuaauuuuaaagcuaauuugguacauuuaacuuuaaucucucaucuucuguuguacauuaaugacuacaaaguagguuuuuaaaauuugaguaggcaaauugaaaggcuuguuuaggauuucuuuuguggcaugcaucaaaggugcgucuucaccuacaaagccccccuuucuguuuauagagguuuauagagaaccccaacgucauggccuguuauaaugaacugcuccaguuggcauguggagaggugcgaucacagcugaaacucagguaauccugcccugcuaaaaagcccuccagaccccagggcaaacuugcaagcaaaggguuuuuggccauagcugauagcaguuaaaguaggguaaguuuaaguuggcuguuaguaaagugcuuaccaugcaaacaugaggacccgaauucacuugaauucagagccccauauccacaugaaaagcuggggugccuguaauccccgcucugaagauacagaggauccuuggaguucagguucagggagacucugacucaaaaauaagguggggagcaauugaggaagacaaccagauguugacuucuggccucuacacauacgucaucgucgucgucguugccguuauuguuguuguuuuguucuguuucguuuaagauguaauagaagacuuucuggaauccaucucaaugucugaugagugacucccauuuaaacuugagaccucagagcaguaguaaaugagaaaaaaguaagauacaaaaccacacaccuggauuuucaguuuucugugcuaaagggaaaauacuuuguaccauacccaauagagugccauuuuucucugacaacugauauguuuuccuacucuacauuaucaauauugucauuaauucucuuuuuguuuguugagacaggcucucauguagcauaguguagccuggaacuugcuguguagccaagguugaccuugaacuugaacuuggaauccucaugucuuagccuccugagugcuuggaucauaggccuucgccaccaugugcagcugagacuuuuuuuuuuuuuuaauaagaaacaaguagaagccuagauauuuguagaucaaguaagaaaaaguuuuuaaaugcuccuagguuuaaagaauaaaaccagccauucuccuuauucuguaucucuucuguguccaacuauuuagcauucuuuuuaaauuggggaucaaagagagaagccauugcucuguaucuguaugccuaaggcagauaaaaagcuaucgaaauuggaauguuacaauuuguaggaaacacuacaaggcccccuaugcagaaaagacaugugcuucuuagaaugaaaugauuuacuagaaucaguguagaaacgucacuaagcagaaauguuuaaaggcugggugagaaaagucaugugacucucagcuaagcgcccacaguaggcaccgggcaguuaguucguuuguuugugacucccauuuacuuguaugagucuauucugaguuagggucucacucacugucucucacaggcuguucuugaacucacagagaucugccugccucugccuccugagcugcuagaaucaaaugugugaucccagcacaccuggccuguaauuuacauuucagauacuauaguuguuuucuuuccccaucuccugaaguugauaacuuucuucuucaguaucuuaguguagugaacacuguagcaccagcauauaguccugggucuccuuuacccacuccuaaaucuuguucucacugagucccaacucuucuggguuucucuggacucuagucaauuauuuuugucuucacuuacucuuggaguaaggucacugucuuuugucuggauuguugaauucucagccaggcucccuaccauuaccucagacuuccucuugucuucacacggcauuuguguuucugucuugaaauccuccacugaguuuaagucgaaguccagauccccagauguggcccccaccccacgacucuccugagucugucucuccugaaucuacacucgcuuucucaacucccaucaugccuuguucuggcugacagccaaaagagauguacauuacaaaggaaaagaggaaaaauaugaaggggaagggaaauguggggcuggaguggugaauagagggagaccuguucugcugggugcuggaagccggaagcagcagccuuguuccugcggugucauugacuagaauguuaagacaggcugaucagcaugguaguuaaauaacacacggaagugagcuuuucagagcauaggauuaugacagcugccuaauuacuugaaaaagaaauuaauguacucaguuucacucccuaccccaaauaaccgccaaugaacuaaaaccuuaauuguagagccaugcuaaaugcucaaaaaauauaagcaaaauauuugauuggaugaugaagucauuuuagagucaccaucccauaaagacuugaguuccacaaaggaagagaaaccuaucaaguaagagaaaaacauuaggccuuuauauacuuaaaagggaacaaacccugaaguaauguuaagguuauaggaaaacgaguagaaaaaauuauuuguugcauauccagcgaacauuagucaggucaauauccuaaauaagcuuuaugaauaugaaucaaauaaugaaauaauccaguaaaaaaaaauauuuaaagcuaugcacaagcaauucacaagucagaaaacaugaaaagaagcucgccugagcuagcagucaaggcaguaaggaugaagaaguguagugugccugccgcaguucugcucugcuugaggaagaguggcgucucaguggggcuuccuacaggccucugcugcucugggagcuccugucugugcuuuguuguuguuuaacuuugaggcaggaucucaccacguggccuugacuggccuggaacucacuauguagacuaggcuggcgccugcuucugucuccucaguacuuuuuaucaacugagccaucucaccagcugcuuuuguuuuguuuuuacaggguuuuauuuuuaauuauguguaugggggucagggguuguguaaaugaguacaggugccugcaggagccgguggguguaacaggcacuuaggagcugccugaccuggguguggggaauugaacugauguacugauagagcaacacaugguuggaaugcuaagccaucuccagccccuucauuuaaaaaaauauauauauauuaauuuuauuauuuuuaauuagguguauaugaguguguuguaccuggggugggggcauugugcauaugacugcagcuguccucagagcccaggggaaggugcuaagucccauggagcugcacuuacaagcuguugugagcugucugauauggaacagggaaccaaacucagguccccucgaagaguaguaagugcucuuagccacugagucaucucuccagcuacuugcuuauauuuucuuuuuauuagaaauugaucuauuuauauuguggguuuguguauaugggugugggcaugcacaguguauauguggaggucugaggacaccugggggugucuucucucucucucucuaaccauuugaguccuggagagcuuacucagguuguagagguuagcaggaggaccuucacccucgcagggcucuuucuguuuucaauaacagcuuuuuugagcaagaagaaugaaaaagcauuguugcuuuuaaaguuuguacuuauuuauucucugcguuuuguguaugagguggcaguuaggugugucuuaguguggugacucugcuuuaacagccuggagcagccugugugccuccucauggugcaaccuuacaauaaaauaauguggugauuaaacauggcgacagagagccaucauuauugauaugcucagugagaaaaagagaugauaaagcuguaagaaugacugcauuucuauaaauacacauguuaacauauauguuuguaaaagaaacuuccuagagugcuugauguugcuuugucuaagcuugggguuucagauguucucgucucauuuauggcacagccuuaugagauggaugucacaugccauucaccccauguucccguuuaaggcuuacucagugguuuucuugugucccagagcugugcacucaccagaacacuuccagaacauuuuuacuaaguccaggcccacacccuuauuuugcuuucuguauugggauuugccuguuuuagacaaagacauuucauauaaauggagucauacaguguguggucccuuguaacuguccucuugcauuuaaaugucuuuguuuguuuguuuguuuuuuguuuuucgagauaggguuucucuguauagcccuggcuguccuggaacuugcuuuguacaccaggcuggccucaaacucagaaaucugccugccucugccucccgagugcugggacuaaaggcaugcaccaccaugcccggcuuaaaugucuuuuuaaggcacaucuaucuauaccauaccauagauagcaggacuucacuggguuuuauaucuguauaguauuccauuaugugcauauaucacacuuucucauucauucuuugcuggugcacaucugagcuguuagaacuggccagcuguuaugagcaagucucagugucaacagaugugcucacuuuuauuaaguacauaaucaggaauagauacagcugcaucauaugaugacuuuaugcuuaaccauuggcagaauuucuagacuguuuuccagaacggggacaguaccaauuuuacaucucuacaagccgugcaugauggcaccacuacuauuugucacccuucuuauucuuagaguggagugaugagcuauuuuacuucuaucaucuagcuggcuaccuccccucugccagguugggcaacaaccuugacucucuucucucauuuaucccuuaugaagguucuuucaugcugaaaaggacauucuaagugcugagggaaccacgacuacagugaugcauagcaucccguacacaguacgagggcugcagaggucuucuuuaugcuguuaguuccucuucugaaugagccaggcacuccaguacccgcgacuguguuagacuuggugacugagacuaauguaaauacgcucaucagaccuuuuguuuucguccuaaaagggcuuguaacucaguauucacugcauuagagaaaagucaagaagcaauugaaauuacaagugaagaccacauuauacagguucguuauucuuggaaaucucugguucugcauuuauuuuguuuguuauuguuuuuaggauuguagccccacaauuugauuuucuuuuuccuuuuggaaguccaagagcccauaucuuccucccuuaccccucccagaugauuguaagagcaaaaucaauaaaauaugcaauuuaaaauaaauucucuagauaagaaaacgaucucuuauggaaguagaaauguggcaguggccgaucuugucucauuauucuuccgggguggcuggguguuuucaccgagagacuuacuaaggaggcgugcccgggcuggccacacacaagcuuuccucacuggguuuacauuuuuccuugcuguuuuuggaggcaguuuaaacuuguaaaaauuuaccaaaaccagaaaauaacagacuaggcuaccauuauucgcaaagaugguuucuauaagagauaaauagacaucuauaaauauaagugguucuuauggcuccacggcagcugucccagggaaggaugccuuuuaucugaaaaugaaauccauuuugauuguaguucauuggaucuuaacuuaaggcuccuuuuguuacuggugcuggcauuugggagucagugcuaagagguagcuugggccaggaguugagggcccaggcuucugucugccucagacagcagugcaucuuugggcaagucacuuaaucuaacugaauccacuuugucuuaguacaaaugggagugagaguagcagccacccccugcugugcuacgaaagcggaacccuucauaaggcuuuggggguugccggagcucacaugugccaugugcuugcuucaagaaucuaguaaggaaaacagggccugcuaguggcugucagccucugcuuuaucaccaccuacacaugcucaguguucuuguggguuuuccuugucuuuuaauuguauuugaaacgcaucgucacacuuuucauguauaacuacuuucugcgcuguagcugcuuugcccucguuauuuaugaaccgugccagagaggcauugcuuuuauccuccccauccaggugagcacaggggugaaguuacucacagagguccagagggcagagccuggguuuuuaaagcccagcuugguacaugauuucacucgagcugcaucuggacagcucuggguuugugcugagaacaugccuuccuuggucuucauugaaguuggggugagccugcugccacucuggagucucagaaggacacagcaggaggcccagccaugucaccuaagcagaagguuccccagaaugcaaagcucuuguggcuguagaacauugacgaugacauccaaguuucuggguuuccagaaggaggggguggaacuuagguagaaaauguuaauuuuuuccaaacaucuuuaaauucacuucaucuguuuuuuuccuuugucucuuuucaguaugcaaacccugcauuugaaucaacaauggguuaucagucaggagaauuaauagggaaggaguuagcacaagugcccauaaaugaaaagaaaggugauuugcucgaugccauaaauucgugugucacaguagacaagguaaguaagaugcuagcuggcacugucaucacuugcggguaaggccggaagccugguguucagugagcaccacauguagcaguggccucgacugcacccucuugccagaaguccugucacucucacuuuacagaugcagagcugaagccaaggaugcacugugauuaaccagcaagcauaauuacugggauugaccuuaaaauuaguguuuuuaucugagcggugugaaaaaguugggguguguguguguguguguguuuguguguguuuaaggaaggguuucucugugcagcccuggcuguccuggaaagcugguauuccugacaacugagcuuuuaagugguagauguuggcacaugguucuggguagggacuuccagggaggcagcacacccuuagagcaugucugagccccagucauucauugagcaaguuuuaaauaccagcugugugccaagcacugugcugaauccugucacagaaggauggucaaagcaagaacauuugccuuggagaacucauuuuccagaguuggaaacgaaggggucguuguugacagugagaugcauacucagagcuaaaggagcagacagaaggggcagacagaagggguaggugcagccugccaggccuucccugauugucagcacugcccuggugccgggcugcgggaagaugcaaggaaagaaccucagguaggcauggcuuaaguccuacuugccuucauguuugcaguucagggugcugucuugucuuacuggaaggagcagaaggucuuugaggagaggaccaacgggcauagagaccucagugccuggcacgugggcuggaagacguguccucuucagggcuuucccauggcaugcagucugucauuuuucccccuugguaauauuuggagccagagguuuuguuuuauuuuguuuugagacagggucucucucuauagaccagguugcccgcaaacucacagagauccaccagcaccgggauuaaaggugcuuaccagcaugccuggguuguuuuguuuuguuuuguuuuaagcuagugguuuuguuguugggcuuaucaacuagucuggacaccggcuaggcaagcuggaucccucuuacugggaagagccauugguaacagguuauguggucaguauauaaguuugugugcacauugucucacuucuacugggguaacauuguuggggaccaguggcaaaagccucaaguccaaauagcagaaacuccucucuagagacaugaagugguuaugaacaaaacucgggaagacuuccauguuauugccuguuugcuacucuauuucuaagaaggagucuggccauuuacuuaguguauucuagagguuuuggggagugugaaaaggugauucuacccauucagcagccugcugguucacugaggugagaggacagacaucugugcaguuccaucucuguaggggaauggcuaguggagggucaguggccuuguggaaccacgaugcugugaucagcaaggagagcucaaaaguccaccagggacccagcguggcagaagagaggagacucagcaaauggucagcuggucagaacuguaggcaucagaauguuaguuuggaaacccugggccagaggagagaucccccugcuguuggggcagaguauugcagacacucaucacucuacaguccuuucugccugcugucccuuugggguagauagauauguuaacuugauuuuuagguucacauucaugccucccuguaucauuuuucuucuucucauaacuccccugucaggggaccgacaagcuccucucuuccagcuagccccugucuauacgucucuacuuuuccucuuuuguugccccagcccugaaacccacacauacacgcacacacgcacucaguguaggauaaguauuggcuaugcuuaugcccgcccgagcugacugugaccucagggcucuuugaccugcuuugucuccugugacuuccuuccugugucucccuuccucacagcuccacuucccuacuccacugucuuguuuccuccacaaauuaccuggucuuugaccuuugccuucuuguucuuguuccucaguagccugcugucacucaagauuaaauugucagagaaugauuuuccucuugccuuuuaugaauaaaagucccaguaugucucuuagucacacucucuguucauaggcuguccucguaccuugccuagaucucuggaauaaacugaucccucugccuuugccuccuucaaguucaucgauccuguuggcugcuaauuuccuugcuuuggagugugcacuguuugccccugaccugauccaggucuucuucacauucccacaguuauggugggcagaucccaucuggucuccucaucccaagacuaucauguugcucccuugguauaauauucagauugcuuagucuggugaccaagauucuguaguugacuucagucacucuaaacaaaagccucguguguuguuugauuguuuaccauugguaagcacagugccagccuuggggacaggacagcuggaugacaaugacuuaauuuuaugacagugauugccaaaggggaccacaucaauagcugguauguagcuugugccagagagcagcagagugugcaguggggagcucauguggggacaggacugugcgaaagcacccgcaccccgaacuggcuggcuccugaacccgcuggaugucagauugaccaacuagaaaucucucugaccauggucuaaggaaguauucuuccucuuaggaauuccaaccuucagugauacauagcuaaauuuauauuuauaauuuuauaguuaguaaauuaguauuuauaauuaguaaauaugguucgugcuaaauacauuuuuuguuuaccuuggugacuggaaagcuuauauuuaacauuguucccccagccaggacacuggcuugaccucugcuccuucuggggaccugugguacugccguggccuguuagaccucggcuagggucugucugaguuucuucaggagcuggaguaggacauucuccaucuaucuuucagugugcugguggcuuggcccugaugaccuacuguuucuuucucuuuucuucauucccucuuuucuuuuucauguaauggaacaauucuauugagacguaauucucauaccauacagucuacccaucaaaaguguacaguucauaacacuugggaggccaaggcaagagggccauuacaagucugagaccagccuagucuguguagccaguuccaggcuggccagagcuacaucgggagagcccaccucaaaccagcaaaaagagcuagcuacacagcccagugauuuuuaaguauauuuguguagguguggcauggcggaggaggaaccagggcacaccuuccccuggggugaugaggguaucuagggacuugucacaguuucccacauugucuuggauaguccucuuagagcuguuuguuuccagggugacucuguggccauggaagugaggacugccuacuccuuccugcuaggggaucccugguuaguguuugggcauagucugucccugggcuagcuguaccaagagcuaagcuguuuauaaccugcucuuuucucugguuacuacuaacugcagacagagcuagcugguuuugacauggucuucuuaaaaaaaaaaaaaaaaaaagauugcuuucagaauuacaucauccaguaaucagacucaguaucuacuggguaucuuagagcucuggguucaaagaguucugaagggccaagaacauuaugggcaccuuuaguucagcauccaacaggaggguugggagauuuucauagcuuagccucgagugacuugccagaugggcuggcugauaaagacaaguccccuagccacccuuaucaccaagggaagaugugccggucuccuccucagccaugcuugucuguugcaaggaucccugccgauggucacaugagcuccuaaaaucacaacccgggcuuuccagcccagcugcuguagcacccuacccugcagaaggacugacaccccagguccucaagggcuaaagccauuugcaauaagaagcuaguaguggccuagcacaguaauggccacacgcugcucuucugugcccuaguucugaguacaccugcaccaaguaccacgucagacucggagucccuccuucaugcagccagugagagccaugagagacugaggugacuuuagucaagugacuugacagggugaagaagaauauuggcuuacuuaaauugcauuuggguuugugaucauuuuuauccuaaguucuuucauggugauuaauaaaucagaaccaaaauggaaaauguuccuggauauaccaaagcauaauaauacauauucuauucauaggaauggcaaggaguuuaccauacccaaaagaaaaauggagauaacauacagcaaaaugugaagauaauaccugucauugggcagggaggguaaguggaaaaaugcacuucugugucucgaauucucuuugaauacuuaaguaaacgccacauggcucauggaaguguaaaagguuuaaagcaaggccaggcucucacagggcacggccuuccaggguggucguucccugaggaccuuccacuugcaguccagagccacuacucuggagacagucuucuuuaugcuguguagauuugcaagaaagagacuucaauguuuauauugaaaucacgucuaccucuguguuuguaagcuuuguaucuaauuggaaguagcuguuucugcaaaggucuaucacagaauauuuugaaugcuaacagauguguucugggcuggagagcuggcucagugagaccggugcuuacugugcaagcacgagaaccuggguucauaucuccagcaccccacaaaagccaguguggcaucaugcauguaacccugccaccgguggguagagaucugcggucucacuggcagccagccuagcuguggaaugcugagguccauauucagugaggagcccugucauaauaauaauaauaauaauaauaauauaaucaugauaauuaauaguauggaggagcaauugaggaagauguccccaugucaccucugucugauccacacaugcucacacgagcaagcaugcaugugcucaugugcacauacuguaaauuuauuaagagccuaaaauuuuuggaggccuugucucagaccuguucaaaauaacagagaaaguuuccagaauguucugagugugaauuauagcauacccaacaguaaaauacacacuuuaauaaaugaugaucagagaaaauuaaacuguaaggaaagcccuuacugugcaaaacauaaagucagaccuaguguaggauacggagggaaggagacacaaggaggaaguguggccauggccuuaggaacugcacuucccucuagccaggcuccugcuaaugggcggcgacacuucauuucauccuaaaugcagcuuguuuggucagcacaaggaugucgcuccuuuacacauggggaaacugagucauagagaggucugguuuccaccccagcucuggcugccaugugugauggugccuggugcagcccucagugccagcugaccgcacagcucgccugcugugucagccgacuuugcugccaguuggugacggcuucagggaggcggaucugugugggcucucuguucugagucuuugcucuuuuauguccuuuccaaauuguucuugugauuaguauauagggauuugauuauggggcagggcaaaagaaacugaagggacaguaaauaaauggagcaagccagcagcuucugugcccagcccucguuccuuugucuuagacauuggcuagucaaggcuagcagggaccucagccuguguggccuguguggccugugugaccuguguucaucucugugacugacuguaagcagacugcuggaacuugagagcaucaguaucaacguagucaaacgacucacuaggaaaugagagacuaauguaguacacuguaaaaguauauguguguuuguauugucuguugucaaaacuagggcaguagccaggcagugguggcacacaccuuuaauccuaucacuuuagaggcaggaggauuucugaguuugaggccagccuggucuacagagugaguuccaggacagccagggcuacacagagaaacccugucucaaaacaaaacaaaacaaaacaaaacaaaacaaaacaaaacaaaacaaacaaaauccuagggcagugacuguagaagucacuucuuuuuuccccaaggacauaaagugguaucuguaaaguuugguucguuuauugauggcuuucacacacacacacacacacacacacaauuuuuuuuagaagaaaaugcucugaaagcauuucauauauugcuaaaaggaaauauucuuuucauaaugaaaaacuacuaucuaucucccauauuagagucaggagaaaaauaauguauuguuuucuacuuacagaaaaaucagacacuauguguccauuaucagagugugcaauggcaacaauaagguagguaaagggagcccgggaugcgagugcacaagcaagcucuacacaaucaaaacuaauggcuuguaaaauccauuuuuagguugagaccacaacugaguguguucagacugacagucaaacagguaugaggcccuauucauucucaagguugagcauuuggggguggggugauucacagguccuuccugugauuggccugcuuugugcaguggugggacccuauucuuguggcccagcccagcccagcccagcguggugugaggacuggagugcugugggcaucuugaccagugccugggacgggugcagccuguguggagagaaugauuaccuacugcgugguguaugugcaggcagacacguaggaugaaguaggacuuuauaaccugagcugagcuuuagggcagacaggguugaguggauuaccaaagugcauuagcagggacaccguccacugggcuaauguggucacuaccagccaucggugucaucggaguugcuucaucucgugucuucuaaucaugccucagacaccaucuguccuacugcacaggcuucucucugccucggagggcuugcuucccucacacauaagucauggcuuuggcaagcuacuuguugcucuugcccacacagauaaggggaugucuguaaggacucgccaucagguguuuuggaagagggaacagucauuggagacuggaacaaagaguaagucaggauaaggagcuugaauuaaucaugguccuuaaaggccaggaaggaaaucaggcuuuuuauccauagagagucucugaggguuucagaacuucuaagaaguccuuacauugugucugcagcugcucacauggaaggaugugcucucacaucaagacugagaggagaggaaacauugaccagaaaaaugagauaacagugaggagaaggggaacaaguguggugacacaggacuagagagaagagugaagaaaaggcagaccagagagccgaucugagugagcccagggaccuagggguggccauaggccugggaagggugaguaugggccucuucaccguguggcccugguauuggugaucuacuuugaacaucugauagcuagcgguuccuaggucuuucaaagaggcaaggacugaagaugcagauguuucugaccagaaaaagcagcauugagugcugaggauaaggcggagcccagguguaaagggaagagcaucaagguuacugcgggacagaaugacaggcagagugggaggcaaaucccugcaagugagugccugacagaagaggaggggcuaagcagggaagagcuggauggcacagaggacguggagcaaagagacacugagaccugucagaguucaggcucagagaaaaaugaggcagaagccaagccucaggggacuagacgugguagacagagccugccacgcaguucugugcugccgcucucagagcacaucacuugauuuuguuguuagugguauuucguugguuuuaguucuucagagcaguccugagaagugggcaugacuguuaucaacacuccuuuaauacagauggaaaaacaagugccaagagaguuaaaugacacuuagagcuaggcacaggaaaugacagagcugggcuugggaggccaucaguggguggccagggcaaguacaggugagguaggaggcucccgccucagccucgugcgcuacaccguuugugcuuggacuugaugagugcuuccguaggagcugcugcugucacccugaugagccacugccugauccaucuucauuccucggcgggcaguggaauaguuguauuccugaggguguggggcuguuuugccacaguggggcaguuggggcuauuaggcccacaccagaaguccucaagcagaaguggggcuuauugggaggaaauagagccccuuacagauugggugagggaguccaagaaccaguuugggaaggagucgggaacccagggguacugggaagcugucucccucugagcugagcaugccacaggaacaccgugguuggccaccacuggcgcuggcagauccaggcucaagaccuugcuucuaguuucacuugcucauuuggcuaggccuaggcuaccugcuacucacguguggagccaggcagucccuggauuccccccuucuguaaaaggagauccuggaacucccuagucaagagaauggacauugagagucugggugucuaggaaaauaauaaaguccccacacguuacauuuuucuuagccuguguguaauuuucagaucgugcuauagcucacuaaagauacaaaaugguuguagugacaguguauagauuuugauuguucuggcuugcugucacaugauaagcucugguaccauugucuaauacugggacuggcagguuggcacuugucacaggccucuuuugcugggugccugaucacauguauuagcagugugccaagaucacagcacaguaaccuguggguauguugaguaagauaaccugacuucaacuuucucacauucagacuggaauuccugcuuccaggccaaaggguccaugccauuagggugcugacuggagacagugacuucuauugcccaacacugcuucuccagaauuuccuggguuguccuaucaggcuacagaaaugcuaauaucucugaacagaguuuaaggaucccauuuuauagaccagaaaaccaagaacagaguugcagaugguguuaagcccaggccucauggaggccuguuuggaguuauuuccauguauaagcaugguaccacaucagagugguauguuaucuauugaguguccacugcugugagccccugggcauggugcuucuucagagcuugcagucuuuuagaaaugacucucaugcuuacucauugguccccugggugugugugcccuaagggcuacaucugggagcugggccaggucaaggcaugccugcccaccugcagccuacugcaggguggaacuugcucuagagucauguacagagagcuaagggacacaguggggacagcauucuugacagggcuguugggagcagaggaucuaggauauacauagauaauuagcuuuaaagugucucuguggaaauuggaucuccuccucucucuccucuccauagccccauccugaucgcauggugcuuucugccuuguucugcuccagcucuccccucacugcaaagucauuaauaauuguguucccugccuugcuccccacuagaccccacccccuuugaggacauaacucuguccuauccauuaucauauccccaauacugcaaaggacuaucugaaauaacuaacuuauaaagagaaaaggcucauuuauuuuggcucaccauuuugguggguucgguccaucaucauuuacccuuguuggcuuuaggcuuccagugaggcaacacaugguaaaggggagcaugugguaaaggggaaccgcugcuucuuggccagggggcaaaauagaggaaaaggccagggccugagcagauggccugacucucuuaaaggcacuauguauaccuugacccugugccucauugccuggcucucagagucaauccucaagaaagacauaggggggccaggcguggugguacacgccuuuaaucccagcacuugagaggcagaggcaggcagauuucugaguuagaggccagccuggucuacaaagugaguuccaggauaucaggguuauacagagaaacccugucucgaaaaacaaacaaagaagaagaaagaaaggaaggaagaagaggagaggagagaggagaggagaggacaggagaggagaggagaggagaggagaggagaggagaggagaggagaggagagaaacauagggaacaaaugaacugugagguucuuagacccaaaugcaccguccugguugggaggggcagccuuuuaccacauaguacuuugagggguagucaagauccgaacuucagcuccagccguagcuguggcuacaguguaagcacuugggaaauguuugcugagaggaugaaagggaacagaaacaauucacagcccaggagggggaaucacugcauauggcugagaggaggugcuaccugaaggaaugagcaucuggggccuggauacugucacuucacagaugucaaggcugcucccgagaugugaguaguugggcugagcuaaagaccagaaagaaaugccaggcagacugcaccugccucugaaggccagggaguugauacucuggcuagacucugagugauuaugcuuggcaguccuuucuucugugcacaggauagugcaggggucaugcaaagcaggcauguguuuacugaguaucugcuaugugcuagguauauucuuggccauccagggaagacuguucugaccccagauuauucacaguuggcaagacagacaguaaagcuaguuguuaccguacccugaugggaugggaugaggagacauacagggaagguuucccaaaguuuacaguaccuaagcugcaucuccuagaggaguagaguaaaggagggaaaggaggcaacaugagaaacguguauuccaaaaagcagucuguaccaagguggagaugugugggggauggacagacacagcauaaagccuugcccagagucagggguagcucugcagggcucugaugcuacccggggagugggaggcugacccugaggacgacgagggaagaucugaagauaggguuuauuuaguucugcugguugugggagagaauuggucagguggguacauccugucuagugcuuggguauaaagagcagaguuagcaaaagauaaguucauuuuggauaaugaguuaacuuaacaguagcugaaaaguguccaaauggagcuggccaguggcccaucaagauguaaaucugauacucacucgggagaggaugggguaaaaccgcacgugggaauuagacagagcaggaagcaggcaguggggguuguuuguuuguuuuguuuuguuuuaauuuaauuuuuuuacuuauucacuuuacauccuguucacuucaccccuccucuccugcucuggguggggguccccuggguaucccccaacccuggcacuucaagucucugaaggagguugugccuaccuaaaagaaaagagugaggccagaagguuuggaauccagccuuuggaaaugcuaggggccgaggaagaggauagcaugcaaaaguggaagaaggaauaguaagguggacagaaagacaggagagugcagcuucugcagauugaaguagccagaaagaggaccccccggguccaguaagaugccagcaauaaggagauacccaucuguagccuuugcaaguccacacacgugcacguagaggagagacucugccuuuguugggccaggaagcuaagagcagaguugugccggagcacgcucgccuagcacgcucaaggcugggaguuccauucccagccuucggaacagaaaugggggaugaaccuguuccaugauguggagggaggagcacuugaggccucuacugggaucgugccuugggcagaggaaaaagaauuggauaagggugccaggcgaggccgagagcuccaccacaucgugggcagagcagacucugcccuaugcucccugcacucacacgcuggcugcucugggacauaaguuguuguucacuaagcucucagccccacacaaggcacccacagguacgcagaggggcagacaggaaguggccguucggggcaaggacuagagaggaguuccuagaacuccuauuuggagccuagaauagcagugaaaacagucagggagaaagcaaaugauccuaacacugcacccacacuuugugcuccacaugugacccuaggaaagagaagaacuuucucccgggauggugcugagaaaauaaagguuugguucucuuuugggacaaggguaaaugaggaggaacugccucuguuuuauguaaguacaguaggagagccucuacugaggucgucuggucuggguauuuccucaugucuuuggacucuguaaaauuugggcuuugagaaaauggagucacucaaaaccaagguguguguagcccgugucugugcacagugcuggcuuccgugggguuguaaugccugccauccagguuugaauaccuguagaugcuuaauauuuaguuugcugucuugugcucauaugucacugacaucucuguaaagauguagcuuaauuguuuccacagauaaccaggcaggcaaacauaaggacaggaggaaacauucgauggacgccaaagcgguuuccuccagaacaagugacggugagugggggcugcacugugugaccugagcacagggugcccaacccuggagcuucacucccugucuccaugcacugcacagucacagcaagagaaggccccccguaugagugcuccacacagguagaccccacugugagccuuugaaaugagucaagaauaaggaaagauggaggaagcaggcacuagguacucuauaugauuuucaaacuguuagcaauagauuugucugcuaaucugcuguccugaugggagccacauauuugguaauuuggaaggauagauuccauuucguuugcaguuuacuguggaaacuuacccuuuggaaguuguaagccuaauuuggagauuguaaaacucuuacuaagaaaacauuauuuagccuggagguggugguacacaccuuuaaucccaguaucugagagguagaggcaggcagaucucuuguuugaagccagccugagaugucccaaauucacacccccuuccuuuucuuuuaaugaacccucugaguccauucagugcucuggcaucuccguggucauagggccugccaggaccucguuccauccucccuuccugucagcugccagcagcuccucggcuagggcuuggccuugggagcucccccugcacaggaaaccacuuucccuuccaagucuucgacaugaguguguagagaugcaguggguguaguacauuggccucuacucaguaacucggaggacuuacuuacuggaccuaagaaccgaauagugaguacguucgcagauucucaaaaguccucuguagacacagacauuuuuguuucuuuucuuuaucucuuacuucauuguauuuaugcuauuugauuuuuucaaauuaauuuuaaaauaaaguuuucucuuaguugacagauuuuagaauuguguauauuuaucacagauagcgugcuauuuuagacuguuuauauauuguggcaugacuaaaucgagcuaguuaacauguuuuacuuuacaucccuaaaaaucccucuuagaaauuuccaagggugcaaugccugcuacccacugcucucuauucugauccugauaagcacuuuuauuauauuccuaaguaaggacaaacccuuuucugaccaugauaacaaaguggggggcuuuguuuagugacuuuccuguauaaaaugucauguuaguagccaugugcaguuuuguugguccucuaaacugacagcauuugaggcaucguggccuggguagccuuggccaauaucucuuugggccuguuuaucugaaggcaaguugaggcugaggcgccauauuucuggacagucucuaauccuucucaacauuuuggaaccuuaacagugggguguccauagacacgcgggacucugggaacauacuuuuccuggugcgcauuauccaggcuucccucaucgcagagcagccaugccugaccaugaccacgagagccugccugugguguugcugccugauuagccuagauuaaacaccauaaggaagcaguagagagauccuugggcauuugaaccagagaugaauugauaaggcuuaauccagugccuuauaugguauggagcugucuuccagagcaucauaugugcauccuagaagugaaggaagcagagggaggacagaaggggaagcucugccagggugccauuacuccuaccuaugccucuguaugcagcugagcgcacugacacccgggaagcuagacguaugcccaagguugggcacacccugauuuuucaccucuuucuccacaguuuccagucagagaagacauuccucuuuggcccggauacauucuaugaugauugaggcacccaucaccaaggucggucuucacugaguaugcaggccccuggacccccagaaaaauuguuucucugacagaaaagcaacaaugagaaugcucuuucaguuguauaauguugucucgucuggagaaaggaugggugacagagacagauggguaccuaagauuaacgugugucuguggcacaaucacagacuauuaucagccugacgcuagauugcucucuguuucgaagguuacagaacucaaguuuucuauuuccacgaugcagguaaucaauauuaucaaugcugcccaggaaaacaguccugugccugugacggaagccuugaaccgagugcuggauauucugagaaccacugagcuguacucgccacaguuuaaugcucaggaugauccccaugccacagaccucguugggggcuuaaugucuguaaguccaucuccuaggcuacuauagcuuaaugucuguaagcccaucuccuaggcuacuauagcuuaaugucuguaaguccaucuccuaggcuacuauagcuuaaugucuguaaguccaucuccuaggcuacuauagcuuaaugucuguaagcccaucuccuaggcuacuauagcuuaaugucuguaaguccaucuccuaggcuacuauagcuuaaugucuguaagucuaucuccuaggcuacuauagccugucuguuccuguuugcuuucucugagguugucuggacagugcuuuaaaaagacaagcagagcacccguguaggacucgguaaagcacaucuucuccaugguuuguguucugcuguacuuagacuauggggcugccugcugcuuaccucccagggaauccucagcuuggagcagcagaaagcaacaguguuguagacgguccacugauaacccucuccagggucacauaggguuuuacaagacauuucaauuguauuaaagugucguuuguuguuguuuucuguugguuuguuuguuugaggcaagguuucaccauguagccuuugcuggcugcaacuugcuagguagaccaggcuggccugaagucauggagauccaccugucucugacaaaguguguacacuaccacaccuggcuugucuugggaagacgaaaaaccauggugguagggugcaaauccuucaguucuauccucagcacaaaaaggagccaacaaagcaaacgaacaccacacaccuuugccggagugcuacacgaugcacugcagaguggagacuagcuccugccuucauguguuuaaaaagggccagggcgccccacuagccuuuggauaacuguuuaggaagaaggcauuaaggaugugccacuaccaccaggcagugguggcacacgccuuuaaucccagcacuugggaggcagaggcaggcggauuucugaguuugaggccagccuggucuacagagugaguuccaggacagccagggcuacacagagaaacccuguuucgaaaaaaccaaaaaaacaaaaaagggacaugucacuacauggggauucuugaggagcccaggcaccaccucagccagugcagagcagcacucucacaagcgaagacaacuaccauuguucugcugccgucuuagaaauaaaaguugcucccucccgauuccuguguccuggagcucauggggagagggcgccccgagagcacaugggguacugagugguuagucccauccucagggacgagggaggcguccacucagaaggugagagagaaguguuccugagacagcugaguuuggagaagaagaaaaugggggugaccugagggcagagggugguugucacuauggugggcaguaguuggucagcucacuggucauccugccugagccugggcuccagcaguagggcagcucccaggaggugacuaaauuuggaguuggccacaguggucagccugcugggcugggcagccuugcacugggcugugcuggacuguccucucuggggcuguccaucuggguuaugcagucaggaaggaagaccaugugaccaugccuuuucuugucuucuugauuuucaccaggauggcuuacgaagguuuucaggaaaugaguauauucuugcaacaaaaaguaaguucucuguuuuuaaucucuuacauugcuauaauacucuggcccagauuagaugaugcucgcucucaucaguaagcucuggguacgccgugaagccucagaagcaaagcagccauuucugauauagcacggccuaccccaaacaccaaaugccacgaaccuguuaacgucgucgucguuuuccaaauucuguuacuuugcagaccucccaccacuuucaaacaauuuggccacccccgucucccuucaugaugucccaccacggauugcccuggccauagaaaaugaagaacagugggacuuugacauuuuugagcuggaaguagcaacccaaaauagguagguagagcuuguuuccaaggccugugcagggaaccgcccgcccaagcagcagaggugugugcagagccauuccugggguggggacagaggcugaggaaggaggagagggacuucaaguugagucaguaggccccaggcagaguuugcccagcucugauggcuuccuuaaauagcagguuuuccugugacacaagucccuaauuucucuaguaugugguauuauauaagguagcaacaaagagucuccugcuccaaaccuagaaccaauaugguuaguuacacauuugauaaaacuagccucaaaucuugguugccauauugguggcccacacaaagacuccacccuaguuauguucaucggcuuaugguggcugacugggaguuuggguuuugcugaguaaaagcuguuaaccacaggaucuuggcacauagggcugggcacccacagccagugccagccaggagugcgguucaguuuggggaggguggcucugcuagguuguggaaugauucaccggucucaccccacugggugagcugucuacacugagacucccacgcacacagccuagcaguggccaggcacaucccauagcaaugagccccugagccccugguuuacauuccgagccaucacagcuuccaaaguguggaaggcaggccaggucgaggucugugaugaccucugagauggcuucugugggcugauuucuuaaccuucuaagucaagucaguaaaucuaaggaaggcaugcuugcuaguagcuggucaauuucucgagguaaagucuaaacuuuagacuauaaaguugcugaggugauuagucaccugagugugucugcgucugguuuaugucacacuuuggugguauuuccucuagguaggccaucagaaguaacacgugaggguaggauuacagguagccuguauagucuggcaaaggcaggguucugaagguuguacuuaugcaagcagggugggaacuucaccccagcaaaucaagaugccuaaagcaggcuaaggcagaaagaaaccguuguguggccuccagcccacauggaauacagugcagcagugcagaucaguugcccugguacucugcacuguggcuugaauguacuuugggucucuucagaacucggguaacugguuuuugcucuauuuuauauugugcauauuuuucuuuguaggccuuugauuuaucuaggucugaaaacguuugcgcguuuuggaaugugugaguucuuacagugcucugagacaacgcugagaucuugguuucagaugaucgaauccaacuaccacucuucuaaccccuaccacaauuccacacacgcugcggaugugcuucacgccacggcguauuuccuuuccagagacaaaauaaaggugagcuagcguuccuguuccucauucaacagcaacagugggcagagauggggcuuccgccucagcugcccucacugcaccguaauaaccagagugguccucacccgugcagcgugcagcauggaaggcgaggaagcagcugauagguuaaucugcagucuccgccagucuaugaguccucaaggagaaaccaaccgagacagaacagggcuguccccguggaggagagggguuucaguuuggaccuaagggcacacugagccucuuuuaagccccucaccugugcugugaguccugaccauuccugcccugccccgccccucagccccucagcugcuggcuaaccaucugacucagacagagcuucuaauuuuccugccccaggagggaggucacuccucucuccuggucccucacagcauucgcacagugcugccauuguguucuuuccagagcagcaugucugcccaucacugccuugagccgcuuccugccccacaggcacucagacuucaaacacugugauacacugccgugccacaccgccaugaaggacuccccuuucuucuucacucccugugccuaggacaugcaggcaaaccauucaggucauacgucagugucugaagcauuugucuggggccaagaauggcuacagccacacagagccaggugcauccuacaugauacaccauggagcugguguguggagaacaaaauggaggaugcccuggcacagggcggguccagcgauguucauuucuaccugugagggucggaccacuuagaucuaagucuuuuggguccuucugugauagcaccaauuucuuguuguuuuuaauauggaguuggguauuuguaccaguuaguuuuugucaacuugauugccuccaucagaguguccaguuagcaugaauggggacauuuucuugauuaaugauugacaugggagggggaguucccagcccacuguggguggugccauuccugcacaagugguccugagguguauaaaagaccaggcugagcaagccaacgaucaguguuucucugugcuuucugcuucaaguuccagcccuggcuucucucagugauguaucuauaaaguaaaaacacucccuugcuccccacagugguuuuggucaguauuucaucacagaugaaagagagcuaggacaguguggacuaugugccgugugcuugcugggcaaguaauggcgcuaaucucgagcccagugccuuuauauuguaaagaucaauaccaaggccaaggccggguuaaggauggagagagaaggcuguuucccugagcagagacaaguagccagggaggggguguguguuggggacggaguaugggcuaaagggacacuuuuugcuguaguuuguugcugaccuaagacaguagcuauuuuugagauaggaucuugagcuuguguagcugaggcuggccuugaacucaugguguuguggaggcuggucucacauccuccugccucuagcucccaaagaagugaaacaaaaaugacagauuuuuuuuaaaaauguguuugagacagucuuuucauaugggccagguuggcuuucagcucagagauccagcggccucugugucccaagugcuggaaucaaagcugugcaagagcaucccuggcuccagcuuuuuuggggggggggggguauaauuacaacauuccuaccuuccuucaccucccuccaagccuucccuuguuaccuucaacuccacggccucuuguccaucaacuuagugcauacagacacguauuugucuaugcauauauuucuaaguauugccuguugaguccauuuaacguuacuuguauguauguuuucagggcuggaccccucguaggugugcucuucccgcaggcagauucccagcucuccuguugccugugguguuuacacaugguugaggccuuacgggcuuucccccccccccccccccccguccaguuuggcacacucauuugucauccuacauuugagugucaugugcuuggacaaauguugauauaaaaugaaaagucuuaucaaaccuauugagugauuuggcuagagagagagcuuagccaguaaagcacccacaagcaaaagcugggcuugguggugugguccaugcuuguacucccagaaucgcuaaggccaacacagguggaugccuggggcucugaagcuacccagccucaccuagcuguagagccccacccaggucccagggagggaaaugugucccaaaggaauagguagaugcucucgacaaacaucugagguuggucucuggccuccacaugugugugcaugaacacucauguguuuauacucauucacauacauguacacacacacacgcacacacacacacacacucucucucucucucucucucucgaaagcugagcauaguauaugccuguaaucccaacacuugagaagaagaacuccagaaguugaaaaguacuuccuacauuugguuuauuuacaacucaaaaauauaaaaguugaugguuucuuuauuuuuaaauguauauacauuuauaagaguagaagaaaaccagcuggaaaccaauguauaccuguaaucauaacuucagaaagguaaggucgggucaagaguucaaggcuagccuuagcuacauggagagaccuuaugucuaaauuaauaaggauaggaaggagucaaaccuagucagcuaaacaagauagcaccaaaaaggagaaaaauaguugggcgugguggcgcacaccuuuaauccuagcacuugggaggcagaggcagguggauuucugaguucaaggccagccuggucuacaaagugaguuccaggacagccagggcuuuuuucagagaaaaaagagaaaaguaagcuaacucucaguuaauguaagccgugguuauuucuuaguuugacuggcucugacccuguuugcaguggaucuagagaaagaccaccuguguguugugugagacugaagauuggggaguuguucugucagccaagcacagaaccacaagaggagggaagacaggaucugcucagauaaugugauucuucaggagucagauaaauuguccaaggaaaaaggcagagagcagcucuggugaaggcagacccugguguucaauggaguucuuauuuucaggaaacuuuagaucgcauugacgagguugcugcccucauugcggccaccguccaugacguggaucacccugggagaaccaacuccuuccugugcaacgcgggaaaccagcuggcugugcucuacaacgacaccgcugugcuggagagccaccacguggcacuggccuuccagcugacgcuugaaaaugaccagugcaauaucuuuaagcaaauggagaggugagaacagaagcuguucacucuacaguucaccagggagaaggcugccccagcauccacacccaaacaccuccauugcccacaccgcccucacacaccgaugcugacccagcccgaaccugcaucuggagaugaacagaaagccuggggcauguggagcgcgcacauguuuugcagucgagcuccauccgcagcccuuacagcucuguucugaggcaggucuugcccaggcugaucaacaugccucccuguugcugcugcucuucuguacacagcacaugggccauugucuguuuacacauggcuccccgaggaagcuuuuccccugagacacaaguucuucagcacaugucgucgccuagugcguacaaggcuuggguguucuaucccaaaacuaauguuuaauguccaguuagcuguugugagcuggugucaguacguggcagggcuggccuaaacuccaccucccauggaagcugcacagguucugggauugcacagguucugggaauguccgacucaggugacauuccuaacacugccaagucucaggcaguacugccucuguuacucaguuuacccuucauguuuagcccagugccugauacacagcagagcucagcugaagagagagaaggacauagugagaaauacuuucauuuggauuucaaaggaaauuuuucuauuaaauuuuuuaagaguaccuugauuucacagagcuccuuuguaucaugucuuagaauuucauagaugggcuuaauaaguuuuacucauauuugccuguaaauacacaauuuacauauggaaugcauaagaccugucuuugcuagggcuucuguuacccuagcaaauuuuaaaaaucaugaccaaaaacaacuuggaaggaaaggguuuacuucaucuaacgcaggcagguaacagugcaucccugagggaauugcagcaggaaccugaagcagaggccacggaggaacccugcucagggcuugcucagcuuucuuaggcaccaggaccagcugcccaggggcaguaagcugggcacccaccccccaaauaaaauaucaaucaagaaaaugcccaauagacuugcccacaggccagucugguggggacacuuucucaguuaaaguuuccucuuagagaauaccuccagcuugugucauguugacauagaaguagccaguacaagauccuacuaacucuggaccacagagaaggggguggcuggagaguccacuucauacucuuuuguacuuuuuaaaaaaaagauuuguuuguuuguuuauuuauuuauuuauaaguacucuguagcugucuucagacacaccagaagagggcaucagaucuuauuacagaugguugugagccacuuugugguugcugggauuugaacucaggaccucuggaagagcagucagugcucuuaaccucugagccaucucucuagcccucuuuuguacuuuuuaauuuuaaauuauaugguucaucuucucaaaaacuaagacuugagaauaucaaaauauaaacaaggguuaauggaaaugcuaucagaaggccugcccucauggucuucuaaaucucagaagaccuccauacaaggcagggcgcauuguuagggcuaugaagauguggguauaaagaguaguccugcugggugcagugacacacgccuauaacuccaguccuuagaagccccauacaagaaggucgugaguuugaagucaucuuggacuaugugugucuuuagugagggagggagaaagacagggaaaggucuuuuuguucgucccuguuagaaccuaucuagccccgagaacugugcgacuuguauuaccgaguuaucacuaugaugggaagcuauaguguccuguuagcugacuggugaugcaggacguguaacuuccagugaugcuagauugacagcuacagcagacacgcacccugagaaacaggcuguguguggggagccuccuagucugaaucaguaaccugcagcagccucuguggucugaaacaggaaugacuaccggacacuacgccagagcauuauugacaugguccuagccacagaaaugacgaagcacuuugaacaugucaacaaauuuaucaacagcaucaacaagccuuugacagcccaggagagugaggugagaggcugacuccgaggcugcaccugggcuccacgcucaccgcugcugugaggagcucggauagcagggcccuuuucuuccugucuuucauuugauuuguuuguuugcuuaucuaucuagucuaucaaucauguaucuaaucuaucauuugucuaucaucuaccuaucuugaggcgggccccacucuaagaacuguaaggcuggcuaagaacucagauucucaggugcuggauuagagcaccuaaucucucuuccuugcaagcaucaggccuggcugaauuuguuuuucauugguuuaaaaauuaaaucacuaacaugcaaaacucuggcagaaaaaaaaugcagauagacguauaaacaagagcucucacauuggccauucuugugcuugugcccucugucagaaugcccccucccucggggaauuuuagggccaguuggagcucaagagggcucucucucugucucucucucucucucugucugucucccucccucccucccucccucccucccucccuuguuuugacagucucuaacuauguagcccuggcuggccuggaauucaauaaguagaccaggcuguccccauacucagggaggccugccugucucugccucccagcugcuggggcugaagguacacaccaccacacaggcuccuugggcguuccuaacagccacucccuagugggcguguccaccgugaggugccagcagcuguccuugcagagggguugggcugggaaggugcuucuguuggaaucaccaaagugacaguacugucacugcucauuucuagcaaaggugaccuugguguccugccgucaggagaugccugccgugagugagcagguguccguucuggcauccucugcgcuguuucccuguccguaggacacuaggccccaggugcagguccguguagaacaggaauugcugagcacugggacagcacagcuuccauuugacucugguuccccuggguggcccuggaugcaucaccucacuccgaaucccacccuuguuuaaaaauguaaucguaaugauacuucccccacaucccacagaugcuuuuuguaaguacagauaaaaacaaaggacuuugugcccucaguaugucauagguauugaggcaaugugagggacugucacuuaacauugucugcguucacugaaggaugauucugagaccagcuguugcaaagccuggugaggacuaggcugcaggacugguagaccacaaacugcuguuguugugagaagagagcauucuauuuuuccaacucauuuuguuuuucaguaaauauccuaaacgaaacaaaacaaaaaccaaccuuaaguucuuaccaauaggaagggauagaaaagaagggaaaggcaagggcuccugggagaggaaguaauaggaagaaauggcgagggagagaaggcggauucgccaggcccaguccugcugaacucccgagccgugcuuccuuccuccuuuagagaggaagcccucggugcucagagcauccacagcgcucugcugaagucuucaacuucauagauccugguuagccauccugugcucagagcccccugggaagguaccugggcacgagagcccguucugauugcuuaacuucacucaugguucaggaaccugacagaagucuggaagacauaaaagcuaugcucaagacgccagagagccgggcucucaucaaaagaaugaugauuaagugugccgacguguccaaccccugccggccgcuggagcacugcaucgagugggcugcgcgcaucucagaggaguauuucucucagguaagaugcugcaucuuacguguauacacgcgugcgcacacacagguggacucgggaacaccauaaagcuaccaacuuaaaaguaggaaagaacacucuagaaggaauucugucuuagaagaagauuuauuauuuuguacauuuauugauagcaaagcaauacauugucauuaucaaauuuauuuuaaagauuuauguauuuauuuuauguauaugaguacacuguagcugucaucagacacaccagaagagggcaucagaccccauuacagaugcuugugagccaugaugugguugcugggaauuggacucagggccucuggaggggcagccagugcucugagccaccgagccaucucucucuccaacccccaauuguuuuucauuauguguuacuuuuuuuuuuguccucauucuugucggacaucuuugcuggguuuggaacccuggguuggcagguuccucgacaucuuccugagacagcaggagaauaaacugcugaaguguuuguaaaugugggaguggacacugauaugcagugggggacagugagggccagggguguaacaguggcuuuugccugaacuguggguuugcacaucuauacacuuaggaggcagaggcaggcaaaucucugugaguucaagcaucuugccugucuacaucagagaguucuaggcuagccagggcuacaaagugagacucugccuccaaaagggggggugggcauuuauuaugucuccuaauuuccugucagaaacuuugaaggucagaagguacugaaacaucauguuuaagcugcuguuagaauaaaacugucaaucuagaacuguuuguagugaaacagccuucaaggaucagggcgagauaaagucacucucagacagggaaagcggugagcucaucccgggaggccugccguguaagcggugcuagaaaggaaggaagaggcccaggugcagaagaagugccccgaaaggucagugccuggguagcuguacaagacgcuaaauucucuaaacuugccugucuuaaagcacagaguuauuuugagcaaaggcucucacauugcaccauuacuuagaguguuggccauaaguaauaagauagaaacaggcagccaggugguggugcacaccuuuagucccagcacucaggaggcagaggcaggcacaucuuuaugaauuugaugccagcuuggucuacaaagcaaauuucaggauagccaagguuacacagagaaacacuacuagaaaagauauuuuaaauaugaagaacaaauggaugguggacucaaucagguauagcauucaaauuauaaacaaguagaacagccauaccauucagaaaaagccaucaagacacaagauagugcugcaaacaggaggguauuuccuaaugagaaaagggcccauagccauaaugugugcauuuaauauuagcagagccaaagucauccgcagccagcaccuggcagaacacucugaagacagugauuagagugucaaugacagaagugaugccagccuacaaaucauaugaaaacggaaggaggcagcugacuccuuagccauuuucaaugcccggcaggcagagucagacagaugcugguuagaggauacugugucaucaccaaguagcuuuguucccaaguacaagguggguugaguacuaggaaagucacuuauuuucauaaucugucauaccccuuguauaauagaggaaagcuugggauuacugcuucaguuacagaagaggcaugucagcucaccaggcaccuuagcagacacuucucuguguagcccuggcugucuggagcuugcuauggagaucaggcuggucuuuggcuccugaugcugggauuaaaaacaugacuuaaggugcaucuaaccacaugcuauugcccaaauaauggaaacaaagcuggaggcccucuguuaucacgcuguuaacacuauguaggccuuucuagucucuguacuacacaagggauagacaacauauauaaaaaacagaaaauaguacaucuuacaauuugcagauaaguugguggcuuuuuguuuguuuugggguuuugcuuuuguauuuugguguguguguguguguguguguguguguguguguguguguguguguguaaaaauuaucaagguacagaacaucccaguaauaauuacauuuuagcauacaggacaagaagcucaacauauuaaggucaaguuggauuuuagagacuaacaaccaggaaauaaaauguaaacagugcuauuauuuuaaaacuuaagguagcaauaaaaagcaaaaauugcuuagaauaaauuuacuaauagauggccagaccucauaaaacugcuacaaacuuaaagagcacaugaauaaauagauaucccuuggucauguauuagaaggugcucucccaagauucuccaguuggcguuggaaagagggcauccauccguucgcagcuccccugccuuaugcacagaccugucaguuaacaguaggaucuagaaaagcuaaaccaugacacuucuagagaaacuacagcagaauuuccccagggguucugaaauggacagaccuuuagguucagaaagcaacagcuauggaaaaaagaaaauauacauugugguuuaaauaggcuuggcccagggaguggcacuauuaggaggagguguggucuuguuggaggaagugugucccugugggggugggcuuugagacccccccccccccacacacacacacagcugccuggaagccuguggaucaagacgagaaugcucagcuccucuccagcaccaggccuccccgcuuccuguguaaugauaaugagcucagccucugacgcuguaaagccagccccaaugaaauaccacuuguaagagcugccuuggucuuggugucucuucacagcaauggaaacccuaacuaagacaauuagaugccauuagagcuuaaaaaauuaugcuaaaaaaugaguaagcaggacagauugugagaaaauacaagucacuucugacaaaggacuguccucaguagugacacaagccacccaguuagaaauaaguaaauauuucaguagccauuucauaaaacauaguaugaguugcaaauaauuacaugaagaaguaccuugcaucaucagagaaauuuuaaaaagugaaauuguagcacauaccagaagaaagguuuaaauugaaacuacugaggccagcuguggcccugugcaaaugggaucccagcacuuuggagcuggaggccaggaggauuaggaguucaaggucaugucaguggcaaacugagucccauuauaaucugagcuagaaauuaaauccuguauuaaaacaacacacacacacacaccccagaacaccuaacaacaugaacuguugaugacaggcguggaacagauaucaaaagcugcagaaaaagcgcagcugccacuuuggugaccagaugaacaaacucuuuugucgugacuuaagauuuacccuuucgggguauacagaacuguuuuuuguuuuuguuuuuuccuuuuugagauagggcgucacuauuaacauuguaggcuggcauuaaagcuuccugcuuuccacguaauuaaacuacacaugugccaccaccccagccuggugugaccuccauuacccaaggcugacccuccugaccaccaugcuccauuuaucugauucuggggauugaauccagggccuugugugcuaagcaauugcucagccauccaagccguaaacccuuagaccugccuuacuugguagcucaggcuguccuggaacuaaguagccaagccgugaacucggaguccccucugaggacugaggccuuagccccacccucccgccucugcauucuguaccacagugcagugaagcaagcccgaacucaggaaacccagucaugcccaacuccucccacaugcucaauuuguaccaguaucuuggcuggaauuuucuuuaucaaucucuacguggauauugguuuguaggguuuguuuucggggucugucugucuguuauuaggcuuucuaaggugaaugagaaaugcucucucugugauuuuauuuuguuuuuuuaauuuugaagaguuugagaaagauuguugauuuuacaaacucuuguuagacuuuacaggugaggcagucuccugccuucucuccacugggagguuuuaggaccagugaagucuccuuacuaguuaguaguaguuacuaguuaguaguaguuacugguuaguaguaguuacuaguuaguaguaguuacugguuaguaguaguuacugguuaguaggucuguuuauaguguguccaacaaggcagcacugucauagcugaggcccauccagggacagggccauguuucugcucacauauggcaccagugugggcacauugggcauuuguggcuaggaggauguuggguagcgagugacaggaccugagagacauuagcaaggaagcuuccagcuaugaaaauguuugggguguccucaggguucucacucugggaccagcuugcugucuggcagaucugguuugccuggcuggugcuacacugggcucucaagccagccugugggguucucagguacuuggguggggcugcuccaaggcaggccaggacuccuaucugagaccacugguguucugccucacagacugaugaagagaaacagcuggacuugccuguggugaugcccguguuugacagaaacaccugcagcauucccaagucucagaucuccuucaucgauuacuucaucacagacauguuugaugccugggaugguaaggagccagcccagcacuucuuccuuaagagucaccacuaguuaggaagaagcaugugggguuuagacuuucaggauggaauggagagaaaguagucauuccggaggguugguacccagaagaggguccgaaggcuguccccagcuccugugccuugagggcugugcuccuccagaggaggaguugcagagccugcagacaggggugggcugagaagagguuucccuguacuccacaguccucccagacuuuggcaucacugccagcucccuucugucccucguaaaaugcugggacagggcagagcucugugguagauaguccaaguuccauuccuagaaagaaaaugaggaagcuggaaccuuucauaaagaaaggcugugaagacacugcaucccuguuucucucgccagccuucguugaccugccuaaccuuaugcagcaccuagaugacaacuucagguacuggaaaggacuggaugagaagaagcuucgaagccuccgccccccuccagaguagcgugauguacacgccuggccuguggcuguccugccuggucucugcaguuucuuagcccuuucacuguuagccagagcugcccccucaucugcagagccuuugaaagcccaugggaugcccaccuucugugaccacaucuacaccauagcuugcugcaaggcucuuuagugaggcccccaagagcugugguuuguaucgacucuggacucuguguuaccacagcccugggaacccugcagaggugaccauggcucuccuagcagugaccaugugccugcagagcagcaucuggggaggugugguugcagguuguggaacacugcugcaagggacgucucucuuaaguccacuagcaaacgaggcagacauuuaagguugauucucccgauuauuacauguuuuauuuauuuuauuagacauuugauauuuucuaugaauuuaaaaauacuucaaagccaauuucagaugccuugaccaaauucaugacuugugugugcgugauuugguuacagaccuauuuucauaaaugcagauuuauaaguuuaaaaugaugcauuuuucccacacuauggaauauguuaaacccuccucuuugauguuaguggggaaggcuuuauguagugggucucacucuaguguguaacagagaagccacgucugcagacaagcucugagcagcugcugucaggaguuuuacaggugccuucucagagaaaaauuggauuugaccauuuuuuuucccuaaaauuuuauaauugaauuucuaaaagccugccucauuuuauaccauuucuauaaaauaugcccugcaaagcaaaccuggguaccuagcagcugauauuuuacaacuaacaugggguauuugagucuagaaauauaaagggucuaucuccucacauuuugaauaagcauaauacuauaaagaugauauucaaugacaugucgaaauguuaguuucauuuuaaacuuguauuuuuuucuggaugaaauuaaacuauuuguuuuuaagaaguuauuuguugccauuucuuuguauugccuaauaaguacucuuucuaaauuugggauagacaacucuuuuguagaacaaacuggaagcuaaacaacuuuguaaggucugguggagccagaauauaugauggcucuucaguuugaccacagacuccacuguagagaagaacacgggcucuuuguccugcaugaagaugccugaccuaagauaacaucgaggaagagacaucuuacccccucccagugccgugaagaagaggaggcuggugcuucaccaugagcacgccuaacauuuuuagagcuaaaagaagcuauaagaauuacaagguaagccggacguaguggcgcacgccuuuaaucccagcacucgggaggcagaggcagguagauuucugaguucgaggccagccuggucuacagaguaaguuccaggacaaccagagcuacacagagaaacccugucucaaaaaaaaaaauuuacaagguagacaagauggucuuuaaaggaaaagaaacacaccaaacuucuagaccaguggucuucagucuuccuaacacugcgacccuuuaauauacgacuggcuguaacuaaagaauaaacgaaagccaggcguugcugagugacaacacagaggugcgcagcuccacaccugcuaagcccagagaaggaggugauguucucaacugucacgaggagaacaggacagagagcaaagggaagaggcgcugggcaaggcaagguuggagccuggucccauuugacagacccagcguaggauuuaaaggguacucugaaucccagguagcacauacagguugucagcuuuccauuauacugacaaaugccugagacaaaaggagagggaggcuucaggccguggcaucugggcuguggugggacauuggguguggaacugaaugagaguggaggagagucccaccauguucuuuuggacaugccucuccaagccagaugacccccacucgaaaguuccuaccaccucccaaaggucccacaccggaaaguaagccuuuaagccuugucacuuugagacccccagacuacagcaaugcauaaagcaagacagaucccuugcaguggacguagacauugccacugggagcuucaguggccaaaagacaaaggaacccccccccccaccagacccacuuagcuaggcuggcauucaaaagggaagaucauguaacucagacaaguucacuacagaugcccuuuagaggucagaucagcaagagggguaaacuucuggacaaaaguagccaugggggggcggugaggcugguggagagggagagagaggagaaaaggagcaagaagcuucaaagaggcagcugcuggaagggcggugagucacagagaagccuguucccugguggcagcagaaacaauggccgggaauggagcgccaucagcucacacagccaggaagagacugaauccguguguaacaauugucucauccugcugugcccagaggaaacuugaggccacucacaacugucacaccggagguugugcagucuguucuaugguuucaagucagaaaggaaagacuccaaggaaagcaagcuucccgaccaucacccuccagaaagcucugcaucccacagucgcggugucccagggaaggcgcgcaucccuggguccuuccugccugccuggcugcuccgcgccacccuuccagcuuccucuagccccacugcuccucagccuccaaccccaccugcaaagcgggguuccuggccgguggagggagcccuguuuagaagggaggacgcaaacucagucgccaagaagcaauagcauccagucaagggccaagaacagcacugugaguggaacagcgugggagggucagggcacaucaaggcucugugcuauuguccaggagagaguggaaauuauauagcuagaggguagacugaacaggcuuucuaaaaauaggguuaggggcuagaaaauggcuuggcggccaaggcacauugcucuuccagagacaggauuuaguucgcagcaccgacaaccaccaguaauuccaggggcucuggcgcccucuucuggacuccacgaacacgugaguacucuuccaggagcacacauaaauaaagagggguaacuguuucguauaucugaggacaggaagacaaaaauaauuugggguggggcuggggguggguggguagggagaugguucuugugaacggaaacucuugaaaaggggcagugucugcagagacugacugggagaacuucaguccuguugggagucuggaaugcugcaggucccaucccgauacaguuccaaccucaaaacagccauuccuuguccucgugugucagagcuaacacagggcacuaauccugugacuaagagaaaaaccuucuagaauccacugacuuagcgggccacuggcuuccaccaacucgaaagcuuggaugucaugggacagcaucccgggccugggugaagacuuccccaucucacugugccuguucuuugauguauuagcccugauuucugacuuuauucuguaaaaccauaaaaauuucauuauacugccaggugugguggcgcacgccuuuaaugccagcacucgggaggcagagacaggcggauuucuaaguucaaggccagccuggucuacaaaguacucacugaguuccaggacacccagggcuauacagagaaacccugucucgaaaaaccaaaccaaaccaaaccaaaaaaacuucauuaaacugcuuccacagugaaacauggaauuuggaauaaucuacuguguucccagaccauggucacucaaaagggcucuagaauaauaaacuaacucuuguucucuuaagauggugugugugugguacaagccugggacacacgcgcaugcacacacacaggcaagggaaaagcacuugcgggcuggugagauggcucagugguuaagagcacugacugcucuucugaauguccugaguucaauucccagcaaccacaugguggcucacaaccaucucuaaugagaucugacgcccucuuauggagugucugaagacagcuacaguguacuuaaauauaauaaauaaauaaaucuuuuaaaauguuaaaaaaaaaaagaaagaaaagaaaaaggaaaggaaagaaaagcacuugcaaauguauaauucuaaaguugggacucccgacccacgggucugggccugccuguaaucccagcaagaagcagggcaagccgcuagcccaaucgccuacagcagcuccagauucaaggagaaaccuugucucaauagacagugcugagagcaauggaggaaggcuccuaacuucaaccucaagucagugcaccccacacacacaagaguauccacacaccagugcacccacacacacgcguauccacacaccagugcacccacacacacgcauauccacacgccagugcaccccacacacacaugcguauccacacgccagugcaccaacacacacgaguauccacacgcuagugcacccuuacuguccuggaacucacucuguagaccaggcuggccucaaacucagaaauccaccugccucugccucccgagugcugggauuaaaggcgcgcgccaccacugucuggcuagccuuaaauuucugacccuccuuccucucccucuccaguguugagaauuguuuuguuuuucuagagauggagucgacucgauaucuagcccuggcaggccuggaauugugugugagucagcuggccggaggcguccggguuaaugugcaugugucagaagucagugcugcugugcgggucaugcggugccuccugcaugcuggguuaugcggugccucccugcaugcuaggugagcacucugaacuaaggcccagccacagagccuuuugguugucugguuuuuguuuugucuuuuaaacuccaccucacaagggcuggggucccaggcuuguaccaccauacccaucuuuugaaccugauucaaguucacugccuagaggcagggugggaccuucaacagggaaaagcuuuagaaaacgaguuuuccuucccggugguuuuaugaggaguauuggaaacauugcuuuuaacauacauuuccuccaauaccauaaauccacaggauuauacagacuuagaguagucaggauuauguaaggauuaaccuugcuacauugugccaguuacaggaagagaacagaaacugccguguacuguuggucuugcugagagugagcuagaccuucucagcucagacucacaccuguuucuucuaggaguccuccaagacucccuauccugggcaggcuggccccuggcccuguaauguggacuaaggagggcaaacagcuaagggugaugaaaacacugccccuggaguacagcaaccgcgccaguucauccccgccugggggaaacacuggccuaccugccacggguucucucucucuccuucccucccucccccccacccccacucucaguuggacacuccagcuggcugccuuaaugaagcuuuuaagcuccuggcuugcggaugucauuucccacugcuugcuauuuguccuucuccuuuugcuugcuuaauaaacuuaaagcgcagcuaccccagaucauucucuggauaaaacagacucuaagguggcccugggacacaaccacacuguacuuguagagagacaucagaucacauugaacaaagacccaagcuacaucuaauguugacaguccccgacuggcccuacaaagcuaccgcuguucuccacugucuguuucuuacaguucuugaggaaaauaauuccagacagaaacaagaauuuuaaacuguuuaaaagaggcuugugagguggguaugguggcacaugccuuucauuacgucacuggaaggcagaccucugugaguucaaggccagccuggccuacagugaguuccaggacagccaggauggacuacauaguaagacccugucucgacaaaccacaaaaagaggcuuauguuaauaucacuuguuauaugacaauuaauuacaauaucaaguacacucauuaagaaaauaacucggguagccgggcggugguggcacacgccuuuaaucccagcacuugggaggcagaggcaggcggauuucugaguucgaggccagccuggucuacaaagugaguuccaggacagccagggcuacacagagaaacccugucucaaaaaaaacaaaaaaagaaaauaacucuagaaggcuagaagcucagcgguuaguaguggcugcucuugcagaaaaccuaguaaguuagguuccugaaugcacauggcagcugaaaaccaccugcgaugccaguuccagaggacuugcugcccucuucuggcuccugcaggcacugcaccuacacuugugcagccaacacacacacaccucaugcaaauauccauccaaggcagcgcuuguguugaaaguacaauggcaggcccucuagcuuuaaccaucuacaguucuuuuucuauuuguucccggcuaaguggucaaaguccaugucuuaagaguuacuauuguggggagggacagguuuauuuggcuuagacuucuguaacacuguuuaucaucaaaggaagucaggccagaaauucaagcagggcaggaguugauacagacaccauggacgguugcugcuuacuggcuugcuaagucugcuuucucagagaacccaggaccaccagcucaggggugguaccacccacaauggacugggcccccucuacuaaucacuaauaaagauaauauccuacaggcuugccuccagccagaucucaugauggcauuuucucaauugaggcuccuuucugguuacucuagcucagugguuuucaaccuauggguugugaccccuugauugaaacaaccuuuucauagaggccauauaucagaaauuuauauuguagcaacaguagcaaaauuaguuaugaaguagcaaugaauaaguuuacggcugagggucaccacagcacgaggaacuguaguaaaggguggcaucuuuaggaagguugagaaccacugcucuagcuugucaaguugacuuaaaacuagccugcacaauccaccauugucucuaaugccaaauagacugcacacaggaauaaaauagaaauaagccagguguggugguucagcuagaggcaggcaaaggcaaaggcaaaggcaggcaggguuacccggugagaccauuaacacagccacagaaggaauaaguaaguguacugguauaucugaggagcuuacuuaccaugugaggcuaauugaggcaaaucaugauagugguccaacuguuguuaagagggccuggacucugggauuuguugaaaauuauaaaauguugaaaaaaaucaaaauauacuguguucauagauuggcaaaagaagugugcuggcaaguucuaugucaucuagacacaaacuagagucaucugagagaagggagccucaauagagaaaaagucccugaugaugguggcacagaccuaccuucaauaccagcacuugggaggcagagguaggcagauuggaguuugaggcuagccuggucuacagagauaguuccagaacagccaggacuauacagaaaaacccugucucaaaaauugagagaaacaugagaacacgugaguaagcacaccuaucauggcuuccuucagugauuaagauguagaaguguaagccaaauaaaccccuucucaacuugguuuuggucacugcuucaucacagcaacaaaucacaacuaagauggccaacuuugcccuaacagcccccucauaacagacucauuccagcaguagcagaagcagccccugaagccccagaucucaacaugguugcauaggggguuaaguuuccaacauuggagacauaguggacuucacauagaagacauagcuucaugauguucacuccaacaauacugcuaagaacacaguauuucuuuuuugaggucuacuaucuucuaggcuccaacucggucuuucaccaaacucagaaccccagggcuccucaacaguccaucucuucaauucuggauuacaagugcacacagccaaaccugggcuccacgugugagcuaguggccccagcuugggucuuuaugcucaagcacaccacccaucgaguagcugcccagcccuuucauuauuggggguuggggcaguuuugagaaucucuagcccuggaugucagauccaacuguuugucucccccuagugcugaaauuaaacauacccaacaaaagccacucuuagcucacaggcagccagcccaccaugacaagugauuuguuuuuaaacuuaauugagcauuuaauacgaaaugugugauagaaauguaagauagaauaaaagauacagggcuuucuugauuacaaguuuuaugcuagcaaagcucaucuagacucaguuuacaguagagccaguugucaagggucauggauucuauagggacccugcaucaacauauguucucaccccagcacugcuaacacaauuguuucuggggacacucuggagucucuaaaguagacacugccaucuaguuuaugccaagaguguuacccuuacaaagcacccaggagccagcacccccaugcaaaccuugagcucagcauaguggcaaaccugcugaacaccugcggaggcaacucccccaugcuugcugaguuuuccuuacagcugcucaucugagggcaaaaucccuucuuauauguucuaguaaagggaguuaucaacagaugcuauaugggagaaacaaaauauguucaugagguagccuagccucaaauacucagaacuaauuacaaaggcaaguuuucaauucuaggacucagaguaaacauuaaaaaccuaucagauugaaaaugguguucaauagcaacaucugugguguucaagcaggaaaugucaaagccccuagccaaggaacaaaaacagucacgccuaccuuacccuaguugacaccauugucauucaacuaggcaugcugaccccaacaaccuugcuuauccaagaaacugaaguuaacagauagcaaaacagcucuccaccauguccugagagcacaguaggaccucccuaaacccuagacuagguuuguaaguguucagcccuccacccgacccuaacagcaagaacaauacagacaaacuuguuuucagguuuauugaaaauauggcauaacagauuaaacagcuccacgugguguuuugaaauucaugccaacuguaggcugagugaccugaagguuagagagacugccaaaguccugcaacaaaacaagacacacggugagcgggcacucugcaaccccagcccuucagccaacagacagggacuaucggccccaggaacuuuuccaacacauacccacccggcuaaugaacacucccccuccuacaccuaacucugauccaaccuucaagcagguauucccuagccaggacacaccaacaaacccaaaccacuacaacaaaacccucgccugcccuccauagccaaggauucagcacucuugucacuacuccccaacuaaagccuaaaagcccauaagcagguucuuagcauagguaaagcuacaaaagcagcacacggcacggucagaggggcucagggcuagagccccaagaacauuccccagccucagucaacaccugagaggaaaccuaauguacaaagcacaaggagcggagggucaggccuguccccaagaacacucaguaccgggagcccaccaugcucuggagccaaaugguuucagaaggcugugcugagaaagaccagcagugcucccagcaagcgucagcugcuguuucacugagccaugcgggcacauggggagaguaucugcucacaaucacuaacagcaugcuggucucaggcgccuaucccaccuucucauacuuaugcaaaagagccaagucucaguccgcugagauaagccacccguaagauggcucaacugugacuagcccgacuacuguagaaauaaccagggaggaaagcagguaacagccagagcugaagggggcggggcaggccacaauuuaggagccagccccaaacaaggaaaacacacccccgaaucaucacagaacaagcagcuccagccauuuagaaaccagauguauucaaggauucaggcaacacucaccaggagcuucagcaucuccuuggugucgggauccaccucaaugaucuccugaucuagggcugagaccugagagggaaagaaucaaguucaaauuaugaaugcguggguuaucuuucaccuccucugcucccaacgcaacacauaaccuuagcuguccuggaaagcaccauguggaccaggcuggcuucgagcucagacaucugccucccaaaugcugaaacuaaagcugugcaccaccacagcccacuuuauucuugugucagaaccaucuagugugcauucagaaagcaggguucacacuuggaugucaagcuaaccacgucgggaggcacucucacugggcucccaugugaaaaugaauuuagaccucgcagagaagcucaaggucggcugauuacaggcacccucggcuggguguguuggcccacgccuuuaaucccagcacucagaaggccgagguggguggaucucucaucauuuugaggaaauagauuaagacuucacugacauccagcugcguucccaccucaggugagcccccaggaagaggugcagaggaagacccacaaaucuuaccucaggaacguaguuaucucuccucucucucucuucuuccugcaacuugauagagaugccucucacaggcccucucugaauccgcuucaucagaugcgugacauagcuacaagcaaugcgaaacagugaccaccucccaccagaaccgacuuugucucuacaucaaggucggucucaccaucggaaagacacacagacacacacacagcacuguucagauguccacuccuuacauccucacucgccgucaccagcccuccuccgaaugucauguaccccgacuggucuuauccgucguacggacacaacacugcuauuuuuuugcacaacacggccauagugguaaaaugcgggaagcagagaccacagcaguaagguuuugaggccggagcucugccuucagcuaccguaaggagcccgaacuaagaccacgucggcaaaaccccacuguggccaaggcacaccuccagcccuucggcgggccgucuggggggagcggaggcaccggcccgggcaggcucuccggcggccgcggcccccacucacccggcuaucuuguuccgaagcuucuugcuggggauaauggcgaucuccucgcacacgcgcuuguugguguggaagucauuacccagacgcguguaguacuucucgaugaugacccgggcagccuucuucacggucuuggugcgaacgcggcccugaggguggagagggcaaagucaccggggagcccgcgccucccgcggaggggccgcggcgcgcacgacuucaugcggaagcgcgccaggccgccggugacggcgccggccccucgcugcggacuugaggccgcgacgagcggaggaugggcgaggauugaaaaggacagagcccugggagccaaacaccuaccauguuggcgggucucgguaaaagaggaaacaggaaacacaagagaggccuauaaagcgcggccagaaagccgcuuccgccuggcucgcgag

SEQ ID NO: 3910 - RNA, 8189 nt, Mus musculus
acucauuuuccaccggaaggagggagaaauuaugaccgagagccugacaccugaugcuagcggcuuuugucucgccaaguugacccaguauuuggccaccuugugcggcgggugacuaugguguccagguaaguggcugacguggcaggcgucccaggaaugggagaagagauggguaagcugcccggcuaucgaucuuccuucucuguguuuguuuuuucuccaucuuuuucaaagaggguugcuagcccacggaaugguggguagauauggaaggagaaauacgcggucacacagacugaaguuaaauuaagcacacacacauacguacguacauacaugcacacauacaaacacauauucacaugcacagagcuguugaauauuggcucuguaaauccaggcauuccgaaucgaugacucuugccugagggaggaaucaccuguugcaguaauuuuagcgcccgugagcacaugcacacgcagugggugauuuuuaaguuucuugaaugugucagcaaaggcauuuaauguuagaaaagggcagcaaggaggcgguggaaaguugcaugguuuguugaggacagauucuaaaaucccauagaauucuuguacaaaggaguuuuuauauugcuuucugauggugugcguggauggguaggagguuggaaaauugaaggagugaagacaguagugaggugcacuuagauacuagccugauggcuuaguaguuaagagcauuuguggcacuuccagaggcucugaguuugguucccagcaccuauaucaaaucacuuguaccucaggacccaaggaguccaacacacuauucuggccuccuugagcaccacacacauaugucauucacucacaaagacacgaacauacauauauauaaagcuuagauaaggugugaguccaccaaaggaaagucauucgucagccaucaacauguuugacccuguagaucagugggucacaaccgugggucacaaccccuuugggaucaaaugacccuuucaccuaaggggucaccuaagaccacuggaaauacagacauuacauuacaauucaaaacaguagcaaaauuacaguuaugaaguagcaacaaaaauaauuguauguuggggucaccacaacaugaggguauuaaagucacagcauugggaagguugagaagugcugcucucgauggagaugaguuugccgugucugccguucccgguguacuguguagcaacagaaggcaaacaugggaaucuuccuuaccuauugccuguuauugcauagaaaacccugggggucuuaagcaagaucugagcucccccuagaaagcuuguagcggaauacuuauuugugcgcucacuauggcuuugugcuggcaaccuguagaacuuuacccuagccucuuuaugggaaauucacuauaaagaauuuguaaguugccuacaagucgaggagagaugcuguaaaguucacuguaaucagucucucucugucugucugucugucugucugucuguuuguagguaauaugacaucuggugcuuguguagcuuuagguuugcccugcauuaaugcugccagcucaaguggacccugaguuauugcuauuaucuuucuuauacuacaguggaaacauguaggacaguggaaaccugucaaggaagggagccuaagagguccaaaaagguaacuguauauuagcaaacacagaaacauuaucagcaucaaugacaaaagaccuuaauaauaaggaaccauucaguuagguguucacugugggggaucccuaaguacuaccuguaaacaaauuucaaaaucuuugcucccaagauacccuuaaaauuauugagagcucaaaagaacauuuauaggcuauuaauauuugagcuauuagaaaaugaaagcuagccaagugauggcuaccccugccuuuaaucccagcauuugggagacagaggcagguagaucucugugaguucaaggcuaccugggucuacagagcaaguuccaggacagccaagguuacacagagaaacccucccccuccccgcccccacacacaagaaaagaaaaugaggucugaaacauguuuuaaggauaagaauaaagggcacacaccccaguaguuuugacaguggucaaugucuccacauauuuuguggauucuaaacucugcuguuugucacucucuuguuuugauggaaaauauuuugaccuuacuuaacaucggaaggcuuucagaggcucccauaggaagcauauuguaagcauaagugcuuuccuuccaagccugacaauacagaccugagguccaguguuccugaaguuauaucaggaggauggcaguucaagagcugucuggggcuagagagauggcucaguggcuaagagcacugacugcucuuccagaggaccugaguucaauucccagcaaccacaugguggcucacaaccaucuguaaugggaucugacgcccucuucuggugugucugaagauagcaacaguguacucauauacauaaaauaaaccuuuaaaagaaagaaaaagaaaaagaacugucuggauaacugagagagaccuugucuccaaauaaaggguacaaaggcugggaauauaggucagugcuggaguguucaguuagcaugcaccaggcucugguuuuaaguggcuuuauccaaauguuauaaaaauaacuuuuuguuuuauaaguaagugucacuguugaaauugugacaugggcagcagugucaccuguaaaugcaauuauacgaaaugcacacacaucacacacaccucuagaagcuguauaauuguggacacaagaauacaaauggguuuacauuuuguguuuccuuuagaaauccuguugccugcuacucuuggaauugauuccagggccucaaacaugcuagauaaguguacuaccagugagcuguagcccagccuucauggcuuuuguugucuuaaguaacuggcucagaccuacuucuccagacuuaccauucauugauuagaacauggagcaaugaucaguaguuuccauaucuucccauucucuuggucugugucucaccuccugccaggaaccugcaggcuauugcuguucugcaucuacuuccuuucucuguuuagaaugcccaugaguuuugaguuaauagguaaguauacaaaaacacaugccuauuacugauuagaguugucaugcucauagguuguuuaaauuuucucauauuggauguagcucugguauggccgguaccugguguggacaaagcccugaguuugaucaaaguuggggaggaggggagaacccaugaucuuuaucuuguuuuuuuguuuguuuguuuuguuuuucgagacaggguuucucuguguagcccuggcuguccuggaacucacucuguagaccaggcuggccucaaacucagaaaucuaccugccucugccucucaagugcugggauuaaaggugugcaccaccaugcccugcccaugaucucuuauguagaaauuuugucaguuaaggaauuccacuaugaaaauauugacuaucuauugccuuguuagaaaaggaugagauuucaguaaugaagagugcuucugcuuggguucugcccucagggaauauuuaaauuuggucauuuaucuugaagaacuguuacuaaggacugaguuacuuuaauuguuguuuuaugucacuuagugagagagucuauaaaaugauuuuuaaagguacuucacauuuaagaaguaauccagaaaauagcuaugguuuuacaacuuuguuauuaccuuuacaggguguuuguuuguuuuccucuacaaaacaaacaaacaaacaaaaucaacuuaguuuauaaauaagaggggaggggugagagaguugugguguuuuucugcaaacaccauggccagcagugucaugucaaacucugugagucugacccggugguuuauuuaagguauauuuuauauaguacaguuuggaaaauguuuccuuguauaacuccaugugccgguagggcaugguuaccuugaaacucuuuucaaaguaugugucacuucuucaugguagguauagaauccaucauggagucuguauagacuacaugcauuaucuucagggucuuggagaagaucuccaggcucuggauguggucucagucauacagauagugcaaaggucacuacacuauuaaccaucuccaguucuguuuuuaagggauggagacagguguggccuggcccuacaaauagcacagaggucaccgggcuuuuaacaacauccauucucagccuucugggcagagaauagguuagacaucuuuuccucugaagagacagcuccgcguguuuaacauuccugguuucccuggugcuuauaugugagcaccagggcucugugcccucuacaguaaacuaaaaauagccaauaugucuuacguuguaccuugagauaguuugaauagguauaaguguuugaaugcuuaccuauagggaguggcacuuuuuggagguguggccuaguuagaguugguauggccuuguuggaugaauugugucacugugaggacaggcuaugaugucuccuaugcucaaguuacacccagugugacauacagucuccuucugcugccuguggaucaagauguagaacuuuuggcgucugucugcacacugccaugcuuccggccuugaucauaaugaacuaaaccucugaaacuguaagccagccccaaguaaauguuguccaaguaaaaguugccuuggucauagugucuuucacagcaauaaaaaccaaacuaagacaugcuuaaaaugucagguaggugguuaaacuuaguggguuagaggaauauuuauacauuuaucuggaccaagaauuaugaaccaaauuuaugauucagagcuuguaaaauaacauaugauagaccuucggguuaucuuaggaauagucaaugcuacagcaaguauuaaaugugagugucagagcucucuuguacuaaugacauccagcaccagccuugguccuuccacacucauucucugcacagaucagaaguaacuacaauuacugagggacugugucagaccccuagguauuaggacagaagacaacuuagccucaucccacagccccaagagcauacacuggacggcugcuuugauuucuaauggaaaagcuuuccuuugauuugugggauaaguugaugucucauuucucucuucagguauauauauguauuaccugaaagcccagggcaguuguugccuugggucaugcagagaauaugcagccacacccaugccuuagauguguguaauucaaguggagaagacacaagccaguggucgcaauaucaacacuugaguguucuguaaacggugagugugagaggugggagucagccagugcgucucagaggugauuuagagccaucaggaggacaggaggagcugcgcuguagguguuagggaucuccuaguugauggcuuauacaguguacaugguaauaagacaguacggagucuuacacuuuucccagugugccggccuuguuuucacuuccuguuucgcucuugcugcuucucuccccuuagauuaauguuugccaugugcaaggaaauggcagaggcaaaaugcuggcggcuuauggaaaaauaauuuauaaaaaaaugauggguuaguucugccaaauuugaguaagugagaacacgagaaaccauauucuguuagagcuugagaaaaggaaggaaagucaaacggugagucuaaccucauuuauuccaggauuggugucagcagaaaaccaacagugaugugguggcacacagugaacugacaggacccaggcagcagcgguucuuuugguggcaauggugccaugucauggguacucuccuugcugauggcagauaccgacaggcaaacuguugccuugcguuuagcucuguuaaccauugacaguaagguaagcaugucuucagcguucauggcucuuaaagaucuugucuguaacacaaggguuuaagacuggggucucauuuuguuguccugacuuagacuuggcaguccuccugcuucagccugcuaagugccaagauuacaggguugagccagcaugccuaacuucuaguuuaguuucuucagacagggucucaugcagcacaggcuggcuuuagacuugcuauugagcauaggauuaccuugaacccuugaucuuccugacucuaccuucuaaguucugggauuccaggcaugcucaguuaaaacaauagguggauuuagucauauucuucuggagacuaagacaauagaguccuugaagucaagcugacucugccuuuagccuccuacaugaaaagguagauagaacaggucuuguuugcaaaauaaauucaagaccuacuuaucuaccaacagccauugccuacgucccacagucuuccuacaagaagugggugcagugaacuccuagaugaggaaggcugggaaagccagaguggacacagucucuacuagugauagaaaggugcuuggaggucagacaggcggguuagaaaguugagaacuuguuuccuauaaugcagguuugaggaauccaaaaaguguauugucacuuacacaauucugcaucacaaugaauuguaggugggucacguagggcaguaguuguaccagaugugagggugagacgcugagacgcccagcugcccauaaacugguucuguuuguacuaaagggcaaguacacgcuucagaaauauuuuauuucaugugcacaagugauuaccaucauuugaaaaggcagggagcugauauguguguguguguguaugugugugugugugugugaugaagagugaagagggggcuuaugugccguggcacacaugaaguucaaagacaacucuccuuccauggugucggauuuggggauugaacucagguccucagguuugguaacaaguacccuuaccagccccaggagccagccauuaaacauaccaauuuuuugccauuuauaguggcucaugcauguaaucucagcauuugagaagcugaagcaggaggcuugccacaaguguaaggucaucuugggcuaccuggugagacacugucucaaaaaacccaaaccaaauagccaccaccaccaacaaaguccaaaacaaaaaaaguaauucugugaaugaaagcuauuuaguuuaccagaagccaaugcuguuuuauagcccauguuccuaacuacuuguuccuucucucugcuacuuguuauguucuggguaguguggcuuuuaaaugcuugcaguuuccacccacguccugugaaggcuuuacagacucucuccccuuugcuaggguguggagccaacacccgugcgcucacucagucaagaguuaacgcgguggggcagguaaagcgggagaagagcggauguugauggaguuugguuuaucugcuuaguaucagggucgugugacaguggucucaguguuaaagauacuuuucuauguugagcguggaguucaaggcuagccuggccgaguuauaggccccccagggcuacauagugagacccuaucucaaacaaacauacagauacucacauauaaaaaaauguuuuuaaauguuuaucuguuuuguguuuuaacagauuuaucagagguugcagcugcacauggccaugagguaaaccuugccccuguuugaaauugaguuucaucagcuucuacaugggauuauaaggacuuggaauauaucacagacccagcaggguuuccccccucauuuuuuuuuuuuaagauuuauuuuucuuccuaaagauaacaugcuuaaacaaaguucuuuaugguuaguaacugugaugcuugaaguugguuaucccuuacuccaguaaauuuuaaaugucaaagauaucuuguuaaauaaaaaaaaaacuaucaaaauuuuuuggguauuauguuuuagucauguccccauauuuguguuaugugcaaagcagugcaggaaucccaguagacaacucaaacugcccaugccugugauccacguuucccauuuggugguuucuauuucaguaguagagaacuucuuucacuaaauacacaugcauauuucauuaacagcuucagccagcuuguguuuacaucugcagugccuuaugucaggguaagaagaagu

SEQ ID NO: 3911 - RNA, 4454 nt, Mus musculus
uggaaauuauugacuuuuauuuccuguugcuaaggaaaagauaagugagccagaaauccuaucaagggucccccccauccccccgcuaggcuggccuccugcugaaggugggcuucccacggcaucucuguggcuugggcucuccaggauaaggaagggaaccugaggacaaaugagaaauugguccaggaaacucugaguauguuuccacagagacccugcucccauccaaucauuauuucuaaaaauguaaauuuggaaggcaaaggaguaauauguuuggaggggagaaaggugggugccagcugcugaguaacacucuccauugugugacacucuccguuguccugcucugaugacugaggguuuagguuuuauucagauuuucccuguagccagcucuaacgucucucucaucuguuguucugcaaagcaucgagaugguacuaugagaugcucaagggugcccguggagacguccucagguuucuguuuagaccaugaugcaugagcccauuaaccccugagugugagcacacagggcuucagagaaugcuccauaagugcaggauuucgggggacauguuucuugacccacguauaucccuugcccugacuggcccaggcagagccacugugguguggccccacgucaccaccuuccuccggcacugacugcccacagagcugccucuugucauuuuuauuuuccaucccuaugaugagugugcugacagccagggcaucaggucagcugcugacucugcauguucuugucugagcucuggcugauccugccugccggagggaucgauugcuucuccuuuuccagcaaaggauggaaucucucccucuggucugaguguguuagccaaaggcaaugcugaggugugggcuagcauugcccagagcgggcuccucaggagggcgugggccucccucagaggagcucuucaggaacuugauucccaggcuggagguagaagcuggacucggugucagcugggacagaugguuuagguccugggguuggugcagcuacagagaaaggccucaugucaaagacuggcaucgucugaguguggcagugcggagugucugcuuuuggaugggauauuggcuccacucccgcccuccacucugcacacacauuuugguuuccaaguaagcaguugaugaugaugucaggauacaaaggcucuguucuauuacucugcuuggucauccuuucugcgggcucagacccaggaaaagaugcaguccuggaguuugcccaucacuccacucacacugcuccccagccaggacccuuccauguggggaucaguugcucuucagugacugagauauuuuugguuucucuuugguaguuccuguacagugaggcugcuaaauucccuaguuggcucucuuaaacccuugagaugaaaccaaguaauucaggacaugucuaaaaugauauagaagccauucuugggaagaacagaucaauucaggggacaucugaccugugaugacccuuaaagcaaacccgaaucuacuugcaugugguccuaagagagauucggaagcccggcacauaggcuggguaggcugggcuucaugacuuaccggcccucuugggauuaaguaaggacucucgaaucucgggcaggcaggggcaaacaggaacugcaugaugucuauagagugcugaauguuauggcuuacuugaaaagaaauuauaaaugucaucauggcaagcuggagcucaauggcuaaaguagcacuguggccuaacugucccauucuuaaagaucgaggagcuggaagaacagugcagcgagauaaacagggagaaggagaagaacacacagcugaagaggaggaucgaggagcuggagucagagguccgagacaaggagauggugaguaaugaggucugagcagggccccgggugucccuggccuagcauggcgaccucugugaucucugcucaaagcaggacaggcgaccuaggacucuggcaacugccuggacuucagaauggagaaucagggcuugcaccacaguucagcuuucccagagccccacaggcugcuugcagccuucuuuuuacagcaucgagagugaacccaggguggugauggagcucaguagguagagugcuugccuaguauucauaaagccccaggguuugaucccugggacagugugaaucaccaugguggcccauaccuauaaucucagagcucguagaagcaggaggaucaggagaucaaaggccaucuucauuaaggccagccugggauacaggaggugcuaucugggaaaaagaaaagaaaagauuucccaaaagccccagccggucucacagaugaccggccugcagaagaugaguucugcugucaggcucaugcaacuagacuuucuguucucagucauuuauauucugggagacaggaagugaagcgcacagcacugagacaugggcaagucaacaaaaccuccccaggccucaguuuuuaccaugacaaagcagcaauuguaaaacuaugggccauuuuacagugcguacaaauuucauguggugacguaucauauauugcauucacccguagagucauacggugugucagaauagcaucccuccauuguuauucaagugagcaagacagguucccagagcagcacccacuagugcauacacaagucggcaauuuucaagaguaugcuuuaaaaucucucucucucucucucucuccccccaucccucuccccgcucucucugugugucuuaggaguugaaagaucuccgaaaacagagugaaaucauaccucagcucauguccgagugugaauaugucucugagaaguuagagguaagggugugcagugguccugagguccugaggccuggcccgaacuccuccauucccucucguguucacacauggucaaggguggguuucugcuuaugaacugcuaguaauggcagagcaccggggggugaaggggggugcugccucaccaacuuacacaaagguucugugcacagccagagugugggugauaguuucuuacucacaggaaaccccugcagaaccacagccagugaggaggggcacggagucgcccugguguccagacagggucagguauaagcccaccuuggccucuuccagcucuugcuagagugcugacuguagaucggccuuccucguuaccaucuauaaagcgagggguuuucuucuccuccuccaauggauuccucacuccaguccucuugaccuacacaagggacacuuuacugaauuucacaaccccgggacugcauugauaaccaguuucugggccuauguucaagaaaguccuaguucuagcaccacagaauaaagcuuuuucauggcauuaagaguccucucucacaaaggacaagaggucaucuagaaguuaggaaagcaagccaugcucacugucugucuguccuggcuuugguaggauauaaacgaaaggacggggccuccgauuucugguucucuuuuggaacuucugugaagcccccuugugcaggacucugcauucugcauuucuggggugcucagaccuucuaauccuucucuagggaaaguaccagguggcccccuuucugacuugaguggugagcguuugucaggguucagccguuuucaugaugguuccauccgucacugccuucuagauccuucucccuuuugucucaucaggcggccgaaagagacaaucaaaacuuggaagacaaagugcggucucuaaagacagacaucgaggagaguaaauaccgacagcgccaccugaagggggagcugaagagcuuccuugaggugcuggauggaaagaucgacgaccuccaugacuuccguagaggacucuccaaguuaggcacagauaacuagggcggggcggagcaagugugugugagaggugugguagacguaggacauucuccauuugcuucuguaaaugcaggugcgaucugucugucuccagaccaauugugccguccgcucacuccuccagaauaggaaaucucucgcuucucuggcuuugugaggucauggacagcuggaagcuucugacucaggaauccagaacuuggucuaccuuagccguuuacgcagucagggcagggauguuuagaucuucccuuaagggcuguuguaacccuaugaaccggggaugggggaguauuuucuaauccaaguaccauuauccuuuacagcaggcccucgggugccuucugcugcguggcauucaguguaugugacucuccagcagguucuagaccacgggcauguggagggagcaucuuuucccaguaugcauuuuguugcuuuagcagaugugacaugacauugucaaccacaaaguucacacucaaaaacugcacaacugacuuacucaaaaagaaauaauuguaaaaaaaaaaaaaaag

SEQ ID NO: 3912 - RNA, 9785 nt, Mus musculus
cucuuccgccacgcuggcgccugcgugguugggaugcugcugcuugcuguaggucggugugcuuggccucuguuagacuccugugugguuccacaaugccuaagaaagccggugcgacaagcaaggccaguggcaagccucguguuguggagagggugggccacggggcuacacuggcggggaacagacgcagcgccuggagggcggaagaccucccuucggguccaggucugagacuuccugggucgcacauuagcucgcccuaaggaugaguaggcuccacugcgcacccgcugaccaccgucuuugcucucucacucugaggguuacacuucccggcaggcugugcguucugccucccuaugguggcugaucgcuuccuucugucaaugagacugcacucccuccccuaauaucccuuuguuuucugucgcugugaucccagccccuugaagucagggaguuugaauccuuauuccucuucauacccgcuguccgcauacugcccuggaaguuguuuucuguuaaguuguuagauggcauuuaaauaccagucgucguucuuucugcaauggacuccucacccacucuugagcguuaggaugcauuggcuauaaagaugacuaauaaaugccccuucucuugagaaauagaaacgauaaaguagacugugggaacaaguccuaagcuagccaagagaucuuaaguagaacacauaccuacacagagacagccccaccccaccccccucucugucucuguauguuggaucaugaagggaugugggaggagcacggugguggcuaguuucugcauguaggcccaguuuagugaaggugaggguagugauggcucaaaauaacugaaguauuuuguuaccugugaaauugugugucauuuuaggguaaaaaccaaaccaaagaaccagagacagcaccuccugcugcagggccuguagcaacugacccuaaagguuuugucaccauagccauucaugccaaaccuggcuccagacagaacgcugugacagguacgucugagcacugggugggauuuggauguggauaaagcagcguuuucaucuuauuuuugccuuguuaucuaaaagcuuauccuguaacuguaaaugguauuuuuuaugucugcguuuagaagcuucuccaucuaaacauucuauagucucauauagagguauuugaaagaaaauguacaauauuuaauaccaaaucagauggaaucuguguaucuuuuccuuuuuaaaaaugugguauuuuguagaugggccuggucauauaugccaauaauucacaaguacuuaguuaggaacugaggcaggaggucagcuagacuacaacaagacccugucucuaaacaauaaaauguuuaggaaggacacauuaggaaaucuauguauagcuuagacuauucuuaguuauuccuguuccaaagaguuuauaaagacacuaaugagaagcgauucuuugguuuaguuuaaugaucauuaacguaaagaaugggagaacgccugaacucugagaacccugacugauuccugugugaaguuaaaguuugaucugcauuaucuuaggaguuuuucuucucuuuuucuuuaaagaauuuauuuauuuauuuauuuaaguacacugcaacugccuucaccagaagagggcaucagaucccauuacagaugguugugagccaccaugugguugcugggaauugaacucaggaccucuggaagagcagucagugcucuuaaccucagagccaucucuccagccccaagaaucuuuauuuucuuuuucuuuucuuuuuuuucuuuuuuuuuuuuuuaagauuuauuuauuuauuguauguaaguacacugcagcugucuucagacgcaccagaagagggcaucagaucucuguuacggaugguugugagccaccaugugguugcugggauuugaacuuuggaccuuuggaagagcagucgggugcucuuacccccugagccaucucaccagccccuauuuuuauuuucaagauaaagcuuuuggucaggcauuggugguacaggccuuuaaucccagcacccaggaggcagaggcaagcagaucugaguuugaggccaacugguauacagagugaguuccaaggcagcuaaagaaacuacacagagacccugucucaaaaacaacgauaaaacauuguauaccaauuuuuuauauauauauauuuugaaaauacuacaucaaaaccaaagugcuagguaggccugguuugugcucauguccgguugucuucaacuguugccagaauauggauaauuguagccuaugcugggcccagacuuaccuucugucucagccucucaagggcuaggauuacaggcuugugaccccagcccaaccuuuagccagcauuuccuaagucaaaacuaagauggaaucaacuauaagggacauaugcauuuaugugcauuauuuuuaauaauuagaacaauuaaacucuucuauccaacauggcuccauuucaaagaugcuaaaaugaaacccugcaucugagagguaacgggagagacuuuuacugaggugcucuuguggaauauauagauguguuguuauauaggugcauauauauauggacauggcugagugaccucagaucaagguuugggaucagcucaagcucauuugcaaacuacuuugaguaaauacuuagcucuccuaagagcugugaaggucauauuaccuaaugccaauugugucaccuguaaaauaggguaauaauggaacuaaguuacggugaagcccuuuagggaggcucauaugcucuuaaaaguagugaaauuacuacauaaaugcuaaacgcauugacuauugaaagcaucuaagauacagaucucaaaagagaggaaccuagccuaguggucagcuuuuccugaugugaaaccugcgacccuggagcugaagcuggccccccacucccuuccuaaagacucuucccauucaaagugggugccuaguugccuaaauccaagauacucucuaagacucuauaccuaucucaguaagguuuuguggguguguucuguaacuguagaugcgauuucucuuucucugaguauauguguagucauucaauucaguccuuguccgugugcaagagacugagccuagcucgacaguuaguugacauccugucccagguagauacacacugcuagaugguucuuugcuucgugagggaaggaagccccuuacggaugggguucaugccguuucuuccuagaucugagcacugaggccguugguguggccauugcagcaccuccguccgagggagaggcaaaugcggagcugugucgguaccucuccaaggucuuggaccucaggaagagugacgugguucuggauaaggugggucccuccuuaaauuauuguauguugaucauaguucuuauuuucuauaaaaggcuuucauuaaaaaaaguugggaggugguggcacacaucuuuaaucccagcacuugggaggcagaggcagguggauuucugaguucgaggccagccuggucuacagagugaguuccaggacagccagggcuacagagaaacccugucucagaagagaaaaaaaaaguuauaugugucagacuguuuugccuggguguauauauguaccacauguauaccugguguauauauguaccacauguauaccugguguauauauguaccacauguauaccugguguauauauguaucacauguauaccugguguccucagaggccagagaggaugucagauccucuaagacuacaguuacagauggugagccaccaugugggugcugggaaucaaaucuggguccuuuagaagagcagucagugcucucaaccacugauccaucuuauuugucuuguaaagccagguuuuaaaaacucauucauuuaaacgcaaaaauugugauuucagucuccucuguccauuuagagacugcccacuccuuauagaccuucauuaugcucacaguauguuucccauaaauucauaacucccuacugucagauuaauuuugcccacuuccuucaagacaucacuauacugaaagacucuaaaauguuugucuuccgcaauuaaggcguuccccagguaucucugaccucacagugcuacugcccacucggggugcugcucaugaagacaagcuagucugucagaaucuccagagaacgacuuuuaaacaagccccugggcaucucuguagacaugcugaaguggagucuguauguaagagagcaggccaaguuuauguguauaaagcucugauauauauucuagugcuggccccugcaguucauaucugggugacauuuaaagucuuugauuagucgggcagugguggcgcacgccuuuaaucccaguacuugggaggcagaggcagguggauuucugaguucgaggccagccuggucuacagagugaguuccuggauagccaaggcuauauguuguguccggccagcagaucacagccuggguucuagccuggaaaggcauuuuggaaaccuggaagagaagaagggcugggcugugcaagauaaggaaggaacuaagacaagcuuucuguucaagguucaauuuuaaugucagcaaacgcgcuuuauaaagaaaaggggaagcccgucccuggccaagcaaaguuccuuugaaguagauaggucagccuuuuagugggaacucaaagauggaaggucuguguuaacucccgaagauucuuggaagagaaccgguuuggccucuggcaguuugggccucuuguagguaguggcacaucaaaaaaaaaaaaaagagcagcacagcagguggcucagcucaagcagcagcugauggucacagcuagccuugcuaggcuggaaggaggcaacagcuauacagagaaaccuugucuugaaaacaaaaaaaaaaauaaaauaaaauaaaaaaauaaaaauaaaaauaaaauaaaauaaaauaaaaaaaauaaauaaaguccuugauuaauaaacuacaccugaauccaucugaccuguggcagagcaugucugaccuuggcaguguuccucacuuacauuagcaugaagcacaucucacucuucccuucuagguccaucuagauaaauuccugcucaaagucuguuuuauaaagaacguguuucaaauuaguccuuuucugagauguuuuaagagaucgugaaaucacaugugguugauuuuguuugaaauuuucagaaauguguaacaauuuauaaaagagcaauuuauuuauauuuagguguuaaaaaggcuuauacugggccaggugugguggugcacgccuuuaaucccagcacuugggaggcagaggcaggcagauuucugaguucgaggccagccuggucuacaaagugaguuccaggacagccagggcuauacagagaaacccugucucaaaaaaccaaacccccuucccccaaaagaaaaaagcuuauacugaguuuccauauuuuccuacauaauuuaaauaaauuacuugaaacuagaauauuggccaggcauaaugggaaguacguguaaucccagcacuugagggagacagacaacaucaggaguccaaguucauacuugacuauauauugaauuugagcuaaucugagcuacaugagacccugucuuaaagaaaaacaaaaagaccuagaaauuagggcuggugagauggcuggugagagcacccaacugcucuuccgaagguccggaguucaaaucccagcaaccacaugguggcucacaaccauccguaacaagaucugacucccucuucuggaguaucugaagacagcuacaguguacuuacauauaauaaauaaauaaaucuuaaaaaaaaauaccuagaaauuagcacauuguagacauucauguugaaauuuuuuuuguuuuguuuguuuuuuguuuuuuuuuuggggggggguuguuuguuuguuuguuucgagacaggguuucuguguauagcccugacuguccuggaacucacucuguagaccaggcuggccucgaacucagaaauccgccugccucugccucccaagugcugggauuaaaggcgugcgccaccaugacuggcuucauguugaaauuuuaaugccaaacuuuuguuauaaaacuugaaguagagaagcaaaagcgcuggagaguuguaggaacuugucguaagguggaagcugccauaagguggaagcaugcagagcccccaggaggacgcgcugcagcagggccagggaggacugucgcuccugccaguguuaggaugcugaaggugucguuuucuuucuggcucagggugguaaaucucgggaaaagguggugaagcucuuggccucuacaacuccagaggaggucuuggagaagcugaaaacagaagcugagaagaaauaaaggcgagaaaugguaugcacuuccuugugggguucucauaagaguagaggggccuccgaggaauguauacagcagugcccacauguggggaauagaacacauagauaagaucugacuaaaauacaaggagaaaagcuagucuguacauuaaauacaggcucuuagaucccuugcuaugggagcuggagagacggcucaguaguuaagaggacuugcuccucuuccaggggaccugggcucagcucccagcacugacacuggaggguuccagggugucccgacauucuucucuggccucugagguuacuugcagacuuguaguucauguauguacauugcacacacacacacacacacacacacacacacacacacacacacacacacacacacacaccccuuucaaaucccugagugcagacagccugaaauacauuccucucguuucacgggauuacaaggaaacagcugcugucugcgacggagcaucugagcugcaggcacugggagaggagcugaaggucgccgcguggaggcggacaggacaccagcucccuggacuccgagugaagcuuuagcuuuauagcuccacaauguuuuguggaguucuggggucuccuaauucaguuuacaacuggaaaaccuuuugugcugcuucuauucuaaguuuuugguuuuuaaaugcaaaaguguucucuuuauaucuuuuaaagauucucuggaacauuucguggaaaaguaaauaaucaugcagacguauaacuuaaugucaguuauuuuuggaaccuuguaaacuuucaaaucuagaaguucuuaggcaucuccaaagcucuuaaaagaauaaagauguaucaggagcaauggcuagcaguuucgagugcuacugcccuggagaggaccugaguucaguucccagcaacccaacauggaauggcucccaacugccuguaacuccaguuucaagggacccaaugccucugggcugagggcaccacacucauauauucauacacagacacacccgcagaaauaaagacagacacauacauaaugaaaaauaaaaaaauugauaaagaugccuugcagugguggcgcacaccuuuaaucccagcacuugggaggcagaggcaggcggauuucugaguucgaggccagccuggucuacagagugaguuccaggacagccagggcuacacagagaaacccugucuugaaaaaaaccaaaaaaaaaaaagucccuuucauuguaaagcccaucagaaaucaguugggaguguuuccugccaugcaugaagccuuggauccaccccagcguugugugaacugggugugggagugugggagugcacucuuacagucccagcacucuggagcugagggcagagaaguucaaggcaauccuuuacauaauagaguuucagaucagccugugacacgcuagauuguauagauaacaugcauauauugcucaguaacacauguauauguaucuauagcugaaaagauaauauaucuucuauauuuggccuaagcuguaauacuuuagauuguuguucguguuguuucugaagcgggagggaucucauuaugaggaacucacugugcagacuugugcuccuucuggucuggccucccaaggcuuggcuuacauacagacaugcacagugugcccagccaaguuacagcaauguaguaaauaacggaauuacucugaucuguagcaugugcuuugcugguaaguacauaagaaaaauguaucaaucacaaaauccacaagaaauaccgauuauaaaaaugcuugauguaaaagaaguagaaauuacuccucaggagccaagagcaagggcagucaggaggcccauccagagcucagugccucuccuuagagaccuggcugcccgcucuuguaagaugcucuucuaccucauugcuucugaguccuuguuucaugugguguggguuagagaacuuucccauucuuucccacaguucuacugggugucaaaaaggcacuucaccugaggccuuguguggcuuacuacaggauaauucucaugggacagacacacacuccaucuaugugucaaguggacguguuaacaugcuuacaaaaugaaguggggauuucugguugugucgugugauguauuucuggaaauugucuuaugagaggauguuuggcugaagcagacaugugagaggaugucuugcugagcagacgcgugcuguucuggaaguugccuggugaaagggcauguggugcuuugcuggagagaaugccugggaggcaugugguguuuggaaagaguauaacagaccaacagacaguaaaugacacucuugcguugguucgccuugcaacucuugguuggucuucauugugcuucgcugacacuggccuucaccguugacacucuugcauugcuucuccuuugcuuucuuccaugaccuucacuugucgugacuccauagagagaaacgcaccaaagaacuucugcugguauucuggcugcugcucgcggcuuccacagccucauaccaguuggcggagccuugcaguuucuucuagaucaagucacugcuacugauuugguguuuugccaguggacuagacugcugacaacgaagauuggaaucgcuccaaagaacuauuucugaacauguccacagccgcccuuuccuauuucuuguccccuuguagugggcuagaagggagguugaagcauuaaugaaccauaauuaaaguagguuuugaaaaaaucuaagccuacaacaaaaugcagagguguccucaagggacuggugagccgcucagccauguccuagaaagcccacuugcuuucuguagucacaccagcuuuauucucagguccacuucacggagacagagagcccuggcucuggguuucacauagaugcgauacccucuguuguagggggcagcucagaagagcuuugguguuuguuuuccauaaguuuagcuccuuucuaccccaggccagaucagaucacaugaaguuucuaagccacccucuuggcaagaaaugccaacucauaaauaaguagccagaaucaaugaauaugaaagagauuuauccuaaacauuguagccaauuaagguccuucccagagcuggagagaggaucagaguacucuguagcaaacuaguggagaaaaauggauaccagaauuaaaauuaucaagaauauaucaccaggcgugguggcgcacgccuuugaucccagcacuugggaggcagaggcagguggguuucugaguucgaggccagccuggucuacagaguguguuccaggacagccaggggaacacagagaaacccugucucga

SEQ ID NO: 3913 - RNA, 5211 nt, Mus musculus
agaguucugugcgccugcgcaagucaugggcggaagcggcaggcgcgucggccggcaccuaagagugccaccucgccccgagauggcacuguuuuccuuccuuugcaaccugccagccucagggugugauccauuggugagccaucuuugccagcagagggaaaauugucaccuauccuuaggguuggcaagagcagccagccucggugcucgccugcccaacgcggcaccauggcaauucgcacagggcagugcgcaaggagaggagauccacuguggaguugaauacaaccguucgugaaacugaagcagaggcaaaucaaugcaagugcuaaaguuagggacuggccuuguccaauaagguuagaauguauagaugguauaugcccagagguaggaagaucugcuaccuaaaugggagauggcuuguuaccauuuugaggaucuuugggaccugaauaaucugagauggggaaaagauuaacugaagaugcccgagucuacggcuagcaguuguggcaguccgagggggaguuuucaggguacauuaaguuugaaaugauuggagacauccaaguggaauaguuaaggagcuaccugaauacauaaccaaauuaucagugaccugugccagugagaggggaguuaaggaggaggacagagacugugacaaaugucaaagggcgacagcauucagauucacaaacaggugagacuggaaugugagugcugaaaacagccacuaaagguugggaucagaaugggaugucucauuuuacucucccagagacacccuuuccacaugacacguuaagugguguguugugagaaaguggcuaaagccuaagacucaggugauucagguguuaaaccacaccacaccuuuuuugaaauacauuacaaauagaggcacaaaguggagccaaaacuauacuguaguaauuugaugaauuuugaggugaaaucaugaugcccuaaaaauauuuacauuacgauucauaacaguagccaaauuaguuaggaaguagcaacaaaaguaauguuaccguugggagucaucacagcaugaggaacuguauuaaaagguugcagcauuaggaagguugagaaccacugcucuagagacuugacaguuuuuaucaggggaggaacacggauugguguauuucugauggugccuggaugggcaaaggagggggaagcaauguccucuaaggaaccgucagccuucuccacagguaccucuagaguaccucaucaccagcuagaaaggacaggaccccgccucaggucaaucugucacacagccacuugccccaauggaaagaacagggguuuguaauccaaauggcagaaacccaauguaaaauucuuaagacuugaucuuagauuugacaauggaguuaaggguuuguuuggcauguaggaaggauaaaugccgugguucucucucuggccuucugaaugugaggacaaaagcagagacagaaggcugaagaaggcagagcagaccaagagggcaguaagcgcuguugauagucuccauuacuguucuguaaacaucuuccuuuucaaagugugugucccuaaaacuucauguucaccuaaaauacauuugaaagugcaaauaguacaucuuaaauuguuggcuagauacuagaucaggaguguuuuuaaaaaauacuuuuuaaauuauuuaaauuauugauauccuauaguagguacagguuagugaaaauauauaauugcauaauucuauauaacauguuguuuuguuauugucauuauauaauuaugucuugauauauaauuguguaauacuauguuguuuuguuguuguuauuaagacugggucucucuguguaguccuggcucuucuggaauuuguucuguagaccgggcuggccucaaacucaaaagacccacccaucucugucucuccagugcugggacuaaaggugugcaccacaacugccuggcuguuuuggcaacucuaacaaagcauuuuuccugcucaauaguguggggcauaaaaauuacuuaaaucguauccaguaccguguaguaaccuuucuaauuauuaaauucuuuguuuggguaccuuaauaccaaugcacaaugaugcaguggcaagcaagaauuuuugcaaaagacuuagagcaaaggccagucagugcacaguaacuacucaggcugcaaugacuggcauuuugaaacuaggaaugaaauuccagcuaggugucuuagucaguggucuauugcugugaagagacaccaugaccaaggcaacucuuauaaaagaaacauuuaauugggguuugcuuacuguucagggguucaauccauuaucauggugggaagcaugaugaugugcaaaggccacaacuucuaauagugcuacccucccaugagccuacaggggcauuuucauucacaccacuacacugggcaacugcuauaccgcugaguuauccccugcccaacucucuaaauauuaguuaaaauuagaagugcauaaaagcuaaacuuuaauuagcuggaacuuuuguucuaaaguaguaucucaaguuuuagagaaaaagagaggugacaaauagguaaacaaaaaggauaaauuuauuuuaaaaauuccaggugaugucccaaugucagugagugguuccguaucuuguuccuuccaugacuacauucaguuacaguuguucaguaaagcacaaggcaugcgaaugccccaauggucagaaagcacuaacuuaccucuggcaugcaacacugguuaaggaaugguuacuacacagucuuuacuucucuucaguuaagcagaaucacacauuccaugggcauucccgcuaacugaggcuuagacccauaagaucauaguaccagagcagacugaaaacaguucccuuucuucaacaacuucaagagauccuggccaccaacacaucaccucccugccaucuugaaaauacaaaauauuacuuuugaugaaaacuuuuauauccuauuuagaaaaauucuuaaguugauacuuaaaagaauucuuauuuuuaauaauuucccacaacuaucugauagacugauagaccuuaagcuuaauuauacaaggguuuuuuuguaagauaaucauuuucaagggaaaauauuaucuuacuuguauuuuaaaaaucugcuuuauauaaaaauguagaaaugucacacugccaaauaucccuuugauccacucuuacuguagcauuuuuacuucuuggguggaacuauguagaugacacaaagccuucuuccucuucagcaggagugacuggcuggacauggacagcuuuaugguucagcgcagcuguuagggaucuugguauucuacccccuucuugcugugaagggcauugcagugcugcaguggccaucuguuggcaucugucacaucucagucaucuggaucacugcagcacccaugacuggcuuagugggaugggagugauaaagaauccaucucagauaaucccuucgaucuguuuauaucacauugugaauuuauacaaacuccacuuccagcuguaaaacagugcuaugugaugcacuucuauacuguuacagaauaccuucccuguaaaugcacugaaacuuuucuugaguguuuucuaggcauuauuccaaaagguaaugaccacauauuugaaaaccccaaauauaaagucaguuuucuuaauuuucugaaauuaguuauuugaguuaaaaagaauuuuguaggaauacucacccaucucaucuaacuuucaaaacaguuaaaacaaaaguuuuaaaaaucaaacacccacaucugcuauuaugacaagaaucucucaauucccaaacuacugaaagaucacgagucagcggaucuacgaaaucacacaagacgaagcagaaaagacggcaauuuacacacacauccaguucucuuugcuucgaaucaugcagagauuuaaauuaacuauuuuacuucuaagaaacuaaaauguuucuuaaucuguaauuauaaauacucaagacacucaaacuauuuguggccaguuguuuaugcuuuugagauuagacugaaugguuaacacuagauuauguauaaaauauuauuucugguauuuguccaucuucuauugaugugccauuguuauugccaggggaacugaaaaauaggaaaacagucuugcuugcagcaggggucucaugcacuacuuucuucaguccuuuugugccauagugagaaucugggcccuaaaugaaaauaaacaagucaguggcugucaguugagaagcaucccuguguucugaggugacuaauggucugcccuauucauuacagacucaguauaaaaucucaugcaggcaucuaacaaaauaugaggguuugcuuaaaaacaauuuuaauaacaauaugaaguucagccauuaacaacugugaaaaagguuuaagaaaaacaaacuguggaaguucuauuuucuuuaaacaaaggggaaggaaguucuugggaagaccuuuucucucagaauggacgaguccugggcugcacugagugcagcagagcaucuuagcucaggcuuccucuuccccuaagaggcucccaugcuagugacucuaaaacauggaagccaggagccuccugagugcauagcaggcacagccuguggggcugcgcggcucuuaccuugaguguugcgcacgcuguguaacagacauugggcaggaucucuauagguucuuugaacaugacccugaauguguuagcagucccaucacaacuaaauccaguaucauucugucccaagguuuguuuuuucucauauucaaugaucugugauuuuuaaaagagaaguuacauuuaaguuaaauuguaacagucuugugggaaagaauaugaagcuuuuagaaauuguaacauaaacguuucucuacuuaucuuuaauuaucaaagauuuuuaaagcauaagaugaccagaaaauggcucuguaacucacacaucacaagaacaggaaagacaucgaacaacgaacgggcuuggcuacagaaggauuccauaaagaaaagcagaguuugguguacgaacuuuagaauguggccuugcgauguuagagggaagaaucugcccuccuuguuuagcccaugucuuuucccuacaauaaucucaacacuuucagcuucaguauuuacugaaauuaaaauguccuuaaaugca

SEQ ID NO: 3914 - RNA, 1193 nt, Mus musculus
ggcuguuuauaaccucaaaccuuacucccaguacacauuccaauaaauuuauucuguaaaaacaauacauuuuuuuguuuuugauuuuuuuuuuuuacaguaaacuucucagcuacaaaccucaaacacacacaaaagaucuuccaaggacaagcauagcaggguugaugagacccaaacugacuaaugaguucucacaguauaagcuggcauaaaaauaaauaagacucuaucaccacaagagcgacaguaaugcacacguaacaaugguuggcggaugaacguuaacuacucuaauucuaguucuaaaagaaaagucuauuuuaaacucuguacucaagagucaaugcuuuguuucccacagugcuccugcugagcucagcuuucaguguaaagugaccaucuugagggauuggcucaaauuguauuggcuuugggaaaaaaaauaaguccuugcuuuauuuugguaugacacaaaaagacucaguaaguucacauauaaacuuaguuuguggacacaggaacaugaguuuugagaaguauuaaguuucaacuagcuauuucuaauacagaauagguauuguacauaugguuaaacuuuacacauggccuuaaaacugaaagaugacucuaacuucaucuccaauacaccaacaguauguaucuaggaguugguucuuggguucugcuacaaagaaaaucccauccugaaguauuauguugagcagucaccuaacaauaugaauuacuguuuagcugaguaucugaugauggugggagagaggcaggaagcugaugacuuggaaaaggagccuagacacagagaagucugcaaaaucuucaucauucuuagugauuaagggcaacuucaugcaaccaaauaacauaaaauaaagucaaccuuaaaaggguuaaaaugucucuuuuuccuucaacagaacagagaggaaugugacuaaugcacacacauacuggggcucugucaaugacaacaaagaccguugguucauaucaaauccaaauccaagaauuagacaaucaaacaguuaaccuucuuguggugucucucaauaugcagcauucauuacgguaguuaggucuguaaaaaaaaaagcaaauaaaacaagccuuagaugagcuaggacacuaccgagggaagcucaucaccaucacccugugggcacuggguucuu

SEQ ID NO: 3915 - RNA, 2360 nt, Mus musculus
ugcgccaacagcgguuggacaggggcucugggguguaagagaaacggggcgccgcucacgggucaccucgcugcgaccgggcacaggcugcgaggaacugcaguucggccucccgggacgcacacacggcgccgacgacgagcagguggcccucguagggcggccccgcgcccgucgcccgcgcgaccgcuuaccucagccauccugcagccgcugcggagccggccuucccggcgcgcguccccugcccgggccgcuccgcguccgccccggcucggcgaccgccgcauccacgcucuggccgucugggccacccccgcccccccugcgcaggagaagugggcggcuccccgcggcgccgggugaccgcgccggcccuugcgccccucgugcacccucgcguccgccccgcgccccgggguccgccccuccgcucgccccgccccgcgccccuacuccggccgccgggggcugcgggcgacgcucgaggggguguggggaggccacgcagagucgccucgguugaggccaggccgcggccccccgcgcacagcggagaccucggcggccgcgggcgcggaggugucugcccccggcgggcuugaaggcacuuguugagaaggagacagacgugucgguguuugccucuccccggcgagggcgaaacgcucucugaaguucccuggcucugcucucucgggcugaugcagccucccucgccucccccggaggcgccucgggucccgguguggaccaggcagaaggcugcacugcccccgcccccaccgggaacuuuuuauuuccacagauguggggacuugggucgggucguggaggcuugauugggaacucaaacaccccggucucuugugugcucuguguuaaagucccgguguuaccgcuugccugggacaggugacuucgcucucagaguuggaaagcgggauuagacuuaacuagguucuaaggagacacggagaugaagugauaaaucaaacaagaguuucguccccugggagccgauggggaggggcucgccaggagaaccugcuuuccggggccugaggacaaagaaaaagaauccuucggcccuaagaacaggggaagauuguccacagcuggugugaaacagaaccagguuuuacuauauagcucuugggcagggcgggaccugagaccugaagagaggccaaaguguuuggcuuuuugggucuguccuuuuuagaaguaagagagccuagacuuggaguggcagguccuguuucuuuuuuuuuuuuuuuuuuuucuuuuuuuuucccccaauuuguugcaccugcuucgcugcuggugggcguccuugaaaagggaacacaguccugcacaaaucagagaugccgggacaaagaaagaguugcaaacagaagacaggaugccaguuaccccacgugcugacaacaggcuucagaggggggaaaggugagaacaggacacaugacagaaaaaaaagugugggcaucugugcugcacgggguccggaaacuggacaccuggauuucccccaggugccuguucugggucuaccuggugguacuuuuccuugcaggcaugaaguugccuagccauugcgauaacauugaccuggagaugcgcauuaauauugccacauggcaaacuucauuaugaagccuuguuuuauuaaugaccaagcuaaacugguugguuaccuucuguuugcucuuucccaaacagcuacaguccaccacaccacccaacguuuuaggccuuucuucugguccuuucuuuuguggcuauuguuucaagguguucucuucagagaggauugugucccuggcucagaagccuucccugacccaccaggccuccacuccacauauuucugcacccuucacuuguuucugccucccuccaugcuuacugcauuuugaagccuagagguguuuccuuguccuaauuucuuggccauugcacaucuuaguggauucugugcaaugaguugcuguagcugacaggacacuugcuuaggaguuagagugaccugggcuuguucucaacaaguggaaacugcuggaggaagcuagccaauucggucucccuuuucugaucuguaaaaguggaccugaaaccaccucuaaauucaggcuggcaagcuaaauaaaauaaucucucuuacuacauguagagcuuauuuuuauuaacuaaauuaauuaacuaacucuuguagaaguuuagaacauuuauauuuccuuguuauacaugcaccaaaaugucuaaaucccaguaaaugguccauuuaaauauucuaaauguuuuucaaaguuuguguucauugcaaaugauuuaguaaagccuuccaccaguga

SEQ ID NO: 3916 - RNA, 336 nt, Mus musculus
agccacauccuccuuccugcccgucacaacaaagacaggcuccuccccgcgaacuggggucuugauguaaguguuggucuucgcccucaaagcuuugauuuuacaaccuggaagccaggguucaagggagggaguaggagaaauagagaaagagacacgcccauuaucccaggauaaccgcggagacccgggacagcccgcgcccaaggcagcugggcagcagaacacgcgaccagagaaagggggcgucucccucgcugaccccgaaccgcgcuaggagcuggaccgccgguucuguccucgaaacgcucgaggaauaaauagcccauuggcugc

SEQ ID NO: 3917 - RNA, 3432 nt, Mus musculus
auaagacuugaaaauaaauaaaaauaucucaugccaaagugagugggaccccaagucuauacaauucaaggaacuucuacauaguaaguauaggcauuagguagggacagagcuggagggaagaaaagcugaauggagacuauguacuugggugccuugcagaacaccuuuuucucgugugugcauguguacaugugcauauguauacauauguguacauguacacauacaagccagguugccuuccucaaacuaucuuauuuaguucugaaacaagcucucacugaaucuggggcucaagggaggauuccacuucaccagcagccccucgaaccccagggauuucacugucucugccucuucggcacuggaacuacgucccaccaugcuuggccucuuauauggaugcuggggauucggauucagguccucccuuguacagcaagcacuuugcugauugagcccucuuccuggccccuggccuggccugccuuccagagugaagagggccacugauaggaauuugggagacauauuuuaguacaucuaggcuucucauggcuaacuauggaccaguaacugcaggagugacaguccuccaacuggagauaggaagggugucacauuuauauucucuaagcacaacuagcuuccucuuuuacuucuacagucugaaaucuaucauuccacagcaacagagcaccagcuagcaaauaccucucccacuaaugacuacucuugcuuuaccuauguaugcagaauacuggaucucaacagggcugguuuugugacacacacacacacacacacacacacacacacacacacaccuuugacauuuucuuagcacacuuugguucugauauaauggguagcuguacuugugucuuauauagagucuugaaauacugcuaucagcccucaguauucaugacagucccaagacaaagaaggccucagucaguggguguucccugcugucccuucccugcuuuguggcuuuguuucaacauggaggggccuccaggcugagcuauggggauuuuagagugacccacuaccccauacagcugaagcuguaucaagacccugguggugaaggccaaagcgcaagcacacacacacacacacacacacacacacacacacccacacacacacacgccugaggaggucagaagaggguagcagauccucuggagcuggaauuacuggcaguuaugaguuguccaaugugagugauggggacugaacuuggauucucuggaagagcaucaagcucucuuaauuacugugguaucucuccagucccuaagauauuuaauuuuuaauuaaauuuguuauugagggguuggggauuuagcucagugguagagcacuugccuagcaagugcaaggcccuggguucgguccucagcucuggaaaaaaaauguuauugaucuagauuuggugaugcaugucuuaaaucuagaccuuaauguaugugugugugcauguguguguauguguguguguguguguguguguaugugugugauggucagauggcaacuuugugggguucuuaggaccagacucagguugccaggcuuugguggcaugaccuuucacacugagccauuucccugccccucccccaugcucucccacucaccucuuuccugugacugcccagguauuauggcauugagacuucacagugccauuuccaguaagacacaaauagaucacuaacaguaucccaagacucaaccuggauuuucuacuguaagcgauacucuucucuguugucugucacauuccccguagcuggggacaaaauaaauagaaacuuugaaacuucuggguauaucuugaagucuuuuucuuauuugcauuucaugcguuccccuuagucuaucaaacuuuguucuuggggaaacugacaauaugugucaggaaccucagucaucaacugaugcagaaauuuuaucgugcaggucucauauuuucaagaaauagggacaaauuuacccuuucuaaggaguuuugaacguguuaaccaugaugcaaugacugguaguagauauuuugaaaacgccaccagcuuaagguaauuuaggaaaagaugggaauguugcugcuuacacucacuuaucccucuugcccguccccccccgccccccaagagagaaagaguaucacuauauagcucaggcuggccucaaauucacuguccuaucuuagccucccaaguccugacaagccuuuguuggcacgccugguauguacucuuucucuuucugagggucuuuuccaggaugggcugaugacuaaguugauaaaguucuugccucuaaaguguaaaggcuucaauucaaccuuuagaacucacuuaaaagugcugcguaggcaugguagggcacuuggaguccugugacuggagaucuggggacaaguggguucuugggguuuacuggccauccagccuggcuuaugcuacaaguuccaggccaaggacuugucucagagaagguggauaguauucuugaguaugacacuugagguugucaucuggcuucuacaugcauggacacacguggacuuguguguacaugugcauguacuuguguggaucgaaaaugaaagaggauccuucuuaggaaauacgggccuucuaaugugaauucugccccuguuuuaucuucuucuguucugaccuugccugccagcuuuuaaaaauccugaauccuuuuacucccccaggaaggccaaacugcuuucuaaauauuggagaauguagaaaaguuaggccucucuucauuagcccaguagacguuaaugguuucugccauuuauuaugcaucucacuucagcacaggcucuguagguaggcaugagccuacuaaguuuggggaaggaagcuaauguagagagaguuaaguuguguggcuuaucauagacaucaaaacugggaccccaaucaugggucccucuaauccaaagcucccuucuuuagcagcucaaaaaaauggcuuuaacaaacaucauuuucagaaaaagugaguccucauuuguaaugaaacagucaaauguuguuuccaucugagugauagugcuaauugacuugaaguaucaggaacccaguugguguaauucguccacgucacacaagaagaucccuaaacucuaaaagcaccuuguccacaggggcuucccaugcccugacauuuaucuccaauuuuugugaucaagugaaaaacuaacauuuagcugcuucugugauauauucuuuaaagauuaaaaaaaaaaaacaggcauuaaaaaagagugaaaugaauugagaacuuccuuuuauuuuauucuuucuuucuuuuuuuuuuuuaugcuccuuaaagaugcuaccuggacuaauucagacagaaaauaaaagcugacaagcuggugacuga

SEQ ID NO: 3918 - RNA, 3432 nt, Mus musculus
ucagucaccagcuugucagcuuuuauuuucugucugaauuaguccagguagcaucuuuaaggagcauaaaaaaaaaaaagaaagaaagaauaaaauaaaaggaaguucucaauucauuucacucuuuuuuaaugccuguuuuuuuuuuuuaaucuuuaaagaauauaucacagaagcagcuaaauguuaguuuuucacuugaucacaaaaauuggagauaaaugucagggcaugggaagccccuguggacaaggugcuuuuagaguuuagggaucuucuugugugacguggacgaauuacaccaacuggguuccugauacuucaagucaauuagcacuaucacucagauggaaacaacauuugacuguuucauuacaaaugaggacucacuuuuucugaaaaugauguuuguuaaagccauuuuuuugagcugcuaaagaagggagcuuuggauuagagggacccaugauuggggucccaguuuugaugucuaugauaagccacacaacuuaacucucucuacauuagcuuccuuccccaaacuuaguaggcucaugccuaccuacagagccugugcugaagugagaugcauaauaaauggcagaaaccauuaacgucuacugggcuaaugaagagaggccuaacuuuucuacauucuccaauauuuagaaagcaguuuggccuuccugggggaguaaaaggauucaggauuuuuaaaagcuggcaggcaaggucagaacagaagaagauaaaacaggggcagaauucacauuagaaggcccguauuuccuaagaaggauccucuuucauuuucgauccacacaaguacaugcacauguacacacaaguccacguguguccaugcauguagaagccagaugacaaccucaagugucauacucaagaauacuauccaccuucucugagacaaguccuuggccuggaacuuguagcauaagccaggcuggauggccaguaaaccccaagaacccacuuguccccagaucuccagucacaggacuccaagugcccuaccaugccuacgcagcacuuuuaagugaguucuaaagguugaauugaagccuuuacacuuuagaggcaagaacuuuaucaacuuagucaucagcccauccuggaaaagacccucagaaagagaaagaguacauaccaggcgugccaacaaaggcuugucaggacuugggaggcuaagauaggacagugaauuugaggccagccugagcuauauagugauacucuuucucucuuggggggcggggggggacgggcaagagggauaagugaguguaagcagcaacauucccaucuuuuccuaaauuaccuuaagcugguggcguuuucaaaauaucuacuaccagucauugcaucaugguuaacacguucaaaacuccuuagaaaggguaaauuugucccuauuucuugaaaauaugagaccugcacgauaaaauuucugcaucaguugaugacugagguuccugacacauauugucaguuuccccaagaacaaaguuugauagacuaaggggaacgcaugaaaugcaaauaagaaaaagacuucaagauauacccagaaguuucaaaguuucuauuuauuuuguccccagcuacggggaaugugacagacaacagagaagaguaucgcuuacaguagaaaauccagguugagucuugggauacuguuagugaucuauuugugucuuacuggaaauggcacugugaagucucaaugccauaauaccugggcagucacaggaaagaggugagugggagagcaugggggaggggcagggaaauggcucagugugaaaggucaugccaccaaagccuggcaaccugagucugguccuaagaaccccacaaaguugccaucugaccaucacacacauacacacacacacacacacacacauacacacacaugcacacacacauacauuaaggucuagauuuaagacaugcaucaccaaaucuagaucaauaacauuuuuuuuccagagcugaggaccgaacccagggccuugcacuugcuaggcaagugcucuaccacugagcuaaauccccaaccccucaauaacaaauuuaauuaaaaauuaaauaucuuagggacuggagagauaccacaguaauuaagagagcuugaugcucuuccagagaauccaaguucaguccccaucacucacauuggacaacucauaacugccaguaauuccagcuccagaggaucugcuacccucuucugaccuccucaggcgugugugugugugggugugugugugugugugugugugugugugugugugcuugcgcuuuggccuucaccaccagggucuugauacagcuucagcuguaugggguagugggucacucuaaaauccccauagcucagccuggaggccccuccauguugaaacaaagccacaaagcagggaagggacagcagggaacacccacugacugaggccuucuuugucuugggacugucaugaauacugagggcugauagcaguauuucaagacucuauauaagacacaaguacagcuacccauuauaucagaaccaaagugugcuaagaaaaugucaaaggugugugugugugugugugugugugugugugugugugugucacaaaaccagcccuguugagauccaguauucugcauacauagguaaagcaagaguagucauuagugggagagguauuugcuagcuggugcucuguugcuguggaaugauagauuucagacuguagaaguaaaagaggaagcuaguugugcuuagagaauauaaaugugacacccuuccuaucuccaguuggaggacugucacuccugcaguuacugguccauaguuagccaugagaagccuagauguacuaaaauaugucucccaaauuccuaucaguggcccucuucacucuggaaggcaggccaggccaggggccaggaagagggcucaaucagcaaagugcuugcuguacaagggaggaccugaauccgaauccccagcauccauauaagaggccaagcauggugggacguaguuccagugccgaagaggcagagacagugaaaucccugggguucgaggggcugcuggugaaguggaauccucccuugagccccagauucagugagagcuuguuucagaacuaaauaagauaguuugaggaaggcaaccuggcuuguauguguacauguacacauauguauacauaugcacauguacacaugcacacacgagaaaaagguguucugcaaggcacccaaguacauagucuccauucagcuuuucuucccuccagcucugucccuaccuaaugccuauacuuacuauguagaaguuccuugaauuguauagacuuggggucccacucacuuuggcaugagauauuuuuauuuauuuucaagucuuau

SEQ ID NO: 3919 - RNA, 21168 nt, Mus musculus
uccaguuuugcuuguugguaccccaguuaggugucaucccuuggagccagcacccacucuguucacuauuucugcuccugagcucuucagcacuguaacuugaauuuaggagaaaaaaucccaacagaguauaaugcucagguuuggcuuuguuucugcccaccagagacuccagcauccccaggaaaacacccgcugcugaagaggcaggcacggauggacuauagcuuugauaucacugcugaagacccuuggguuagaauuuccgacugcaucaaaaacuuauuuagccccaucaugagugagaaccauagccauacaccacuacagcccaacaccagccuuggugaagaggaugggacacagggcuguccagaggggggccugucaaaaauggacgcugccaauggugcucccagaguuuacaagucagcagauggcagcacugugaagaaggggccuccaguagccccaaagccagcuugguuucggcagagcuugaaaggucugaggaaucgugccccagaccccagaagacccccggaaguagccucagccauucagccuacaccaguuucuagggacccaccagggccacagccucaggccucuuccuccaucaggcagagaaucagcuccuuugaaaacuuuggcuccucacaauugccagacagaggaguccagagacugagccugcagcccagcucuggggagaccaccaaauuuccaggaaagcaagauggaggacgauuuucuggucuccugggucaaggggcuacaguaacagcuaagcacagacagacagagguagagucuauguccacaaccuucccuaacuccucagaggucagggacccagguuugccugagucuccucccccaggucagcgacccagcacaaaagcuuugucuccagacccucucuugagacuguugacuacacaauccgaggauacucaaggaccaggucucaagaugccaagucagcgggcacggagcuucccccugaccaggacccaguccugcgagacaaagcuguuggaugaaaaggccaguaagcuuuacuccaucagcagccagcuaucaucugcugucaugaaaucccugcugugccuuccaucuucagucucuuguggccagaucaccugcauccccaaggagagggugucuccaaagucaccuugcaacaacagcucagcugcagaggguuuuggugaagccauggccucugacacaggguucucucucaagugagugucugugcccugcuugaucuccacugcccccauuuuucuauuuuauauagcauuuaaacauuucucagacgcacugguuaaaaagaucauuucaucucaugugugugugugcaugcagaucugugugcauguguguauguacacaugugcacuggaguucugucuuccauguuaagaaguaguuuacauaauagccgaccuuggcugggaugagaagugggggauauguucaggcucuugguaaucugcucacaaagauacaggaggcgaaugaaaaguccaccuucaucuuaaggagcucugggugaggccagggaaugcuccccaguaagaaucugucuugaucuucacaugggccuaggaccugggcagugaguaggacauuuagucuuguuucagcucagccucuaacucuaggagcagaguccuggcuuguacagcugccucccucuuuagguaaagucaggagguaggugagaccagcuucauuuuugugagggcuaguaggggguccaaggucuucugcugcagggcugggucuggguuuucccucuugaaucagcugugauuuauuuauuguuugugcugcugagaguggauaugucauaacagaguucccaaauagcauguagcuaacagagccccuggcaggauagaguugauaaaaaaucuugcaacagagaaacccugucuugaaaaaaaaaaaaccaaaagccaaaccaaaccaaaccaaaccaaaccaaaccaaaccaagcaaaccagaaaaacaaaauacccccaaagaaucuuguuuuucacaccguguuaucucugcuugugaaagccuuucagagcugagagaauauucagaaggucucacagagcccggggaaaccgaggacaggaaccacuguucuucucaggccggccagucgguuaucuccuugcugagugcagaagaacuggaaaaacucauugaggaagugagaguucuagaugaagcaacauugaagguagguuuccugcaugcacaucuguagggacaagggcuguuguuugucaucuuagcugacccagaggggaaguagcuaaagaaguuuacgguuuguagcuuaagguuuguuaugguguuggcuggcaucaggacagguuuuguccugucagugguagagggacaccaugucacuugacauagcaaguguuaacaccugauuuuagcugggaugggaaguguuugugugugugugugugugucugucugucugucugucugugucugugugugucugugucuguguuuuggagggacauggccaggccccuuguccuggcauccuuugccauuuuauggcugagaaggaagauccauggucacagagccagggugcucugacucuaaggucaugccaagugcuaugccaacaucccaugggcugcuaaccuggcaugaguguccagagagagaacccacaugguguagcacugccaguggugaacagcauagacgcuuugguuauuuccucugcccaccucaaggugagcucaggagggucugugugccucagccacaucaucccgaaagguccacuucccauguagucgcugagcucagccaaugguguguaucgaggaaauggcccaaccagagcuggagccagcagucaggagguggccuugugaaucucacucucuggaaaccucuuaggcucuguacccuguaccugaacugggauaaugaaaacugggaagcaaggaguccauuuuuacuggaagaauuacagcugcccuuccaaggucaaaggugugguaguaaagucugaugaacccaugguaccuuggggcugugguuucucaacccagggucucacuaaucacuuguagccugcaugagccauugauccccagagccugagucaauaaaaauaauaugcuggaaggaaaacuucaaguucagagcugccuaucuaaagggucaguaagaagacuuuguuucuaguauggcaaccacucacaggagaaauaaacacacacagacacacacagacacacacagacacacacagacacacacacaccccaacuccaaauaaccugauauaagugggucaguguggguugaugggaccuucacccucuggucccuccucugaccugggaucuccacauuaagagauggaagaagaccugcaagucagggacucugguagcucacagccaaugaacugcuuugccauguuuuuauuuccuagugccauauacaaacuaguggcccaagagcuaugggccugaaaauaaaauuuacuggaucuuuuaaaguguuugguuguccuaaguccugcuauuucugaguguuuuguuuaaagggaaugagccaguaguggcaggauugccuuccucugagguagccaauccuaguaugcagauguguuuggccugcccucuuugugccuuucacucaugccuguccaccuugcccacguaugugaccuccaucgcuguugugggcacuggggcuccaggauucagcuugagaguagaaugggagccucugccuuuggagagugugagaaaguuguccuggauccugacugggaguuucuguuugugccuguuucacauuuguacugcaugugugacagagcgagaugccaacugggcccuuuacugcugcuaugccauggaagaaggagcagccagcaccugugaaacagcgcugaccucugagagguugacccaaagccuagcaccggcccuugucucagaaugccaugggaaaguggcaucuuccagccugcagggcucucuagcugacuuugcaaugugcaguccagucuaugggaagugggugugagugggugaguaggagcagaagagagcgggcuugcuguuuuacauacauuuguuuacccucguaagcuuccuguaauuccugcgcgaugaaacugaagucugaggaggugguaguacuggcccagcugguguuuaauaaaacaaaccagugugguguuaaagcauguguuaaacuguucacguugcugcaguacuguguuugugaauguauguauuuucauccacagcaauuagacagcauucaugucaccaucuuacacaaggaagaaggugcuggucuuggauucagcuuggcaggaggggcagaucuagaaaacaaggugaucacggugaguggcccagggaugggcacauuggagccaguguggguugcugggggucagaagacuugccugaaagaggucuugugcaggggaacaccaggccacugggcaggggucaggacaggagguguaaaggaaagucauugugaccauccuucucaagaggcacaguaugggcuccucucugaucugcauuuaacccucggcauuauaugccuuuaacaaagaaggucucugugcacccagagcagccucaguucaccaacauaaacaggaaaugcacgugaaguaucaaaaaucauuguguguaugugcacauaugcacaugugugugcacacacauguucuacauuauaacaucuuaacagcaaguuugcacagcuuaaagcccucaucucuguaauuuugaacaucugaauuuuguauguagaggauauauuaaaaauggagaucagaaucagggagauaucucaguaaauaaagcacuugcuuugcaagcaugggaaguucaguuuggugccuagaauucacguucaagcaaagcuguacaugggagugcaucuguaaccccagagcuggggaagcaaagacaggcagauucccagggcuugauggucagucagccuagccuacuuggcaagugcuaggcuagugagaggccaugucuuaaacaaagggaaugguggaugccuaagcugugacagcugagguuguccucuauggcucccacauguaugugcacauauaugcugcugugagcacacauaugugucuauacaccugggugaauuggggacagcuuugguacaauaucacauaauuuccucuggaaauuaagaccauggcagucacaaggauuuagauagguccaguuuauggucacagggcacauuuagaaaccucuagucuuggaauguagacuuccccacacuauguaaagaggaacccaugaaagggaacuuauugaaaggaggaggcuauucuccuuuuaccuacuugaagaaugagaauguucaaguggacaacugauaacugggaauguucaaauguucaacugacuuguugguuagcugagcucgguaggauccagccaaggaauagaagacauuucugugcaaugugcaggcuacacauaccacagugcucacccagucuacagagccuaugccuaguccccuguuuuucaggcccuagagucugggagaguacagggaggugagcagaccucuauucuaagcauauuucucuagacuccuagucauaucuggccuagucgaucugaccagaaugggcuacugucauuagcccacagcuucuggucaccaguggcugacucacaugguuucuggccccccugaguucaugauucaggcuauucguguggcguggaucugggaaucaaacucaggccucaagugugguggcaaagcacuguuccucacugagcugucuuucugacuguaagaugguuuuuaauccuguucaucaugcagaaaggagaaagggaccagcuagagaauaagggugucuaggcagccuaggauaguguaccucaaguacuuccaguagaaaauggggcaugaacaucucuccggaagggauuaacucuccugaaaugcaauugggagucaccauguuauuacauugcuuacucagagaaccaagauguaaacuggcauuguaggauugcuagcaucucuaaacaaugaacauuuuuggagcuuuucuuuaaaauuugagugccaccaaauuucuuugaucuuagaaaccuauucucauaaauaucccucaauaaguccuagagucaguuuucccaggaaaccauucucagaaaugugcucuaguguagguaaggcagaagauguuccugggaguggcugggguuauaggagaggucaaggguauugugugggaagagugcagaguacucacuggccaucacuguugguggucucugcccugacuagagaaggaaagggagggaugcuggcccuguccaguugcucugcccugagauguauucagucuguguugucuuuggccuaaccuccucuggggguuaguuggauaccugucucagaggccucugccagcccucccagcacaaauagggaucugaauugggugguuuguggcuccugacuccuugaucuucuucagguucacagaguguuuccaaaugggcuggcuucccaggaaggcacaauucagaaaggcaacgagguucuuuccaucaauggcaaaucucucaagggcgcuacccacaaugaugcccuagcuauccuucgccaagcucgggacccaaggcaagcugugauugucaccaggaggacaacuguggaggccacucaugaccugaacuccucuacugacuccgcagccucagcuucagcagccagugacauuucuguagaaucuaguaagcguucccagugcaguggggacugguguggggagaugcgccuuuugagguacauucugucuuuggccauuuagauccaugcuuggcagcacugugugguaaugugugguucacauaucacagcuuccuagcaugcuuggugcacuguagagaugaguguguuucugcaugagugugugcucgugucuguggugugugugugucuguguguaugucugugguguguguguguguguguguguguguguguguguguguguguguaguuaagcagccagcaucagccugggcagcugagccugagagaagaacacaccacugaccuagcccacgugcuuuccucugcagaggaggccacugucugcacagugacacuggagaagaccucugcagggcugggcuucagccuggagggaggaaagggcucccugcauggugacaagccucuuaccauaaacaggauuuucaaagguaggcuccuuuuuuuucuuuuucuuucuucuguacauucucuccacuugcgacuaugcagcaaacaccucccaaaccgagaaccuuuuuggccaugguggguucccacacucucuuuagucacguguugauuccuguguguucaguucugcuuuugugaccuugugccccuuuucagcccugcccuaacuucucuuuuuauuggguucucucccgugaccgaacucugggcuugguucugcuuggcaggaccaagguuaggaagaggcaaguaaggaaggcccucacuugagcugagaggcaccaaaagaugcacugagagagaucaauacuguucccaugcaauguacuuaaacaugauacagcugugacaggacugaggcaaagacaagacaaccaggaguucgaggucacccuuggaagucaauaaacaguuagccuggguuauaugagugagucugucuggaaccaaccaaaugauccaggaugcacugaguaaagccagaggcuggcguuugucugauagccuggcuagauuuacccuagcucuggauucauccauucuuguguuuauuuuccauuugaugucuuaucuaucauggauggggcugcccaauaaugacaugugagucagcuggauauggauuuuccugagaaaauuaugaaugccuuauagcuaccaugcaaauauaucugcaacacuuugccacuucuuagcuggaagccuuaggcaagggaacagggaugugcacaaaggcacagcugaaggaccuggguucucauguuaaguuugcaaugcagaguggcaagucacuaaugugggcccaugcacaacacacgggaaugagucuccagccauaggcaggcauggugccaugggauguggaugccagagacugcaggacagaguucaaacugagauccuacgacuagucauuuucaagcucuaaguaagggucucugucuuugguuuccaugcugugaaaagggaaucuauuauuguguauccccaaggaaugcugccauggguacagaacaccagcacaacacccacugcauugcucaauagcccgaacuauuuuucauuaauauucuauacuguuauucacuauugguuaaggccagggugucgaaaaugguguguguguauuggggggcguguuagggaguucccuucaauauaaacaguaaaggaagauuuugugauuucuguaugcaucugugacagagugggcaccaugcagggcuaugagugcaugcaggguuaggucuuuccgagaggauacagaguucuucccaggcuguuucaagccaaaagccgugugaagauugcuucacaaaugucucagcagcgcacaccucuucccaccuguugccgaugaugucacuagaagcagguugucaacgugaaucagggagucaauagagagguucagggaggacacagaacaccagagguucucuaggaauuauggaagucucuaaccaggcucuggcuuggccugccauuuccucacuuaaaaauggcauagauucucuugucuacuuuaguuuucuaugccccagagagauguuccugguggccacuguguguuaccauccugugaaaugcuucacuuuagaaucccucacacgcucccaaagaugggugugcuauccacuugugaacuucccugguuccccagaaagugccuuuuauuguaccuguuacccauaaagcccaagaugaccugucaucuucuucuuuauagggacagaacagggugagauggugcagccaggggaugagaucuugcagcucgcuggcacugcugugcaaggucuuacccgguuugaagccuggaaugucaucaaggcauugccugauggaccugucacuauagucaucagaaggaccagccuccagugcaagcagacaacagcuucugcagacucauaggcaggcggccaaugcuaagacaaagcaggagcuggaagcuccaguaaucgcugauucucagggucucugcugcccaccucacccaggcuggggaaagcccaggugugccucugguagcugcugcucagguuuggaccuccuggcacacugcccaucaagagggcuguuccaaaugucaggacagagucacgcagagguggcuguuacgaaccacgucaacuguauauagacagcuuagugauaauacccuggugccguaauaaaaugguuguauugcaguuucccaagaaacaaaugaccugauuuggaaauccccuagggacuaugaaagccaccccauggcagugcuuuuuuuuuuuuucucucaugcaucucaugucuuggaggggagcuccuuacuaucagcucgagcaggucaaggcugggcugggguccugugaagggucacugcuuguggcucuccccagaggggcuggcugaugacuggggaaguuucuucacggcuggugcuucugcaccaugccgauugauucugcaccacacugcccagccacacuacagucaggugcgggugcaucuuuuaaauguucugccuuugaagacucauaacauugcuccugucacacuccugccgagagcaggcaaacaccugccuggguuuaaggaaaggggauaaguuguuagaaacagcucugugagaugcagccugccaugaagaacacauucaaacacauagaagacuuuuugguugggucgagagccuagaaggaguggaaccagaagacagaggguaugagcauaaaauaaaauuauuguuaaugucuuaucugucacgugucaggaacccugcuugguauuagaugauaguuauuggugaucacagccacuucaccaauggcgguccugcaccaauguauuggaggguacugagccucagaacaauaaacagcuugucaggcuaagauguggaagggcagagguuuagucauuccuucagugacaugagcaggcccaggagauugaaaacauggcacaucagggaauaaaaacaaacaaacaaacaacugcuuagcaugucugcagcaugugcauggccaguauauuugcuuugguuauuucugaacagcggauagccaagcucagggcaacucacugucacucucaauuauccgcagcagauauagcuuucaccaggucugggccagggguucagauccucaaucauuccaugaaauagagaugacaugggaaggccuggcaagggucacagauaaaacaccagagcccauuuauuuuagggccuugacaauggaagcuugcuacuauauauaacuugcugguuucuccauaauuggaagccagaaauauuugcuggaaguggacucagagaccccagcuggauccucucuucaggaaaagcccuucagugacucuucguggcuagcucggccucacuuacucugaaaaaugacagcauguuacuggagcugacaugcuugcuucuccaguccacucugaguucuguccuauagcagacaaguaaaugaggaacucaagauaccauuuauaucaaucuaucagguuuaauagaagguacauuugaucuaacaggagaagguauggggccggggggaacagcugucaguaaguaaaaugcuugccaugcaagcauggucaccugaacuucaucuccagagacaagaagaaaacauaaauaaaaccaaccaagcaaccaaccaaccaaaaagaaaagaaaagaaaagaagagaaaagaaaaggaggaaaaaaagaaaagaaccagaugcgguggcauucaaaguguaauuccagaccuggggaagcagaaagauacuggucccuggaauuguuggucauccaaucuagccuauuuggugagucaaaggccaaugagaaagcuggucucaaaaaucccaagguggaucacauccuaaauaaugguauagcaagugaguaagcuuaauauggagacaaaaccagagagagagagagagagagagagagagagagagagagagaaccacagaaagagaucagcauccaaaccccaggcaacagggcagcagcaagaaaaccugacagaucuauagagauugcgggaaauucugaacaagccccgucaaaaugaagcuguguccuaaugagcccuuugacuaaauccaagcugcuccaacaacagugagaagaacaaagguagagagaguaggggaauuauuaaaauuauuaaaagcuacuagaggggagcagcuggacugugaggguacugugucucugaagacagugucagucagcagagaucuuuccuuucuccaucugauggaaagcaaggaucuaaauuuauuuggaaagcuaaagagaaacccuuugucccuaaaggaauggcagaccuuguggucagugucagauacaauaggcgugcauacuugcacagcauagcagacauucuucccuccuuccuaauggcagcaaagccugaggggccaggaguccccagcauucuugccucaccaugaugacugagggcacagugagguacaugccauggggcucaccuccccagagucuagcaugcacacaggaacugcuggcccugccuagagucacucauaggggccacaagaauucacacuccuucccaaagauacaaacuggccugaggcaguuacaagccgguuucauggggaugugaaccuuaacccacaaagggagaaacagauagaaagagaugauucugauggaagagaucacaaacgguagauugaaaguauuuuuccuuaaggcuuauccugugguuuaaaacaucauuuuccaaguugacacuuuuguaaagagugaaagucuugugcuaaaaauuuguauacaaaagcauauccagaaagggaacacaggagucugggaacuccagaugccagaggaagcaggacuuagcgaccacaauggaugaugauucuuuaagacccacacagggacaaggugucuuacagcaaccagcacacagggcucuggaccacaaggaaucaaagaguacgugagccaucucucagguggccauagagggacuugcccuggccugccaggccuaugugugcaccacggcaagcuagugguuagcuccuuccacaccaagcccaagaggacggagggugguguggggggaugggcugcuccucuggaauggaacccugagauuugcuguuaacuauggcaucucaaaaggccucagcagcucuuccguguccuuugaggcucaacagcuggaguuccugaaggaccauaggcaaucccugccaauaggcgacugucagugauggaacuuccucacugccuucugaagguugggguagaacucagccaugcuucgagggaagaaggaguccaccacacucugagggagguagccacucaggucugucugaaagaaugugaccagguugguuuuguugggaucccugaagaaauagcagaugcggguuagauauguaccauggaagcaucuagcucagagccaugaccagcagaagugguccagacaugguggucacuucuacuccugcucuagauucagugcccaggacuccucucagccuccuuguuguggaugauagcauagccucuaggggacacacggcacaguugcuacaaacacauuggggagcugguaggacagcuaggugcagauucuccuuauggcuacugacagcccauccccccaaccccuccugggcuuuguguauaaggagcuguuuaucaguuuaccccugugcagagaaagacagccagaaggaggaggggaggggagggggagggagagagggaaauacagagggagagggaacaaauccuccgucagauuccauguucucucucccuccccaccucccacugauucugggguacuuucucugcccauacgccacccccacccucaccccaagcucaagcuaucccucauagucacucagcuguguucucuuuggaaacuugaacagauaaguaagaaaucugaguuagugacuauguuucucucuggggagcccugggcuugaugggagaacaucacagaagagacaaaccacguggggaaagacacacagaguaaguaaaaguggauaaaaggggccucagaggcaccacggcugucuuuacaggaaagccaggaguuugccugacauacucaucagaauacaugcggaacuuacauacauacaguaggcagaacacagagaaugcucccugcauacaguaggcacaucacaaaugcagcucuggugcugccuccuccacagacucuccugcccucugagaugcuuuuccucugucacagauagucugagcccagacaccucagaucugaucugaacacagucuugcuccccaguguggccucuugcccugacucacagcuccuucuacucugggcacaaagcaguuuacacugaagucauggcauggcugcucagaccucucuaaagcucccaaaaugucuagaggggccuggcccugcuuccucaaugauuucuucuagccucucuucuggcuccacugagccaacacaguggcuuccucccaugccaguccucuuguggccacacccucucaccaagaggaaccuugcaccugcacaggccacugugccaaucgaggcuccaaccagggggauuuuggugaucugugcggugacucacuccgaccagaccccagguccuuucaucauccuuuaguuuucuauacagcacuuagcuuguaguaagcaaugucuaguguauguauaacauaauuucuuuaauuugugccuuguuuaucuucucccaccccaucagaauuaagcacucagagaacacaugucuuuuaucuguuuuuuaaaaaagagaaaaacaaagauagucaacauaaaaaccaccuggccggguuuaaguguggcuuuuuacuuguugggucuauucauggucuugggguagcuacuuaaccucucuggcccacccaucccucuuauagagcuuguaccaucaccacuguuacauagccugaagcuugcagacuguguguuccccaagccagcccuaagccucagcuucaaggagaaacggcucuuacuugucuagacccuccuugaaauaugcccggcagccuggaagggcaaggcaggucucagcaucugacuguugggaacauggcaaugaaaaguggucaaggguaguuuuauaggcccacaucagagggucuggucuccucugcacugggaauaaaguugugugugcgcgcacgcguccaugcuuuaccacugucaaacucaaaaaauuugugacauuuaagaaaagccuucccagagcuguuuggagagccagauuagcagacaugguguuaggugggggugcucugucuggguuuuaguaaucuaggcacugagaccugccuccuggaacuguguggggaaggccacaccuuccccuccggcuaugugcagggacccaugagcaggugcaaucucucucacuguuaacuugggugcugcucauuauaaaccuggggccuuaggguaacucauuacccagagagcucucaggaaaacccuggccguaucugugagugauuuagggcucuugggcuucuuuccagggccgauucacagcauggucucagaacuauccuccaugcccugagaucugccgccuuucuuguacaggaagguggucgcugcgugaacauaggguggggaauuuguucuuggagcuacuuuagucugguggauaucuucagagaguccagaagaccuggagcucaggcaguacacugcgcuccuggacuuugacuguggacgcauaacuuaacuguccuaacccucagcuugcuuauuugccuaauggcacugggacauuugccugaccuguccugugaggcugggcaccuggugguugcacaugccuuuaaccccagcaccuguaggcagaucucugaguucaacaacaacaaaagcuaaauccagguaacaccuccuuaccccucugccaggugccaccaagaguggcacaucaugucaugcaagccuaugugugacagugcauuuuguaacauugauauuauuuuuguagauuacaguugaagugccuguuuucugaguucacagugguguuaugguugggucuaagacaaaauucuccacccacuuuccuuacccuggcagugguucacagaagcacccgcauggaugguuaaauccucucacaaaaccgggcuuugggggacacaauggauguuccacauggguagcuggaagacagacaugaagucaguggacucaccugcagacagcagggucuccaccgccagcacugaagauccugcgccugcacaggccaagugccugaagcccagcuucccagucaacuuccuuccuuacauuuacacucacuccaguucacacccgugcauccucaccccaaucccccacacccccacacacaugcucagauacacgcacacacaugcacucacuaccacacacaguuuucuccaacccuuuaagaauuugggaagaaagaacauuccagaauauaagaagaaagacuccucgcucagauuucagcccaaagaaaggaggcugugucccucaccuuccccaggggcagauacagaggaaugacuggacucugcuccccagaaggcaggaaccccagaaagcaaccauaugguuagaugcucccaugacuugacaaacugacuuacaaagagauuagcugcuaucugcauguccacagcacaagcugagaucagcagagauaaaaacagcacugacaaaaaucugggacacacaugauaaagcccugguauguggucuccccauuuuaaacccuauggcacaaaaucucaacucgacaagggaagaggaugggacacaagagcuuguuggugguuuccaaucaccaagcuuuccuugaagaucuagggcugcguaagacugagcccggcaucuaggccagccagugaacaccuacugccacuuaccauuggagcugauggugccauccucauacuucuucaccagcaccaaguccacaaagucccugggagaaauaagcuucauggcagcugagggcguggagguucugcucacacacagcaucugucaaaacaaaggaggcucagguccacugacgacaaguccaccucauacccagcaucugggaaacgaagugcgugggcaacauggggagcugcaagcaggacggaaggaagccucggggcacuugggcucuuuccagcggcugcauugaggccaaaaugauuucaucgcuuuccaaacaauuucaucuccauguuucuuuauaaaauaacucaccugagaacagugucccuacaaaaugggccuccucccccacccaucuaguaccauccuagcuugcagugcccaggguacaagaucucuuggggugcuacagaucuucaggaauuauaacugcaauauuugaccauggugccccauacugggcucagcucaaugucaguuucccuuucuuaggcacaguccaagaaacaaguccauuucugaauuccuguaucucgcucgcagcaggcacaguggaaguaauggccaucuucuacaaccauaaccaucuucugguuccaucuggagccugaaggaaaagucuaauuuuaagaauauugaagacagaagcacuuguuagagacgugagcuuacuccggguucaugucucauccacacauccuuuccuuuacccaucuucuauuaagaauuaggaugcucgagggcuguccaaaucacgcucacagacacugucuggaagggucuuugcccccuuaccuucaauguuucauuuaguagacaggacccagacuuguuacuggagucucugcuuuucaggauguguaaguccccuggcagucugugcuuucucucccucugugccuaguguccacugaagagugugucucucuggcaacaagccaaaucucuucaugggcacaugaauuaaugagaaccaagaguucccacauaucucaugcagagauaaaaaaaaaauucuuuucuuuuuguguuuaaucauucuucauccaaauuucuaauguuaccucaauaaauuacacucauaccucaaucuaguacuuaaaaaaaaaaaggccugugaucaaaagaaguacaugauuagaacaguauuuuuaacuuauaagaauaucucuaauaaaauuuggugauguccaaaaaaaccaaugggggcaaaaauggacuggaaggccaggccuaauggggcaagcuuguacuugcaaggcagaagcaggaggaucagccuggucuauaauauugaguuccaggccaugcagggcuacauaaagagacccugucuuaaauuaaaaaaaaaaaaaaucagugggcuauauaaagcaaagugcaagaaaaauaauuacauacugauuaagaaaaacguacuuccuguugguggcuugcuuuguuuauugaaucaaaacacagcccuggccagccugguguucauggucuggcugacuccaacucccagauccucauaucuccauggcugcugggauuacagguacgcagcaauggggaacuuuuguuuaaguacuagacugagguaucagaguaauuuauuaagguaacaugauuacuuuccuucuggcuucuuugucucugugcacuuggcagcuucucuuucccucugucagacuguuucuucccccagguuucaggauagggagcuuguggccaggaacagaacaccugguaacugccuugaaagcacugacagguuagccauuguuauggcugcucaggugucagccuguggauuuccuagcuuuucauucugucccaccagccacugugcugacaccaagaggggugagugugcuagagagguggagccacuuuaguuuccaaaagaugaccugcagggcucugggggcagcuuaguggguagugcuugcugugccagggugagaagcagaacuuagguucccuagaacccacacacaagcugguugggaguguuaguucagcuguaaucccagaagggagucagaggcaggggauugcuggaguaagcuggcuagaccuguaagcuccagacucaucaagagacuuugccuuuaauccccacacucaggaggcagaggcaggcggauuucuguguucgaggccagccuggucuacaaagugaguuccaggacagccugggcuauacagagaaauccugccuugaaaaaacaaacaaacaaacaaaaacaaaaacaaaaacaaaaacaaaagguauuaaccaagggcugcucaacuucaccauuuaugcguaaugauuuguauacacucuuugcauuguuuauuuuuuucuuuucugaugcugguuucacuuaauccagaauaagaaaauccuaucaauuuauugugguuucucaaauguuuccacuuagaccagcuggcuuuuauaaaggaaguuauuuaacuguaaauggggaaaaaaaugaaagaaagaagaaagaacaacuugucauaaauuaaagguaacuucaaauuacacgcggaauugcuagagucagauucccagcccagggcgccgauucaucucuuacggggaaagcaacagcuaaauaguauccaaggcacauuagugccugagguucacucuccucuucuugguaccagagggcugaaagaagaguugaaacacggcaucaucgucaccguguguuucaguucugucucugacauaaacuccuauggauaacagacugacugaaaugaggauucugggucggagcaaagacaccuggcuccacagcuugcaaaacacugcaagguuucacaaugcaaccugcuuauguaagcaccagacaugauagcgccagacagagccuagaagccaacacuaagaugccauucaaaccacauaggucugcucacccagaguuacuugcacaucuguuuccacugugauuuucuauucuucugaguuuucuauagucaaaaaugaagcaacgaucuuacaguuguaggugaugccaggacagguccaucaagaucggagcugucucccauaacacuuccuaccucacguggcuauuugaauuuacauuuauauuuguuaaaaugaauaauucauuucuucaaaccagccaccuuuucaugcucuauggccccauggaauugaggcugccacacuagacaaggcaguuggcagagcaacguugcuguaucccaaggcuuucugcuggguagggcuggucugcaggaugaacgcuuuccugaaggagacuuguaguggucccgcugugggcaaaggaccaaaguggcucuguuaagagacaaugcuucaaacuagaucuguugguguaaauccaggccugccucuuugucuggggaggccaagccuugcccugcaauuccucagcuauagucuguagauucugcugaggguuucuuagucucucagagacacauuguuuccugccagggacaaggcuggacucgucugcauggcacuccucuugccuacagauguuauagaucccucuucagagagguggggucgggguguugcagcaagacaagacacuacagauaacacagccagagacacuuacauccgugaugcucuggacaauuucaaagcugcucacauuaucaucccacuucucccggaggcccgaagcaacuggcuuuaugcaaucccacaccucuucuggugucccacacagaaucccuucuccucgguaccuagaauggagaggaauuugauccaccgagucaauuaaacuuguuuaucuuaggauuuuaucucaggucuauuacauuuuuguucugguucuaggacuugcugacagaaaacggccuaaaauaugcuagcccaucuccccucuagccugcauaaacaaacagguacaaaguccucacagaacacagcuugcuagaaacgauucaaaacacaagcuaaugcuuuucuggaagguaacuagugaucacagaaggcuggggcggauugguaucuuucaugaugcaaccccagagacaccaggacgggaguaagguucugacagacuuuguuaaaagugcgcacuuacagauucccuggaaacuccucagauggccuccaggaaauugaaacuccauucugucaaaaggcauaggauuguagaauuuuagagcuagaggaagucuuggagaggagaucucaagacuugauuccccaaggucacccaaccuguuccuggcacaguugggguaacugcccccuacugcaggcgaugagcagagcgauccuggcuggcugauuccuggagcugugggagucucuccagucgccuuaaugccaccaagaacuuuuuguuuucucaagcaauuuaaggcuuuuuuuuuuuuuuuuuuuuuuuuaaaucagaagcgccaaggaaggaaacuauuucccugucacucccugggagagggauugugcaacaaugaacggaggaaagacuugguacuuggaguuucagauccaauccuaaccuccuagcagucagaugaccuugaguggguuucgaaaugaaaggggcagagaccuccaggagucccagagagcaucaacccgcaguggaaucaguuucucaacccaccucugggguccagggugcggauaaucucggggagaggagaagccuaggaguuuggaggacuccaaacccugcgagcagucuccagaccccuuuucccgcccagucccucacucacgccuucccgacacuucuuccagcccgacgcgucccgccgguaccggagcaccuucucugccaccgccucacucucuugcguggcccaggacggguccauuccgccaacgugcaggcucccagcugugccacacagguucugcugggaggaaagcugggccuugggcggagccuggagcc

SEQ ID NO: 3920 - RNA, 1990 nt, Mus musculus
acuucuuuuuuuuuuuagauucacuaaauuuauuuuaaaaaucauaaaacguuucuuacaaaagagcauuacauucugcacacugcucugaacaaaugccagggacaugugaacuauuacuuuccucccugucccaccccccaauguuacagugaccacaaaguaagguguucacaauaauuacauggggggaauuuuuuuuuaaaaccaccaacaaugaacaaaaaauaaaaaucacucacucugcugcuguuucaaaauuucaauguuaguuuuugcaugcccuccccccaacccuguuuguaaggaacuaaaacauuacaucuggugaacagcaaagauuucacuacaccucaaaugcagaacaccuaugaagcagaggaauguuggcuuuuuaaacagaagcagauaaaaaaaaaaagaugcaggacuccuucaguucuucacuagucuuagaaaaacuuuccagaauacugcuucacacuauaaaaaagaaaaaauaucuugcauuagaauccuucaacaucugcauacugcuucacacuguucugcagcaaauacugugcguucuguaucugguccuguguuccuguaaugguaaugaucugaucuucagacccuucuaaagguucaucaauuuugauugaugcuccagauucaugacgaauuuguuuaauccgcugaccaccuuugccaauaauagauccagccaaaucuuugggaauaguuacuuguguagugauaauagguccgccaagaucaccauaugagccacggcccccugcauaagaauagucauauccagaaccacccugugguucauaagccauuugccauucugaugggcuccauguaucaauugcagaaucccaaguuucaucagcacugaacccaaccaugccaucauagcggucuccaggccuuccucuucugucauaagccauuagaucucccccucuggguggugguggaggaggaagaggcagauuccgggcucugcugccaccccggccaccucgaccaggagguggugguggagguccucgacgagggcucauauuaucauaaucucuucuagaaggaggcaugagacgcccaccccgaccaggaggcauucugucaaaaccaccucuuccccucauggggaaucccacaggucguccucggcggucaucaaacaucauucuuaaaaccaccauaaucauaggucucaucauaaaaguugggaucguaagguugugcacguccuuugaugggagacucagauauaaggucaaggaugaucuugaugcauucuacaacccuauuagguuuuccuccaauaagaacaacucugacaguagagugagggcagcacuccuggaaaagcuugauuguugucugaguguuuucucgaaguucuuugauuuuagcaccuuuaacaccaauuauuccuccugccagacucugaugaaucaacagucucaacucgcaaucaaagucacuuccuuuauaauguugguaauuuaagcauuccacagcaucagauucgagcgggagcuggcugguugcagugggugauggcaacugcaggcccucuuccaagguagggaugauuuucuucagaauuucuccaaucgucucaauaucagcacugauacucaguaugcgcucggggccacugcugucugggacugaaacacuggcauuguagucuguacggagagccuuaauauucuugccuccuuuuccaaucacugcuccagcauucuugcucugaagcaaaaugcgcaauucaaccaucucaucaguauuucuagaucuuuuaaaggcuugcuccucuuccauaucuucugcagggcguuuaccaaauucaccauugguuucgguguuggggaagguuucuucuggcuguucggucuccauuuucuugaauuaaauggauccaccaaucgcgcgaguccgccguugccucccggccgcgccgccuccgacggucggucacugcuga

SEQ ID NO: 3921 - RNA, 3561 nt, Mus musculus
uccacuuucuguagaucagacuuaguauauuugaagagcuucacaucaauacaacguggagauuaaaauagaaaaggauacccggcccuuggaaugaacaagguaccuauggccucucuagaaaaccacccuucaguuagacagaaaacaaaucaugaaauucccacucacauguggucauggacacagaggagggcaaaucaguuucagccagcaccguuccucuuuggcgguuaacauagccaauaugacuccaacuaggaauuaugaggauuggaaauaggcaaaagguuaugugcuuaaguuguucuccugugaucugaucggccuugccuaucaacuauauauucuacgugauaaucaucuuuguguucccagcacccacuuucaguauccucaauguauagucaacaucaugagucucuacugaguagcccugaacuccauuaucaguauccuuacaacugccaguagcucuaauuaauguccucugcauggaguuugccaacauguguacacauacacauguacacacacaaauguuuuuuaauaguuaauuaguaagguagaaauugcaguuguuucuacagaccauuugaacuacacugggauuuuuauuguuuuuauuuuauauauuuaugucuauggguauuuugccugcauauaugucuguacaccgugugcuugccugauguccuugcaggccagaagaggacaucauuucuucuggaacaugagucauaaauagcugugaguuuguggcaaggugugugugugguguguguguguguguguguguguguguguguguguguguguguguguauguguguguguguguugggguguaguuucagcuaguccagacuauacugagacuggccuugaacuucugaucguccugucccagccucccaaguacuaguuuaaaagucauguaccacuucauagcuuuaacuaccuauuuugaaaaucaguccuacuuguguuuaacacggcaugagaagaaacugccaggaagccguuuaggaaaaucuguuuaccaaaauucuacccaaaggaagaugcuggcauacuugccagucaaucuuaguuacaaaagucuccucccucgcccucuucuguggauuuuauuuguuuguuuuuauuuuuugacauagggucucaugcagcgaaagauaguaaccuugaacuccuggccuuccugucuccaucucccaagugcuaggauuacaaguauuugccacauuuggcuguuugccaguugauuuuaaaagaaucugaugaucacccaaagagaaaaggugaaaggaaagggcauaggucaccaaaacugcucuggguuuccuccaguagcucuccgagguuugucauaagucuagaccuccugaaagcuguuugacaggagagagccaagguaacugaugaaugacgauuuugcuugcucaguauuugcuuaaguacgguucaaaauuuaggcaggcuacaguucagugauaaagccuuuguuuagcaugcaaaagguaaugggaucaccuacccacacacagacacacgaaauuaacgaauuaacgguuaauaaccugggcuauuuacaacaauuucugaagugauuugugcuuggauaacaaacaccucaucuucaacaguuugggaaguuggacgcaucccaaauauauuucccuuccucuaaaacaggauuaacuacgucuccucuguccuuucuuuagcugaaacuggauacaugugugcuacacauuuagaauauuacaauagggucaguuaguagacucagcagacaaagcuuagcaagccugaacaccccaguucaaugcccuggucucauauaaagguggaaggauucaucauaguugucuucuuaguuucacauauccuuugugacauguguacacacacacacaccaaacacauacauuugaacacauaaaaaauaaaucuuauaaauccaacuguaagucauaguuuaaaacuguggggacuggguuuguuuuucaauuaugauaaaauucauauuuaacaucuaagucuucccuaaagacccaaaauguaguaauugcaagauuuuaagacauacaaaguugcagagucuggauuggaggccugaagcuacacagaacacuucuuagaggacagagcaaagcaucgaggcacuugcugugucagagcacuccacguuaaggcaagaaugucaaggaaaaccgacgugaaccuaacauucagggagguagacgggguuacucugguggaguccaucacaaggucuuccgcuucauggaguucacuguaaauauuugcuuuaguuuuuacaacgggaaaacagaggcacaaauguuuggaggacagacacagugaguaauaccuaccuccucccaagagugcucuaaggacccaaggacacauuaugagugaaaguggucuguaaacuaaagacugaaauaaggauagcaaaugccucaguuaccacaguucagaaaaaagccaggacucagucaaugcuaccucacguuaccacagaagugucccuggguaaacgugaauagggccuccuggauaaggugccaaagagcaguucuuacaaggcaggggguagggccaggguaugacugagauccuggguacccucucaguaauaugucaugugaguagcagcuucugguccccacacccacucaugccaccaucccaagaagagugagucuuuuaaaaggcaacucuagcucuuaagguugaucacccuaucuucuggguguaucacauacugcaguacagauuuccugcagugcauguuggaaucggucuguacauacauugcuugugaguauguguuagaagcucaguagccagggcuagaggcaaagcucagcaguuaagagcacuuauugaucucucaggagacccagguuugcuucccagaauccacguggugacucacaaauauccauaacuccaguuccaggggauccaacgcccucuucugaccuucugaggcacuaggcaugcacauaguacacagauaugcaaaacucauacccauaaauuaaaaaaaaauuauacaaaauaguaaauaaacucagaagugaaguguucuuucuugguuggucaaagagcucacagguugacuuuuucuuuugaauucaccuugcacaagagauaauauguaagaacauaaagucaguuugcugguuuauguuguauuguuucaguuucuuuccaaagcauaaagggaagagaacucuguacuuuagauaaacaugcacacauguacacagagagaaaggggagggagagauagaaagaaagagugcgugagagagagagcucaauucucaaguuaaagagauggcucccagaguacuacuacacaauuuugaugauguaauucucaaaccugucuucugaucuccacaugcaaacuguggcaugugcacgguugcauccacacacacaucagauacacaugaagcacaacacacaucagauacacacacacacacccucaaagaucaaucuaagaguuccucgggccugaggacauaccuc

SEQ ID NO: 3922 - RNA, 4471 nt, Mus musculus
agaaagagcaguuucaaauuuaauguggagacuagcuaguuaaugucaugcaaggagauagggcaagucuuuuugccuuuuggcuugcaguuuuaaaauuaguucuucaaggauuaguucuucuggcucuuaauuccuuucaguuuacucugugauaucugcagacuaaaggaaccauaggaaauuuagacuuuaucauuuguguaaacccaacgaauagaaauaauuuccauguguacauaggacuucuuuuggcagcccucuugccaaucuaccugcagcugaucuagacuaaacuuuacaaaagaacuggggggggggggguaggagcauacccaaggucacuucauuuuacuuuauaacucuugcaagaucuaauuagagaaaacaacugcuccuuugaccauuucucacuuaauuccuaaugcauauuugcugugcugagacaccaacugucuaugcuggccucagacuuauggcaagacuucgacuucagucucugaaguguugaaaugagaggugugagcaacagccagguuugcucugaccauugaaaauaaaauguauacacacuauuacuuuaaguuuuuuuuuuuagaaagugugggaaaaauugauuuuauaaguuaaauuucauuuugcugcuaacauuuuauggugacaacuuuucagaucugugggcacuggaaagguuuaagcacaauaaaacccccugaaaaaguaaaugauacacugaaagccuacaggaguuuuuugcgcauguggcucauccagguuucaaggcuauagauaaguuugucacucuauuuaguaagaaacuauucaacagugucuucaacaagccauaaacucccccuuaaaaaguccaucccaaauuuauuuaucuacagaaaagccaaacuaccucgacaugauuucaaucaacaaaauacucuuucaauacccaaccagccacuugaaucaaggucauaaaaacaagcccuccacugacaagcaugcucuagaaaguucuaaguccagaggauagacucuuuuaucaaacugccuagaaccuucuauaaagucauagagauuucuggguuaggccuagccucacugaagaugcuaaaggaucaguugauacagugcuguuaagucccaugcaaaauucugugagcuggcaaggcagcaccccacacaguauuaggaaguacuuuaaucugaaaaugacaggccgaauacaaaucagauuucaguaagccugaaccuauggcucauuauaauagagaaaugaguggaggacaaagagagcuagguuacuuuccagaaaaacuagagggaagaagacaaaauccccacuaacaguccuccccacuaacaguccuccccacuaacaguccuccccacuaacaguccucccccacgcacugcauaguccaaucacauucgauugccuuuaaaaauagaucacauacauuugucuuucuagggugcaaggaugcucagaggaauaauaccagagggaaaauggaauuuuagaguggaaaugguuaggcacuggggauucacuugccaauggauguaaaccuuuuuccccccacagcuccuucccacagauggcaggcggcaugcacaguuagugaaaagacaguaacugcgaaaagccaucugagaaacauaacaauuuaauagaugaaauaaauacuccaguacaugcaggguaaaaacuugacauuggggggggggggaaaucacucuauaguguaauuuaaaaaauaaaacacacgcucacaguagcuuucccccccacuugcaaaucauauggcaaagucauacucuuuuucacaccauguauacucuaauucaacaaaaauaacgacauacaaaaagguagcuacauccaugucuaaaggagggaaaacugagguaaccuuucauuaauuaaaaagaaggaagaaaugagcccaugaccucuuuccugcccaauugauaacugaguugaggggcucgaguguguaggguuaacccugcagccagcagacuacccaucuucucugugucugagucccuauagugggcugguggacacccaggcccucugaguacuugaugauugcauggcccugccuucuggaaaauuccucuugagcauuuaacaugagggaggggaucaccuauggauucuuugguauaaauggagaggggagggguuaagugucuuccuuuagccugggguggaaaacagguauaggggcugggguggggguggagcguggggagugcuaauucacagaauuggaauucacuggcgguaaaguccugggugaagaccuuucccuuaaagccugagauagcagggugcagccuucagacacggcgcaggccgaguuccucagccucucccugugguccgacaucuuggcgcucccaucugggugcugcgccagaucccugaggcacugggucaagagcacgcaggccgacaccacacucauggcaccucccaggauggcggucugcaccgccuugcccucagugcucacggcagcugcgcgacccaggaauugaggcucgguggcaaagcccaccaaagcgcucaccgccugcaccaagggcccacugaagagcgcgcaacgacugcgggccagcucgcugggugccgccuucacuucgcguacgcaugcuaacagcgcggaugcacuugugcucaugcacuugacgcccagcuugaacuguucgcgagagaagcggucccgugacuugucacuggccagggcgcacgcauccgucaggaacuugagguuucgagacaggcccugcgacaccuccagcaacagcuguggggucauguccgccagugggguggcucgcagcacagcacagccuuguucuaccucguggcggcagcgugucacacgguagcgguccacaaggccuggcugugcagguugagcgcccgguguggccacggcugccagguaggccgcaugugcagaacacucggucagcgacaccaccaagucgcccaguuccacaagacugucucccgccucuccgaagcggcccauguugagcuggcucugcacgucgugggugaggauggacagccccuuagugcgcgcgaugauggugucccggcacugcucgaaggacuccgcaccagcgccaggggaggcggggccuucgaagagcaccggccgcgccucgcuagacagcagcagcaggucggccaccagcugcaucuugcccuugcagugaucacagauagauaccagccucuuccgcggcugcgagcuggccccgccgacggcgcucccaggagccggagaagccgccucgccagugggcuucccggcgcugccgcuagccaucgcgcccagggggcacuggcaugccgcuggggagcccgcuaccaccgccgccgcgacucagcuggccagggccgcgcugccuuccgcgcaccaucaugccacccaccgcggcgggcacagagauccggguggcggcggccgguggccgggcgucgcagggcgggcccaagcccgcggcaagcucuucggggcgcuguguagcucgcgggaaccgugagccggggcacggcagacuccuaguccgcgccccucuucacuagccuaccagaaaaguccccgcugccgggcugucgccaccuuccugggcauggccggccgggccgccggagcggagagggcgggacggggaggcugggaguuguccuuccuuccuuccuuccuuugaaaucaaaauccucugcuccuagaggagcgcgggcggcggccccggcaggcuuugcugucagccgcugcgcugcggcuauccggcucagcagcgcacgugggcuucaggggcggcgaccccgccagacgguacaggcuggcgacggcggccggagcugacgcccgggggcgcgcggccgcaucuccugcuccggcucuuagggcgcugggcggccacugggccgagggcguggcuggcucuguggcggccgcgcggagucagucgggcgggaggcugcaacgcagggugcugggcggccgcgccuucccgccuggcgguucagagugcgcggcccggcgccgcggcggcacgcccuccccuccugaauggccugcggccggcgaccggcugucguggagauuccaucuguguuuccccgcagagcccgcgggccccgcgcauccgacgccccaggguggucggcucagaaggugagcgcggcgucgcggaggccgacccgggcccggacuccugccauguuugucaaccagcaacuuccgagcgaccuccgagcaacugaaaggaagggaggagaccgcaggccaggggacacccgccugcccgcgcacgguugcaguuuucgccuccuggcguccgccucgcccccggcucgccgccgccaccucggccguaaccuccccggagccuauaggaaucuuuuguguggcgucaccgccuuucguuuaaaucccgcuuc

SEQ ID NO: 3923 - RNA, 4471 nt, Mus musculus
gaagcgggauuuaaacgaaaggcggugacgccacacaaaagauuccuauaggcuccggggagguuacggccgagguggcggcggcgagccgggggcgaggcggacgccaggaggcgaaaacugcaaccgugcgcgggcaggcggguguccccuggccugcggucuccucccuuccuuucaguugcucggaggucgcucggaaguugcugguugacaaacauggcaggaguccgggcccgggucggccuccgcgacgccgcgcucaccuucugagccgaccacccuggggcgucggaugcgcggggcccgcgggcucugcggggaaacacagauggaaucuccacgacagccggucgccggccgcaggccauucaggaggggagggcgugccgccgcggcgccgggccgcgcacucugaaccgccaggcgggaaggcgcggccgcccagcacccugcguugcagccucccgcccgacugacuccgcgcggccgccacagagccagccacgcccucggcccaguggccgcccagcgcccuaagagccggagcaggagaugcggccgcgcgcccccgggcgucagcuccggccgccgucgccagccuguaccgucuggcggggucgccgccccugaagcccacgugcgcugcugagccggauagccgcagcgcagcggcugacagcaaagccugccggggccgccgcccgcgcuccucuaggagcagaggauuuugauuucaaaggaaggaaggaaggaaggacaacucccagccuccccgucccgcccucuccgcuccggcggcccggccggccaugcccaggaagguggcgacagcccggcagcggggacuuuucugguaggcuagugaagaggggcgcggacuaggagucugccgugccccggcucacgguucccgcgagcuacacagcgccccgaagagcuugccgcgggcuugggcccgcccugcgacgcccggccaccggccgccgccacccggaucucugugcccgccgcgguggguggcaugauggugcgcggaaggcagcgcggcccuggccagcugagucgcggcggcggugguagcgggcuccccagcggcaugccagugcccccugggcgcgauggcuagcggcagcgccgggaagcccacuggcgaggcggcuucuccggcuccugggagcgccgucggcggggccagcucgcagccgcggaagaggcugguaucuaucugugaucacugcaagggcaagaugcagcugguggccgaccugcugcugcugucuagcgaggcgcggccggugcucuucgaaggccccgccuccccuggcgcuggugcggaguccuucgagcagugccgggacaccaucaucgcgcgcacuaaggggcuguccauccucacccacgacgugcagagccagcucaacaugggccgcuucggagaggcgggagacagucuuguggaacugggcgacuugguggugucgcugaccgaguguucugcacaugcggccuaccuggcagccguggccacaccgggcgcucaaccugcacagccaggccuuguggaccgcuaccgugugacacgcugccgccacgagguagaacaaggcugugcugugcugcgagccaccccacuggcggacaugaccccacagcuguugcuggaggugucgcagggccugucucgaaaccucaaguuccugacggaugcgugcgcccuggccagugacaagucacgggaccgcuucucucgcgaacaguucaagcugggcgucaagugcaugagcacaagugcauccgcgcuguuagcaugcguacgcgaagugaaggcggcacccagcgagcuggcccgcagucguugcgcgcucuucagugggcccuuggugcaggcggugagcgcuuuggugggcuuugccaccgagccucaauuccugggucgcgcagcugccgugagcacugagggcaaggcggugcagaccgccauccugggaggugccaugaguguggugucggccugcgugcucuugacccagugccucagggaucuggcgcagcacccagaugggagcgccaagaugucggaccacagggagaggcugaggaacucggccugcgccgugucugaaggcugcacccugcuaucucaggcuuuaagggaaaggucuucacccaggacuuuaccgccagugaauuccaauucugugaauuagcacuccccacgcuccacccccaccccagccccuauaccuguuuuccaccccaggcuaaaggaagacacuuaaccccuccccucuccauuuauaccaaagaauccauaggugauccccucccucauguuaaaugcucaagaggaauuuuccagaaggcagggccaugcaaucaucaaguacucagagggccuggguguccaccagcccacuauagggacucagacacagagaagauggguagucugcuggcugcaggguuaacccuacacacucgagccccucaacucaguuaucaauugggcaggaaagaggucaugggcucauuucuuccuucuuuuuaauuaaugaaagguuaccucaguuuucccuccuuuagacauggauguagcuaccuuuuuguaugucguuauuuuuguugaauuagaguauacauggugugaaaaagaguaugacuuugccauaugauuugcaagugggggggaaagcuacugugagcguguguuuuauuuuuuaaauuacacuauagagugauuuccccccccccccaaugucaaguuuuuacccugcauguacuggaguauuuauuucaucuauuaaauuguuauguuucucagauggcuuuucgcaguuacugucuuuucacuaacugugcaugccgccugccaucugugggaaggagcuguggggggaaaaagguuuacauccauuggcaagugaauccccagugccuaaccauuuccacucuaaaauuccauuuucccucugguauuauuccucugagcauccuugcacccuagaaagacaaauguaugugaucuauuuuuaaaggcaaucgaaugugauuggacuaugcagugcgugggggaggacuguuaguggggaggacuguuaguggggaggacuguuaguggggaggacuguuaguggggauuuugucuucuucccucuaguuuuucuggaaaguaaccuagcucucuuuguccuccacucauuucucuauuauaaugagccauagguucaggcuuacugaaaucugauuuguauucggccugucauuuucagauuaaaguacuuccuaauacuguguggggugcugccuugccagcucacagaauuuugcaugggacuuaacagcacuguaucaacugauccuuuagcaucuucagugaggcuaggccuaacccagaaaucucuaugacuuuauagaagguucuaggcaguuugauaaaagagucuauccucuggacuuagaacuuucuagagcaugcuugucaguggagggcuuguuuuuaugaccuugauucaaguggcugguuggguauugaaagaguauuuuguugauugaaaucaugucgagguaguuuggcuuuucuguagauaaauaaauuugggauggacuuuuuaagggggaguuuauggcuuguugaagacacuguugaauaguuucuuacuaaauagagugacaaacuuaucuauagccuugaaaccuggaugagccacaugcgcaaaaaacuccuguaggcuuucaguguaucauuuacuuuuucaggggguuuuauugugcuuaaaccuuuccagugcccacagaucugaaaaguugucaccauaaaauguuagcagcaaaaugaaauuuaacuuauaaaaucaauuuuucccacacuuucuaaaaaaaaaaacuuaaaguaauaguguguauacauuuuauuuucaauggucagagcaaaccuggcuguugcucacaccucucauuucaacacuucagagacugaagucgaagucuugccauaagucugaggccagcauagacaguuggugucucagcacagcaaauaugcauuaggaauuaagugagaaauggucaaaggagcaguuguuuucucuaauuagaucuugcaagaguuauaaaguaaaaugaagugaccuuggguaugcuccuacccccccccccccaguucuuuuguaaaguuuagucuagaucagcugcagguagauuggcaagagggcugccaaaagaaguccuauguacacauggaaauuauuucuauucguuggguuuacacaaaugauaaagucuaaauuuccuaugguuccuuuagucugcagauaucacagaguaaacugaaaggaauuaagagccagaagaacuaauccuugaagaacuaauuuuaaaacugcaagccaaaaggcaaaaagacuugcccuaucuccuugcaugacauuaacuagcuagucuccacauuaaauuugaaacugcucuuucu

SEQ ID NO: 3924 - RNA, 17069 nt, Mus musculus
aggguuuuguuuuuuuuuuuuuuuuuuaaagaggcuuuguuuuuaaauuguuggaaaugccacaugugauggccaaggcugucaaggaucacagaccugcugggaagucucaaaugacagaacuaucaggagcagcuauuuagcaauauauaccaaauguuaaauuuuaacaauuauacuguaaacaacuuacccuuugaauggaaaaaaguuuaccaaaauacuguauaugaaaauguccagagaggcuggguaagaugggcuuccuuuuaaucccaauacccaagagacagaggcagguggaucuccagugaggcuagccuggucuucauaggguguucuaagccaaaagaaaaaccaacauucagaccuaggucauagguuguuucuguuguuguuagugguaguguuuugcuuauuucgucucauuuugagugucucauguaauacaaucugaucuggaacuucugaucuugcuucugcuuccucaguguugggcuuacagguaaguuuggguguuaaagcacuuuuagggauauauaauuugggggagggcuacuuuggagcaucuuucagaaacuucugcauacucauuccaaagacuuaacacagcuccucccacugccgccccccccaaacaaauaaaaguccuuugaaauucccuaggaaauucagagaggggggcuugcaugaggucugcucagaaacgauuuccagugguggagcucccaggagcccugagguagcuuccccauggacagauggcuggccaaggagcagacuguccucacuugaaagagagcuagaagccaguggucccaggggacacuggacugaagcaguugugcuguccagaugccccugcaguugcuguaacaggggccguccuccugagaacaggagacuacagugcaaugauggcaguguuagccuucccugcugguaauuuuauggaggaggcuaagagggcuccucugaagaaaaggccauacaccaagaauugugacuaguuucuuuugcauuuaguccuuuuuguuuuggggguuauuuugggggggggggagcauggggagcgugaguuucagacguagcugaggcuauccugcaacuaaguaaccuggccuggcugauccucccaucucucccucccaaacacugggauuacaggcauucaacaccauaccugcuuuuccuccuuaguaccacuauaaggaaucuguagucuggguacaagugacuuuaauagacuuucauucuacuugauuugacucauaaaaagcagcaguagggccuccuggcuucuugugcuuuagaaacucgaacccaagaauuugaagaaaugugacaacacgaggcaguuuagggacugucaaaaaucagggaggguaaaucgaucaaucuggaguucaaauucuugaacuguaauaaaaggaggcuuaaugugccaauuucguuucuaguagcaaauaaguguuuggagaggagaaucuguuuaucccagcucagaauacacagccagaaaucagaaacagcagaaagcaugaaccgaaggcugcuucaagccucucugccuguaaacccgagagacugacuaaaggccugaguccggagaagcucuccugucaguacuacgcaaaaucccugaggcacucaaaauuccaacagccuccuagaguccucacuccccaguccagacuccucaggggccuccaagagcacccuugucuacuacuucuagccucagggccuuugcaaagggaacucccuugaccucccaacaaagcucugcccauucaguucacugcauuaugcauuucuuccuuucuccucacagucagucauuccugccaugccugcacuguccucagaacccaccagugacaacuacaucacaggugaugcaugaaccuggugaagaggcugcacaccacacucaaagccaugacagucccgugucagcaucaugaaggcuuccagaaggaaacggcagcccugagaaaagagcaucauggcuagacaugacaguagccaaucaacugccccaugugaaaacagaaaaaccccaggaacggggcuuguuucagauuugcugggcccacagauaccaaaaggaugagugcccugucccagcuucuccuagauuggcagcacccucaaacaggacagcagcagaucaucacaagucacaaggugcgaggaccaaaaaaagcuucuuuuugaagaggcucagcagguuguguccaggacgcccugagcuggggagggagguguggcuugguaagagaaacaugaacggaaaccaacuggaggacagaauauacccaucacuggaggacagaauauaccuaucacuggaagcugguaauuguacuuuauuuuugaaaaaccaaugaccaacaguagcuucacugggacaaaguacuggcagcaggguagggcaauucuucacacugugacacucuuaacagugacaauuucuagccggguacguguacauguacuauuucgaauuucaaaccacaacugagguuuuaaaagaaugugaguucuuaaaaauggcauccucauagaaauguucuuuuagcgaagcuucaaccuaugaacagcagaaacagaugugaacagcagcacaucaugagaguaccauacaaaagcacaaguuuaggcacuucaucaaaggaaaccgcuuagaaauacuguagaugagguccacuccuaugcaagacucugcuggucccuccucgccaacuuuauaguuguugggcuaugcagaacgugggcccucaguggaagcauccuucuuuccucacacgaugaacaagcgcauucccucuucaacuccaggagacggggagacaaagauuccccagaaccgaugagaaguucuggacggcacugucgugaaucugcccacucugcauaacgaguuugcuguccagauccugggcgcacagcacugcucauacggcacaguuaucuucacucacugaacacagcacugcucauacgacacaguuaucuucacucacugaacacagcacugcucauacggcacaguuaucuucacucacugaacacagcacugcccauacggcacaguuaucuucacucacugaacaaucaauacccgcgcuucagucaaguugaagcuucucaaggcuugucugacuugagcuuguaauacacagauacaacaggccaugggaccacagcaggugcacugaggagggagugguacucugggggugucauggacucaagagaaauaaaagguacaaaacaucaaguuuccaaagucaggugaagccacaguagacaugacuugccaguccacuaccaaucacaaauccugccuucacaugggaagccuuuuauacgguaacugugauauugaccagauggucauacacagaccauuucuagaggacaugagaaugucaucugcuaugcaguuuccugcaccaccugccccaccagucugcgaggggcuaucugguccugccuaccuggcgggaagcuugccaccugcuaaaggucuucucuucugcucccagcucgauugucuuccuuggaagcacgugguuugggaucucccuccuucuuuuuagccuucucuggcuuuguuuuauuuuucuccuugcuuccuccuccuuugccaggauacaucugucccucuagagugacuucagcacaccggucuugacugaccaaaaaguccuugaucucccaggcauagcucccaucccggagcaugaagauggcgcggucggaucccacgaugaaccuagccagagaagccagcaguuagcaauguaagugaggugccuggggucagagaaggcugggaggccuacauuucaauuccacccaaaugcugaacuguucugccuugggccaaguggcugcugacuuuaauguucacugagcucuaaacaagcauccugcuaagaucaagacagaagcagaugcuugaugguccugaagcauacauaaaugacgcugugaagagauuauaaaugacaaacuccuuagggagcugcaagggacacaggugugcugcagaggugagaaauucccauuuuuaucuuuaacaugaaaugucauuuccaucuaugucuuaugguuuguacuggcuaguuuugugucaacuugacacagcuggaguuaucacagagaaaggagcuucaguugaggaaaugccuccaugagauccagcuguaaggcauuuccucaauuagugaucaaggggggagguccccuugugggugggaccaucucugggcugguagucuuggguucuauaagagagcaggcugagcaagccaggggaagcaagccaguauggaacaucccuccauggccucugcaucagcuccugcuuccugaccugcuugaguuccaguccugacuuccuuggugaugaacagcaguauggaaguguaagcugaauaaacccuuuccuccccaauuugcuucuuggucaugauguuucguccaggaauagaagcccugacuaagacaugguuuuuguuuguuuccugcuaaguguucucacauagcccaguaugacuuccuaaggggaugaccuugaacuucagauccuccugccuucaucucccaagugcugaguuuacagguauaugccacucacugugccaagccacguuuuauguucugaagucucaaacuggcuuugaugagaaggcuaaaagccacugcauggaacagguccuacaagacuccuccucaagggcccacaaagauccaagggaagcagacagaaauccuaaccuccaaggucagcaacaagcacucaguguauccccauacauuagugcccaggaagaagaaagcaauggcaugggucugggugacacauaaaagcgugcccacaaggcaugaugcugugcuccuaagcagcagaccaucagagaacagucaccaccaagauaucugaugggaguuacagagagcauucuuagcaacuccuuccguucuuucuuaucacuuucuuacuuccucaauuaagauacuaaagacuuggguuuuuggaacuauuguuaaacagaaaaaauaggcuauaaaaaaaaaccccgaaaaaccaaaacucaguuggauggguagggaggugagggugggaaggacagauuuagaaggggguagaggauggugaauaugauaaaaaauauacuguauaaaauauauaaaguagaaccuuucauauuuugagauuucaaacuuuaagaucauauggccuuugaacacagacuuguucacauucguuuuauuaaccacguguuacaaccacaugugucagcacagcuacaccaugaaccauggaacuggaacucauucauucuucaaagagacuaagcaaugccauuuuuauucugaugaagcaaagguuaaagagauaaaagacaagccaaauuuccaagacaagauauuaaaacaaacauacuaauuuuggccaauaaacaaacaaguaaaccaauguuucaagaaaaaaaaauuaaauaaaaggauucauagacaggaaaggcccaagguccuuggaaagacugccaaaacagacacccugcuucagccccagcacacauccaggugauguggccaaagcugcaaucccagugcuagaggcagaggugagaggaucuuuuuaagugugaggagugaggccaucuggacuaaauggccagagcuauagugaaaaaucaaauauaaaccccaaaugcccacaaaaaugaccuacuauagcuuggggucuuuaccucugaacgucauaguuggcguugaacaggcuacccugccacaggcuggugaucuccucugucuccuucucggugggguucccagacacggugacaaacaucaucagagucuucccuuucuuugucauuuucaagaugcucucagguuugccugggucuagcuuugagaagucgauaggugcugagggucucuuguguucuggaaggucuccuucuucuaugucaucaucuuucugucaggagagagggagcauuaaccugucaucagagacgcucucugcacuugcacagguucugcccaggaugucagacgcaggggcacaccaccaaacuacuacacaaacaaaauguccaaggauaucccccuugacaauacuuagggguccugcaucacauagguuuccauaauguuccuauucccaauuuaaucucaauuuagauuauaaaaacagccacauucuggugugguuauagaugcuaccuagcaaugaaaaucaaauacacauacaacagaucucaaauacaaguauaacggcugaggguuguacucucagugacucccagugaucucaaggagaaagugagaauucaaggccaacuuaagcaauuuagcaagaccuuaccuacaaacacgccuggagauauggcuuagugguagaguacaugucauucaggaugaggccuugagguaaauugccaacaccacuaaggcaauuuucuuuuguuaaaauaacaggugccaggcauaaaagaaagacauauuauacaaucccauuuauuuaagguaucaagaacaaguaaaaauaauguggggggacaggaauuagaacacugauugcuucugggaggauaugagaugggucugacugagaaagaacacaaaggaaccuuucggugugauggucugugaucccaggacucacuccguucuguauuucaauaaaguguagguuaucagagacagaggucaugucuagcaaccccaggguccugaguccuugcuuccagcagagcaaaacaaacaaacuccucauguugcauccuuaaaacccacaauucacugcaugcaaauguucaacccccauacuucuucuauguagugguguguccuagcaauccugaaaacaccugugaauuuuaggaaggagcaaaaguguacacaugcgaaggaugacuauagcagauuccucacuuggggaaaaaugccacauggaagcaggaagagagcacccuguggguacaggcuggaaaugcaggcacauugauuugagagguaccuggaugaguggguagauaaaaauauuaagacagagguuucuugaagaaaagacuagucacccuauggaaaacaaaaagugaagccuuaaauaucuuuuuugccucagcaagaaucacucauauaacaagucagaaugccauggacaacaaccugaagcaguucuagggccaaaucuggaauaauaugaacaucaaaauaguagugaggauuuauaauucucuaaguccauauuaacauaaagaaagaaaaagaauaucaguagaauaucaauaaauaguuaauaaauggaauaacuaauaaauggaagaacguacacaacagacagaaauaaauaauccccaaaggggaugguaaguuggcuuggugggcaaggcgcuugccuuggcagauaugaugaccugaguuuaauccccagggcccacaugguagaaggaaagaaaugaccaacuacauccaacuuguucuuggaccuucauaugcaugcugagguacauauauaggcacagagaucucuacuagaccacauucacaaguguguuuguauuaaaugcagggaauguuauucuguuggucucugcuguucagcucaguacacaucucucuaauagacuagaauacucuccuguccugucuaaaaucaaaccugcucccuguugcccucugacauucccacacaacacuuccucuuuauaagauccaaccauuucuguuucuguuuacgaggguuauuuccuacccccuuguucugacagaugucuugcucaucucugugaccuccucuuccucggggucugagcacuguccauggcuaggccucucacaaggcaagguucacuuuagcagguuaaaaggcauuauuuacuagaguccaaaaaggacaguuggaaauugaaaggagucauacccacucaaaucuacuccaaauuuucuuuccagaaucucacaguggagcccaaaccaguuugaaauuuacuauguagcccagguuuaacuaaggcuagccuccuccacuagucucuuaagugcuggaauuacaaccuugcacuaccauggccccacuacuccaauucuucuguuggguacagagaacaacaacaggaguccccccuuuuuaagucaaauccaacagguggauauuuuaaauguaugcccaaaagucuuaccuccuuccaacaauauaguuagccacaaguuaaaaaaaaaaucagcauuggaaacaaacucugaaaaguucucuggcagagaaccuuacacagugaauauagcuaugugugugauuccuuuccaucagcugugccaaucaaauacgacaguacaaucaagggcugcaguguacuuuugaucaggaaucccuccuuagaaccuuuugcauaccccaaaugcaaucaaguaacagaccagaauucggccucucacaaaacaaguccacuacucccaucaaugaaaaaccugaguugcauaugagauaugccuuaguucccuuuaccaguaaaauaaacccacccaagaaauuacaaaagccccagcaggaauauacaccaaaagaagucggaaacccucuauauuuggaaagaucucuaucaaagcuaaaaaaaaguugagagaccaccuuuagaacccauucacuccagaacaggaggaggaaggagggaaugcucuucaggagcgcucgcucccuguucgcggcucacaaaccaccaagaucaauguagagaccccugcgacauagcaaggaaaguagggcuugacuggugagaguccaagugcugacuggaguggcugaggagccaugauagcgaaagacacugggcgagaggccugagccgugguggaaugaagagagacgcgggagucaacggguacugggagacauuucaagaaagacccucagagggcagcgagcgggaucaggggacaaaagucagaaggucaaauguccgagaggguaaggguuaggagaaaagggaucuguaugggagaugcucagaagugugcaggcgacacagaccucccacugcuccagaagucgcgccaugucggcaucguuguaaucgcggauguccuucuuuuuccguggaggugggguggccucgcccggaguguccgccgcguaggcauuaggaggagggagcaacagaagguccgaggcacacagaaacaguagaaccgcgcgcagccaccuggaggcagccauguuagcagccuagcguaacggacugcccagcguaaggcacaaugagccugcgcagacagcgugcggaguccggacgccggggccucgcccccaccccgcccccggccuuccaauccagucccuaagcguguucugcgcagaacuaaacccaguacuugaccccgucccacccucgcggacucaagucccaauggcuccgccuccgaggaguccguagccuaccgcaccccgccucguucugguuccuccuguccggaccucauccgguagcuccgacccccuuggcuccgcccacaacugcauucccuuggggcucccaaccucaggcuccuccccgucaucgagccuuucaccacuugacuccaccccucagccacggucuccugacuccgccccuaggguaccgccuccucaccagacuccgccccauagcucugggagcucaccuggcuggggaccaaggguucuuccuccugguuccuccccuugccaggcuccgccccgcgagcuccgccccuuggccuggccaaacaaucuacucuagcuggguccugcccaacugugcuuucuccacuauuuggggguuuuguuagaagucagcccuuuugucucucauucucuagccagggucugaaaguucccucaggguuucagugacagaguccucgaagccuaugaaaugaaugaguuggaagauaugcaaacuaccuugacccugaggcccuuuucaggguguugacauucaacuacgcucccuaguaauuucuagcaagaacaaaccgccugcugaaaagcuaaggacagcuagggcaacuuuucucgaagacuguaauuauagggucuauuguuauucugcuccacggaugauuuucgacccaccauucuuucaauaucacugucaauuaaacuggaaaaaaaaacccauuuaauugauaaccauuuuuauuguuuaaaauaguuccugucucuucugauuuucaucuaccacuguggcuuuaaccuauaggacaaaaccacccuaauuuuauuuucuauuuuacaagauuuugaccacuaagaucuucaaaauuaaaauacuuggggucagagauacuuuaaaguuuccuaagcuuuaaguggcagaucugauuucuuuaaaauuucaaauuauaucauaagacaugaaaccuugguguaguuggaaaauauucaaaaacuauaccuuaaguacugaccccaaagugccacauaaugcauacaauuuauuucuauauuuacaaauguaucucaagaauggguuuucaauguuuauaucagcauacuguguuaauuacuaagcauacuuggguucuuuuuuuuuuuuuuuuuuuuuuuuuuuugguuuuugcgagacaggguuucucuuuauagcccuggcuguccuggaacucacuuuguagaccaggcuggccucaaacucagaaaucugccugccucugccuccugagugcugugauuaaaggcgugcgccaccacgccuggccuuggguucuugaguguuucauuccuuuacuguuuuuuaguuuuugguuuuuugcuuuguggguguuuuuugucuuguuuguuuucucaagacuggguuucccuggcuaaccuggaacucacucuguaaaccaagcugaccuagaauucagaggucugccugacucugccucccaaguguuggauuggaggcaugugccaccacaaccauucuucacuaguacaccaguguuuuuguuuuuucucucauggucauuauuauauuacuauuuucccugucuuuuucucuauacuuuggauggauaucguuaauagguuucauauagugcaaauccuuuacaaaauguuuaaguaaaagucuuucuuaugacugauacuucuuucucagaaguggguggaaauugaguguuaagaauguccuggguucagcugggcaugguggcacacgccuuuagucccagcacuugggaggaggccgaggcaggcggauuucugaguucgaggccagccuggucuacaaaguaaguuccaggacagccagggcuacacagagaaacccugucucaaaaaaaaaaaaaaaaaaaaaaaaaaaaaaaggaguguccuaccuuauccagccuucuuugucauauggccccaucacaaaggucuggaguuucuauccucaaggucaucaaaaguuccaggauggcuauugguacuccaaccaucagauggcauuccaaucaaaggaaaugggaaauaagucaagcugagggacgagcauccuauuagggaauugugcacagccuuucuggucucauugagcuaccucucugagagggacugggaguaauuauuuagcugucuuugcuaccaucucaaauaaauuuaggcuuguuaggaaaagcauaaaguggagguuaagaaaagagcuaacuagcaacgugagccuuauugaccuucacucuaaggucaaauguggugugcauuuauucccacuguaguaacguagcugauuuuuuccauauucauacauggauaugaauaaacacaaggacauuuucuguugacguuauacagaaacaacucauaagaaaagaaaaagaacuuuuuucucuucuuuuuugaaaucauaagggaaaugucaugagccuucucccaggggcacauugcuccaccccguggcuuggagcucuguccuggcacagucaugcuaaaaaacaugcacagcuguggcagaucaugugcucugcagggcggggucacccuggucauucauucugccaacugccaagguaagguuuagaaaaaaaaaaaaugcugguuuucuuggccugaaauaucuaguuacagaaaaauaaaaagguuuuucuuuucuuuucuuuuuuaaguauuguaccacaauuguuaaaacaagucagaaguuccagggcuacugacugucaucugaggaggaaacacaucuggcucccacuccauugaucugaaaacauuuggagcaacuacauuuucaacauuugacagacuaaguauauuuugguguuuuggaacacugaagaaccuucuuugucuaaugacuuacuguuaggcaggugagacauugacaggaaggugaacuugaaguccuugguaucauacaggaggguuugcaauagcagacgggcuaagccaucuacaguacacgcuacagauuccagguuaggagcuaaaggggccaugguaguaaaugucuguacuuagucuguacuuauuucuucucucucucucucucucucucucucucucucucucucucucucucucuuucugugauauucaugugaaggccagagauuaauaucuagugucucccuucacuguuuuccacuuaguaauauaauaaagcagguuauuuucuuugaaccgggaguuuaccauuucuacucaucuggcuagauagcuuacuacagagauuuccuuuccugucuccuugagggcugguccacccagcuuuauguagauccuaggaacccaaacuuugauccccauacuugcucagcaagggcuuuacccacugagccaucuccccagaucuugccccuauguuuguuuuaaguguuggaauuauucaaauguggucagauauaugguauagccauggaaugaaaauauggacccaggaauccaggacacuuucuucccugaugucuaccauggcaccaccagcgaggcuuacagcauaacaacacuaguagccauauagaaaauaguuucaaggucuagcuagagccaggagaacucagauggcccuggaauuugaaccaggucugaggcagugcaguauagagcuguugaagaggggcuggacauaaaacuguguucagugccuaaacgaggggccaggcucugaguuaaauacucaggccaaagugcauccuaaguuuaaugagaacaugagccuggguucaugcuggccuacauucuccacagcuaaggagugagaacaacaccuucuaacacuaccugaaaccuugcaugagcaauauccaaaaccugaaugacacugucaucaaugagcccuaggaccugguaggagccaaacauuaacccuuuaagaaucgaauuauagggggcugaagagauagcuuaaugguuaagagcacugacugcucuuuugaagguccugaguucaaaucccagcaaccacaugguggcucacaaccauccguaaugagaucugaugcccucuucuggggugucugaagacagcuacuuacauauaaucuuuaaaauaaaaagaaccgaauugugggacagucugacaaauggauucuauuaacacugucuggcgacuauacaaggcacucggaugggggcauagauacugccucuguucuucacagguuaacagaauuguggagggagcaaagcuaguagucccaaacaguauggcaauggccucaaccagguucugcaaacagcacaguagaaaugagggacagccaugcccaagugugucuaaagguccagagaagcugcgugugaggcagcaacagccugaguuaaucuguaaguacugaccaccagguaucaucgugaccaggaaugguuaguguuggcugccuauggucccuaaguccugggauucauauuuuuucccacuggcugguggaauaggcuaugaaacgaucaucuugugcaagcagccuuacuaugguaccagugaggcuuauagcaauaguaacaucauaggauacccugggaaacaauuggaggaaauccucacucuccuagauacuagaagcugaauacuccagcauuugugucagugucuucacugggccugugcacagcuuccuugcucacuauagaagcaacagagaagauaagaaacugaaagccaaagucuugccccaaguguguuacuggacaggaucaggaugugucagagggcuagagaauauaccaacuauggaggauagucuuauuccauggugauucugcacucuagccaguaaggagcucuuauguaccaacugugaugaauaauauaaaggggaugggaccgcauccuucaguuguaaauuguucuucuccaggagaaguguuauuuguuguugaugauuuuaggcuaggucucgccuagcccugguugcuuuaaacuccuuacauuggcuggcagaugaucuagaauuccugauccugcugccucuaucucccaagugcuagugugugacaccacaccuggccaaggccgauacucaaggagaaugaaccaaggugucugcaaauguguaagaaagaucaucugagaccacuguccaccugugagcacaaacauaaaaccaagaaacccaaguccaaaguuaugauauggccaagacugcuccuuaccaaccacuggguggcacuguauaccacagacagcuugguugcuuguccacaaauucuggggguauaccaugaaugucuaaaguucauacaagugaauauuauuuccuauaaaaaggacauucugauacguuaucgcacugauuaaccucaaugacauuaugcuuaaugaaauaagacagacacaaaagaacggagugcuucaaaucaucaaguucacggaugaaguugguaauggccagagacuagaagagagaauggagagauguuauuucacagguagugugucagggaagaugaaacuuuucugaagguggauggugcugggcacaguaccuccccccucaaaaaaaaccucccaacccccuacccauccagcagugacaggaagagcaaggugagaaggaacagggagaucuuagauuugguuuccacugcuuugguuugcaggucaccucgauuucccuagcacugaucagaaugcauaauucugccuaacaugaccuaaacacuuaguaugcaguacuuuguuuguuugguuugguuuuuugagacaggguuucucuguguagcucuggcuguccuggaacucacucuguagaccaggcuguccuugaacucagaaaucugccugcuucugccucccaagugcugggauuaaaggcgugcgccaucacugcccggcuaguaugcagugguugaucugcuguccauuuuuguccugugcuuuuacugaguaaacaguaacugggagcacuuauuugugaaccuucccuuccgggacucuuaucuucacaagcagaggcugcucuauuacaaucuauaguguaagcgcagugccuugaacaagggcuggcacaugguagacacccagcguuugagcuguaagugaacaauggcaggagguaaacaagaaagaaccuggaaagaucaguuuaggaagagugacacuaucugaaaaacgaagccuugguggcaggcaccuuugccugcugagcuaucuuacuggucccucucuuagguucucagaguuaaggaaacuauuuuuuaggauucacugcuauuccuggguuaccagggaggaaguagcccuauagaauucuuguuaagagagccauugguuuuacuggcuucaguuugcagagacaguugguucaccuaaaaucuaaagcaucugcaagggcauuuuuuuuuaauuauuauuuuugauuaugaguagggcggcuauccagguuuuuaccgguuguuccucauuaacuuauauuaauaacuugacucauaauuuauucuguaaacuauugggguuuggacgauaaauuugaggccauccaacuuauaaauaacacuuauaacuggcuuaaaaauguaggacguggagguccuacgaagagacagaagaacaaacauuuccauuggcugagcacacacuggcagugcugggcaccagcagaagacuucagggcucuugagagagugcuuuacugggaggaggcccagguguuccaggaguuucuggcagacaaggucugcacaaagaaagggaguggguguggccaguggguuuaggggaccuucucuuuuagccacugcuguuguuaagagccuagggagucacuuaguccaccuggccacaaagcccuauggcacaggccuacaaucaccaacuacagacccugaaggaggaucgccagaaguucaaagccugucugcacaguuaaauuaauaaauaaaaaguacaguagcucaagguccuccguuuaauuccucguuacagggcggggagccaucugggccaccaguuucccagccuguaacccagagauaacaguguuuaccuccagagacuggcucuuuacuuaacaaugguugcuauuauuccauuauauagauggagucaggaaagggcgaacugcugaucaaggcacauuggaauucuagccagcuggaaccgaggucaccauacacuaccugacuacaguaacuugggagagaaaacuugcccaaggucacacaacuccuaaacggcugggggggggggggguaagaccaaccucagggagggucuaucacugagucaaacaagcuguggggacucaagcgugaucagagcuccuuuucacuguuucacggaaacccacccacaggagaggguccaacacaacaaagggcggaggagggcuugcaaaagucaucgaaucucagaggugacuggaauccggaggcgguggggagaucccgggaguaaugaguggcauccuccccaagcaagcaaaacagaucaccuuuuacacuagcucccucggcagggaggaagcaucgaguccuggggcaugcugagagcuuacguaaggccacuagcggcugcgccccgguguccccaggguauacacagcgccugggcgcggagcgagggcgggccuuccccaccacacacgcuucccagccucuccggaugcagggaccaccggcccca

SEQ ID NO: 3925 - RNA, 1436 nt, Mus musculus
cuuuggaauccugggaaaacuuuauuggauggagagacauuuguuuucauuccagcaagauauaugggguuagggacaaacaucaaugacagagcccuggccucauauguacauggccaugaguuccauaccccaaaacaaaaucacuccaccaaaauaaaacaaagcacguggacauuugaaaauuaauuggaaaaguaaagugucugugauagucauugauaaugccacacuggggccgauggguccuaccacuugugucaaucagacccugaucacgcccagggaccacuuuccuuaugauggauaugaguugccuuuccugauucugaauauuuuuauuacccacuugucucuggggcagcugggcccuuucuguggucaucacacagaugcccucacugcaaauuacaaagccacagaaggacuacacaucugccuugcugaaagcuggagguaacacggagggacuuccacacagcucaucaccggcagcagcuugauuccagccacuagaugccuuucucuggagacugugaccuacucucugccauagagagugugccuucuucccugacuuguggaugacucuauaacuauccuuuucucuucauuuccucuaugccaacuuccagccuucagcaugaguauuuugcugcgguguuuccuucucuauucacaacugcaggcuuucuuucaauuagcagaaacuugaggccacucugguggcaaaggaccauguccguccuccauccuucagaauggaaagcacaagagaagaaaaacuugggauucuuucaccuuucucaccuucacaugauccagugacagagguggggacccccuuucuucuuuguuccacauaaucaaguggcagacguggggacaccccuuuccuucuugugugucucugagaagggauguucuaucaaucugccuucucuccucuccugagaaacccccaggaucagcacagccacuuucuucccauauauaaugggaaaauuuaaaacagcauaagaaguauuugguauaguggucugcagugucaugcgcauguaugagggaauccuuuuguuaaaaaaaaaaccauaaaaacaagaaaaacacacaccuuaaaaaugauaaaaggggugggucugggaaaucaucucaguaggcaaaugcuugcugugcaagugugagggccugagcuucuauucccagaacuuaugugaaagugagugggugcagaagggcaccuccgggauuccagugggccugugggagauggcagccagagagaggagaauuccugggagcuugugagccagcuagccuggggaguaaugucaccagugagcaacaaggaaggagaggaccaacacccaagauugucaucugaucuccaaacaugcacuguggcaagcacaugcucacaugaauacaccaggaca

SEQ ID NO: 3926 - RNA, 76193 nt, Mus musculus
gucagcgcgcguugagagccaaucgcgggcgcucccuugaggccgcgucacaggccgagcagccaaacagaaaaguuuaauaaacagcggacggagggccggcggcggcgggccgggagcgaguggggguuuggcggccucaccuguccucacucucagcggcggcgagaggcggcggcggcagcgcguccggcggagagggccgccgccaggugaggagugcgggcagcggugggcgcagccuccgggcggccugggagccggaagcggcgggcggcgcagcagguggccucgcaguggcgagcggagggcgcggucccgguggggcgcggucccgggcuccccgggcgcgcgcugagcucggggucggggugggcgcgccuggggccaguccggagcagcugccgcacgccgggcagcguccucacgucccuuugguaggcugaggcuagagaaggcucagagggagucuccgggauuccaagcucucugcuccucugagagcguuuucaaguuucucacuguuggaugcguaaacaagcuacacggaguguggcgucugaagucaaucuaacucuaucagaacucagugauuugccaucaucauccagaauugucaggcguuugugggaacuggggccuuggggucaccuccaagccgugcaugcuaacuagcuugguagucagcaccuagugguuccgaaaaccgaaauuaaacgucacuuucaaacuauauucgaaauuuauccuuuuccuaauuaaaaugccacguaggcuuuugagauuauuuaugaaguauuuuauggcaauugcuguuuuauguauuauuuccaggccugcggggacaauuuuuugguaaaccaugaacauuuaaauggagaaaagacauugucuuaauuuuuccuuuuuccuuuuuuuuuuuuuuuuuuuaacauuuaaaaaacacguaagccgggcgugguggcgcacgccuuuaaucccagcacuugggaggcagaggcaggcggauuccagccuguucuacacagugaguuccaggacagccagggcuacacagagaaacccugucucggggugggggugggguggggcggggagacaaacauguaagagggguaauaggcacagauaggaaaauuucaggcuugauugcuguuuugacugcagccauacuuuccuguguuaaugucaaaacucacaauaugaguuauaucacaaaguuuuuaaaguaauggucaguccugggagaauacacaacacaauguacuauaaagagagaaaacauaaacuuucagacuccucacuccagagccagaacuagaacauuacucaaacuuguauguguucacgaguuucuuaucuggccuaacccaguuuacuguuucuuacugagguaaauaaacauucuagacucgguggauuugcucauucucuagccuuuuaaaaauuaguuuugucacacacuaaucucuucaaacagugucacuuuagguuccuugcccuuugaacuuuggacagauaguguaugguugugguucauccauuucauuguuucuuaaugcuguguuccucccuucaccccaguguuucgaugguguuucuuguuuugcuucuaacaaguguacucugggaacuuuucuucuugcagcuguuguugcccaaguugccugucgaaaaguaaauacuguagaucgugguagaaaguuguaggcaaucaguaauaaaauagagaugaaaacguuacgauucugcuuccuuccuuuaaucaggaagacucacuguucuugugacugguuccuaguugcuauguuugcaugaggaacuaagauuucuguuaaucucuacaccgaaucccuucaaaccggcuguggaaaguuuggcacccuuugguacuucucagggcaaaaccagcaagugggagaaaacuccauguuuugugaagccacccugucuguucuccaccacuccuccccucccugcagucucuggcagguuauugaggagucuucuuugccuuaaaaccguccgucuugcaaaagaaacuuggaguaagcuuugucugccuaguuggcacaggcuuuguuggagggagagugucagagagcagauccuuuaagggaaacauuaggacccacgugacccuccgccacuuuugagaagacuaugugaguguacuaaguuuuucaagacuugucaaccacacauugaaguauuuuuuagguuuaagaauguccuaggguuugcucuagacaaaugucuuuaauuuuuuaauuuugcuccuuugugugugugugugugugugugugugugugugugugcgcgcauguguguguaugcuuugaauaacuuguugaaggcaugagagaggagcuuuuuaauuuuuuuagauagggucucacuauaaagccuagaacucucuauauagacuaggcuggccuggaacucauagagauucccccagucaacugucuccagugauaggauuaaaggcgugugccaccacaucuggcuagggggcauuuuuuugauguuuguagcuugcagauguuuuguuuuuauaguguaguugcuucugcuuuuaaaacuuaguucuauauuuuacuacaaaucacacugacagagaguuuggggauuucucccacauuuugaagauguguaggaacacaaguacuuccacagauaagcauuguuaauuaacauuuugucaagcauaccuguggucuuccuguguauuuuguaucuccuaagcuacuacauguuucuuuaggauucagucuugguaccgaugcugagucaaugcacaugaacauucauuuuaaagucuuuauaagcauuucaaauuuuuucuuaaaauuuuuaucaaaguguguagggugugugugugugugugucuuguuuaugccacuguagucccagcuacuccagagacugaggcaggauagugugagucuagguguucuaaggguucuaaauguggauaggcuggcuccacuuucaaaacuuacuccaaauguaauguccccacuccuuuguuuuauagaagaugauaaucguacucaucuaauuguuacccuuccuucagguuuugcucccuauagucugugcugguugcucuagugucuagaagauguuuguguguguguguguguguguguguguguguguguucucucucucucucucucucuggguguguggguguguauguaugugauaugauguaaagugaagugaaauguguguauguagaggucagaacaacuuuguaguuucuucuauguuuacauggguucuugggaucaaacucaggucucaggcuugcccagcaagaacuuuuacccacuuaagccaucuugccagcccugaauguguuuauagauaugauaguccuaggcucaaaguccuucagugacuuuucgauccaugagauaaaauucagacacaguuuuacugugguuuauauaaccuacacugguugugccaauagaaaugaaugcaaauugcaaaucugagccauguuaauuuaaaauuuucucguggcccuaggacaagagaaaggcagugaaauauauuuugauuuaaccuaagaugcaguacuuugaauaugcggugaaugugagagauuauuugugggcuauuuugcacuucuggagcugauguguaccaucuaccugcagcguguccuaguucagauuggccaugauucaguguuuauacuuguaagaucuuuuuuauugugccuuuuaucugucuaggauagcagucuuuuacucuguauugcaaauauuuuuucuggcucuucauuucccuuguauuugcuuauaggccuuccuccuuucuccucucuccuaaccccuguuuacuucauugaauuuuuaaaauaucuugguuauuacuuuuacauuuuuauuucaucugaaaaguaagaguguguguguguguguguguguguuuguguguguacauggagugaacacugguuucuugaggguggggagguguccagaaaugaguauugaaccccugagagcuggcauuacagucaaguuguaugauauggcuguugagaucuaaaaucagguccucuaaaagagcaguaugcauuccuagccacugauccaucuuccagcccaguacuuauauuaaaaaaaguuaguauugcauguauguugcggaugauuggugcaugcauaugugcaugguauaaaacauuuauggaggucagaauaugacuuuguggaucuggggaaucaaacucagacaaucaggcuuauauauguagucagugcaacacuuacauuuuuaugacuuuacucugcuuuuauauuaaaguagucucauucccagauaacuuuaaauucuuuucaaguauuuauuuuuauuacaguuugggggggagggugugcagaaugugcaggugucauuggaggccagaggcauggcauucucauggagcuggaguuacaggugguugugagcugccuagugugaguguguaugcccgaaacugaacucagacccucuguaagagcagaacuggaucuucacgucucaauucucucucuaguaucucuuuaaaguuucauuuuuuuaauccauauuucuguuguucugagauguguuguuuacauaaauugaaauugaaauaacuagauguuuagcuauuaaaaaauucugucaaaaauaugacuguggggucaggccacagaaguccggugaccagacuucaucgucaguuuccauguaaagauggaaggaaagaacuagcacuguaguuggccuuugaccuccagaugugcccucuggcagaugcacccccaaucuccaccucauuguggauacuuuuggauuugcacacaaacaaaaacuuuaaauuuaucaacaacacccuccaccccuguguuucucuauaauaaaaacacuuuuauuuacaugcgaaaaugaauacauacuugauuuuguuuuguuuauuuagugguuuggcacuaauacuaccucucacuccaaaucuugguuguugggugucagacucugggucugacucagugggcaaaggcuuuuccugggcuugcacugagcccugugaguuccuguacuugcauuuucucccuugcaacacucugagcaccugauaaacagcagacuuuguguugaguauugaagguacugcuauggccaggauguguuccuugcuuuccuggaguuuguaaguauaagaaugguaggcaauuaaagcaacagacaggaaguuuuagguuuuaaaguguuuagaaagaaagauaugauagguacuaauuggguacuuucaacaugcaacacuacagagguaacaguugaucagauacaauauuugguuugaccuagcucuugagggaaaauuuagauugacaggagucugcugguugaggggugaaugagacacgcucaguucuuauuuuggagaacuccauuaaucaaggauguuauuuuggcccuggguauuuuucgucaucauuucuuaugaauuaccuaguuguuguuuauuuuguuuuguuugccaacucagaccucuacccacacagucuuugccucauugugauuuucuugcgaacucuuuccuguuauaggagauaggccuuaaucuuucuguugguuguguggcuuacucaggguaggcauuucuuuugaauucaguuagcacuuggaguccauuaaccaagcaugguucuaguguuuguuucuugcaccagugcugugcuucuggucugcuaacuaccaaccccucuggcuguuuaagcaguuaaaaugacaauauuaaacugcagucccacauuuauauuggucacauuguagaugcucaguagccauuggcuuacacuggauaggagagauagggagucuuuugcauuaauaaaaguuaaucuuaauuuuauaaggguguggcuuaugaucacauuauuuuaauuaaaauagccaugccuagcuuuuaaaaugugguaagucagaauuaaacuacaaaauuggcauuuguuuucaaacaagaauaaacguuuaaaacaaaaugugaugguaggugauuuuuaauccccagcccacaaaggcacagacaggcaaaucuuugcaaggccaggcuggucuacauagcaaguuccaguauagccaggacuacaaacaaacaaacaaacaaaaaaguguguauugaauaaugauauauuuaaauguuagaauuuuuacauuuuaaucuuugacucagaaaauuggaaaugcgugcucuaguuaauuuuauuuggacauguucucacucuucucacaaguuucuaaagagguagagacuuuguucauuuuguugaccuuggcauccucagcaggcagugguacccagugguaugauguucagauagugcugaggcaguaaguugacagacaagagacucuuuuuaaaagaugauuuuauugucuaauauguguauauguguucagcagguggggaaggguguuguaaaugugugaguguagguacccauggacccuggaagaggauguuagcuagcuccccuggaguuacaggcacuugugagccacccaauuguugguacuagacacugaauuuggauccucuccagaagcaagauaugugacaagagacuuaucuguucaguuucuacuuuucaaaaauuaauuguaagauugcuuuauuuguagcagugauuuaaaaaaaauaaucuuuuugauagcuaucugauaauuaaucuuugucuuuuagucuuuuacuuauauuuucuaguuuaggcaaccaaguagguacaagaaaacaaaagcaguuucuuuuucuccaucuagaaguuucauuuagacccauggaacauuuacuuugugcauguuccuuuuuauuaaauaauuuuugcuucuaaccucaacaguacaucuuaauaugugaaauuaugaauguuuuuccuuacauuuuuucuucuuauuuugauccccauuuaauuugugcuuauuggugaccuuguuuaauccuuuuauagaccuaaaacaaagcagguuacugauucuuuuuaaagaguguguuucuaucagcuuggauuauucuuuccuaucuguaguuugccuuaauuuucuuaauguuuccuuugugugcaguucaugggugaaugggccauggccaaccccuuaagcauacacacuuugugcucucuuccaccccugguaagaagauaaaccacaccaagaguugcaaauuaaagcacaucucucacugcuggagguuacaugugucugccaggggaguaugcuuugaaaauuguuuuccuuaucacuuggauaguugauuucagacucuauucucacugauccucgcauguuacacuuaagucgaggguggugucuuuuuuuuuuuuuucccugacuuuguacaucaccagcucuguccagagagaaugacaggauugcuuuuguaagaauggguacaauucuuuuuagguuguuuguuuuuguuuuguuuugugacaaugucucuuguaguguagacaggccugacacuauauauuaguagucaaggaugacuauaaaugucugaucuuccuguuuccaccuuuugagugguaggauuaucggcaugccuuguauauagugccuggaagcgaaauuccugugguucuggggaucaaucccagggcuuugugcauagugagcaaguacuuuccaacugugcuuuuagucucuccccacccccagcccuggauaggauuauuuucaucaaaacaggucugaccaaguuguuuauuuuguucauuggugguuuauugucuuuuuuauuauuuauuuuuugagcugauuagguuugggaaaaugucuggacuccuauaaagaauauacaguauauuucucugacuacuugauauuuagaaaauggcguagucacacacaaagcuucucaacagcuucaugcagacucuuuguucuaaccaugcgauguugucauguaguuuagacugcauagcuucuggguuuaauauggcuuccuuguacuuguuuuuguggccaucugcuuuuagacauagccuaaaacacauuaauuuuaaucauguaccuaaaaugaugauuaucaccuugauguucuuucucuucuuuuuuguuuuugugguuuugagauagaaucuugguauguagucaaggcuggcauugcacuugugguuauccucuugccucagccucccugguggugggaguacaggcauguaccaacccaguuagcucacaucuucccucuguugucuugguaauagacuaguguuaguauuagcgcugugcuaacauaugauuagugucuuucuuacaaguaauucacuuugaagggaaauugucccagagaaguaguuuguuuggugcucaaaauugucugcucauuccauucuugccaaauuguaaaaaaaguaaaugaauauuuauuuucagugcaugucaguguauaucuaucuuacuuaguacauauggaggcagaguacuacuuguaggagucaguucuuuccucccaccauguagguccuggggaucagaagggaucaguggcaggugccuuugcuugcugagcucucuugccaaucugauccuguuugccaguuuuuaacuuuuuuuucccucucacuuguaaaaguuuggucugucuuccucagucugcacugaaaauuagauguuuucuuuuugauaauuguaccuguacuucucuuccaauguuguuuuucaagagugucucacacuaggaagaaaaccugaacuugacucaugaagugccaggcauucaaagcaaugaguuguugcaaaggaucuugggacuaagcuucugugaauuggcucuuucaguuuguccacuuaaagggcauaauagaauaugcagcuguuugggcuucaccaggguauugcuccauauucaugucuaguugcaauuaugugaauuuuuaguuuguuacaaagacuucuuuuuguauucaaaacaauuuuguuggcuuucuguucaaacauagaauuuuucucugagaaagauuuugaacuuugaaaauaguaaauuuaaauuuaaaauucuuuaauacauaagcuuauugaaaacauuuuaagacccacuguuguagcaggcauggugcuacuugcuugcaauccuagaacucaggagauagagguaggaggaggaguucaaggccagcuucacuuuuucucauaaaucaggaaaucagaagaacuccuuuaaaaugccuuauuuuuauguuauuuuuaccagcuauaguuaaaguauugguagaaguggaaaauguauuuuacuaaacaucuuaaauacuaguuauugaaucagguaaugcuuaaaaugucagaaaaaaaguuugggcuaagcuacuaaaauguaaguaauucuaauuaaaccauaaaguacagcaaauguagucauguauaauugacaguaggaauuuuuucuuuaaaagucagaaucucuguaguguaugucucuuuaagagucuaguaaaaaaugccauuaugcacagcaccuuggauaguuuaaagggaacacacauuucaucuacauuugguaauaauaauuuccuuccuucccagcacuugggaaucuaaggcaaccuccugcuuagaagacaacauagugacuucugggccagucugagcuauauaguaaggacucuguuccaaacaaaccaaaaauaaguaaaacaacuccggagaggguggcggaaaccucccugaacuuucuaccugggacccauggcagggggcuugucuagcauauuugaggcucuggguuagauccuuaacacugugaaauaaacaaguuaacuuuguuccugaaugugccauuagacaaguugccuugugucuuuagaucuccuuuugccgugaauaaucaguuuuaacaggaaauagcagucuuuagggccacugagaauuuuauaguguguuuugauacccuagacuguuucagugaauuugacagauagcuuagaaguggcucuuagcauuuaggguuuagcuuagaaaugaguguuuguuuuagcauuuaggguuuguuuuuuaaaugcuguuucuuuuuucuuaaguuaaugguuccucucacuaugucuuacagaacacacgcaguuuguucuuagcaaaauuuauagugaauuuuguguagauccucacaauuuuucagacaaaauuugaacucuguuaaaagggaaaaucuguuuagaccauaacuuuauauccgugguucugugaaaaugccacauuauuuauauuagaagugugaaucuugcauagcuuauccucaaguaaacgaaaguugauucugugaauuuucauuguauuuuaacccaaacaaaagaaagcaaauugcuuaugaugggaaaacugaaacauuacagccuguuucuuuaagaaaccagcuuauccagggguuuaguguguuuaaccuaaccugcuagcgaggaaaaguucuuuaaaauaauggauauuagucguauccaaucacagcucucagccucacuaacagggaggagauuugacucucuggccacuagaauugcgggagguggagcuugguauucagguuugguugcuuuggaguacagcuucaagugaaguuaaucugaggugaagcaaacagaaaauuguggagguuuuguugguaggauuuuuguucuaaucuuuuaauaaucuuauacuuuauacuuuggcuccuuuaugcuuuuguguauacucggcuuugucauuguuucuauuuucugaugcaaacugaacauuaaaauuaagcagggaagcagaacaaaagggcuguuugaacaggaaauaggugcucagagcaucaaacuugacuuuauuauuauuuuuaguuuagaaugugagugccaguaaaaaccuuugaaucaaaaucaucuucacuaacaagcuuuucucuuaaaucagauguugaagcagucauuugucaguuuuuauaaaugacauucuaaggaggucuauuugucauuuuccuuaaaucuaaacuguuaauuugcuaaaagaaugagaaauuuguucuuuuuaaaaaauggaaauuccaaguguuugauuuuuuuuuacuuaguguaccacucccccuuuaucuccaguuuauuuuaaauuuagcaguauguugacauuuuaauauuucacaguuuuagcuuugucuguagaaaagucauugauaaauguuacauauaguaaaauaaaacuuucuuuagauuucauuuuuuuaagguugaagggauuaguaucccuuuaaaacaggaagcggauaguguuuuauuuuaagagcuauaggugggcuaucaaaacuugaaaaaaguauauguggaucuuuuaaccuuuuuuaaccugaauaauuggaagcacaccucaguauucucucucucucucucuuucuuuuuuuuuaaauuuucuuucuuuccucugugccuuuugcccucagaaaucaagguauaaaaaguucccuuuaauagucaggacaggugccagcccagcccucccagccaggguguuugugucugcugugcuguuuguuccagaucacucgaagcauuuaaaaucaaugcuuuucuccugugucuauugcuaaagcaauacuguaguacaaucaggaagucacauguaugcucacaguacaaugcauggccucauuuuccuucuaccucuguagcuuauauuccugaauuuuacaacaauugugaaaaauuauguacuggacaucucaaguuaaaacuguuuaguucugauagcuuugcaguccucuagaguuaguaugguauuaauauagucuuuugucuuuuccuuuagauuguucuuaauuuuucaguauuuuaaaugguauuacaaugacuguauaucuguauacuucaaugcuuuacuuuuugcaaaauaguaauuuauuuaggaaaaagucuccuguggaguaggcuuacauagauaauggaugucaacacucacuggcuaaauugcuuuccaggaagauuuugcuuuuuucuauugccgcccacaggacaucuucaggguucccugagaauagccccuuaauuuuuuguuauauugugccuuuggagcucugaguuguuggcuaguuuuugucuaagcgaauagccuauuuuaaaccccauuuuuaaagauauagaugaaucuaaacccauuuucuugauauuaaaauuagcugaaagaaauugggaacauuuuuacccacuuuagugagcaauuguauaucucuguuggcuguuuuauuuauuuauuaugaguauugcucucagcauguucaaagcuuaauauuuuauacuggcuuucuuggugccagcucuccugaguguauguugcuucuguaagcuuauaccaaaaagaccauuuucaucuaagaaaauauaccaggaacaguuuuagagaaggucuuaaggagagcaauuauuaccuguuucugaacuuguaauaaguaaauagccuuugucacuauguuucuguacuuugagacuuuaaaaauacauguaagaugaacuauacuguguaguuccaggguugaaaauaauguauuaacacuucuccagcaucuacagguuuucagugaaagguaaagaagacaauuguauacacacaguggcuucagacaugccugugcuuaggggcaggcuuuguuuuccaguggugcugauucuuccugucaggagcuagucucuaggugugauagguuguaucugcuugaggagcuggugaaccaguguugcagaauaaagaacaaaguuguuuuaaggcaaaauucaaaauuacuaacuacuuaguaaagauaaugauagcaguacuauagcacauauaugcuugacuuagucgauuucauuuugcauuguaaaugaacuaauuuuccuguaaauuuuuuuuuuaauuuacugaugacuuaguaucauuuucacagcugcuagugguauucuugucuugauguuuguuuccagaaagucagaagugugcugguguggggguuggagggggcagucaaugccaacuuguuuuguuaugguuggugaaugauuuuccccccagacauguuuuauuucuucagguuugcaauagaagaaaaaaccuuuaaauuuuuauuucuaucauaaauauuuauuucccuuauucugaacuagagaaaaugucuaauuuucuuaaaaauuuaaccauaccacauuaaguagagaugaacauaauuauauacauaauaauuuuacuagcagccauuuaagcacugccuauugauuacauuuuaauaguuacugagguaaggguuuacucauuuaugugcucuggggaacacuggaacuuugaaaaaugauuagccugaaugcuuucucaguuucucuccugcaucucugcuccauuggucgcugguugacaaggacugcccucuucauuccguagcuucagaggaagaguaaaauuuugugacuacagagaagagaauucuuguauugauuuagauguugggaaaauaucuaaaaagccaauagucauauuuuauucuuuuaggauagaaggaaaaauguuuaaaaauguaauuuuuuuuucuucaaugauaaaaggaaaauuuuuaauggguaguaaauuaguaaaacuugaggcaaccuagaaacuugauaauuaugagguuucuuuguuauguauugauuuuagaguuuugcaaugcuuuccuggguggcuguguuuuaggaaguaagcuucuuguugguaacauaggaugcauuuauuuaugagcugauaacugagucugcuugaugacugugauuuucuugguguggauguauuagaguucacuugaagcaguuuuguggucaguguuuugcuagagaagagcagauccaucugcucaucucuguacauucccuucugcucuaugaggcaccuggaucuauuuccccuccuggauuuuuaccuuccucgguaacauuuagcacucuugacagcuuugaaaaccuucccaugaguuuaaugacacuaucugagcuauuugugaacuucuguguccucugcaaaugugccucuuuguaaccaucaaguuauagagcuucuuaggauucuuaacguuuuacucauucuagaccugcguccuuucuguuauugguuccaagaccugagucuuaaaaaacugugugcgugcccgcauguguguaaguccgugcauaaguccauaugaaaguaaguccgugcauaaguccauaugaaguacuugaggccucuggccauccagcucaccagauguacugccuaugcuagauagaaccuguaugucauucugaucauuuguuuuacccaguuaaccaccaacuucagcuguaaauuaucucuaggauugguccaccuauuuuccuuaccucuuuagcacaagccacauugauuuuugcaugaauuauaagaacagcuaccuagccaaccucuacaucauucuuugcacuuagaauauacuguugacuguacaaucuugucuagcuggaaauuucuucuugccuuuggagcuauaacuaccuaggaauaauaauaacgccagauaauucuggguuaaagauucucucugacagucucuaaacaaccuuaaaagccauggauauuagaugguuagcuauuuuguccaaaguugccuuagugugaguagcuagcacaaugggauuaaaaccaaaauacuuucccaucacuaagcuguauucucuuguuuugacuuagugucucacuguagcccaggguauuugugaacaauaccuuagccuccacagugcuugggguuaaagaugugagacaccaugcccugcuguauaucucuuucuagagcauguaaguguaccuguccagacuuuuuuuccucacacuacucuacuuuauucuuuaacuagcuauuuacacuucuacccuuuaggaaaggcucaaaacaucccaagccuaaaauugcuuuaaagaaaacaaacauuuucaaaaaaauauuuuugacauuuuuuuuuuggcggaacauuuacaaaaaagacaugacauuuuaauaucuccauaauauaagaugaagaagaaagaaaggggaaaaagagagacagacagacauaggaaagguguaaagauaguuuuccauauguggccuguugaauuccucacauuuaauaaaggcuugaaaccaagcuguguuaaaggaagauuaggcagagugugaaagcccuuuaucugaguuguggaauuacuaaugacuguuucugaaacugauggacugggccuuguguaaagguuuaucaugcacccagguguguguagugucugcuuggaagcacaaggcaaacagccuuaccuuacaaugucuuaucugauauagaagauuugguagaaagccucauucuaccccaccguaaggcauugucacaaacaauaucacuuuaaaaaauggaggcaaacuccaaauaaauggaauaauuuucauuucaaauaugucuuuuccuuuuaccauacuaugucgucuacccuacacuguauguacuuaaggcaaaacauguauguacuugaggaacaacaaaaaauagcuuuucuuuccuuuguaguuuugaaagaaaaugugaguggcuaguacuucuuuuaaaggaagugauuuucaauuauuggaaauaaugguauuacaguaaauguccacuaugaaagccaaaagguuuuugcuuuuaccuacuccuuaauuuuuuuuugaaacagaaacuaucauacugcuuuccaaaauuuuaaaauagcauguuuacuauccaaaauaguauuuagcuaguuuuuaauaguaaaaaaagcaagauaacuauguuuuaagaauaugacaguauuuauguuguaauauuuuuugguuuuauauaauaaagagguauguaauuuggaaagaauuuuguguaaaauacagaaccuauagcuaguuucuugaaguuacagaauuuuguaaaaauauuuuauaaugaaaauuauucucagacuguuaucaaaaggggaaacuuaaugcugcugccuuguuuuccucugagugaugggauugcaagcugccucacagugaacucaguagcagauuugacugaguaguuccuagagaucuuagguugucacacaaacucaggugaguuugcaaauugcuaaguuuuccuaaggaagcgcauguuguuuggugacuuuggaagauacaaauauuucucauucugucaguauuauauauacugaauuguggcuuuaaguuacugcuacaguaucucaguagagaagaauagcuuuuaagccaagaagaccagaaaauuaaaaaacaggcaauccaacaugccuugacaguuuguuauaucaauuugccacuuucugauaucggggaaucuccucuuuuuuauaguuugacuuaaaaaucacauguuuuauuuucuccugaaaaggagugacccugaauggauaaaagaauagauuguuuuuuuuuuuggggggggggggaagcuuguuuuagcuuauucuaucuaaggucuaguugauuagcagaugccaucuguauuacacuugcccaguagcuugucucacucaagcaauucuuggcauggaaagaggcuccugggguccuaggguaacggaugcugugagccauaguuagcugugaaagcuucuaugcagaaaaguaguaaaaacaggauuaggauugguucagugauugcaacuccucuguugaacacugaaauagacacauuuguucuguuuuugcaugcuucuaaucuaaccacagggcuuugagccuacagggaaguucucuaccccuagcuacaugaccagccagccccugaaucucucuuuuuaauuuaauuuaauuuuaaaaauguuuuccuuuuuuuuucuuuuauuugaugaguacaccauagcugucuucacacacaccagaaaagggcgucagaucucauuacgaaugguugagccaccaugcaguugcugggauuuaaacucaggaccucuggaagagcagcagucagugcucuuaaccgcugagccaucucucuccagcucaauuuaauuuaauuuuauguguguuuugccugcauguauaugugaaaagugugccuguugccuaaggaguucagaaaagggcauuaaauucccuagugcuaaagcugcacauggagccaccuugugggugcugggaacccaacccagaugagagccucuuuaaggauuauuagcauuuaauuguuagcagcaagggcuguuaaccacaaaaccuuuucuccagcuacuuguauuaaaucuuuauguguauggcauguucuuuguuuuuacaauuggaauugcuuggucauaugauaacucagugagaaauuauuaaacuguuuuucuuucacuuacauuaguaauucauugaaauuguuucuccucaucaguacuugguauaaucaaauuuaaaauuuuaaucauccuaguagauauagagcagauaacucacugugaugcuaauucauauuuccuaacuauuaacaauguucauagcaaaugcuaauacccuaccucuggcuggguauagucuccugucuuucuaguuugcauuuuacugagacucaaaacuucuugccucaucuuuuccuuuagcuucugauucccucuugaaucacauuuuuucccaguucucuugacuuuuaaagccuaugaccaguucugccuucuauucugcuccuaaaccucagcuaacagaggacauuugcauauguuuauaguuuuuuacauagcuaucauuuuucuguaauuuuuagauauuuuacuuaagguuaaaauuuuguuuugauuuuauuucagacauuuaugcagaaguguucaggagcucugcuggcccuacucuacccuuauguucuguccucuguuccaguuuggcuugcugugucauacucaguguguaugggaaucguuucucagcaaguuaagagacaaauaccccaagaacuuugugcuuccuuugaacagaauauuuucuuagugagauuaagcuaucaaaauccaugaguugguguuugugaauaguuuuaccuaaccugccucuuuucaacuuugucaaguaacccaacaauaucuuuuauaacuuacuuauuuauuugauguggaucugaaaguaggaaggagaaauauugggaauaaaaaaggaucuaaauagaggagcaagauuuugaucagagagagaaguggggacauucuggccaaaauacauauguguaugaaauggucaaagaauaaauaaaaguuacacugugaacuuuauaauucacaccucauccuugauccugcuuuuccuguccuacuguguggcucauuuaagccauugcugcuuugaaagacuuugaccaugucucucauuucauaguuacuguccagauuaccaugguauuuucucaccuuucugacccugccuuccuaacucaauaccuguucauccuuuucaugaggggagauacccauugcuauuggcuaaggaaauuacauguacaauaggccaguacuauuuaacacuguaaguaaugauagcuuaaauuaaaauuaauuaaaacuaagugaaauaaaaaaucuucaaaacuccauguggcucguugauaacuagguuauccauguguguagguuccuuuauuaccuaacauuugaaggcuuuuguaaaaggugcacucuggucuuaggcuuucaucuauugucuucaugugucaaacucuguguguguguguguguguguguguguguguguguguguguguguguguguguguuuuggucaaugaauuacauacauucuuuccaaauacccuaucccuugccuuaauuaucuuuacauaguucuccuugguguaaauagaccuuucauauauuccugacagaaagauacucagauuuuacaacuucuuuucuucacucaucauacaggauggugguaauucaguacauugccuuuauucuaaagcacaguacaauagggaccaugcagugcuuauauuugucuccucauauuucacauucaaauauauguuaaguugaaauuaguaucuaccgauaggcauuuucuuugaguuaauaugccauuuguauagcuguggaauuguagucuguggaagugacuagucgucccuguagcugccuaaucucugcucuuuaccuagucuccuuuugccuaauuugaacucuagauguugauguuuguguaaggcuugaauuguguuuuauuacucuucuggccaacuagaaucuagccuguagguauuuauccaucaggaguagcaggccacugucacucugcuuacacucaguugaaucauagcauuguccuuucuuaagcccagaaugucuguuuugguuuaaaauacuaaccaggcugcagccaucauaaaauaauccucuccugcagcauaacaagucauguucugcaacuucccuuccuugguuagguuuauguggguuugcuuguuuguuuggucuguuuuuguuuuucauacucuauugugguuugcuaacuuucuuaucagaagauaauuguggcuauuucuuauucaaguuauacagcucuggaacuuuuuauagguugcuuaucuauuaacugguagagcaagaauuagaagaaaugcuugugugcacacacccucauugguguguguuugugugugugucuacaaucaacccagguaugcuuaauauuugaucuugagugaaaugucucuugaaaugaauaauuagugaccaugauucauauaucagaaucugucuccuucugucauugcuuggucauuuagauggagucuguuugcuuuaccccuguagugguuagacuauugcuugagcucuacagagguucaaaugugagaaacguaaguguauguacugagaaguguuagauucuuuagaaaugauggcuuuguacaaaguaauugggucacugaggucauaauuaggucagaagggagugaauuagucugugggagugaaguccucugagggugguaguuauaaaagagcaaccauggcuucauaaucuggcuuccugucucaucaugugauuuuuuuuuuuuuuuuuuuuuuuuuuuuucugcauggcuccugccaauugcagugccaucuguccuuaccagaggucaaaccucuggggucauccacucuuggacucaaaacaacaagcuaaguagccucuauauaaagugugcauguauauuguuacaaggacagacuacuacagugacuugccaggugugugacaugagccaguucuaugacuucucuaauuuccucaccucugaaguuucuaccuccaaaggucauugugaagauuagaggggacaauucaggcaaagcauuucucauaaaaguccucuucuguucuaaucuuguccugcugugaguucacuggcagcuucuuuagucuuuucuaccccauugucucuuuacuggcaguggcaauaagauaccuaagugaauuuccaguagacaguuuugcagagagaacccagacagacaaacagacauggagauacaccuguaauucuaguauuaguguuauguagugagagacccucucucaaccucacccucccacccccgccaaaagguucuggagaaaggacuuaauagagcuguguuggagagaugucuguucccagcugcucauuagaacacugaaaccggagcaugggagcauaaaaugacaaguggcaggggaauggggcauuugauuuuguuuguuuguuuuuuaguucuaggagcuguaugucuuuggacagcagucuuuuuuguuuauguauaugacuaccuugcuuguguauauguuuguguaacauguguguaccuguugucaaggucagaaaaaggcauuggauccccuggaucugccaugugggugcugagaauugaacuuggucucucugcaagagcaauauguagucauaaucucugccaucucuccaguucgagacaguaugucuucuuuuuuucuuuuucuuuuuucuuuuuuuuuucuccuuuuaaaauuuuuggaacacuuacaauaccuuuuuuuuuuuugcauucauaaacuauaaaagccauguuuuccuggaguaguacccacaauugaaaugauccuuugcuagaacugucaaugguggcaaaagguaaagacagcucccugcugucuaaaacaguuugaauuguuuguuuguuuucuuguguuggguuuuuuuguuuuuguuuuucaauauaauauuuuuaucaauuaucugggaauugcauaccgugcacccuaaucacauuuacuucccaguccuuucauguccuuguccuaccuuugugaccuccuccucaaaaaguaaacauaagaauagaaaaaaugaaaggggggcagggcgggaacgaaggaagcgagggagggaagggagggggagggaagaaaggaaaaaagucagucuguccaauuuguguuacuuguauacucacuggagcauggucagacuccaucaggcugcccuaaaagagaacugaguccuuccccacccugcaccugacagaugccgucaguucugaguucuuuccauauaccguucagguaaggcgggauccuugacuguaaugagaaauuucaggauagacuacuauguaacugaugggaguuuauuaaaaggaugauuuuuguuuuguuuuuaaaugugauuuuaagugcagagagaggcacucaggaaaggauaaaucacacccaaguauauguaugaguuucccaagguaaagcugugcuuuauuguguucacagugaucauaagugugacucugagucucagagcuaugagcuucaaaggguugcugagaaauggaaaugaggagccagaugguagaggugcuucccgccaaggccgcuaagcugaguuugcuuuucaggacgcacauggucgaacugauuccucugauuucauaagaaugugcaucuacacaucaaacaaauguaauaccugcauacaggaaaauuccugaaauaaaagacaggauuagagucgauaaggucacauucuagaucauagggauguuagaaguucagcuaucuucacuauaaacaaaagucuuugugagaguuccagaaaauacccaagaauagaguaguacuguaccugagauccuaaauucccagacuuuaaguguggcucugugauuacuacuucaacauuauuugaaaauauaucuguaaaacgaauggugucuguacagcagauuuuguucugugugcuggaauucuugauuuucagcugacaauagacuucacauagucucugcaacgagggacuccuuuucuuucccucuccuccugcccuaccucaaaccuaccaccaaaagauuuuggguuuccacugaaguauucuuugauguuagguuacacuucagcugguuuugauuuagaacguguucucaucucugacucccauuuggcaagcugaaaugaguugggaugaugguuuucuaggcccaguaacuuggaaggugaaauggggauucacuugaguccgggaguucaacgcugagauuggcaauguagucccacuguagaaucuauuucaggaauuggagguaggcucaaagauuucacuauugaauauuaauauuguccuaaguguuagauguuuuuaugucaaauaaggguaagaagguagaggaaaaaaggcacucacuguaggugccuaaugacccacauuuuguuacauuuggcauaguuuucuuuuuuuaauuuuuaauuuaguauaggcuuuuuauuaggcuguauauugcuuaccauuguuuccaaaacucuucccuuaucuucucuauaucccaucacauaaagccacauuccugugauugcucucauuagaaaauaaauauguaucaaacacaugacaaauacauacaaugcauaaaguaagauaaaguacuauuaaguaaaacaaggucacaaaagauaaaacaagcaaaugagcaacaaaaaauuaacaaaguuagaguuaaauuucaagaagguaauaaagacagaaagauacauauuugggacuaagcaauucccauagauguacaaaaugugaaguauaauaugaacaaaacaauaauucuaaaaaaugaacagagaauauaaagauaaaaugagaagauaaaacaaaccugcaaauauauaagcgaguuuacucuuguuagccaucuucuucugggcauggaguuugguuuuaauuguaguuuguaugcccuaugagacucuugggaaaguucuuaauuuuggcaugguuauaaguuguagauaucuuauagguuaggaauugcugaauaugcuaaauucccaucucacuaaugggaaggcuuuuggcuuagaacuugcugcccauguucaggugauuacaaucacugugaguucauauuaguaucagcccugcacugucuagcaacucacauuacuauuguuauaucccuauugaaucucacaguuucauccuccucugcaaacguuuacugacaaauguguauaggaauuugauggagauuauuuuguccauuuuuauaaauuauuuuacuauuauccaucuggaauaguuuucuuagaguaaucaaaugccccuuaagaggaaauauguuaccaggaccuuuuugaccauuuguuuuuaagaauuccauuuagauaauacaguguuuuuauauucaguguuacuuugacaaucaagugauuaacaguuaaaguuacugauuuguccucaauauacuugauucauucuucuuaauaagaaacauucuaauuuuaaugcaaauuuaacuacauccucaguauaaucauuaauguuagcaacugauugcauuccugaguuugaaaguuuguucuugauaguguagaacucucagacuacaaacaaaucauuuacagagucuauguaguugacaaaguagaagcuauuuugcauuuucaguaccuuaacuuuuucagagaaagcacuaaauaauuuagagugcuugucaguacagagagaaugauaauccagcucacugcuguauggucauuugaucuagauuuaugguauuucuuaaaauaaguuaugguuggaagaguauuuucuacuggccagaaccuuugcauguuaaccgagagaagggauaauguugauugauagagaaaggaaaggugauauuguacugcaaguaaauacuuuggauacugccugcuguuuguuaggaccuuaaacaaagugaaagagaugaaagauuauugaguaauguuccagguaaauagaaaguagguaagauaggcauacccuuagcuaacauguuauacacagcucagcauuuuuauuuggauguuuaugaguggaacccagggacuuguacaugcugaggaaguacugugccacugauuuacuucuucagcugaacugggaauuuuucuaaagucaugaucuuaagaaaucuggucauuucaucauguguuggcuaguuuuuaugucauuuuaacauaagcuagagucaucugagaggaaggagccuuaauugagaaaaugguccccuuaaguucaggcuauacaggcaaguaaucuuuuaggacauuuuuuuaaauuagugauugauguuggaaaaccuuuucauuguggguaaugcuacccuuagcugggugcuauaagaagcaggcuaagaaagccaugggaagcaaaccuauaagcagcacccuucuagggccucuguaucagcuccugacuccuguuugaguuuuugcccugacuucacuguucagcacugaugugaaaucacaagccaagccuuuccucugcaccuugcuuuuggucaugguguucaccacaguaguaaagcccuaacugagacacauccuuuacauccuuuacuugaucugcagcugauugcugacuagggcaagcaaccuucucauggacuucaugggaguugauuuuaaaguucagaaagauaaaaagcaggauaagaagugacuuaaagauagaaguuuucauuucugcaaagugugaauguccugaaauaaucugagcacaguccuuuaguaauuuuguuccguaaaauucugauucauuaugccaaccaaagaaaaaucuaggagaguggaguacccauggagcucccagccccaggcugguguggcagaccuuucugggcucuucucccagugugggagagaagcaugggcagaauucucauguggaucgaguucaccuuuggaaauaauuagggcagggagagugaaugagguuuuuucucccuaagaaaaguagggugugugugugugugugugugugugugugugugugccacaacuuuuccacuuaaccuuagaaguaggaccaaaaguggagugaagccagagaguacugacuucacugguuauguuauacaauagacauuuucauaagugcagugaacuaaauauggacccaagacuuaaauguggcaugcugaaaguugugauucuucaaaauuuagaugauuuugaaaaauuuuccagauguuuaguuguacuaccuuuacaguguaggcucucagaaagaguucuucuguauuuucacuaaaaccacuaccuaccuuccccugggcagcugauuucacaauggugcuauuugcaagagaccaucucuuuuauagucuguaacaguuucuuggaaauauguuuccuugcuccaucuauuuugcccaagaaacuuuuaaguccuuucaugugaggagagcauggugaacagaggagggcuagguuuucucuauacggacuucuauuuuucugcauuggaaaggaaaaagcacuuccugcacaagcaggagacccagaaaucugauguccaagcaccacaugaaaugacagggugcaacagagcaccuguagccccagugcucuagagacagagauugcaaucccugagguaaguagaauaaccagacuacccaaauaggcaagcccuggacuuugccuuaauacuaagauggaaaaugaucaagagaagcauucagugucaggcuuuggccuccaugugugauguacacaaaugcacacguguguauucauacccaacaugcauaugcaccaguacuugcacauaccacauacauacacauccaaagggguuggggcacuuugauuuuuuuucuuuuuuugacaacuucugagugucuguggaaaaggcuuacacuauucugggcaccuuucugcucauucauuggcuuacauguggcuuuucucccuuuugccaagucauuugccauccuuuucccucaucauguaugugaauauaugugauuauugaagacaacgcuuuugcuauuauucuguggcacauguauguggaggucagaagauagcuuuguggaauugauucuaucccuucaucuuuacuuggguucuggggaucauagccaggcugcacugucacuggcucucauacuuuuuauugucuuguugcaugaauuuaaaauguguuggugucacauaguugugcauagguuucauaugaaaauauaaauuguggccauuuuuccuuuuaccuuuuccuaucuugauucugugaguuuugagagcaacauuuuccucuauaguauuaaaauuagaagucccuguacccuuuuuuauuuaauguuacaauaaugucuagcaguuuagaacaaaagguaagcaauggaccauuaucaccuagcaggaguucaagagagccgaucgucauaacuucuucauacaugcuuuaaucuccaccuccuugaauuauuaccuaauuuccccuuaaauuugaguauuguuaauuugagcauuaccauuaagaguuaguuauccuuuuaaauaguaagaaggugauaaauacuacuuggucccuacuagcuguugauaacuaauuaauaaccauaguuuuucaaggaagacucuuagaugccuucaaacuugcugucuagcccaggaaugacauagagcuuuugguccuccccccaaguauuggaguuuuaagugugugacacugcucaguuucguuuugcuugagguugagccuaggacuucaugucuccugguaagauacuuuaccauuugagcuacaucccagccccagcaaacuuuguuauauuuaccuaaccaaaagcauuuauuaguacuaaaauugcaaauacucuuuuuuuuucuaaaguuuacagugggaucccccccccccaaccucuuuacagaaucauuugggaauaugaugauucuaaaacucaaaaaagagacaagucuuaaaugcuggcauuagcuagucaugguaauugcaucuguaucucagaacucuagaggcuaagcagugguuuaguaguucaaggccacccugugguacuuggacauaucaaaaacaaugaaaaguugaaguuuuccugaaucacuaaauguggguuucuucuacucuuucuuucuucuuguuuuuuguuuuuguuuaagacaauuucacuauguagcccaagcuggccacaaacuuuugcaucuuccugcuucacucuagccucccuagugugaaccaacauucagcaaacaucaguuuuuguauauuacaucuauauaaguauguuugguuuacaguuuauuauuuugugauguguguaauggugggugcccaaauaucauguguguggaggcagaggagaacucucaaggguaaucacuucucucuguccaccaaacuugcauccucaggcuugugcagcaaaugcuuuuacgcagugaaccccacugcucuguuccuauauuguuucucaaacuaaggaugaccaaaggaauaaguuuguauuaaauguuuucaagcuaagauuauaccaaagauaucaaaaaggcuaucuuuuggagguauacacuuugaccuguuuguagacagaaauauuuugaagguaacaccuuuacaauaauuuaaaaccaauuucauuuccacuguaaauauguauuuacuguguucggugguaaacauuaccuuuccuuuuaugauucaugaagagucuuaagcaucccugagcacuagcuaggaagugcuggcuuugaaugcuuuucaggaaccaguucuuuaggaauagaguagguaagggauuuauaucucugaugcuuuugauucugggcuuugagacacucaucucauggucaccuagcagaagauguucaaugaucauugcagaagauucccaguguuuuacauuguaucuugaaacuuugacucccauucuaauuuauuuuaaauaaaaaaacuuguuuuugaccuuuguuuuucacuuauuuauuggugggcagcuguguguagaggucagggcaccuuuuggaaguuggcuguuauccaccuucuugaagcagucucucuuguuucugccacucuauacuccaggcuagcuggcccauaaacuuccauaggagugcugggauuguagguauaugcuaucauauccaacuuuuaaaauguggguuucagggauugaacucauucuugagacuugugcagcaaacacuuuacccacucuuuaaucuuugguucuagccuuggacuuuagcuuccuuguauuuaggccaaugcuggaguccaguggauuucaacuuuaagaccaauaaagaacuauuacugaucccugugcuagagaaguagaaauugggcuauagcugacuugagaaagaccaguaccuagcaguucauuuugcagcuuuucaaaccacaaacaaaucaaaagagaaaagccugguuugagggugacggaguuaaacaugucuggucuuccuauaucaggaauuuagguuaucaagguuguggccaugcaguauagaggucaggucaguuuagaucagucugauugacuguuaaguaguuucugauuaauguguuucuacuuuuuccuccugauuaaaggaagcuucaaaauugguaaaagugauaaugacuuuagcauuaaaaauagugaaaauacacacauugugcauuguaacagauugggaaggagagacugccuuguccccacuuguaauuuuugcuaauuucuuuacuuaaauggcuuuuggguaccauuaaauucuugaagagaauauaguauagaccagaaaaucuugccgaucaaggacuugucaucuacuguaauacauuuagacuaucauaguuuaacuuucugcugauuacuuaaugauccagaagaaagaaaggagcuaauuuugaccagguuaguguaugcuguacugcuacaucauuuugccacugaccauacaaaaauuaacggugggaaagauguugguuuuuugagagugauuguauuugguguacuugaugugucaagggaaagaauguaaauuaaguauuacucugucauacaagcccuccaauguguuuguuaaaaugccuauuuuaaacugguaguuuaaaacacaaaugccacagugaccaacaaaacagaguguaguggguugaauugcauaggguagaauacagccuauugacugcugcuuucuuuuugagaaaugucuacaauucuacauuucguuuucuccacauauauuuaucccacuaccagcgcauagcauugugagagaagugucagccaggaugaauggucagagggacuuagaacuaaaagaaaaaagguucaguaauuguuuuuaagaaacccaaccuugcuguuacugccuucugcugugcuguuagguaagugguagauuuuaaaauuuauguggugcccuaacuggcuaagacgugggcggggggggggggggcuuauuguucacaugacuagauuggucuugcaguguauuuacuucuagacugcaaaucuuacguaaugagugauuuguguuguggaaggugauggaccugguauguauguaucugggcaauacuaauaucuauaacucagagcugagaauaauuuuuggacucaaaggccuagucauuuaaaaaccaacuguugugauauuuucauuucuugcuuuuaaccauuugcaguguuuucuguguaagucacauuuuaaaccuuuuaaaagacauaaaauaaugaaauuuuaaaauucaaacauaauuguaaaauacaagaauucaaauuucaguuuguuucauauaaaaagauggaauaaccuaauaaaacauguaucauuacaccuuucagauauaugugcuaaaaaacagccucaguuucuuuucucaaaaaauuguauuuugaaaauuguaauaugagugcuauauuuaccuauuucccuccucgucuuccuccuccaauuuuucugcuccuuucucagauucaugccuucuuauucuuugauuguuauuguuaacuacacguaccuuuauaaauauaaccugcuggguucauuuaguguuuagcucauguauacguguuuuggacugauggguugggaauagaucugcugucagaggcuugucccuugaacagacagucucucucaguccuuaauuaccuguagcuuuucaauuagggguagggacuugugagauuucucccauccacauuggcaaaacacccuguuuuuaaaguuuaguauuaaagauaaaacaaucuucucauuuagaaaugaagacauucuccuuuagaaaguacaacacuugauuaguaaaguccuaccucuccccaauuuuauacuuuguuuuuauuuaauugugaauucguaagaacaaagcuugucauagcauuaaaaucuuaagaacaacaauuuauacuuauacaauuugauuuugauaaaagaauuuccuuccuaaauaaaaacauacuaggaaaaugauacagcaacagcaacauuucucuugugaaggagauacauauuaguaugcuuggugauuuguuuuuuucuuuucccuauuauaaaguauuucagcaaaaagacuaaggcuuuuguuacugaaaucugauuccuucaguccaauuccuuauuuuaaguagaaaaccauuaguuuguauagaauuuuggcuguuagaacaagccacagaagagcccuaaauagcucagaagaguuuucuugagacaugagguagauauuuuggguggugcaaauuugaagacauuccucauugagcuuuaucuuugcacucuucagaguaaagacauaauuugggcgugggaauggcuuauuucuagcuguaagcucaaccagaaggaccucuaugucacauucugcaugcuuuacucuuaagcucuacagcucccccaaaagacuuugaucuucuccagguuggcucccagcuugaauaccggucacucuuauuagccccagaggagaugguggcaaagcuggaauuugccauccucuugccuuagccucuuagugcuuuggauauacagguauggaccuucauaccugaagaaagaaacugagugugugugugugugugugugugugugugugugugugcgugcgcauuuguauuucuuaaauauggucuuuuggguuuaaaauagcuuaaauuuuagguucgauuuggucugguauuauucaugauguauuuuauucugauuaagacgacaucaucuaccugcugcauucaaggaagugaucauuaaauuuagaucucaggaaaaaaaauauaaaaguugauagagagguccagagauagaggauuuaaccugcuuuuacuaccugggauaggaagagaaggcaggaauugggaugggagaaaaaaguuuugcccuugaguauucuguaagaacugguaauaucuuaugcaauggauacauuagaccagaucagucuguuguagaccugcguaaaggaaggcaaaacaucgcuguaaagcagaggccugaaagcagcugagguacugguagaugcucuuguccuagaugacuuggugaaagcuggauccaguuuagcccaagaaguugaaugcuuccccauucuuguuagccaagugaacuggaguucuugcaucuccuucgucuauaaaacagagcaggguaugcaguuucccacacuccugucuacuauguucguugugagauuuuccaaguacagaaacugcuguuuuacgccucuuacagcaaguuuuaagggaaaggaauuacgagcaguguggccacacauauugucuuugguccuuaggauugaagcugcaaucugacaaagcagcccucuaccacuggacuacacuacccacccuacccuccuuuacuuucacuuuuucauuuaugucacugaaaugguugugauuugucacuaguguuuugaugucaaugauuaacauucuuugucuuucuucuccagaugcaggaugcucuguaguaaaugugugugucccucuguccuuacugguaucauacaggguuguuaaguggaaggugugucuugguauuuuccauuggugcucuagauugaucguuagcuuuugcuuugguucugccuugauacugggcaaaacaagaaauuagcugaauuuggcguuuuaagcaaggagacauguuuguagauuaugaaaggcagugcacuguagaaagguuuaccucuugaacuguggugaaguguggggaagguuguaccaguucaacaaggaaggaagggagggaggaaacuccaaaucugagcaucguaacuugucaucauuauggggcaugugucaguaagcacucaccugugguguucuguccgacuguguccuguaacucucugagugaugaucauagucagcucaacuuagaugagcuugaaugcaguuguaagauaggaaaucugguuuuguuuuacuagaugcuugggaucauuagaauaucagcuuccaauguuuuuuuuuaauauuaugaaauuuaagcuuauagaaaguuauagcaauuacuuguaaguaauugcugugugccacuuagcggagucugaccucccuuaauaguuuguccaaaguauuauugcauuauucuagucagaauguucuuugauucugguuggguuuguuuuugugugugugugguuguauaugcugcacaguuguguguguguguguguacauauguggagaccaggagacaacuucagaaguaauuucuuaccagacaccaccaugucuucugaggcagggcugauuucccugacuucagggccagcccaauaaaagaggcuuucaggccagagaagaauaggcgcccuccuguuuggcuucccagcacuauguuccacucuuuccuguucuuaugguuuggagaugguugguugguugguugguugguugguugguugguugguugguuugcauggauuauagggucuaacucaacuacugugcuugcacagcaaguauuuuaccaacaauuaguguuuuuccugacuugagaauugacuuaugugcaucauauuguacauaucuuuuacuauguauucuuuuagcauaugaauauuuucauaaacaccuaaaacaaggauauuguauuuuauaagaacuuuaguguuaccagauuaagaaaauauaaaaccaguauucucuaacugcuuuuacugguuuucgcaauacuguuuauuuugaguuuuggggguuuuuuuuguuguuugcuugcuugcuuugcuuuuugagaccacaucuuacucuuaaacacagucuggcuugaaacucaguugcacaucuccaugcaaacaaacaacaaacaaacuauuccuaaaccaaaaauaauaggaaacaguggaacacagugcugggaauccuaggaagccagacaggaggaucccuaugcuucacuggccaggcaacccccuuuaaugggcuggcccuacaucagggaaaccagcccugccuuagaagauaaggugggugucuucuaaagaaugauuucugaaguugucuucaacauacguauacauauauaugcaauugugcagcccauacaaccuagaugcuagacauauagguauggaccccauauucccaguaaauguucauuagcuuaucuauuucaguucaggaaaucuaaccauaugacauuuucugccacauuucuuuguccucacucauguucuuaguaacauuuccuuaauuuguauuuguuuuuacagacauuaauguguuuaaaguggguggcaaacuuuuuguagaauauucaucagguugggcucaucaguguucaugacugagguuaggaaacaaucuaucugugguaugagcuucucauuguaccauaucaggaggcauguguccaacuguguauuugucaggaauaaauuuucauugucugauuagugugagaucugcuggaguccucuucuucaaaguucuaauaagucaccuguggagaugcaccuugauacuugguguaucuccagcccucauauaaccuucauccaugagcuuuaacccucucugauaauuuugccugaaucauugcagugacucuggugaucugucucaagacuucaauugugugagcucaaaacugcaagagggaaccuguuucagcugcuaugugugucccuuugcuuuaaagaguuuaguguuggacaagaagcugucaaucaacuuguaguuugucuuaagcacuuucgcauccucugagauaaacccgcucuuuuccuuucucuuuaacaguacuucaguugucuuccuuuuuccuccccuuucuugagguugcuccuuccaaguucccauaauuguuaucccaaagagauagcuuucugaauuuauaagcauccugucauguuccugauaaagcuuauuuacuuacuaguguuguacuugacuauaugauacacaauuccagaaauggcuugcuguuaauacuguggaucacucuagccugucauuuaaucaagccugaggccaagaguacuggguuuaggagacaaagauccagacucaguuccauagucugcaaagaguguguaauguauagaugcuuauaggaaggaggguggaaugcaucugcaaaauucuguguaaaagguuuucuaggaaguuacaaacuuugugaaaacuuggauuauuucuuagaucuuuuguguuuauauauguagauuauaaauauuuguuuugaauaaacuaagucauuuuuauagcauagcauaugugcaguauuuuggcuuagacaauguaaaguauucaaaauaauuguaaaauuaccaaccuugaaaguuauugcuuguguuuuuuuuuaaucaugcagcaucuguuaaguauuuaucuuauauucaugaaauaguaaagcuugcccgaaacuuuacuauagauaaguauagguauauugaagccuaucugcauacagaaaaagauauuuaucuggauuuucaaggacaauuuuauagaaauuuauuuuaccuaaaguuuauugccaauaagaaagaaaagcauugagccaucuaagccuaaagucugcccauauguguaacucucugucaaagccagaauuuuuuuuaguucuauaauuacuaauuuuauuuauuuuuuuauuaaauuuaccuccuggucacaguuccccacccuucucucuucccagucccacccuugcaaaucccuuuccguauugcccccuccuuuucucuuuagagaagggaaccucaacuuggguaccacccuauccuggggcaucuggucucagcaggacuggguauauccucaccacuaaggcccaaccaggcaguaggagaaagaggauucaguggcaaggaacugagaccgagacaaccccaguuccacuuguuauaagacaaccuacauguagaccaaguugcacauuugcuacaaaugugcaaggggucuagguccagcuccagcaugcucccugauuacauguuguuagccccaucccuuccccacuccccacccccugccaugguuccagguuaguugacucuguaggucuucuugugguguccuugaccccuccaguuugcccaauuucauccccaacucuuccacagccucauguuuggcugugggucucugcaucugccuccauccccugcuggaugaagaauaaggaauaaggcuagaauuuaaagauaagggcaauaauaccacugaagagcacucugcuucaguuuucuuacauucauuuacuuauuguggggagcauggacugaagaggguuauacauaugucacaacaugcauguggagguccaaggacaacuugaaucaguucuuugaucagugaauucuggggaucaaacucaagucuucaggcuuggcugcaagagcccuuaccagaugauucaucuuacuagucucugcaucaaauuuuaaaguaaugccauuuuuaucuaggagaauagauuuuuuuuuuuaauggaaucuucuaacuaaaauauuucuguuuguuucugcagugcaaguugucauuauuacugccuauguauacguuagugaaguggagauaggauuuuaucuuagcuguaauuaccuccuaauucguaaacauugugauuuucuuguguuuauuuuaaccauucaguaugaauaggauuaaguauuucuuacagaaaugcagucuuauuuuccagggaagccuucucccaccuuauuuauccacagcagugguggcacuguaggacaaaaacaggaccugugcugcaggucuucauggcgcaugucagacagaaagguaguaacucccgcuguaagaaaaagacuaggacuucugucucuuaagagcuguuacagagcuguccuuggagcacugaaggcccuugaccacuuguaaagauguagcaguuauuuuaaauaaacugguggggcaguuauucuaaauaaauugcuaagcuucagaaaaauuaaagaacaccaguuuaacuaacuuugggucaaaugauuauacaaaguaauucucgcuaacacagccuacagcccuguguagaagaaguguuagguuauggcuauguauuaacuacauucuuucauuugugucaacacccccuuuugugucccugaaauaaugaaagcauuccuuuaacuuuuagaugauuaaaauguuaauuuacauuauaaguuuuaacugucucaacucuguuucauguuaaauguguuacaggaaugaaucugaagucugcugcaguaaaacacugaaggcuuuaaaauguuuucuugcauaaaagucaaacuuuaaguagcugcuuaugaggauagggaaggcaggaagcuaaugucugucucaagacacaggacagcuguuugcucaucaaccucaacugugugaguagagaccuaagccuguaaccuuauguaagugggccuaaaacuuaguuaaaaagcuaaaguuugugaagauucaccuaagucagcaugauacgauacaaacgacuucaaggccucuuguuucugguggguaggauuugagggguggaguggcuaggagguauuuagucauaagauacuauuaguaguaacgcaaugcuagugaucauacaucuuuaagaaauuauccuaaguuagcaucugcaugauuaauuuucuugugaagaagaugauuuuuuuuagauugcuguuuauuuuacaguuaauuucagccaacuauaaaacuuauuuuaggaauuaagugauauuaauauggaacuuuuuuccuuauaauuuaguaauauagaaagagcauuaccuaaaacuaaaggaauguugauuauuucuuaaaugcaguuugaaauguuuuaauauauuuuauuauuaaaguacuuagacaaguuaaauucauagugauggggaaaaggaguuuucucucuuuugcaaagauuauccccucaagaauccucuuaggaagacaccuuuguuuccuacuucaguuuuuauuguugaugaugaauuuuaggaaugaggcucuaauuuggauuccccucccuucagacgaauguguguuauguguggauggguuuuuggaaguuugcagggacugagcaggcuggucagccugucacagacucagcguuuaacugugggugaggcaaagaacaucagcaguuguuugcuuaguguauuuguaucuaaggugagucacuuucucuuuaaugucacaaagggacuauccuucaaagcagugaacaagaagacacaggagugcugagugcauacugaaucuggauaauuccuuuggaaaaaacuaagguuucuguuugcugauucugcuuuuuauugguuagucaggugauacacagaugucuguaucugagaagcuucaaaggagugauauuauaaucccuuguuuaagaaugacaagccucccuguccugaugcucuggccuauuaaacaggcaauuuaacucuuuagccaguuguugacacuuacugguaaagcuaagauaaauuauuuagggcugcacuuuuaaaagaaaggggagggaucagaagucuaacacuuuucccucucauuuuagucaaaaauaaagaaaguucaaguugaaagaagccuuuggaguguggucucuaaagccagacuagggagaaaggagaaagaaugaguaggaaagggaagccucauaacuagaaagcauguuggaacaaaguaacuaguaaauggguggcagguuucccucuggcuucugccacucuggagugagucucucucuguucaguaguucucuuaucaaggcuaugcaggacagagguaaggagcgguacagccuauguccguguagauaaugugaugcgcacauucuucucucucucccccgcccugcccuuaccuugcuuaccaggaggguguauaggcuuguugauccuggucucuuacccagauugauuugcuuuuucauuuauuaugcagugugauuauggaguucuggcuacaugugaacgaguggucauuaaguaccgagacuagaaagucagucagguuguccugguucacauccuagguaucacuuuaacagucacaugauacugaggaaucacuuagccucuccgugccucuguaaaacucaaggauaauuucccagcuaacacagugguagaguuagugauucacagcacuugcaaaugacuaccaucaacacuaugaagccucuguuucuucuuugagaggaauaauacuaggaaauauaaauccucaaaguaauaguuaauuuuucuuugauuucugucaugcugaggauugaaucuggaguaucauucaugcuaggcauguacucuuuucacagcuacauucccagcccccaaauaauagacuuuggaggugugugugugugugugugugugugugugugugugagagagagagagagagagagagaaagagagagagagagaguggggggguggaaauguguguuucuagagaucuaacucacguugacugcaagcuccuuuacccacugagacaucucucaacccaauauuaagaauucagaaaugagcauauucagcuaagacaccauaagaaacacccccagcacagugagucaugaccuuuacucaccuguccuccuauucugaacugcugccaguauccacccauuucacacucuagagagccgcacaaggguuagugauguacuguuucugacagugcuguucuguaggaugacacuggguacagugcuauauaaagccggauguuuauugguggugccaucguguuugucuugccugaugugggugcuggaaacugaauuuguuccucagcaaaaagcaguaguacaccaaugcuuguaacuucugagccaucucucucuagcccugcaguaauaguuuuuaaauaugaaauugguagguaagcaagcauuaguauagcuacugauauaguuuguuagugacuacauuuuggguuaaaguucaccacuucuuuguguuaugaaaaugaaagcuaacuacccccagggugggucuuagggacauacaauaguguuuccaaauguauuuuagucauuugaacuccuuugcucaaauaaaaucauugcuagaaauaggacauuguaaaaauaccaaaaaggaacuguuagagcagauuuguggugcgcucugccccuuuaguuuucuuuuucugcagucuuuuccuccagcuguguacuugaugaaacaaaacauacuuacaucacauaaaccugaggaagauuuaccuaagugguaagauucacaaaaacuauguacauuguuguguuuuuaauuuuucaguuuguaacucuggccucuuaguagaugggcuauuaucuaaagcuaguuaugguacuauaaauauuaaauugaaaaaaaugauaucagaaaacaagcauugaguuccguguuucauuuuauagauguuggccauaucauuuuuuuuuucuacuuagaggcuauauuaagucuccuguguuaucugggugaagguuaaaguuuauuucuccuaaguaauuuguuuuucuuuagaauauugugccuauuaaguauucaaauacucuuauuaguuguacuaacugauggagaggaauaacaccaguuaguuucaaauuagcaaguagaucauauugacuuacuucauuuuauuuaaugacaguguauuguugcuuuucucauuucugugaggaaggggaaaaauccucaggcagcugugauugcuuagcagguaaagacaccugcugccaagccugacaaccuaaguuugaucuccaggacucacaugguagagugagaaaacugauuucuaugcguguauccucugaccuccacacaugugcuauggcacacguuacucugucucaacaaauacauaaauaccauccuaguuaggguuacuauuaacugcgaugaaacaccaugaccauggcaacucuuacaaaagauaguauuuaauuggggcuuacuuacauuuggaggauucuuucauuauugucauagugaaagcauggcagcaugcaggcagacauggcacuggagagguagcugagaguucuauauccagauggccaggcagcaggaagacacugggcuagcuugaacaauugaaauccaaagcccagugacacacuuccuucaacaacgccauaucuccuaguagugccacucccuaugagagccaucuucauucaaaccaccacaaauauauuuuaauauuuuaggaaaguaaguuaucaaaucuucccauacucccucccuucuaauuuucuuccauccuccauaacuaacuauuccuuccaauuucaugugcccugccacugauuuauuuuuaaguguguguauggggaaggguguggggauguguaugugcucacagagaguauugcagucccuggagcuggaauuacaggcaauagcagucugauauagcugcugggaacugaauggaggaacaguacaugcuuuuaaugaugaaccaucucucccuuguaccuuuuauuuuuuauaaacgcaaugagucuacuuaguaccgccagugugugucuguguguauguguguaacauauacacauagccucuuaggggcuacaguuuuauaaauugacaaaagcaacuuaagggucuauuuuggcugacaguacaaggguacaguuaugauggcaggagugaagcacagcuguuacauuguauccacaguagguaagcagaaagccaguagugcugguacucugguguuuuguuuuguuguuguuguuguuguuguuuuuauuuuuauuuuguuugguuuuggcuuuauuuuuuuccccuuuuuaugcaguucgggaugcaagcccaugugaugacuuuacccacuuucaugauacaucuuucuucuacugaaaacacucucguagguacacugagagguauuuauauguucagggugauucuaaaucuaaucaaauuaacagugaaguuuaaccaacacagacacuaucucugacuucguuuuuugauagccauuuuuauuuacuuuugaugucaugcaacauucauuuuuaucccugugaacucucuucaaaacaauaugaaauuaaauguuaaaugacaguauauagugagauguacuuucuagggcuccuuccaguuauaaguugggagaauucccuguuuccuuaucauuuuacugcaaacuccuuggcaugguuaauaagcuuuucacaguguuaccuuagucuguuucuaagguuguuuccaguguuugauauuccaagugcauagaauucuuucccaggaagaaugcaguugugcaucuguuagcuguggacacauugagcauauacuagugaaaacugagacagcaauggaauugcuaggcaauauaaccuauggaacuaccggccauuuauugaagugcuguuguguggaguuuguacuuguuuuuauccuucugcaaugacaaaugcucacuauaaacaauuagaaaguuuguauuagcaaaauaacugacacauuauuuuaugagcuugaguuauaaaccauucccugauacugcuggcugagagagagagugguaucaucucagguagaggugaggcauuuucaacuaauuccuaacaagugaucuauugugugguaagcaggccuuugaggcaguguccuuguugaaccacgacugcagaaaaauaaucuuggaguaacaacugcaguugcagauguaaaagucacccaaaucuaaugugaguuuaguacugcuuucuuuaugcugccguguguuuucauagucauugagugggcucuuccuaagacuccuguggaacagaaaagacagguaucggucgggcgugguggcgcacgccuuuaaucccagcacuugggaggcagaggcaggaggauuuuugaguuccaggauagccuggucuacaaagugagagaaacccugucucgaaaaaccaacccccccccccaaaagaaagaaaagauagguauuacaccucccucugugugaggggcucggacuaagcacuaacaggaccgugucauaaucaaagcugguuuuagaauuaagccaagcccauuguucucuucacugcauuaccuuacacaugaaguuaagccuuuauauuuaguuguucuacugugaacuauagucaggucucuuuuaggauguuuguuauccauuacuucaagugacugcauccucacugaaagaaaaaucagccucuggaaugccaugcaccuuguuauuugccugcuuguuuuguggugcuagggaucaaauccaaggccuugugcauguucacaggaacuccacuacuccuuuuagcuacugaucuuuauuuuggucaaaaaaaaaaaaacccucuaaaguuagaaugauuauauuucuaaauuuuguugaguacuuguuagcacuuugugguuuuauagcuguuuugauuuugaagguagacgacuguuucucuguaguuacaugaaaaucagacauuugugucuguguccuuguaccuaugggauugaauccaugccaaccauaugauauaccuuagaacuauacucucagcucccuacauuaacucuugcaagcagaagcugcggcauaaaacuucuauuauaguaaccagaagaauaguuggcagcauggucaguguaucauccuugaaaaaagcucuaauaaaagaaaagcugcuuugcugucaagaagucuugcuguguuuuuccuaauaacauuucuaaccaaggaaguuuugaaagcauucauguauucaucugacuugaguaccuaauuguuuauacugaacuugaagcaggaguuggcaaacccuggcccacuaacccaauccuucucagucaccuuuuauuguaaguacacuucauuuguuaacauuuaugugugguuucuuuucauuaccaacguagaacuugagaguucccauagagacuguguagcucacaaagcccaauauuuauuauuggugcuuagaggaaaaguuugccaaccucauucuagaguaauugaaaauacaacucugagaagaaaagaaagugcuuuguguauuaaaucugauuuuucucuuuucuguccuuaaagacagguuauuugucuauccuucgucuuucaguugauccugaaggcacugcugcugauugcaggcagcuguagcuauaacaaucugccucugggcuuuuaggacucuguuuccucagugagcaggccuguucucugaaaugagagccaugaaccuuaacucuguccaaagggacuucuguugcuaucauguggacaggaaacuaucaugaagaagacuuuauuccaaggugucauuaccccagaaaggaucaaagaggaauaaacuacugcagaaucugcaccaagauuaaauaaaguuaauaauuuuauuucuaggaacuacuguuuauaugauuucagagcuaaucaugugguguccaauagucaguuugguguguuuugcccuggggaagacuauuaguccuguugucaccauuucuuagcugagaacuaacacaaaagaacacagaguaguucuuuguguaggauuaaggccuuauguucauguuggugagacuuuagcuuuugauauuacuaggagacaggacaaccuccaugauccucuagcucuuagucuuucugccuccucuucugcaauacuucuugagcuuuaggaugcaggaauguuuuguccagugggacccuaugacucugcauuuugauugguuaugguuuucuguaaugguuuucaucugagcaacaaguuacccauaucucuagccucuauaagauuaacuuuuaagaagagauaaagaccuuuccaagaguuuuagagguagccaaguugguagagugauugccugguaugcaugaagcccaggguuccauccccagcaacaguuuguaagugguagcacauguaauccuagcacuugggagguagagaguaacaagauuaaaaauguagccaaauagcuacauaggccagcuuaggcuauaugagagccuuaaaaauauaaaaugaauuuuucaaaaagaacugcugucuuucauguuaagaguauagugauaaaguguauaacaacuucugacacaauucagugccaccucuaagaugucagcuguuuuaucuucgcuuuuauauugccgacuuaaauaccaaaagauugaaaaagacaaguucuuuguuguuuuauguuuugaggcaaggccuuacuguguagcacuggucguccuggaacuugcugucugaucuucuugccuugucuucucaguacuguaauucugucucugugcuucugcacugggugcuuuuuugaaguggggguuucacuauauuguguaggguggcuuuguacuuagguggaagugaucugcuuucuucagcuuuccaguaccuaaaaguacagggacaugauagggcuauaaauuguuauugccuugaaaguaguuuugaccuccauaaacucagaaagggucucagggaauccccauauguaggcuuugaauacuugguuuagccaguagcuugagagauuagguugaauccuaaguauuuuuaucuauaauaaaaucagcuccuuauauaaaaaucauuguacaaaauucuaaaagauuuagagaaagauguuacugaacugaagaacuuaagcaaggcaguccauucacaaaggcgguaaacuaaauuagagauuuacuuaaagugguguuagagaugaaggaggugaagcuaccugugugcuaaauggcuacauggaaguuguggcuggaugguuuagaagcuuuaaggucaaagaggaggaaaugaaagggcuuauggguauggauccuguguauuacagacuauacuuuauaguuuggguuuuguggggcgaggauguuuuguuuugagaaacagaugaaaauccaagagugaggcggccauuggagagcucugacuugugaaagacaggauauugagugacuuuauguagguaagcacugacuuauuuugaagacaauugguacaaaaccaagaucuguuuugagagcaugcuagcuauugaauggagcucucagcugcuuuccaaugugccuucuuuaugaugcagcaaccagcuuuccccacaguagcaagcauauggaugaacaucaugacccacaguaagcauaaaauggucuuuggguuaauuacaaaugagaaaagcgugaaucauaaucuugcauuauuccacauuuuaaaaaaaaguuaaauccagauaaauugccauugaaagauaaaauaaccaaguuuagaaguauauaauaucuucaugaucuuggaauagacaguggcuuguuaaauagcaccuaacuaaauaaggacauuguuaacuuaguaucacuaugaugagauaucuaauagggaaacuuucaggaagaaaauuuacuuuggcucagugucagggcuuaucaugguagggaaguacaugggguuagaagcguguucaagggguuauaggcccucauaucacaguggaccaggaagcagagucuaagccugaaaccaggggcgugguaucaccuucaaacgccgguuccuaggaaccauuucuccagguagacccuacuuccuaaagguucugcagcuucccaaaacauugcuaccagccagggaagacacauuuaaagcaucagcuuguagaaucaaacuagacuugaaauagaaaagacaagccacauagggggaaacauauguaagaagguaauacaacagaaaacagguaaugaagacagaagaggaugcccaauagccggucagaacauccagugauggggaagcuacaagguggcucugagauaagacagggaggcacagaguauuuacauaggaggguuaauuucucagaguuucugaagccagcuaauagaauccggguaguaaaaagcaaagaaauucauucucuugauuuuaaaguccagaagucagaaaugaaguuauugcugagcaucucaaagcuugcugugccccuuuuaagguucaccugauuaauccagggugagaucuccucagauucuuaaucuguuugagaaaguacuuagagcuugaaggaauaggguauggacaucuuuguauuggacuuccagcccaguucaggagaaagacaguauugaggauggguaagcucaggaauauccugggacuuuuacuuccaggaaaguguaaagauuuguaacugcuugggaaacuguguaguggucucugcugaaguugaaaguuccucuucccaaugauacaacauucccacucuuagguauaugcaggcuaaguauggaugcaauuuagccagaagcuauguaaauaauaucccaacagcuuuguuucuagaaguccuagacaagaaaguuugaaaauccccaucagcauuagauaguccuucacgccauggagcauugugugcagggaugagaauaagcacaccgcaguuacauaaaggguacgguugaauuucacaguguuagguguuaguuacauaauuccuuuacagaaguuuacgagccagaaagcuacuaaguaucgaauguacucaggcaugaacacacacauacacuggacacuuccccaccuugcucccuucuuuugaccuugagcuuacagagcuggaaguagggcuaugugucauguccagcuacaguggcccauuuugagauuuaucauccaggccuauggaaacuucccuguagcaguagcaggauaaguguggauuauacuagaacacaucuaacauugauguaauuauauguaggaaugcuaugcuuuauauaugcuaggaaaauauccccagagaucuuauccauauguuagguagauucaauggccuuuuuguuuuucagugcaagcaacagcaggaaagacaacucgacuuagggaucuggggacugcuaugcagagaguuaucaagccuacaguacaguaggaacuuuaaccuaagucccuguucuuucaucugagugagcagcuuucuucccaagugcuuucugucaagguguguuuuccauuugauuugugaccuuccuggauagccugcagaauaucucaauaaaucucucucucucucucuucccccucucccccucccuucucccccucccuucucccccucccuuuuccccucuccuccccuucccccucucucucccucucucucccaucuccccuuccuccccucccuucgcucccucuccccuccccucccauccuccccucccucccuucccccacucccucguguguguguguguguguguguguguguguguguguguguguguguguguguguguguguguguucggauuuggaggugcugauguucagaacucuaagaauuacuaugucaaauugagcauugauauuuggaucacuuacuguuaaaaauuuuuauaguaaagguuacuuuagaaucuauuuugcuuucuccugggauucucucucuuuuuuuuuuuuuaauaaaaaacagagaacuagccaacugugggugguuagcuuucuagugauuaaagagagacagcuggacauggugcugcacacuuuaaucccaacacucaggaggcagaagaaaauggaucucugaguuuaagaccagccugguuuacauucugaguuccaggcuagccugagcuacaaagugagacugccucaaaaaaacaaaagcaaaaaaaaaucagaaagacagauaggagggacuucgggaguuuguaccagaaugauagcucacuguaauuggcauuuuuauuuaauuugcuauauuguauaugcaccccccacaugccuaacuucuuuugaaauuacuaguaaagguuccaaauucaggaaaucaaauucauguuaaaaaacaaucucggaugagggucauaagagaugacucugguucaaaagccuccaguuugguuccuagcacacaugugacagcucacagacaucuaaccccaaguccaggggauccaaugcccuucuggccucuacaggcaccaggcacacaugucuuuugugugugugugugugugugugugugugugugugugugucuauaauuuuuuuuuaaccacugcuaggagaggaggaaggguccaaagaguauguauauagccucuggugaguugagcaugugccaguggauggucacacacaaaauuguuuggccagcacaaauaggccuugaugaggguggggaaugacucaaaguugagugggguggacuucagaggaguugggaaaggagggugaauauaaucaaaacacuguaugcaaaauucucaaagaacuaagugugugugugugugugugugugagagagagagagagagagagagagagagagagagagaauaucugacaaacaauaagacugaugaaccagugggcagacauauagaggucauccuaaagaguuaagccugccuagcaagcuucaauuuugagaacaugaacucacucugagaggucuuccuguuuuacuggaaaaccugaaauuuuuaugugacauucaccaaauuuugaggauuaauagcuaaguaauuuuaauaugugcuggccaaccaaauagggcugaguaagauuaaauuggcauuuuacagguuuucuggacugacuccucacuguaaacuauuucuuucuuguuuccuuuagaucaaggcaagaaaacaauaggaguauguguguaugcauuucuuuuauaaccaguuuaagcugcuaggcaucuguucugaauaacauuuccauauuacuuuaauaauaauuauuucauaagauucauaugggcauaaaauggauuugaacaagauucauagagcugggaugugaguugcuagguugccuaugguaagauuuaagcauccuaaagagugccauaagcagcuuucugagaaaugcaggagagacugauuuccugaaauagauaggacauagugcugcggcagacagcaucuacaggaaaggagaagcaggagcuaagaaugagcaaagaacuggcccuuguacuucuaggcauagcugaguuagagcagugauugagcuuuagcuguaugguuggcacuguaugcaucauuuaauguguuggguagguaaugcaucuguucgcagagcaucaacccuaggguagguuagugacauguucaaacucuuacaaacaagaaaaaggccaaguugggaauuggacuguugcuaacugacuccgaguauucucauuuuacacaguauacuuuauguggaaaguaggcuaagcuggguacauuaugcagaccaugaaugcuugguuggguauucuucaagggcauuuacuauacaauaacucaaacuagguguuccaggagagcugaagucaguagaacucgaagcaagguaguaaaacagaaaaaaauagugcagcuguuguguacauagaacucaaucuccaggcuccuugucccuccaagcuuuucgucccucgucugcuugaagggacaaaagucagcauuggaaugggaaguaaaauagcaugagauucccaaaugaagucacuggaacugguaaguucacuguaggaaaugaaacaaaggccuguccuuagaacugucucuugccuucguucauugcucuucuuuuguaggaauuuuaauuuguaaugaauucucuugcauucucagacuaugcaaucuugaauuuuuauauagauaaggacuucguuagaggaaaagacaaaauggaaaaauuaauuauuuugaguacaguagguuguagcuaguuaaaguugcauauuaucuaagacugaacaauuaaguaaaguuuaagcugauuuuuaagugcaaauaauaaaaauucuuggaugucuuaaaauuagguuugucuuaaauacaaucauccuucuaauuguuuaauauuagaagacuaauuuguaggcugaggagaugauuuugcaguuaagagcacuagcuuguucuaccagagguccugaguucaauucccagcaaccacaugguggcucacaaccaucuauaaugggauuuuaugcccucuucugggcacucacuggggucucauaauaacaucuuggagaguuguuuagaaauaaauggcauaaggacaaaacaacagucccacaguaaguucugaauaacugugaugcauuagagagcauaguuuaugaauuugacugugacaagaccguucaauacuuuggauucaauucaugagcuguuuuuuaucacuguacugugcuaggcagaguucacucucaggccuggcauuuuucacugcucuucuucuuggauuugcagcugcggagucccacaguacaguaugaagaauugaucugccuucuucucuuaccuuacccauuuuacuccuggauaguuucagugccagauuuaugcccugcaaguuauucacccacuagaaagggcagaagaguaaggaagaguugaccugggguuuuccacagugcccuuguuguggcacugccuuccuagaaauuguuacucuuugugggguuuuuuuguuggugguggugguggugguuuuuuuuuggaucauuuugaaucuuuacaaaagguacuuuuucaguguuuugaaaaugaauuaaguaugguugaaucuauuuauaagcaauuuccugugucuccugaauucugaaaaauuacuguuugcuagcuacugugcaggacaauuuggcuuaggaaauaauagccagaguuggaugguauugaguuuaauguugguuuugaaguuaaauguggcagaagagcuugauuaucguauuuuacuuuuaucucugucugcuuaccuaaguauucauagaaauacaucccucucuuuuugggguguuguggcuuucauuuauacacuuaucuauaucaugaggaaaaacaccuuuauuauaccuuacuuuaaucuguuguuuaguggcaugauauggcaugauauaguaacagguuggaccuguauguuuacaaugucuuugucucuauuauguaucccagggaaucuuguuaggugcucuccccacccccaaguggucuccacuuacaaaaaauuuuaaguccauagauaaugcuguauaagucaguuuugugccucuuuucacaaaagaaauguauguuagcccucuugaauguacauuuugcagcaaugaauucucagaauguugguucagggaucuuaaugcuuucuaaaaugaaugaaugccaugaagagauuuuguuuuaaauauuguauuugguacuauuuagcauaugacagguaaaacugaggggaaaauuuaauacuaauuguaaauguuuuaauggaaaguacaccuguguucuuccccccacccacccacccacacacauuuuuuagugauaaaagacuuaaugaaacaagagauuagugguugcuuugaauuuaauauauacagugccguaaaagaaaaucugggcccuuauaguugaaaaaagaauguuuuaauaaccuucccagaugaugaaagaugguguucuuuaauacuacaccaaaacuugacaguugauaguuucuucagggaugauugcagaguagacucugguagcauauaaaaccucuuugucuucuuguuggcgugucuuuccauuugaauggcucuuuuguucaugaaugauuuugugcugacauacauugggucugauuuaaggaggucuuuaaauguuagaucuguaucauucaguuaugccacuaaucucacuaaaacacucaaaauauuggagacuuguuuaagcccuuuucuggcugacuccuuguuagugacugcuuacagauuguuauuugaaguaacagguacacuuacuuuguuuuagaaaaugucugcuauauacucaaguauuaauaaucaguuuuuaucaaguuguucuguuaaauaaaguuguucauugaaagagcaauucagucaccucacaauucaaauaguugcacaaccauuuuuuucuuuagauauauuucuccaaaauguaaaaauacuucauaggugacccucaccccaguuagucacauaaaauauuaaaaagguguaguggcacaugcuugugaccccccaaaauuccauucucaaaaaaaaaaaaaaguguccuugggcaagauuuaacaaauacauggcuuuuugcucuggguguagcaugaugaugucugcuaguacacuuuguuccacugccuguuuggcccauugaaaggugcuggcugaaacacaccccugcuuuugcaccacugcagaaggaucauugacaguauguguuuuguuuuguuuuguuuuguuuuuuguuuuaaggcagguaacuuguuaauguuguuuugaggauaguguugaccuccauacaaacucauggaccauauuuuuaaaaccacuaguuuagaaccuggacuuugguauagcuaggcuaucuggaugaaccccagcuccauuacuugauuauuuuuaucaugaugagcagucauccugacuuuuaaaaacuagacaaacacaaagaaagaacauagggcuagggagaugguucaguggauaaaguguuugauguacaagccuacggauccgaguugagaucccuugcagauacguaaaaagcaaaacacugcagcgugcauccuguguaauccaagugcuaggaauguaaagacagaaguggcacuggccagccagccagucuagcuguauugguucagugaggaacuguuucuaaguguaggguugaaagugacugaggaaaagacgcguuauaguuuuaaccucugaccucaacacaggugugcauacaaaaugagcaugcacauacacacuauauuaauacauacacacucaaaagagaauagacuagugucccucaggaacaucuacccgucaaacugcuucucuauauugucuuuuaauuugacauaugaauauacggaacuccaggaaacagaugacugguacaacaugauguugucucugucucuuucuucccccccccuccuuuuuucccccuuccuucccccucccuugucugucucugucuuucccucucccccacccuccauuucucucugacaagaaugggauucugaaagaacuugccauggagugaaaaauaagcuugucagaaucucagauuauauucccagcuaacguguaaaguagcaucccuuaacgcuuugagaccuuuucuauuauuugagguuucugcuuuuguuuuccugguuuuaggcagagucacgcuagguagcccuggcaggccuggaacuccauguaguugagaucagugucuagggauccucuugacucagccuuccaaguguuguaauuacagguauacauuaccuuguccacacccagcuaggucauuucuucuuuuuuuuuucuuucauuuuuuucuuccuucauuuguuuguuuugagacggucucauuauguaacacugacuggccuagaacuugcuauggagaccaagcuagacagugucucacagagaucugccuguuucugccucugagugcugugauuaaaggagugcucuaccauggugcucugagacauugcuuuuaaugguaguuagggguaagucugcagcuucuuguaaugcagacagaggaacuugugguuauugguuauuaaauuucauacaucuuuacccugaacaaucuucaaaacauucaguggagaaaacucugcucugugaauagugaaugcuuuccuuagauguuuaccaagucaaggcaauuucagugacaaaguguuuucuguuuugaguacuauucuuuuuuggucuguaguaacguuccuuuagaaggaguucuuuuuaauaagccugcuauuacuguuugcugcuguggguugugugugccaagucacuaguugcuuucugggaggaauagcaugugaaauucuuccaucugcuuugauugaucaucgccuucaagugguucccaaauauguccugagucccagcaugcagucagugacuaguaucucugucccaguacauuuuaauuuuacucuguaaaauuauaaaugguuuaaaaaguaaacacuuuucuuaauuaggcaaguagaaucuucacaauugagaaaaaaaaagucaggcacauaucagagaaagcauaguauugccauucuuggauaugcuuucuacugcucuuuuauaauuaauagcuguuccuuuagcacuuguuuagcaacauuuacaguucacuguguacauuuucucccugaaaaagucauuuaaaauguuagugagucuggaaaguuuugucauuaauauuaguauuucauuuuaauggcagacacucagaguguucucaguuuuccuacauuauaaauaugccaugagccacauccuuguguauucuuuguucuuuuucugauuauacuauaaguauucuauagauuaucaugcuuaagaaauaaaggcagaguauuugucuucuacaggacucuugaggugaauugcuaaauuacuuuccaaaaugauuaaauccuaguccucauuucaccaacauucuacccaguuacauuaggugguaaucucuaagcauacuaaaucacaaguuaaugcagacuugaacaaaauuuuaaauagcuagaaauuaaauaguguugcucauuauucuaaacguccaaacugaaguuaauguuuggguaguacagaguuuucagaaagagauggcuuccucuggggaaguuuucuacuuucuaagccagcacagaccuccuuacagagaguagcuugaagucggagcucagcaaguguccuucgcucuuuacuuugcccuguguuuagggacaguguagcauagcuaggaaaaaagcauaaagaugguuuucccuucauuauagaaagcagauuuggauaauguaacacugaagucuuguguugggauucuuuacuaauuauuugcaaauuucaggugugcaacagaagaacauggcucaagaaacuaaucacagccaagcaccuaugcuuugcuccacuggcugcggauuuuauggaaacccucguacaaauggcauguguucaguaugcuauaaagaacaucuucaaagacagaacaguagcaaugguagaauaagcccaccugguaaguaauccagcugaaacccagcaguguuucugacgacacaugggaaauaugcaauaccuccuuucacaucugucauacauaagacauucauaucacuaaagcaaaauuaaaaaaaaaaaaaaagguagggaauacuaaagaagggaaaccuauauaguauguuuugugggaauugaucuuccuuugcauuuaccaggccuuaggauguuagaauauuaaccuauaaugugguuguguuacagcagcuucugucagcagucugucugaauccuuaccaguacagugcgcagauggcagugucccagacgcucagucagcgcuagauucuacgucuucaucuaugcagccaggguaaggugacuuucugaagcaugacugaaacuaaagaguauugaucuuacgauaguuuuuaaucacuucacaaaggaaugcuuuaaagcuacugcaggauuuacuggccuagaauuguaucugacugcuuacuacucacuaguuacaagaugcuuuguacuguucuuuguuaaaggagagcucuuucaagucuucaauccccuuuucagacaucuuuuccuuuauucuucacacugcauacugaucgcugccaaagucccucuaaaguuaguucuucacacuauaguccuuggucuacaaauauuagugccuugaaucggaagagccuugguucagauucuuuguuuuuaucauggggcaauacuaauuuuucuguuuuauaauauauguuugcuuuuagcgcugaaauuagagauagagggaugcauacagaaauaacauguuuaaccuuugaaaaucauggugcaugcccauaaaaucucugacuugagaaacagaggcaagaagacuaggcauucaaggcuagggcaaacuauacagacaauuuaaggcuccucuugggcaagggaggaaggaaggaaggaaggaaggaaggaaggaaggaaaugcuuuuuuuccauuuuauuauguuauaaacuaggcuauuacguuuuuacacuguuuccuuuuuaaaaauucaucauagaugcucauuuacaacuuuguuuucauuucugaagcaaggcugcaucaugcuaguuuucauuuagagcauucauguaauauuugggauguguuaaaacgcacgcacgcacgcuguugcuuugguuuccuaagcauagacuucuggccguacuuagccugugguuucccagcccuaugaucaugguagguuacaagugucucuguuuucuauaggaagugguauacuauguccuuuuaguuuguuuggauauuuagaaggugaacuuuucaaacugaaauaauauugaguccagcagcacuuaccugaaggaauuaagagauucucuugagcccagguguuuaacaccauucugggcaucagaacaagccccuaucucuaaaauuagaaaaguaauuuuaaaaaacuuuauguuaaaaaaauaaaaauaucuuuugcuuuucuagcccugugucaaaucagucacuuuuaucagaaucuguagcaccuucccaaguggacaguacaucuguggacaaagcaguaucugagacagaagaccugcaagguuugcaaaugauagcauguguuuguuuaacacuugaguuuuguaggccgggcacuagcauagauguggguauuuagaacaguaccugcuuauuguauaugcuuuguuaguuuuguuaugagaagaguauuuuaaauucucaaauauuuaaauucuuaaauauuuaauaguugggaucuacuuuccacuuguauauaauuagaucagaguaaacagaagauucaaaucugauguaauuagagugagcaauagaaguauuauacuauauguucuguuguguuaggcaguuaaaucccaaaacucuccucuccgagcacugggacuacuggcuugcugauuuugguuuugacugauuauccgggaggcuuuucuuccugcuucccaggcacuccucuccccgugugaacuacagaguaguggucacauccagcuccuugcauucauaagugcggcaccccauguucucacccugguuccauggauucaaaugauccaagaacucugagaaacuuaucugaaggcacuugcaauggggaggcauuuaggagguuucauaaucuuugcuaggcucuguuauccugucagccaagggagcuuacugugcaaagauaaguucaggguugugugacaccauggcaugguuuaaggagacagcacacugacgucugcaucauguauaguguaggcauucugguaacagaugaucuggaauauucaacuuuuuccuugaauuuuauauuaaauaauauagauauccuuuacuucuugcccugucaguacuugaccggaagagcugaaguuguauacaguugugagcugcuugugugggaucuggguauugaacuuggguccucugcaggagcaguaugugcuucugacugcugagccaucucucuagccuguuacagaaaaaugauguugagugaggcagaggugauaauguaaaauuugaaaaaauauuuggaagguguagauagguaaaaggaaagugaugagaauuguuccugaauuuuagauggucugguauagacugcuaaagugagaauagaguuugaaagcaaagcaggagggaaaggaacagaaaacagccaucugauccugauuagguucaggccauagacacaaccaaagggauaucccaggagcaauuaguuuugagagggagguuagcagagaaaagaaaagaacaaaaauaccacucacucaggagaguuaugggugucuuaaacagaacacauuuuaaauuucugugugaaaagaauuuguaaaaauuaaagggugugaugugcaugccuuugauuucuuugaauucaaagccaguuuguucugcauggcaaguuccaggacggcaaaggcuacauagugagaccuugucucagaaaaauaagacgaccaaaaugaacaaagauuaaaguugcaguugagaguugaacgguuugauaaaggagggugaguuaauaacacaacagcguaggugcuuuacaccaauuugauguuuggagaacgucaaaguuuccuucagcuuacccugagugcauuagccaagaaaguaguuaugucauauuaggaaggcugcaaaauuuuuuuaauuagguauuuauuucauuuacauuuccaaugcuaugccaaaagucccccacacucuuccccauccacucccacuuuuuggccuuggcguuccccuauacugaggcauauaaaguuugcaugaccaaugggccucuuuccacugauggccgacuaggccaucuucugcuacauauggagcuagaggcacgagcucuggggguacugguuaguucauauuguuccaccuauaggguugcagaucccuuuaguuccuuaguuacuuucucuagcuccuacauuggaggcccugugauccauucaauagcugacugugagcauccacuucuguguuugcuaggcccgggcauagucucacaagagacagcuauaucuggguccuuucagcaaaaucuugcuaguguaugcaauggugacaguguuuagaagcugauuaugggauggaucgccagauauggcagucucuagaugguccauccuuucgucucagcaccagacuuugucucuguaacuccuuccauggguguuuuguucccaauucuaagaaggggcaaaguguccacacuuuggucuuuguucuuuaugaguuucauguguuuugaaaauuguaucuuauaucuuggguauucuaaguuucugggcuaauauccacuuaucagugaguacauauugugugaguucuuuugugauuggguuaccucaagaugauucccuccagguccauccauuugccuaaaaauuucauaaauucauucuuuuuaauagcugaguaguacuccauuauguaaauguaccacauuuucuguauccauuccucuguugaggggcaucuggguucuuuccagcuucuggcuauuauaaauaaggcugcuaugaacauaguggagcauguguccuucuuaccaguuggaacaucuucuggauauaugcccaggagagguauugcgggaucuuccaguaguacuauguccaguuuucugaugaacugccagacugauuuccagagugguuguagaagcuugcaaucccaccaacaauggagggguguuccucuuucuccacauccucaccagcaucugcugucuccugaaguuuuuaucuuagccauucugacugcugugagguggaaucucacgguuguuuugauuugcguuuccuugaugauuaaggauguugaacauuuuuucagguguuucucagccauucgguauuccucaggugagaauuauuuguucagcucugagccccauuuuuuaaugggguuauuugauucucuuuagucuaccuucuugaguucuuuauauauuuuggauauuaguccccuaucugauuuagaauagguaaagauccuuucccacucuguugguggccuuuuugucuuauugacagugucuuuugccuugcagaagcuuugugauuuuauuagguccuauuugucgacucucgaucuuacagcacaagccauugcuguucuauucaggaauuuuuccccugugcccauaucuucgaggcuuuucccuacuuuucuccucuauaagcuucagugucucugguuuuauguggaguuccuuaauccacuuagauuugaccuuaguacaaggaauaggaauggaucaauucgaauucuucuacaugauaaccgccaguugugccagcaccauuuguugaaaaugcugucuuuuuuccacuggauguauuuugcucccuuguuaaagaucaaguggcuauagguguguggguucaucucugggucuucaauucuagucuauugauuuacuugucuguugcuauaccaguaccaugcaguuuuuaucacaauugcucuguaguacagcuuuaggucaggcauggugauuccaccagaggaucuuuuauccuugagaagguuuuuugcuauccuacguuguuuguuauuccagaugaaucugcccauugcccuuucuaauucguugaagaauugaguuggaauuuugauagggauugcauugaaucuguagauugcuuuuggcaagauagccauuuuuacuaaauugauccugccaauccauuaucaugggagaucuuuccaucuucugagaucuucuuuaauuucuuucuucagagacuugaaguucuuaucauacagaucuuucacuuccuuagagucacaccaagguauuuuauauuauuugugacuauugagaaagguguuguuucccuaauuuuuuucucagccuguuuauccuuuguguacagaaaggccauugacuuguuugaguuuauuuuauauccagcuacuucauugaagcuguuuaucagguuuaggaguucucugguggaauuuuuagggucacuuauauauacuaucauaucaucugcaaaaagugauauuuugacuucuuccuucccaauuuguauccccuuggucuccuuuuguugucgaauuguucuggcuaggacuucaaguaccaugcugaauagguagggagaaaguuggcagccuugucuagucccugauuuuagugggauuucuuccaguucucaccauuuacuuugauguuggcuacugauuugcugucgauugcuuuuaucauguuuagguaugguuguugaauuccugaucuuucaaagauuuuuaucaugaauggguguuggauuuugucaaaugcuuucucugcaucuaaggagaugaucaugcgguuuuuguccuugaguuuguuuauauacuggauuauguugauggauuuccguauauugaaccaucccugcaucccugggaugaaaccuacuuggucaggauggaugauuguuuugauguguucuuggauucagauagggggaauuuuauugaguauuuuugcauugauauucauaagggaaauuggucugaaguucucuauauuuguugggucuuucuguaguuuagguaucagaguaauuguggcuucguagaaugaguuggguagaguaccuucugcuucuauuuuguggaauaguuugugaagaacugggauuagauccucuuugaaggucugauagaccucugcacuaaacccaucuggucaugggcuuuuuuugguugggagacuauuaaugacugcuucuauuucuuuaagggauauaggaccugaucuugauuuaauuuugguaccugguaucugucuagaaacuuguccauuucauccagguucuccaguuuuguugaguauacccuuuuguagaaggaucugauaguguuuuggauuucuucaggaucuguuguuaugucucccuuuucauuucugauuuuguuaauuaggaugcuucuccugagcccucuagugagucuggcuaaggguuuaucuaucuuaaugauuuucucaaagaaccagcuccuuguuugguuaauucuuugaauaguucuucuuguuuccacuugguugauuucgcccaugaguuugauuauuuccugccgucuaccccucuugggugaauuugcuuccuuuuguucuagagcuauuagguguguugucaagcugcuagugugugcucucucuaguuucuuuuuggaggcacucagagcuaugaguuuuucucuuagaaaugcuuucauuguaucccguaaguuuugguauguuguggcuucauuuucaucaaaaucuaaaacauccuuaauuuuuuucuuuuuuccuuccuugaccaagguaucauugagaagaguguuguucaguuuccacgugaaccuuagcuuucuauuauuuauuuuguuauuaaagaucagccuuaguccauggugaucugguaggaugcaugggacaauuucaauauuuuuguaucuguugaggcuuguuugugaccaauuauguggucaauuuuggagaagguaccaugaggugcugagaagaagguauauccuuuuguuuuaggauaaaauguuuuguggauauguuagauccauuuguuucauaacuucuguuaguuucacugugucccuguuucguuucuguuuccaugaucuguccauuugugaaagugguguguugaagucucccacuauuauugugugaggugcaaugugugccuugaacuuuacuaaaguuucuuuaaugaauguugcugcccucguauuuggagcauagauauucagaacugagaguuccucuuggaagauuuuaccuuugaugaguaugaagugccccuccuuuucuuuuuucaugacuuuugguuggaagucgauuuuuauuagauauuaaaauggcuacaccagcuuguuucuucagaccauuugcuuggaaaauuguuuuccagccuuucauucugaaguagugucugucuuuuucccugagauggguuuccuguaaacagcaaaauuuuggguccuguuuuuguagccagucuguucguuuaugucuuuuuauuagggaguugagucuguugauaguaacaguuauuaaggaaaaguaauuguugcuuccuauuauuuuuguuguuaagguuggcauucuguuuuuguggcugucuuguuuuagguuuuuugaaggauuacuuucuugcuuuuucuaggacgugguuucuguccuuguauugguuuuuucuguuauuauccuuugaagggcuggauuggugaaaagauaauguguuuggguuuuuuuuuuuuuuuuuuuuuuuuugguuuuuuuggguuuuauuuugucauggaauacuuugguuucuccaucuaugguaauugagaguuuggcuggguauaguagccugggcuggcauuuguguucucuuagugucuguauaucaucuguccaggaucuucuggcuuucauaaucucugguaaaaaaucuggugucauucugauaggcuugccuuuauauguuacuugaccuuuuucccuuacugcuuuuaauauucuaucuuuauuuagugcauuuguuguucugauuauuaugugucgggaggaauuucuuuucugguccagucuauuuggaguuuuguaggcuucuuguauguucaugggcaucucuuucuuuagguuugggaauauuucuucuauaauuuuguugaagauauuuucuggcccuuugaguuaaaaaucuucauucucaucuacuccuguuacagguagguuuggucuuuucauuguguccuggacuuccuggauguuuugacuuaggaucuuuuugcauuuuguauuuucuuugauuguugugcucauguucucuauggagucuucagcaccuuugauucucucuuccaucucuuguauucuguugcugaugcugacaucuaugguuccagauuucuuuccuaggguuucuaucuccagcguugccucacuuuggguuuucuuuauugugucuacuucccuuuuuaggucuaguaugguuuuguucauuuccaucaccuguuuggauguguuuuucuguuuuucuauaaggacuugcaacucuuuaacaguguucuccucuaucucuuuaagugaguuauuaaagaccuucuugaugucuucuacugucaucaugaaauaugccuuuaaauccgggucuagcuuuucugguguguuggguugcccuggacuggcugaggugggagugcuggguucugaugaugguuaguggccuugguuucuguuaguaagauucuuacgucugccuuucgccaucugguaaacucuggagucaguuguuauaguugucucugguuagagcuuguuccucuccugauucuguuauucucuaccagcagaccugggagacuagcucucuccugaguuucaguggucagaacacacuuugcaggcaggcucuucucuuucagggaaggugcauagauaucuggcguucagacuugcauccuggcagaagaugaaggcccgaaacaggaccugucccagaagcuguuaacuucuguaguccacacuuucaccugugcagacuagucaugguggaguccaggaaccaagaugucucccgcagaugcucaggcaaagcccuccugagccggguggacaccucuccucuggcagggaaggugcauguaugucuggagccugaaaagggggcugccucagaagcucuguggcuccugccugucccagaagcuauuagcuucugcaguccacacacucaccugugccgacuaggcuugguagagucugggaaccaagaugucucccgcagauggucuggcaaagcccuccgggccgguggacaccucuccucuggcagggaaggugcccugaucugcaaaauguuuuuaaaaguuaaaaaccuuuuuuuuuuccuacaaguaugcuuugaaugacauuuagauauuagacaaguauuaacuuuuaaguucauuaaagacuuagcauucauaacuucagcauaacagaaucuucgacaaaucagauguaaguuucaguuucacccaaguuuaggaaggaauuaguuuucaacuuuuuaauucucucaguggcauccuuugauguguguuugaguuaguguaugugugaaagcugggacauagggugucuguccucagaugccauccacuguucucaagucuuuuuguagccagaauuuaccaaguugucuaaaguaacuggaccaauuacaaggacaugccacuggacccagcucuuuugccaguguagguucugggggacuaaugcaggucuucguguuuacagaacaagcacuuuacagacagcuaccuccucacccugaacagccuccuaaauaaaaauaaauaaauaaguuuaacuuacauuuuaauuuaaaauauuuucuuugucaacacaaauguaaauaugcuucacuauacauagauacuuaaaaguacacacuuccuuuagacagaauuugccugcugagcaaaucagagaaugaugcuucaucauuuaaucuauucaaugacugaaaagagacagagaaggccucugcaucacagacacauuauacaggaagcuggaacccuggaucaauuguaacuguguccccuccauaagacagcgugaugguugugagcugggauucacugugugcaucuugcuggcauguccaaaccccuuuguucccccaaguagguaggauccacugguuaggcaagcugccugguauccauguauuccaguaucacuggggcuuucagaauagcauuuccucuguauauaauguuuauucugguaugaugcuaucggguagguggugaugcuuucauauggcauguuggcucgaauucucaagcuuaagugaaaauuuagccuauugcuguauguuaucuaacuauccuuuuaaaaaguuuuuuaaggauagcaguuucucaagcucuuaaaaaccuaagacauugcugggcagugguggcacacgccuuuaaucucagcacucgggaggcagaggcagguggauuucuggaguucgaggccagccuggucuacagagugaguuccaggacagccagggcuacacagagaaacucugucuugaaacaaacaaacaaacaaacaccaacaacaaagaagacccaagaacaaaaaaaaaaaaaaaaaaaaaaagacuucuagcucacaaaaacuagcuuaaagauaaaauauaugugcauuuugguguauucagcaauacugaaguagauuggcugccuugaagauagagcugaacuuugguuaggucuugggugaugcagacugaaaagaagaugggguuugauguagagcuucugguuucauguccuccucuuucccugacauuucugugcugcauuuucauuaguuuugaaucaugucaaccuuacaggaaauuuagaauuauucagaccauagauccaaaaugaacuguacaaacaauaaaggauauucuguuuugcauauugcccuguugacuugggaguuaaaggaggcuuaggacgguggcgcacgccuuuuuaaucccagcacucaggaggcagaggcaggcggauuucugaguucgaggccagccuggucagagugaguuccaggacagccagggccauacagagaaacccugucucaaaaaaaccaaaaaaauaaauaaauaaaauaaaaauacaaaaaacaaaaaugacuuuaaaccuuuucaguguagaaugaaucagcuugugggaagguugggcugucaaggacaagacagggggaaccaggauucuuauggaguauuguuagaucaguaguucaugacagccaaaggaacuuuuggcuaaaaugggacuguuauuuaggaaagcuuacaugacggagaaaucagggauuucaucugauuuagaagaauuauugaaaagagccaagacagucuugaaaaaguuagaauacuuaacaguucccagcuucaaacuuuauuaaaagacacaguaaugcagacugaaguauuguuuugaagauacucaaacagauaaguggaauaguauugacaguccagaaagauacucaaaagcaauagcaaacccauaaugaguuaacagguggcccccagcagagugcugcagacaguuuauauuaaacagaauucuaaggucauccaguaagaaaaugaaaaucugcucaaagaaugaauucauuaaauaaaucacccauaauguauccagaagcuacauaaauauaagaacugagacuguaaaaacucucaaggcaaguguaaauuuuguggccuuagaacuuucauagauaagacaucuaaagcaguagcaaccgaagaggauagauggaauacuuuuguuuucaugaaaagaaugaaaaaacaacacagagaauguuuuacacuaucuguuuaagaaugguggauaaagaaauaaaauuuccuccuggagauauagcuuggugguaaagcguuugggcagcgugcuugggauccuaguuuaaaucugugauagcuauaaaaagaaggaaagagugaaagaaagcagaauaaggcaauccaaugaaaacaugguucaguucccagcauccacauggugcucggccaccauccauaauccuaguucuagcuggaacgacacaaacgugcacguggugcacauaguacaugcaggcaaaacacuuaaauuuaguaugaaucuuuuaaaaauguaugaauauaauaaaaaauuuaauagaauuuuggaaauucucaaagaauuaauaagauguuuuuaaaggaaagaaaaauaggcaauggaucugaauagauauuuuuuucagagaagauguacaaacugacugucagcaaauaaaacaaugcucugcaucaguagucaccagggaagugcaauagcaaaccgauagaguuaacagguggcccccagcagagugcugagacaguagcaauaacaaguguuguuuugguuguggaagucagacacuagcacauuaugggaauucagaauacuauagaugauuuggaaaacacucuagaguuucucaaaaagguaaggauaguuaucaggugaccuagcaucuucacaucuucugaagaaaugaaagcacgucauugcuugcugguguucuucuugccuuucauuguguagcuuuuaggaauuggacccaggguaucaggugugccagcaagagccuuaccugcugagcuauguugccaggccuaggauugaugguauuccuagaaaauaagaaacaugacacuuguuucuuuugaaugcuaguaucagugcuaaugugauuuucuccuagaaguuaauuuuuucacauuuuacauagaauuuuuaaacuaggaagagcuuacauuuuacuuaauuuaaacccaugucuaagaaaaugagguucagauuaaaaaauuaauauuaucccaguagucgguuauaacugucugcauugaauaucuagggagcauuaguucuaugucuucacuaggugcauagccgaaguaagcagaaauauuugaguuccucaaaaaaaucuacucugauccuucacuugguugaacucucugguagaguucucuuacaugcuugagucaugaaaacacuccaugccaaaaaagcguugucuaauucuugagaauugccaagauugucagaagaaaaauauguagagauacuguauccacuaccaagaaaaaguagacauauuaagauaguguuugguuaccuaucaauguuauuuuaaguucaguuugguuuuucacuguguuuaugaauaugccccaaacagaauagugaauaguguuuaaauuguauuauguacuuacuauuacauuucuauucuuuuucuguuuacaggacccagagcagagggccuuguuccucuugaaugugauccuccauguggguaguaaaaccacucuuaccuguccagugcuuuugugaaguaucuuaacaguaguaauggccaguagaccgugucuagucaggauuccaguuagcaaucagcuagaaagcauacaacacuuuauuugccucuuuuauguuguuacauuggccucccugaagaccugcaugguccguggguauaacuagacagucauguguucuugauuaguaacaguugcuguguguuucuaauucucauuuuccuauauaaaaaccuaucugcuucugaagaaacugcccuuacuuugccuuuaaacucagaaagacuaugguucuuuggcgucuuuccuacuacauuagcucucuauucaugaugaguaguuccuuuaauauaaacaaaauuagauaaggcauucuguggucguauaucuuaaauauaaccugagaaaacauaauuucuuggaaucagucuuccagauuccuagaauucuggcuugugaauuuauuuaacucaagcuguugauugauuaaaguaagguuauacugagaguugggcuugagcagauguucccaucaucucuuggugcaguaccuaguacucagcagucuaaaugggaccucuaacucacuagcauuuucacacagcuguccagucuuuaacuucaaaguuacaucugccacuggugauuugucuuaggucuucaagcuaaauggcaaauuuacuguugaggugugugacacuauuuguguucagaauaagaacaugaguuuuuauucuccauuuccagauacuucccaaaguuugucucaguaguuaaaccaguuuuguuuagaaccugccauccuguuacugacauuuaagaauuaauuuuuuuugacuaccacauuuuuuagagaacagauuagauauugugguuuacaaaauuuaaagacaguauucugaauaaaguuuaaauauuuuugaguucuguucagagucaagccuuaccuaauauuuuucuagagguggggacuuaaacaagauauucacuccuuguccauaaguuuugugccucuauuuuguuugaaaaauacaauauagucagauguuguagcucacaucuguaauccaagcccuugguugaggcaggaagauuacuaugaauuugaggccagccugggcugcagaauuagacccuguuucaaaguccauaaguaagaaauaaggauguauacuaauagaaauuucucuggccugguuuuaacuugucuaguagagacuuuauaugcaggauucuucaguaccauucauucacuuauaauuuaugguguuguaucauguuuuuaaauacuagaugaguuaacauaagugguuauaauccacucacuuauuugaguaucagcuguaaguagcuuuucuaagggaagcuguacuguggcuaugggaauguucuccauagauauaguagguaagugacuaaacacagauccaccgacaguucuuccuugcguggcaguagcagcaggguaggcucucguaacaagaaugaugagacagguuccugccuucaaagaguccaguuagccagguuaagucacauggauauaggagcucaggagaggguuuccuauucugaaacugcaggcuacuucaggaaagacaagauggaguuaguagcuaaagaucacacacagcaaggaccuuacaagagcuuacaggugagagaaagagaugugucauaggaacucuggcccucccguggcucaagcauauggcaacuuaaggaaugaugaaauauugccacagagagugaccggaauggugaaagucucugggccuuaaacuggggaaugguggggagccaucagauuuuuuaaacuauuuuugcuuuucaucuaaaacagacaaauagaaugagaauuggguuggugccaauagcagggguaauagaguagaaagcugcuaagaguguugaugagggaaguguauuggaucuugacauugaagaacacacauggcuaaaauggaaaagccuuuggggguggcugauagauuaagccagaaagauguucccaguauagucggaagagcagugacuccugggagaggcucugguugugauuuuaaagugggcaaguugaacuuaaaccaugauaggccuuuuacuauuuugagguagguuauauacucuaucucuggugcacucaggaagaccagaaugacaaguaacaggaaaggacacauuuacaggguuuaguaacaaccauucaaccugagucucaguacauuugcucuugacuguaggaugaaaaugcauugauuuuuaguuuucaucuuaauuacaucguuuuaaaguuuccauguaucugauucuuuuuccuagcaucuuaagugcuuuugggagcagaaaugguguuaagaaagauuuucauuuuauugcuuuggcuggacuuuuacuuauuuuguaaacaaggcucaaacagcaauccucuggguacuggauuaaaggcaugugccacaacacuuggcuuaagugauuucacauaaaaaugugaaacguucugagaacauugguauuccuguuuucugagaagucuauuuagaucagccuaugagcaguguuaaguugucuuauggcuguuuucuucuuacauguucccucagacuuccugggugucaggcagugucuuucaagaaggaaaucugugaauguuuagaagcaccauuugucuaccuguuuuuacacacacauuuauugaacgggggggucauguuuauaaauaguggaaaguuagaaguaucuuuucuaccuauaaaucaguuccucagauaaucuuuaaauugcagaugcaugggauaauaugggaugagggccaaccaccacccaaacaccaaaucuuacuaaauaauuaaauuugccacccuccuguuuuugucagcuucaguaucagauacgacacagcagccaucugaagagcaaagcaagucucuugaaaaaccaaaacaaaaaaagaaucgcuguuucaugugcaggaagaaagugggacuuacugguaagggccuccuuggaugguuuaaaguuaagaucauguuuuggaauaacuuaggcucacuguuacugaccaguuaagauuacugcugccucugugagcauugguauuggguacaugucaguuccaggauuacuuuuuuuuauuauuauuauuuagcuuuuaaaauuuuauuucaguuggguuuuagaguauuugaccaguuaggcuauuguggugaaugcuggaaaagagcaaagaugaaucucuugccugcaaggagaugguauuuugggggccuuuggugaacuuuaugguguuucuauaaaauggugcugaucagagaccacacaugaucagugagcuaaaagcaaaacagccuggugcuguauagaagauaccacugguauuacugucuguaacucaacugucaaaauuguuaaaggggaacuauucaaaaguauuuagcaaagaauauacauuaagcacagucagacuacccuggacagucauggacaggaguucuguagucaguuuauauaaacaaagggaaauauagaggccugucaaggggagugcagaugccacucugacaggggaacuaugggugaggccagggcaagccugguacugagauucacuggaaaguggugcagcuacaaauggcuuugcugauuguuuauuuagguauagugccaaauacuuguauaaaaaucaggaguguaaacagaaaacaguaagauuuuaagugaaaauuaugcuuccgaguugggcaugguagcacaugcucauaaucccagcacuugggaaguggggacagaggggucaggaguucaaguggaugcuauaugagauccuagcuccaaaaaauagguaagaaaaggauaccuuaugcugaaauaugggucggcauugagggaggagauucaaguaugaugucuuuccuccaauauauauuuaacuuaaaauggacauauuuaauaucaaaugcauccuuuaaaauuuucaugaaguuucagacuucaugacuacaaggcuaggacuuaguuuucaucuaauuuagcuauuguuuacuuugauuuucuauugcauaaaguuucagaauauguuuuuaaguuaaaauguaguaaagaaaguggaugucaguuguugaugauuagaguauugauuauuccugagcuauuuuccaauauccauaauaacauaaaagccugauuuggaggagcagcacugucgcucugacuacagcucuauuugaguuucaacucaaaaggcauaucccuaaaauuaaguagcuuuuauuguguguuuuuuguauauuggacgcucaccuggucaggaguaauucaugacuccuuuaaaagugcaugugugagauccacagaagcuuagugaguugucucuugauacugagcauauugacccacagaaaccugcuuccagggucuuggucuccccagacagaaccauucacaucuccuguaauuagccaagggggaaauuaaagguguuacguugucacucagcagcaggucuucuggacucauuggucugcucuuaaauguuacaguugccuucugacaguaagcuguuucuacacucuguauuuucaguuuaaaaaaugguccauuuucaguuuagcaaccuguccuaggaagaaauugugagcauaucacuaguaagggaaucagcucagagaagcagucagggcuugcucuauuccaaguaaguauauguguagaugggggcaagaaaggaagcucucugauaguugagaauggagcucuuggaacuaaguauucuucauagacuuaaagauagguuugcuuaguauuaacuaugggaagaacuuaauagcucacccuccugucuaacccaugcuguacacauaucauccauuuccaggguuugaaugccgguguggaaauguuuacuguggugugcaccguuacucagauguucacaauugcucuuacaauuacaaagcugaugcugcugagaaaaucagaaaagaaaauccaguaguuguuggugaaaagauccagaagauuugaacuccugcuggaauacaaaauccuuugacuaucugcaaacuaaacauugacuugagguuuuuuuuccuaguccuugggaauguagagcaccguaucuugcauagacccuugaaucaugcaugucaucagaagaauagauuuuugguuuuguuuugaaaaugacucugaacauuuauuuccauugcaguuucuguggcugaaaagaaguauuauacuuuuaagaucauuuuaauuuuaguugagugcagagggcuuuuauaacaaauguggagaaauucuggagggcugugauuuuuccaguauuaaacaugcaugcguugaucuugcaguuuauuucucauuguguauguauauauagcuuuucucugcagcacgauucccuuuugauaaggcccuucuggguacaacuaguuaucaguaacugaauguaucuuaaucauuacggcugcuucuguuuguuuuguuuucauuaacaaagguuauacauauguuagcauauaguuucuuugcacccacuauuuaugucugaaucauuugucacaggagaauaugugcugacgagauucuaaauuugugguuuuugguuccuuuuauuuuuuuuuuuaagcaagggaaagaaaagcugagugcauuucacugcugacugcaaguuucuuugagauuacuguucauuggucugugugugcacaauaugaagaaugagcuggucauugugcgguauuuauguuuauucaccagucuuugauuaaauaaaaaggaaaacucgaaaaaaaaagcuacguuucccucuucuuucugguaauuacuuuugcccuguuaaaucuucuagggcuuugcuuucuaauauaauaauaauagugguaagagcaccacugugauuugucucaacucuagucauggauaauuguuaugacaaauuauauuccugugaggcaaagaccuuagaauuuuuucaaaaccaaguuacugagaugugugauaauucuggcucucaucuaacuguccugcacucguuuacaccaaauuaaaaucuaauagggcuucuuuacuccauaggauuagaggcauucacauucuaucagugggaaauuauauacuagaaagaucccgcaaagacccacuuguccucugcuuuccaaacuuuucuagaaguuagacuuuuuaaaaauggcaguggcuguaccuuacaguacaaauuucuugauggaaaaaauguuuaauuuuaaucaauaauguauuuaauaugguuuaauauuaaaauuauauauuuagcugaucauaugaauaaauuuaaaucaggaucaaccacugugugucucaguagauucagauagaguaauccaggcaugguagugugugccuccaauucuaacacuuaccagacagaucacugcaagcucaaggcuaaccaggucuauauaauaggcuccaggccagagcuauauagugagaauuuauccugaaaggggaaaaaaaaggcuuauucauaauuaacaaaauagcaggauuagaaagagauuaacuagcugguugguaacccaggccuuuaaucccagcacuugggaggcagaggcaaguaacucugaguugaaggccagccuggugacuuucaguauagccagggcuacacagagaaaaccuauaucagaaaccagagggggcgaggguugaauagugucauguaucccagucuuggaauuaauauguagcugaggacagcugcuaccaugcuucauuuaugcagacguacgaaaugcuggagagggguccagaccucaugcuaaguaagcacuuuacaguccuacauccucaagccuacaucuaggcagaaaucgggccagugauauagcuaaaggugugaaaguucuugccacaaaagccugauuucagaacuaaacuccagaguugucaucuggccuuuaacacacacacacacacacacacacacacacacacacacacacacacacacacacacacugauauaguuaagaagcaaaacuauagaaagaaaugucuuuaaacugauacuaugaaaaaaccucuaucaauuca

SEQ ID NO: 3927 - RNA, 1042 nt, Mus musculus
augaggccugagacuaaccuccaauuaguaauuguugcuuucucaaaguccaugcauguuuuugcccauuaaaaacuucuuuugggauagaaauuucuggaaagcuuucaucacaucuuuguuucucaggguauauaugagaggguuaacuaaaggggugaucacgcaguagaacacugagacuacuuugccaauugugaaguuguacuuagcuggaggucggacauaggcaaagauuauggugccauaguagauggucacuacugugagaugggaggcacaaguugagaauguuuucuuccuugcuucccgggaagacagccugauuauugugaccacgauguugccauaggagcucauugugagaaggaaagaacugagaaucaccacagaacugcagguguaacccaaggccuccaccaagaaugugucugaacaggagaguuuaaagauggggucagagucacaaaaaaaaugguugauuuucugcgggccacagaaguuuagcugagagauaaguaugguagguagaagaggggcaaggaagccuccaacccaugaugcagcugaaaaccucaggcaaaugugaacacucauaagaagugaguaaugcagagggcggcauacagccacaugccugucauaagccauaacugcuagcaagaugcacucaguggcucccagggagaagaagaaauaguacugagugaugcagccugcaacaggaauggugacaaccuuugugacacauguagccagcaacuuaggcaccguggcuguaguguaccagaucuccaggaacgauagguuuccuaagaaaauauacaugggugucuguaauguggaauccacaagaauaaggaaaauaaugaggguguuucccaugagagacagcaaauacacaguuagaaacaucauaaacaaugggagcugcagugaagaggagccuggaaacccuagaaaaauaaacucggucacugcuguuugguuuuuuacauccauauuucuuuuccucugcccugaaggggaucaacagcaccca

SEQ ID NO: 3928 - RNA, 995 nt, Mus musculus
gaugaacaauuccacccuggugacugaguuccuccuggagguuuuugcugagucuugcgagcucagaauccuucucagugugcuguuccugcugguguaccugggcagccuguucgggaaccuuaucaucaucauuguuacuacaguugaccagacacugaacacacccauguauuucuuccucaggaaucugucuauuguagacauguguuauguuucugucacugucccaaaugcuuguuucaacucucucacuggccagaggaauauuucugugacugggugugcagcacaaaucuuuuuugucuucuuuugugcauguguagagauguuuuuucucaccaucauggcccaggaccgcuauguggccaucuguaagccucugcucuacccugugaucaugaaccaccaguucuguguucagaugacacuggcuucccuacauagcucucuuaucauugcaagugugcacacuuucaaaacuuuccaacuguccuucugucacucuaaugugguuccucaguucuucugugauauccccucuuuguugaagcuuucauguucagauaccuuuaacaacaaacucuuaaugcuaaucucugccauuaucauugguugcagcugcuuuacauucauugcuguaucauauuuuaggauauuaucaacuguguugaagguuccugucaaaggagagagagggaaagccuuuuccaccugugucccucacauuguuguggugucuguguuucuuaguucuucuaccuauguguaucuaagaccuccaguaccaacauuagaaguaguuaaggagauggcucuuucugugucuuauacgauugucccaccauucuuaaauccuaucaucuauagucuuagaaacagacagauaaaggaggcugugaagaaaguaauauuaagaauuucuuugguauuugaauauaaaagaaaugaguauuuguuagaguuuucuagaguaagaaaguugaaaaaauaaa

SEQ ID NO: 3929 - RNA, 1013 nt, Mus musculus
uauggccaacuccacccuaguuaccaauuccaccuugguuaccgaguucaugcuggaagauuuugcugagacuugggaacucaggauccuacucagcgugcuguuccugcugguguacaugggaagccuguuagggaaccuuaccaucaucauugcuacuacaguugaccagacacugaacacacccauguacuucuuccucaggaaucuguccaucuuagacaugugcuacauuucugucacugugcccaaugcuuguaucaacucucucacugaccacaggaacauuucuguggcuggauguguagcacaggucuuuuuggucuuauuuugugcagcuguagagauucaguuucuuaccaucauggcccaggaccgcuauguggccauaugcaagccucuccucuacccuaugauuaugaaccaucaauacugcauucagaugacacuggcuucccuacuuaccucucuuauccuugcaaguguccauacuuccaaaacuuuccagcuguccuuuugucacucuaaaguaauuccgcauuucuucugugacauccccucuuugcugaggcuuucuugcucugacaccuuuaacaacaaacucuuacuucuucugacugccauuggucucagugguagcugcuuuaccuucauugcuauaucauaugcucgcauauuaucagcuguguugaagguuccugucaaaggagagagaggaaaagccuuuuccacuugugucccucacauuauugugguuucuguguuucuuaguucugcugccuauguguaucuaagaccuccaguaguaacauuggaaguaguucaggagaugacacuuucuguguucuauaccauuguuccaccauucuuaaauccuaucaucuauagucuuagaaacagacagauaaaggaggcugugaagaaaguaguauuaagaauuacuuucauauuucaauauaaaaagaaugaguacuugucagaguuuucaagaggaagagaaacgacaaaauaaa

SEQ ID NO: 3930 - RNA, 588 nt, Mus musculus
guugaggggcacgcacccauuucuuuuuuuuuuuuuuucuuuuuuuuuuuuuacucaaagugauuuuauugcuugugcacacaacagcauuuaugccacuagagcagaggcuguggaugacucauauuuccaauuaggugggagcacccgcuuagucuuauaguaucgagccaaucggugaauucugcucucuaucagaaucaggcggaauuuagcauccuuauccuuucuguuccucucaaggugcuuucggacagcaacagcuuucuuaaucaaaugguagagauccucggggaggucaggggcaaggccuuuggacuugaggauucucaagauuuuauuuccagucacaaaacggaccugggccaccccgugugagucccucaggauuacaccuaucugggagggagucaggccuuucuuggccaauuuguaaaucuguuccuucacgucgucagacgucaacuucagccacguggggacgcuacggcgguagggcagcgccgacugggacaggcccuucccgggagcgugcaugcgacccaugauggcggaggucuggcagcaaagagccacccauuucuaaac

SEQ ID NO: 3931 - RNA, 19405 nt, Mus musculus
uaauugacaguguuauauuugaauguucuuagagcuacaauguaagcuaaaauuacccagcaugcaaccccucaaacaucgaccucauguugcuugucuccucgcugauagauuuagacuaagagucacaagaugaaacuacaaaauaagucaguaauuucucccuaaugcugugauucuguuuacauaacauuuacuagaauguaugauucuuguuaguuuuuguauucucccccauuguuugaauuauuuuauguagugugucuggguguguguguguguguguguguguauugccagaggaggacauccaguguucugcuuuauuauucucugccuuauuccucuguagcaaagucucucucugaacuuggaguugggccagaagccagcaaggaccaucaguccuccuaucuuugucccugauaguacugggauuacaugucuguucaucuuauguuccaggaggaauugaaucucaguccacauguuuccucagcaaacauucuucacuacuuagccauucuccagcccucugauuuugaaauuacauuuguguauuuaugggauugcacuggugugccaguggaggucagaggucaaccugugggagucaguucuccucuuccacauuugggucccacgaauugcacucaggcuggcaggcuuggcagcaaauauccuugccugcugggccaucucacccaccaccuccaguuguuuuucugacugcuaugucugguuuuauguuccuauagccuagaccauuccagcacgagaugccacuuugaagucgggaaaauaaagcuauacugguuuuccuaaagcuacuuucaaacuuuuuuuuuaaacuauagaauaagugcagugagagagaaaaguuuaccaacuaaacaaauguaaagcucucuggaaacguugaaaaacuaagcagaauaaaucuggauuaggcugugcgauuaugcuaggcuucaaacaagugguuacucugcagugacaucuauggagcagugcauccauuguucucuggaauuuaauucauuuuaaauuacucauccaaaugauaaacugugagaugugccucacuguggggagaaaauccaagaauuguuuuuuauuguagccacaagugcuagcugggaagcuuuucagccuguucuaauuaggcuccacuuacugucuuucgagaaacuguuagcuucagacaugcgaauaaaaccuugccaagaggaggauuggaauuaauggucuugcccacucuggugugauagcaagcuuugcagaacuguauacagacgucccacaaaagcagaacagcaguuuuuacaagggaaaguuuuauuuucaaaacuaaaagcagcgugggaauucugugcacuguaagauacagucuuauauggguaucaauauagccaauaaauuauuguucucuucaaggacuacuacguaaauguuugaauccaaaacauuauaaauugccuauugaagacuuugcuaucauuaucuggaagcauaauaaccacacauuacaaaaauaucaauauaugacucucagaagaaaacauauacauauacaaacauaagaauucauauucccugugugucacguauuugauauaaaccucugaagcaaguuuggaucagacaaaaauuagaauucuccaaaaacugaaaguuuaacuuccuugucaaauaggcccuauuacccgaauacuuuaaagucucuaugcaaaaguaugcuuucagacugcuuaaaugcuauaacgcacacaacaguuuuaaaauaauauagccaauaauuuuugccauuugaagaauacuagguaaaagauacuaugugacucacaccacaagagucaaugauaaaaagcuagccucuccuacaaugagugcaaaaagaccauuggugcuggcaagaagacgcaugucaccccucccugcaaucuagguaguuuccuuuaauccaauagcaaaucugggcauauuuaagaggcgugauucuaacugccacguugaaauccuguggagagccauucauguccacccacuggugcccugaaaagaugccgauaauuuuucuuucccauuucugcuguggucucuuccacauccucacauagaccccugaaccacuggccccgggcugggcgucacacugcugguagagaaggucguaggucucaucuuugacaucacagaagcgguacaccaaauugccgggccggucauugucauaaccagagaaguggauccugcccccugggagcugcuucgcuggaggacucacaccaaucuucaugaacugucuuuugugggguuucuugaguuccagcagggcguagucauaauccaugccgaugucauuggcauugcccuugauccaccccuugggcacaugggugcguuucacgcggauccacugaaacuucaucuugucuggcauggcugagcucgagcuguuguccccuccggcaccaucuuuauacuugggcuucaggaagcccacucggaguuucugugucccuuucacauagguuuucccaucguguaugcagugggcagcagugaggacgugcuucucugccaccagggugccagugcagccaguagacaacuucaccgauguugagaaaggauaauugagcaggaaguccuucccaaaaaugcuaaaccugccaucguagccauaaaucugccucuuccugcgagaucucccuguggccuccgagucucugccucgugcccugccuucaccauugcugaggauguagaugcccacccgagucucugugcggcugccauuggcauaaaggguuucauaggaaagguacugcuuggccucuucguaggugggcagugguguucccuugugacacugagguccacaugaggaggacaccuccaauuucgcuuuggcgucgaagucugccuuagcuaaguugaggguagacugaggcaagacuacagggaggcgauaagccggccauguggguuuccacggaacgguguagggacucaccugcaugaacacacagagcaggacaagaaggaugaagagccccgggauuccagccaugcugagugcuacuguagaaacaaagacaagaagucaggaggaugaaagcuauacaguucauuuacugcagccuggcagggcacagccgcacgcuggucauguuucuaagacugggaacauuccucagguuccaagcgagagccucccucagguaauggucucacuuacaugcaaggacuugcuugaccuuaggaucauuuccacaccucaaauccaaaugaagcuauuccccacccccuucaugaugaagaaguaaagaccaugggacauuacagggccacaucuagaaaauuuaccacuauucugugaacauauggccagcucucauuuuuaugagauuuuugaauguucuuuuaacuugauucuauauaccuuguccucuccugucuagcuacccacccacccuuggccccuuuccuuccuuguuaucuuauucuauuacaguaaguucuuacauaauuuucugggcaacaugcucacuuagauaauaaaucuaaagcagacacuuuacuggucgcaaaggcaucugggagggguggagucauacuagaaaucuuaucauuccuacaugaugcaugcaugcacuuggaagaugacaugagaauuuugcagauuuuugcuuugaauuuggaaaaaaauaaauuaggcauugccuuugauccaaccuucagcaacuugggugcauuucaccccaaauacauugaaauuuuauauuuuaggguguggcugaaacagcuguuggauccugaauaaccaucuucacacuuccauacaaguaaauaauuguagauauuugaauuaugcugcaaaauaaagggucaauguucaagauauaaagcuuuaaacacuguaucuaauaaccuuaugauuauugcuguugguuauucagaugucuguaucuguguuuucagcuugucuaauaucuuuaccuuggaccuaugcuaacaugugaaagaguuaugggauggaugcucacguugcuggaagaauaaauuaauauugcaauucaggaaauagaguucuugaugcugcauggugauuuccagggacagauaugcauagauggugagguggcucagacaaaggguacaaaguuagaugcagaaaguaagagaaggaggagagguguuccacugaggggagguguugaaaaggcauuagauacacuaggagauagagaaggagacacucagaaggaacagcaugcaagagcaugggggugggcaugagugugagucagcucaggaauuacauucagcucggcagggguguacagagaugguagaggcagcaggcaacaagcccguuguagagcacuguguguacuaaaugcaagaguacaaacuguauccugaaagauguauugaaagccccgaucaaucaucucuggagaaaagcaauuacaaagaggguuggaagugcuuucaucauugcuuaagcaucagugggcuccggcuggcuccaaaucuucugguucagcugacucaguggguaggguaauucauucacagucaggcaucccagagcagaaugggggggggggguauuucucaagaguccagcuaagggaacaaagcauccacaagaggaaacagugauuucuuuaucuuuuuacuccauuucucuugcaaggugcagauacacuggcaacuucugagugccuugugcuugcuuuauauaaggucgaaaacucuacugaucuuaccuaacuuaccugagcaagccgagccacaucccuaauauccacacacucaaacguguuuucuguccccucugcuaucucuuuugccccauugccuugaacucuacuucugcuaaggaaaauaaaaauggagaaaugaaggaacgagauccuuaaaaaauucauuuccucgguauuuccuaaguccucaaaauucuacuucucuccaucuuuguaaauagaaaagaucuuggguauuuggggaguacuuggguacuugagaguggaauccuuacaccugugaagucacggaggaaauggaugugugcacacgcguauuuguaugugcuugcuggguacaaugaugucaggacuaaugcuucaaagcgaccagggaagguguggugaugcuaacagaguccaccuuacaauggagaguuaagacauguagugaugauaacacuuugggagauguguagaacguggucucagccugacuauaccaggacccagcuauacugaggacccagcucuugagcucaucuuuggugugaacagccuuugcucuauaauaauucccacuuugacuagccacuccacucacaccagaaucccugucaaaugggaucuacuaaagaaaucagaugucucccuugaagacugcaacauaaccauccucucuuugcuugacuaauguggaaaacauuaauucuguuaugcacaaugcaucaaguuguauuucaucuuaucuuaaggagacacagaauccagaggccuaagcugucaaguguuccucuuuuuaaaauaugugugggugagcauaggaucuaagagaggaccaugcuacacuuaucguaagacacauauaauacuuuuaguagacaagaaaaacuggagugcuaagauauacuaauaucagaacaugaaacgaugaauuccaaaucugaaacaagugcauaacuggauagaaucugaguuaucaacuguaccaaacuuguccuacugucuauagcuuuauucaucuauuuaaaaaugaaacaguuugugacaagggugucaggaaagcgaaugucaggaaaacucugaaaccacugcaaacacauuuuuaaaaauccaacuaggaacuucgcuuuaaugaacuaauccucuucucaggcaaaauuaaacccucuuuccaaaugcuuugccuauacagcaaaucccuauuuauuuaaagaauacuuucuaacguuccgaaguacaccccauuucacaagugccaacaugccauccccccuuaguccguguuuaaaagagaaguaacgucuuuagaaaccaguccagugagcgguacugcauggacggguacccagcuuuccuuggauuguggguacuggguagucagucagcuuggcucuuguccugauagccucucaguauagauggucaaauuuacuccuuggcaacaugguagaugacuacaugccaagaacuucagagaucacuuacaaaugaaagaaugcuuaaagagucuacuaaaugauaggcuauuagcaauucagauugcucacaacuuaaguucugaucacguagccaagagucagggagaaguuggccaucuauggcaaagacuguuauccacuuaaggaaaaacacagcuuucucuguguaagaucaaauuuggggguacuuuggaagcacuaguuucucuuagcuagaaacaaggcuuagaaguacgcagugguguugaacugcauucauugacaugauaagacgaucuucauucuacauuuuccuuaagguuucuaugagccucugaaaguuaaaacuuuaguccaaacauagaaagggacauagacuucgagaaauuagugcagaacauuuuuccaaauugauugggaauaucugcugagcaauugagacauaaaacuaaaugugaaguccucauguagacuuaaacuggcacuuggcuauuaaaguuauaagcauccaaaguaauuugcucugucauccuauuuaaagugauuuauacauagacauucagggauguaacauacacaauuuuaaucucucagcuagaaacaugaugcaugugcuaccuaacuuuaaauccuguaguauuuaaaaguggaucaucuuguucuuguagagcuguuuggaaagccaacaccuuuugaaaggaaugaagauugccaaaccuuaucuuucuuauagcuaaaucuggaugaaaaaaaaauguuaguucugucacauuccauuucuaggaaugaaccuuugcaggauacagguuccucaugcacauaaacuaucuucuaagcuuuccaacuaaauguuuuuuaugaauuacuucacccaguagcaaagcaaaauggagaagcaagguaaacagcgauuuuucucaucauacuuaguaauagagaaacugcauuucuuuuccagcuuugacuaucugacucacaagaagacuacacacucccugcccagguugcaaauauuagccacugucuaguuaucuagugcaucaaaauauuuacacuuuacaaacauacuucauaagcccaauaauaguuuuaugguagagggaauuugcacauuaucagaugugccaaugacaauaaccuuccuagggacugaggacuagggacuagggacuggaguacugagaauaacuuuugugauucucuagaggacagucuucaaaacugcuaacaacucaguucuccuuaugggggacaauguuugaaugaaugauuuaacuccuagaagccagcaauugcuacaagagaacaucuaguuuuucagacaucuauugucuauucuacaaaguacgguuuccugugaccacaauaaaauguaagaaaguacaugaagguggugcucaugcuagacaccaguuggaagagcgacaaaggguccuccaugaaaucuguagccagggacacugaacaaugaggcuuugcuaauuccccaagcaaaugccuacaaaugaacaaagcucugugaauacacugaagccaagcuugcucucauuuuccagaaucacauaaccccuuaaggcaagacagacccagucacaguauggcuuaagaaugauggucuuguaaggaaacgggaggggacuuaagaagcccagcaaaucaaguacaaucucauggucacacagagcuuaacuucucuaucagguuuuaggcaaaaugagccauccuaguaaucccaagacagccuagcagcagagcaauuacagagugcugucaauggugagaccaugagaaacgaaaucccuggaguuauuuggaauuaugcaugaauaaugcccggugcauuaacuccuaaaacauccaugggagggaugcucaggagaaccugagacuauuagcacagcagaccugggccaacaauguucucagacacacuaaugggaacuuuggcacuuaggccacaggcagaaaaauauaccuacauccacugucuaccugaauagucaucagugagacagaaaugaaauccauauuaauuaccuuggaagacugcuuccuuccaaggucagagaaagcaugacaagcugccuacugccuguuuauaauaauggaaaauacaagugaagauuuauucauauauuuauggcacacucagaaaaaaaaugaauguagugccuucaaaagaauccucggucucuuuaucccguccccaauccaguucuaagagacucuuuaaaaauguucacugaauaacacaggcuagccucaaguucacuggccuuccccagccuucgaaguguuaggauucacaggcaugcacuacuguaccucacuccuaggagacuccuagaaagacagguaauaguucuuuuaaacacuuuccccccccgaaacaaugucuaacaauauccugauacuaauuugcaauagggauuuuggaaaaaccuaacuucaacuauaaaucaaacucuucucacagagccugauaaggcuauuuuguauugaccuaucuguccuuaaggcauucgcuaggaccucucaaguucacuuacaagaccugggaguagcaauuucuauacuaaccgagauccugaaucaucuggaacuuuccacaggcuacgggcuguuucuaaauucucguggaugucacccaauggacaauaaaacaaacaggauuuuaaucagaggcuuuucucaagggaugcucugagggaggugggagggagaaucggcuccauuucaggagggggugguauugcuccaucuaaacacaucuuccucucuuaaaaguucuaggggagggcaaaucuuuucuuucaguuagcaauuugugauaaauggcuacaugcugaagaaauauuugcuuccaacaacuguugauagcccaggcauaauuuucuagauuuagcacucagagcaaagucggcacccagcacagagccugaucccaacuuguguuugcugacuuuuucuugcuuguuaagguguguucauagucacgugccagguuaaaaauuaaugcucagagcacgaugaagucagauacaguaggcgcaaaacucaaagaaagaaaaugguagagguuacaguguguguucgugggggagagccuaccuugaccucuccagggacaccuugccauacacagcuccacuugaccccuagacaacaccuugcauccaagacagcgcuuucaaaaccuucuuuuccccauccacuuuaagagagacacugagugaauccaaacgcuguacagagccgguguccggggagggaggcucuuucaggcucuuguccuaagcccagagucugugcggaagccacggcaaacuccccgguguuacccgcagccaccccaccccgcgcgcacccgacucuuuguccggcuccggcacacgccugguccuucggacccagcgggagacgccggguccccgcaucgcacucacccgcguggagcagcccgccggggccgcggccgugcgccgcucagacaggugugggcgcccggaggacgcgcgcggcucccaugccugcuccgcagaguggccgagugcgagccugagguccagcagagccugcagcacccgguccgccccccauccccuccccuucgccucccgggcccucccgccccgcccccagccgcgagccgcgcagcccgccggccgucgccuccccuuccccuagccgccugccuccagccagcgucacccugcuauucagagguccagaacccucgggccccgcgcaggugggucuccgcagcgcgucaccaccagcggguccccguacucgaugccccugcaccguguccgaugaacggcuccuaccagugacucuugcacucucccgcucuagacaacuucacaccaaguucuaggggucuacauugcccagagucugcuaaagcaaugcuccagagugggcggucccuuccaaccuuccaguccuccagcaccccgggugcguggagcgccgcuaggcaaguuugcaaagcagaauucaaacuuguaagcuccucacccgugcgcauucugugcgccuugaauagugacgaccgagcuccuuuccaccuuaguuccuccucuagcgcuucuagaguguaccucaguuuguaauccagaggcaggcuaccgagguugcaggcccugcaguucagcugcuagcauacugggucccagagcacagcaagggaucgcggacuuggcagcuucccagggguugacuggugacgcccccggccuggucuuuacuggggcaccagggcaccagcugguggagccaccuccuagcuuauggugccuguuucccuaaaucacuggagaaguccacaccugggggacugagucagccuggugaccucacuauuuaaauaucuaaugcuauauagucuuaguagucucuuaagacuauccacacauccauuucugugaaccaacccuucaugcaggucauggagaugaaaaggguggagcuguggauuuccccucaggacuggaggacuggagaggccuaaucuugcuagcagucagacagcuccugaacaguaggacaaaauuuugcagaggucguuuucuucucuccuccuccuccuccuccuccuccuccuccuccuccuccuccuccucucccuccuccuccucucccuccuccuccuccuccuccucucccuccuucuccuccuucuccuccuccuccugcuccuccuccuccuccucuuccuccuccuccuccuccuccuccuccuccucuuccuccuccuucuuuuuucuccugucaaucccagaguagccuuccuuuuuuccugucaaagcuugcccucagaaagggagggccugacauccuauuccacaccaggauguuagugacauguccagugagcuaguguuugccuugccuuuaaauaggaaagcccugaacacauuguugaguaguguuucucaaacauaaaggaaacuaguauuguccaccacguuaaaggcaaaaccuucuuagaccuccccugucuuagcuuacauuuucuuuuuaaacaauccauuaaugugaguguauacauaaagcuaggugaaaacuuaaacguuugaacaacucaagaauaaaacucaaacugaucgaauacaaagauucucuuccggaacaguaaaauuuaggguuucucucagucaguucuccacagugcuuccacuccuguggucugugcaaggcccuaaaacacucuguucucucacuucuuguucuucccagcucucuuucuuguuaacauaacugugaaagugguaauuuccuagggccaaagcuuagcacauaaaaaccagauuaacucuuggugauuugaaugagauguuucccauagucucuggcauuuaaaauacuugguccccaguugguggugguguuuagguaggcuugggagguguggccucgacucaggaagugugucacugggggugggcuuugagguuucagaggcuggcaccauucccaguucaccuucucuguuuugugcuugggauuuaaggucugagcucucagccuccugcuugccaugucuugccuccauggacucugacccucucacacuguaagcuggaauaaacucuucucuaaguugccuuggccaugugguauuaucacagcaauagaaaaguaguacugaugguuaucucaaugauccagaacaugcuuagagugauucuuugagaucacacaaguaaaacaaauuaaauuacgggucucccaggguuuauagcucccaaucgagcuauauuuauggacuuggaacucuuuaugacuacaccaacuaaaaccuagugcaguucaagaggucacagaaaugacaaaggcacaagaauuauuaccaaagaaaaacccagauaaacccuccagcuucaucugcucuuaguuaaguaaauaacugcuugcuuuagaggccacacggccaugugauguguuguuagcugccuaucagcguuaauaccagagcuccuuugauaugugggcuaacuaaacuauuggcuccguuacuuuacaggaauggcuaaaauggcaugaaagacuuggucccucuguuuugacaucaugucuauccucaaucuugaccuuguaggcuucucaccauuacauauaaacacauugagcauugagaacuauuuuguccaagacuauauaguacagugccagugcuacuguuucuaugucauaagaucccacaguucugugugguacccugccaggaucugcuccugacuagcauuguggcuuuuguccuaaccuuucccugccucaguagccccuucuauacaaccagggcugcugggguugcguuaaagguugaauagauaaauacgcagaaugugcuugagaauaguucuuuaugugcagggaacagguaauaaacaugagcuguggcuacuccacugugcaaagagacgguguuuugaagccuuuucauauagcaagaccucuguccauuuuuuugacaguuauugcuuauuuuucuuaacaguuguaguuuucaaaguagagccaggaagaacaaauauuacuuccaucaaucauaaagaaaaacuggggcacagacgggccucagaacacuucccucucucggccaguuccaguuguuaccgucuucuccccaaacagcuaacaaacaaacaacagcacagacagacguacagaggguccagggcuuaaacaggacucuggcuuuagauguuuccuagauucguuauagaaaaauaauuuggcccuuaggucaucugcacggcggccauacggacagcaacaugauggaucuguaggguacuuugaccuuugagagauguguucuguguaaacagcagguguucccaugccgcacauagaugucugcuguuuucuuuuucuguacuugucugucuuccccccagggggaaaggaccccagcccccucacugccuucucaacccuuuuuaugugcacugcaguugaggaguuagaagugcgcucggggugaagccugcgagauuacugucuguccacuguguugaaaauuucuggggcugcgcaaaugccccugacccuuuuggugcaggucauuaaaagcuauggucauaaaacaaaaucugacacaagguaaagggaauuauagucuaggucaaggaacaaacaugaguuagaaaaugggagagaaucauugcuucuuauuaugccaggucugaagacuuccccgaggcaaugggauuugaauugaacucaaaagguaaaggcccgggaguuucauuuuacugccuuugucacuuugaauugcuggagaucggauacagcaccugcucacaccggcuuaaagcucuaccacugggauacauacacccccagauucugggcaagguuuuaauauacauuaucuuacugagucuguggaaccacacugccauaugacgagaagagcauuucuacuguauaacugaggaaucugcaaggauugagggagcagagcuagggcugggcuguaaagauuaugggugcguccuuuaaugaacacauuaugcuugguggcaugggguauauuuuauugcauguaaccuucaagauaaaagagaaaaagagagauauguuagucugucauaugcugcugaaaaagagcaccacgcacuggauacuuuauaaagaacagaaacuuauuuggcucaugagucucguggcugagaaaucuacgauggacgugccugugcuaauaaaauaggucacugggcaucauguggugauacaagaacguacauggcuggcucacuucuauacccaaggcagccucacaauacaaauucuauucccuccguaagauuaauuuacuucgugaggugucuaucucguaauggucccacuaauuguacugagaauucagggauuacuguuuccuccguuuugcagucaggacacugagguuagagucuucagucaggaucccaaguucugcucuaguagaccacacggcugaggcuccugcuggccugucucauaccuuagcugcgaguccgcacugcguccguccgggacucuccuguucuagugcuuccgauaaggagcugagcuagucaguuuggaagcuaucaguuagauuacuucagaggagaucuguuuccuggcuaaagcacuccacaguacacguguauauugaaauaucacacaccaccgacaaacaccgacgauguuuaugcuuugacgcaagauugaaacauuauugaaauaaucauuuccaggugcuuucuuacuauuucggugacucucacaaagcguuauguggagcuaguaguuugcuuagugagugggcguugucggcucuucauagugaaugagaaggaggcuggaaugagagauaaggaagcagauggggguggggggaugaaaccucucugagccauaaaagaggugugcccuccgguaaaacaccuugcuugcucacuguccuugcuuucucaccugcagucagaacuccuggugaugccuucuuagagucugagucugugacauuuugggggacggagaagcccagcacuucuuuuuaaaauguuuaggccuccacaggguuuacugugggaaccuaagccauagaagaauguggaguucuagaggccggcuggugagcuagcguucauuugcuuguugggcgggcgacauuaauagaggaugugacuuucugcgcuucacuucucaaaucugugcuccaggcuaaccgagggcuauuuaaugaugucaucaacucagcauuaaauacacucuguauuucuaucagcuaugguuauuaauaaucauuauuauugcuauuaugaguguucauuaaacauucuaaaaguuauuggaugaaugaaucaaaugcuaucaaugcuuacacauuuaauucaaaaacucaaagaauaaauuaguucaaguugccacucaguccucagauguuuuuauuacuguggucuauaaguaagaaggcuucuuuuaguauugaauuuaggaaaaauuauagauuuaaguuuucccuucaugccucuuccuuuaaucuucucuaaggcaucaccaauuuauuuaaucaacaaauacuuguuaaaccacugacaagccuuuauacuuacauuuauuagugucuuaagggcagaaguuucuuuuuucuuacaauguuauauuuaaaaccuuauguugcuuuuuuuuuuaaagagcacaacagauuccauaauuaaauaaaaaaaacugacaaggugaaacauuaaaaguaugaaaucuuccaagcaucuaaucaagcaaaggaagaauaucaaaacuuuaaaaaauccuagauuuguuagagauuaugcaugauaagcauuuaaaacuaaaugccaucaucccacugauacaaauaagagagguauaaaauauaaauguagcagaugccuaauauuagauauuauuagaaccucacaggggcacucaugggacucagugacagacagacgcugcacugcaagggagagccuuacucucacccuauugugaagaccagauugagcuacaacugccaggagggagaacaaacucuggugcuggcgauuuccuguauacugagggcauucuucuaaacugaaaaauuagaaacacuucaaaauaacuauguguuucucauuuucuuuggucaaauuugaaaagucuccagaggcuaacacuggguuucucugguguucccuaaaucuauaaagaguugaaucaucaagaacaaaaaagaaaucaaagauuucugacauuacaaaaaaaaaauucucucaaauuagaaaacuuuuuuuuuuuuuuuuuuuuagaaaauuguuuuguuuucaauuucugguuauauuuauccacaaauacuggggucucuuuucucucuuacaagaagcuuuuaugugguuaaguauggagucuggaugcuugaauucaaugucuuucaugagacagcuuuucugucuggcaaauccuacgcacccuucaagcucagacaucgacucaugucugaaggcuuccaaacccucaggcacuggguguuucagaucauucuuugcucucagggaacuauaugaaaauaguaccuucugguugugucuauuugcauguugaagcugaaguggcucagagcacccccgcgcccccugagcaggaaauccaucuugauuuccucuguagucuauagccucuuccucuacagcagagucaagagcuccuuguaaaggcucaaccaauuugaauauaaacaguuauuagauagauuaaaacauaacauuuuaauuagcuaaaaguaguagaacugauguaauuugaauggcuaaccaugaugaguaggacaggacuugugugaaguuuuacugcugaguucuaauauuguccaauauacaaauaaguccaaaccucuguuucagcuuucugaucagcauugcuuucuuccaagucauacccaggugauaaauuuaacuuccuuuucuauaugguugcauucuaaaugucauuuguccaugacuugaggcaucccaaugaagucgugagaacauuuucagggagccucuggauuugggugauccauucuguucugaagugcucuaccaggaagacccacauagaauccuauugggaaaauguguguuuuuuuaaaauaucacacccccgauauuucuuauagguauuagcagauuaucuuugaaacuaaagguuaauuugaugugcuuauuagcauccuaaaugcucugagaaguucugaauaaauaaaucuuguucaguucauuuauuagaugguacucaagcuuacuugauugggaaauuuuuuaauguuuuucaauaugagaguaauguuuuauaggcuaguaagguucuaaagaagaacauuuggggaacaccauuucuaaguguacucuacuuaugagacugagccccuucucuucuaagauguggccagcacuuuugaccccucuguuccuggccauauuugaaacacuauuccaaauccugugucuaugcucuaaccaguuuuugaaggccuggcacaauguccauucucuaaaaaauauugcuuaucagcuuaugauuuccuguagugauugucuacaacuuucucguggcuuuuuaauuucuuuuauuaucauuuuacauuccuauuugucugcuguuaaauauugggcuggcaucuagaauuugcaucucugcugcacauuauuuuaauugggcauaucagucaggaacuccgcaggaacacaguucauccuagaaggacucaaaugaagagacucuaacaaaaugccaucugguagagguaagaagaagauugaggagugaaagaagagccauccagaauucuacgccaucauuaggcuggggguuggaagaagggacaaaaugucaggugagcgugcuuacuagagagggaagccugccugaaauuacugccaaguccacggagaggugcagcuacugggagaaacuguuccucaagaaagaagggauggacauagaagugccccaacaaagccccuucauccucugauauccuggaucuaccagcaugagcuugcaaggcggucaguccagcugccucuaaggcauggagccagggacacugaauggaagauaacacgugggagauacaucaccugaguacccaucacauuaagagccaaaccagguuaugaccaguaucuaccucauaggucaauauuaauuaaauuagcaaccacauaaaaacauuaacauauugaauaaugacugauucuccauuuuagcuacucauuauuuuuacuguuauaaaaacuucuaugaauaaguguuaucuaaaagcuaacagagggagacaucaugucauacuguccacccuuguaugcucagcacagagacaagugauuggugucacugguaauggaggccauagagcaagggacagggagauauuuuaaagagagggagcagggaguguuuaagcaacaaacugaucuugggacugucccugcucuucuuagacaauccaaggccccuggguuuuccuuugugucuguggagguaaggacugcugugcagucaguucccucugagcacccagagccaugacaggaaguggccaucaguuacaguuuuaaucuuccacaccaauccuaugaacgucacuguuucauccuguguggaacuugcuguguauauuuacacacagguauuaggcuccucuacagcauuuuugaagauugcuguugauuguugaucuuccuccugcugcuucucagaauccucugccccucccuaccccucagcugccuuucugcuuuccuuuaaccagcauauccuucaaaaccucacuuucccccuuugcaguccuuuuccuacuuucagggccaauaaccacaacuacucucauacauauuuauauuuauaugcuuauauaaaaucuaaugucauacaucuaugaaaagcauuaauagcuggagucacauauaagagauaauaugcauuauuuuucugaguccccucucuuaaucauuuccagaaccauccauuuucccgaaauuuuuauaauuucauuuuuuucuccauggauauguagaauuucauuguuuacacauaucauacauucauuaucaauucacuaucugcugauggacaacuggacuggugaauggacaaguaacaagcguguugcuagcaucucuaaacuuagagucuuucuggugcacgcccaggagugguguagcuaggucccauuuugaaaguguguuaaagucgguccaccagaggcuaagaggagaguuucuaucuccagaagcgccgugcuucuugcucggagaaguaagcugcuuuauuucaaacugccggcaccugguuccuguugcccugggcacuuggauuaggaaaauugcaggaguaaucaguagugugauuuuccugucaaagcccugaagaacacuggaagagcuguucuucagcuaacgggcuugugggagggcaggcgagaggccccucuggggcggcugcccugguucagggagaagcuccauucugggagccgggaacuuaccauaggaaggcaggcaugcaggcaggcaggcaggcaggcaggccucuccugcagcucugucccugggcuccgggagggugucaguucugagaaucuucucauaaggcagagucauugaaggucacccugccagaagagucuaguacugacaccagcagcuggcgguagga

SEQ ID NO: 3932 - RNA, 19405 nt, Mus musculus
uccuaccgccagcugcuggugucaguacuagacucuucuggcagggugaccuucaaugacucugccuuaugagaagauucucagaacugacacccucccggagcccagggacagagcugcaggagaggccugccugccugccugccugccugcaugccugccuuccuaugguaaguucccggcucccagaauggagcuucucccugaaccagggcagccgccccagaggggccucucgccugcccucccacaagcccguuagcugaagaacagcucuuccaguguucuucagggcuuugacaggaaaaucacacuacugauuacuccugcaauuuuccuaauccaagugcccagggcaacaggaaccaggugccggcaguuugaaauaaagcagcuuacuucuccgagcaagaagcacggcgcuucuggagauagaaacucuccucuuagccucugguggaccgacuuuaacacacuuucaaaaugggaccuagcuacaccacuccugggcgugcaccagaaagacucuaaguuuagagaugcuagcaacacgcuuguuacuuguccauucaccaguccaguuguccaucagcagauagugaauugauaaugaauguaugauauguguaaacaaugaaauucuacauauccauggagaaaaaaaugaaauuauaaaaauuucgggaaaauggaugguucuggaaaugauuaagagaggggacucagaaaaauaaugcauauuaucucuuauaugugacuccagcuauuaaugcuuuucauagauguaugacauuagauuuuauauaagcauauaaauauaaauauguaugagaguaguugugguuauuggcccugaaaguaggaaaaggacugcaaagggggaaagugagguuuugaaggauaugcugguuaaaggaaagcagaaaggcagcugagggguagggaggggcagaggauucugagaagcagcaggaggaagaucaacaaucaacagcaaucuucaaaaaugcuguagaggagccuaauaccuguguguaaauauacacagcaaguuccacacaggaugaaacagugacguucauaggauugguguggaagauuaaaacuguaacugauggccacuuccugucauggcucugggugcucagagggaacugacugcacagcaguccuuaccuccacagacacaaaggaaaacccaggggccuuggauugucuaagaagagcagggacagucccaagaucaguuuguugcuuaaacacucccugcucccucucuuuaaaauaucucccugucccuugcucuauggccuccauuaccagugacaccaaucacuugucucugugcugagcauacaaggguggacaguaugacaugaugucucccucuguuagcuuuuagauaacacuuauucauagaaguuuuuauaacaguaaaaauaaugaguagcuaaaauggagaaucagucauuauucaauauguuaauguuuuuaugugguugcuaauuuaauuaauauugaccuaugagguagauacuggucauaaccugguuuggcucuuaaugugauggguacucaggugauguaucucccacguguuaucuuccauucagugucccuggcuccaugccuuagaggcagcuggacugaccgccuugcaagcucaugcugguagauccaggauaucagaggaugaaggggcuuuguuggggcacuucuauguccaucccuucuuucuugaggaacaguuucucccaguagcugcaccucuccguggacuuggcaguaauuucaggcaggcuucccucucuaguaagcacgcucaccugacauuuugucccuucuuccaacccccagccuaaugauggcguagaauucuggauggcucuucuuucacuccucaaucuucuucuuaccucuaccagauggcauuuuguuagagucucuucauuugaguccuucuaggaugaacuguguuccugcggaguuccugacugauaugcccaauuaaaauaaugugcagcagagaugcaaauucuagaugccagcccaauauuuaacagcagacaaauaggaauguaaaaugauaauaaaagaaauuaaaaagccacgagaaaguuguagacaaucacuacaggaaaucauaagcugauaagcaauauuuuuuagagaauggacauugugccaggccuucaaaaacugguuagagcauagacacaggauuuggaauaguguuucaaauauggccaggaacagaggggucaaaagugcuggccacaucuuagaagagaaggggcucagucucauaaguagaguacacuuagaaaugguguuccccaaauguucuucuuuagaaccuuacuagccuauaaaacauuacucucauauugaaaaacauuaaaaaauuucccaaucaaguaagcuugaguaccaucuaauaaaugaacugaacaagauuuauuuauucagaacuucucagagcauuuaggaugcuaauaagcacaucaaauuaaccuuuaguuucaaagauaaucugcuaauaccuauaagaaauaucgggggugugauauuuuaaaaaaacacacauuuucccaauaggauucuaugugggucuuccugguagagcacuucagaacagaauggaucacccaaauccagaggcucccugaaaauguucucacgacuucauugggaugccucaagucauggacaaaugacauuuagaaugcaaccauauagaaaaggaaguuaaauuuaucaccuggguaugacuuggaagaaagcaaugcugaucagaaagcugaaacagagguuuggacuuauuuguauauuggacaauauuagaacucagcaguaaaacuucacacaaguccuguccuacucaucaugguuagccauucaaauuacaucaguucuacuacuuuuagcuaauuaaaauguuauguuuuaaucuaucuaauaacuguuuauauucaaauugguugagccuuuacaaggagcucuugacucugcuguagaggaagaggcuauagacuacagaggaaaucaagauggauuuccugcucagggggcgcgggggugcucugagccacuucagcuucaacaugcaaauagacacaaccagaagguacuauuuucauauaguucccugagagcaaagaaugaucugaaacacccagugccugaggguuuggaagccuucagacaugagucgaugucugagcuugaagggugcguaggauuugccagacagaaaagcugucucaugaaagacauugaauucaagcauccagacuccauacuuaaccacauaaaagcuucuuguaagagagaaaagagaccccaguauuuguggauaaauauaaccagaaauugaaaacaaaacaauuuucuaaaaaaaaaaaaaaaaaaaaguuuucuaauuugagagaauuuuuuuuuuguaaugucagaaaucuuugauuucuuuuuuguucuugaugauucaacucuuuauagauuuagggaacaccagagaaacccaguguuagccucuggagacuuuucaaauuugaccaaagaaaaugagaaacacauaguuauuuugaaguguuucuaauuuuucaguuuagaagaaugcccucaguauacaggaaaucgccagcaccagaguuuguucucccuccuggcaguuguagcucaaucuggucuucacaauagggugagaguaaggcucucccuugcagugcagcgucugucugucacugagucccaugagugccccugugagguucuaauaauaucuaauauuaggcaucugcuacauuuauauuuuauaccucucuuauuuguaucagugggaugauggcauuuaguuuuaaaugcuuaucaugcauaaucucuaacaaaucuaggauuuuuuaaaguuuugauauucuuccuuugcuugauuagaugcuuggaagauuucauacuuuuaauguuucaccuugucaguuuuuuuuauuuaauuauggaaucuguugugcucuuuaaaaaaaaaagcaacauaagguuuuaaauauaacauuguaagaaaaaagaaacuucugcccuuaagacacuaauaaauguaaguauaaaggcuugucagugguuuaacaaguauuuguugauuaaauaaauuggugaugccuuagagaagauuaaaggaagaggcaugaagggaaaacuuaaaucuauaauuuuuccuaaauucaauacuaaaagaagccuucuuacuuauagaccacaguaauaaaaacaucugaggacugaguggcaacuugaacuaauuuauucuuugaguuuuugaauuaaauguguaagcauugauagcauuugauucauucauccaauaacuuuuagaauguuuaaugaacacucauaauagcaauaauaaugauuauuaauaaccauagcugauagaaauacagaguguauuuaaugcugaguugaugacaucauuaaauagcccucgguuagccuggagcacagauuugagaagugaagcgcagaaagucacauccucuauuaaugucgcccgcccaacaagcaaaugaacgcuagcucaccagccggccucuagaacuccacauucuucuauggcuuagguucccacaguaaacccuguggaggccuaaacauuuuaaaaagaagugcugggcuucuccgucccccaaaaugucacagacucagacucuaagaaggcaucaccaggaguucugacugcaggugagaaagcaaggacagugagcaagcaagguguuuuaccggagggcacaccucuuuuauggcucagagagguuucauccccccacccccaucugcuuccuuaucucucauuccagccuccuucucauucacuaugaagagccgacaacgcccacucacuaagcaaacuacuagcuccacauaacgcuuugugagagucaccgaaauaguaagaaagcaccuggaaaugauuauuucaauaauguuucaaucuugcgucaaagcauaaacaucgucgguguuugucgguggugugugauauuucaauauacacguguacuguggagugcuuuagccaggaaacagaucuccucugaaguaaucuaacugauagcuuccaaacugacuagcucagcuccuuaucggaagcacuagaacaggagagucccggacggacgcagugcggacucgcagcuaagguaugagacaggccagcaggagccucagccguguggucuacuagagcagaacuugggauccugacugaagacucuaaccucaguguccugacugcaaaacggaggaaacaguaaucccugaauucucaguacaauuagugggaccauuacgagauagacaccucacgaaguaaauuaaucuuacggagggaauagaauuuguauugugaggcugccuuggguauagaagugagccagccauguacguucuuguaucaccacaugaugcccagugaccuauuuuauuagcacaggcacguccaucguagauuucucagccacgagacucaugagccaaauaaguuucuguucuuuauaaaguauccagugcguggugcucuuuuucagcagcauaugacagacuaacauaucucucuuuuucucuuuuaucuugaagguuacaugcaauaaaauauaccccaugccaccaagcauaauguguucauuaaaggacgcacccauaaucuuuacagcccagcccuagcucugcucccucaauccuugcagauuccucaguuauacaguagaaaugcucuucucgucauauggcagugugguuccacagacucaguaagauaauguauauuaaaaccuugcccagaaucuggggguguauguaucccagugguagagcuuuaagccggugugagcaggugcuguauccgaucuccagcaauucaaagugacaaaggcaguaaaaugaaacucccgggccuuuaccuuuugaguucaauucaaaucccauugccucggggaagucuucagaccuggcauaauaagaagcaaugauucucucccauuuucuaacucauguuuguuccuugaccuagacuauaauucccuuuaccuugugucagauuuuguuuuaugaccauagcuuuuaaugaccugcaccaaaagggucaggggcauuugcgcagccccagaaauuuucaacacaguggacagacaguaaucucgcaggcuucaccccgagcgcacuucuaacuccucaacugcagugcacauaaaaaggguugagaaggcagugagggggcugggguccuuucccccuggggggaagacagacaaguacagaaaaagaaaacagcagacaucuaugugcggcaugggaacaccugcuguuuacacagaacacaucucucaaaggucaaaguacccuacagauccaucauguugcuguccguauggccgccgugcagaugaccuaagggccaaauuauuuuucuauaacgaaucuaggaaacaucuaaagccagaguccuguuuaagcccuggacccucuguacgucugucugugcuguuguuuguuuguuagcuguuuggggagaagacgguaacaacuggaacuggccgagagagggaaguguucugaggcccgucugugccccaguuuuucuuuaugauugauggaaguaauauuuguucuuccuggcucuacuuugaaaacuacaacuguuaagaaaaauaagcaauaacugucaaaaaaauggacagaggucuugcuauaugaaaaggcuucaaaacaccgucucuuugcacaguggaguagccacagcucauguuuauuaccuguucccugcacauaaagaacuauucucaagcacauucugcguauuuaucuauucaaccuuuaacgcaaccccagcagcccugguuguauagaaggggcuacugaggcagggaaagguuaggacaaaagccacaaugcuagucaggagcagauccuggcaggguaccacacagaacugugggaucuuaugacauagaaacaguagcacuggcacuguacuauauagucuuggacaaaauaguucucaaugcucaauguguuuauauguaauggugagaagccuacaaggucaagauugaggauagacaugaugucaaaacagagggaccaagucuuucaugccauuuuagccauuccuguaaaguaacggagccaauaguuuaguuagcccacauaucaaaggagcucugguauuaacgcugauaggcagcuaacaacacaucacauggccguguggccucuaaagcaagcaguuauuuacuuaacuaagagcagaugaagcuggaggguuuaucuggguuuuucuuugguaauaauucuugugccuuugucauuucugugaccucuugaacugcacuagguuuuaguugguguagucauaaagaguuccaaguccauaaauauagcucgauugggagcuauaaacccugggagacccguaauuuaauuuguuuuacuugugugaucucaaagaaucacucuaagcauguucuggaucauugagauaaccaucaguacuacuuuucuauugcugugauaauaccacauggccaaggcaacuuagagaagaguuuauuccagcuuacagugugagagggucagaguccauggaggcaagacauggcaagcaggaggcugagagcucagaccuuaaaucccaagcacaaaacagagaaggugaacugggaauggugccagccucugaaaccucaaagcccacccccagugacacacuuccugagucgaggccacaccucccaagccuaccuaaacaccaccaccaacuggggaccaaguauuuuaaaugccagagacuaugggaaacaucucauucaaaucaccaagaguuaaucugguuuuuaugugcuaagcuuuggcccuaggaaauuaccacuuucacaguuauguuaacaagaaagagagcugggaagaacaagaagugagagaacagaguguuuuagggccuugcacagaccacaggaguggaagcacuguggagaacugacugagagaaacccuaaauuuuacuguuccggaagagaaucuuuguauucgaucaguuugaguuuuauucuugaguuguucaaacguuuaaguuuucaccuagcuuuauguauacacucacauuaauggauuguuuaaaaagaaaauguaagcuaagacaggggaggucuaagaagguuuugccuuuaacgugguggacaauacuaguuuccuuuauguuugagaaacacuacucaacaauguguucagggcuuuccuauuuaaaggcaaggcaaacacuagcucacuggacaugucacuaacauccugguguggaauaggaugucaggcccucccuuucugagggcaagcuuugacaggaaaaaaggaaggcuacucugggauugacaggagaaaaaagaaggaggaggaagaggaggaggaggaggaggaggaggaggaggaagaggaggaggaggaggagcaggaggaggaggagaaggaggagaaggagggagaggaggaggaggaggaggagggagaggaggaggagggagaggaggaggaggaggaggaggaggaggaggaggaggaggaggaggagagaagaaaacgaccucugcaaaauuuuguccuacuguucaggagcugucugacugcuagcaagauuaggccucuccaguccuccaguccugaggggaaauccacagcuccacccuuuucaucuccaugaccugcaugaaggguugguucacagaaauggauguguggauagucuuaagagacuacuaagacuauauagcauuagauauuuaaauagugaggucaccaggcugacucagucccccagguguggacuucuccagugauuuagggaaacaggcaccauaagcuaggagguggcuccaccagcuggugcccuggugccccaguaaagaccaggccgggggcgucaccagucaaccccugggaagcugccaaguccgcgaucccuugcugugcucugggacccaguaugcuagcagcugaacugcagggccugcaaccucgguagccugccucuggauuacaaacugagguacacucuagaagcgcuagaggaggaacuaagguggaaaggagcucggucgucacuauucaaggcgcacagaaugcgcacgggugaggagcuuacaaguuugaauucugcuuugcaaacuugccuagcggcgcuccacgcacccggggugcuggaggacuggaagguuggaagggaccgcccacucuggagcauugcuuuagcagacucugggcaauguagaccccuagaacuuggugugaaguugucuagagcgggagagugcaagagucacugguaggagccguucaucggacacggugcaggggcaucgaguacggggacccgcugguggugacgcgcugcggagacccaccugcgcggggcccgaggguucuggaccucugaauagcagggugacgcuggcuggaggcaggcggcuaggggaaggggaggcgacggccggcgggcugcgcggcucgcggcugggggcggggcgggagggcccgggaggcgaaggggaggggauggggggcggaccgggugcugcaggcucugcuggaccucaggcucgcacucggccacucugcggagcaggcaugggagccgcgcgcguccuccgggcgcccacaccugucugagcggcgcacggccgcggccccggcgggcugcuccacgcgggugagugcgaugcggggacccggcgucucccgcuggguccgaaggaccaggcgugugccggagccggacaaagagucgggugcgcgcggggugggguggcugcggguaacaccggggaguuugccguggcuuccgcacagacucugggcuuaggacaagagccugaaagagccucccuccccggacaccggcucuguacagcguuuggauucacucagugucucucuuaaaguggauggggaaaagaagguuuugaaagcgcugucuuggaugcaagguguugucuaggggucaaguggagcuguguauggcaaggugucccuggagaggucaagguaggcucucccccacgaacacacacuguaaccucuaccauuuucuuucuuugaguuuugcgccuacuguaucugacuucaucgugcucugagcauuaauuuuuaaccuggcacgugacuaugaacacaccuuaacaagcaagaaaaagucagcaaacacaaguugggaucaggcucugugcugggugccgacuuugcucugagugcuaaaucuagaaaauuaugccugggcuaucaacaguuguuggaagcaaauauuucuucagcauguagccauuuaucacaaauugcuaacugaaagaaaagauuugcccuccccuagaacuuuuaagagaggaagauguguuuagauggagcaauaccacccccuccugaaauggagccgauucucccucccaccucccucagagcaucccuugagaaaagccucugauuaaaauccuguuuguuuuauuguccauugggugacauccacgagaauuuagaaacagcccguagccuguggaaaguuccagaugauucaggaucucgguuaguauagaaauugcuacucccaggucuuguaagugaacuugagagguccuagcgaaugccuuaaggacagauaggucaauacaaaauagccuuaucaggcucugugagaagaguuugauuuauaguugaaguuagguuuuuccaaaaucccuauugcaaauuaguaucaggauauuguuagacauuguuucggggggggaaaguguuuaaaagaacuauuaccugucuuucuaggagucuccuaggagugagguacaguagugcaugccugugaauccuaacacuucgaaggcuggggaaggccagugaacuugaggcuagccuguguuauucagugaacauuuuuaaagagucucuuagaacuggauuggggacgggauaaagagaccgaggauucuuuugaaggcacuacauucauuuuuuuucugagugugccauaaauauaugaauaaaucuucacuuguauuuuccauuauuauaaacaggcaguaggcagcuugucaugcuuucucugaccuuggaaggaagcagucuuccaagguaauuaauauggauuucauuucugucucacugaugacuauucagguagacaguggauguagguauauuuuucugccuguggccuaagugccaaaguucccauuagugugucugagaacauuguuggcccaggucugcugugcuaauagucucagguucuccugagcaucccucccauggauguuuuaggaguuaaugcaccgggcauuauucaugcauaauuccaaauaacuccagggauuucguuucucauggucucaccauugacagcacucuguaauugcucugcugcuaggcugucuugggauuacuaggauggcucauuuugccuaaaaccugauagagaaguuaagcucugugugaccaugagauuguacuugauuugcugggcuucuuaaguccccucccguuuccuuacaagaccaucauucuuaagccauacugugacugggucugucuugccuuaagggguuaugugauucuggaaaaugagagcaagcuuggcuucaguguauucacagagcuuuguucauuuguaggcauuugcuuggggaauuagcaaagccucauuguucagugucccuggcuacagauuucauggaggacccuuugucgcucuuccaacuggugucuagcaugagcaccaccuucauguacuuucuuacauuuuauuguggucacaggaaaccguacuuuguagaauagacaauagaugucugaaaaacuagauguucucuuguagcaauugcuggcuucuaggaguuaaaucauucauucaaacauugucccccauaaggagaacugaguuguuagcaguuuugaagacuguccucuagagaaucacaaaaguuauucucaguacuccagucccuagucccuaguccucagucccuaggaagguuauugucauuggcacaucugauaaugugcaaauucccucuaccauaaaacuauuauugggcuuaugaaguauguuuguaaaguguaaauauuuugaugcacuagauaacuagacaguggcuaauauuugcaaccugggcagggaguguguagucuucuugugagucagauagucaaagcuggaaaagaaaugcaguuucucuauuacuaaguaugaugagaaaaaucgcuguuuaccuugcuucuccauuuugcuuugcuacugggugaaguaauucauaaaaaacauuuaguuggaaagcuuagaagauaguuuaugugcaugaggaaccuguauccugcaaagguucauuccuagaaauggaaugugacagaacuaacauuuuuuuuucauccagauuuagcuauaagaaagauaagguuuggcaaucuucauuccuuucaaaagguguuggcuuuccaaacagcucuacaagaacaagaugauccacuuuuaaauacuacaggauuuaaaguuagguagcacaugcaucauguuucuagcugagagauuaaaauuguguauguuacaucccugaaugucuauguauaaaucacuuuaaauaggaugacagagcaaauuacuuuggaugcuuauaacuuuaauagccaagugccaguuuaagucuacaugaggacuucacauuuaguuuuaugucucaauugcucagcagauauucccaaucaauuuggaaaaauguucugcacuaauuucucgaagucuaugucccuuucuauguuuggacuaaaguuuuaacuuucagaggcucauagaaaccuuaaggaaaauguagaaugaagaucgucuuaucaugucaaugaaugcaguucaacaccacugcguacuucuaagccuuguuucuagcuaagagaaacuagugcuuccaaaguacccccaaauuugaucuuacacagagaaagcuguguuuuuccuuaaguggauaacagucuuugccauagauggccaacuucucccugacucuuggcuacgugaucagaacuuaaguugugagcaaucugaauugcuaauagccuaucauuuaguagacucuuuaagcauucuuucauuuguaagugaucucugaaguucuuggcauguagucaucuaccauguugccaaggaguaaauuugaccaucuauacugagaggcuaucaggacaagagccaagcugacugacuacccaguacccacaauccaaggaaagcuggguacccguccaugcaguaccgcucacuggacugguuucuaaagacguuacuucucuuuuaaacacggacuaaggggggauggcauguuggcacuugugaaaugggguguacuucggaacguuagaaaguauucuuuaaauaaauagggauuugcuguauaggcaaagcauuuggaaagaggguuuaauuuugccugagaagaggauuaguucauuaaagcgaaguuccuaguuggauuuuuaaaaauguguuugcagugguuucagaguuuuccugacauucgcuuuccugacacccuugucacaaacuguuucauuuuuaaauagaugaauaaagcuauagacaguaggacaaguuugguacaguugauaacucagauucuauccaguuaugcacuuguuucagauuuggaauucaucguuucauguucugauauuaguauaucuuagcacuccaguuuuucuugucuacuaaaaguauuauaugugucuuacgauaaguguagcaugguccucucuuagauccuaugcucacccacacauauuuuaaaaagaggaacacuugacagcuuaggccucuggauucugugucuccuuaagauaagaugaaauacaacuugaugcauugugcauaacagaauuaauguuuuccacauuagucaagcaaagagaggaugguuauguugcagucuucaagggagacaucugauuucuuuaguagaucccauuugacagggauucuggugugaguggaguggcuagucaaagugggaauuauuauagagcaaaggcuguucacaccaaagaugagcucaagagcuggguccucaguauagcuggguccugguauagucaggcugagaccacguucuacacaucucccaaaguguuaucaucacuacaugucuuaacucuccauuguaagguggacucuguuagcaucaccacaccuucccuggucgcuuugaagcauuaguccugacaucauuguacccagcaagcacauacaaauacgcgugugcacacauccauuuccuccgugacuucacagguguaaggauuccacucucaaguacccaaguacuccccaaauacccaagaucuuuucuauuuacaaagauggagagaaguagaauuuugaggacuuaggaaauaccgaggaaaugaauuuuuuaaggaucucguuccuucauuucuccauuuuuauuuuccuuagcagaaguagaguucaaggcaauggggcaaaagagauagcagaggggacagaaaacacguuugaguguguggauauuagggauguggcucggcuugcucagguaaguuagguaagaucaguagaguuuucgaccuuauauaaagcaagcacaaggcacucagaaguugccaguguaucugcaccuugcaagagaaauggaguaaaaagauaaagaaaucacuguuuccucuuguggaugcuuuguucccuuagcuggacucuugagaaauaccccccccccccauucugcucugggaugccugacugugaaugaauuacccuacccacugagucagcugaaccagaagauuuggagccagccggagcccacugaugcuuaagcaaugaugaaagcacuuccaacccucuuuguaauugcuuuucuccagagaugauugaucggggcuuucaauacaucuuucaggauacaguuuguacucuugcauuuaguacacacagugcucuacaacgggcuuguugccugcugccucuaccaucucuguacaccccugccgagcugaauguaauuccugagcugacucacacucaugcccacccccaugcucuugcaugcuguuccuucugagugucuccuucucuaucuccuaguguaucuaaugccuuuucaacaccuccccucaguggaacaccucuccuccuucucuuacuuucugcaucuaacuuuguacccuuugucugagccaccucaccaucuaugcauaucugucccuggaaaucaccaugcagcaucaagaacucuauuuccugaauugcaauauuaauuuauucuuccagcaacgugagcauccaucccauaacucuuucacauguuagcauagguccaagguaaagauauuagacaagcugaaaacacagauacagacaucugaauaaccaacagcaauaaucauaagguuauuagauacaguguuuaaagcuuuauaucuugaacauugacccuuuauuuugcagcauaauucaaauaucuacaauuauuuacuuguauggaagugugaagaugguuauucaggauccaacagcuguuucagccacacccuaaaauauaaaauuucaauguauuuggggugaaaugcacccaaguugcugaagguuggaucaaaggcaaugccuaauuuauuuuuuuccaaauucaaagcaaaaaucugcaaaauucucaugucaucuuccaagugcaugcaugcaucauguaggaaugauaagauuucuaguaugacuccaccccucccagaugccuuugcgaccaguaaagugucugcuuuagauuuauuaucuaagugagcauguugcccagaaaauuauguaagaacuuacuguaauagaauaagauaacaaggaaggaaaggggccaaggguggguggguagcuagacaggagaggacaagguauauagaaucaaguuaaaagaacauucaaaaaucucauaaaaaugagagcuggccauauguucacagaauagugguaaauuuucuagauguggcccuguaaugucccauggucuuuacuucuucaucaugaaggggguggggaauagcuucauuuggauuugagguguggaaaugauccuaaggucaagcaaguccuugcauguaagugagaccauuaccugagggaggcucucgcuuggaaccugaggaauguucccagucuuagaaacaugaccagcgugcggcugugcccugccaggcugcaguaaaugaacuguauagcuuucauccuccugacuucuugucuuuguuucuacaguagcacucagcauggcuggaaucccggggcucuucauccuucuuguccugcucuguguguucaugcaggugagucccuacaccguuccguggaaacccacauggccggcuuaucgccucccuguagucuugccucagucuacccucaacuuagcuaaggcagacuucgacgccaaagcgaaauuggagguguccuccucauguggaccucagugucacaagggaacaccacugcccaccuacgaagaggccaagcaguaccuuuccuaugaaacccuuuaugccaauggcagccgcacagagacucgggugggcaucuacauccucagcaauggugaaggcagggcacgaggcagagacucggaggccacagggagaucucgcaggaagaggcagauuuauggcuacgauggcagguuuagcauuuuugggaaggacuuccugcucaauuauccuuucucaacaucggugaaguugucuacuggcugcacuggcacccugguggcagagaagcacguccucacugcugcccacugcauacacgaugggaaaaccuaugugaaagggacacagaaacuccgagugggcuuccugaagcccaaguauaaagauggugccggaggggacaacagcucgagcucagccaugccagacaagaugaaguuucaguggauccgcgugaaacgcacccaugugcccaagggguggaucaagggcaaugccaaugacaucggcauggauuaugacuacgcccugcuggaacucaagaaaccccacaaaagacaguucaugaagauuggugugaguccuccagcgaagcagcucccagggggcaggauccacuucucugguuaugacaaugaccggcccggcaauuugguguaccgcuucugugaugucaaagaugagaccuacgaccuucucuaccagcagugugacgcccagcccggggccagugguucaggggucuaugugaggauguggaagagaccacagcagaaaugggaaagaaaaauuaucggcaucuuuucagggcaccaguggguggacaugaauggcucuccacaggauuucaacguggcaguuagaaucacgccucuuaaauaugcccagauuugcuauuggauuaaaggaaacuaccuagauugcagggaggggugacaugcgucuucuugccagcaccaauggucuuuuugcacucauuguaggagaggcuagcuuuuuaucauugacucuuguggugugagucacauaguaucuuuuaccuaguauucuucaaauggcaaaaauuauuggcuauauuauuuuaaaacuguugugugcguuauagcauuuaagcagucugaaagcauacuuuugcauagagacuuuaaaguauucggguaauagggccuauuugacaaggaaguuaaacuuucaguuuuuggagaauucuaauuuuugucugauccaaacuugcuucagagguuuauaucaaauacgugacacacagggaauaugaauucuuauguuuguauauguauauguuuucuucugagagucauauauugauauuuuuguaaugugugguuauuaugcuuccagauaaugauagcaaagucuucaauaggcaauuuauaauguuuuggauucaaacauuuacguaguaguccuugaagagaacaauaauuuauuggcuauauugauacccauauaagacuguaucuuacagugcacagaauucccacgcugcuuuuaguuuugaaaauaaaacuuucccuuguaaaaacugcuguucugcuuuugugggacgucuguauacaguucugcaaagcuugcuaucacaccagagugggcaagaccauuaauuccaauccuccucuuggcaagguuuuauucgcaugucugaagcuaacaguuucucgaaagacaguaaguggagccuaauuagaacaggcugaaaagcuucccagcuagcacuuguggcuacaauaaaaaacaauucuuggauuuucuccccacagugaggcacaucucacaguuuaucauuuggaugaguaauuuaaaaugaauuaaauuccagagaacaauggaugcacugcuccauagaugucacugcagaguaaccacuuguuugaagccuagcauaaucgcacagccuaauccagauuuauucugcuuaguuuuucaacguuuccagagagcuuuacauuuguuuaguugguaaacuuuucucucucacugcacuuauucuauaguuuaaaaaaaaaguuugaaaguagcuuuaggaaaaccaguauagcuuuauuuucccgacuucaaaguggcaucucgugcuggaauggucuaggcuauaggaacauaaaaccagacauagcagucagaaaaacaacuggagguggugggugagauggcccagcaggcaaggauauuugcugccaagccugccagccugagugcaauucgugggacccaaauguggaagaggagaacugacucccacagguugaccucugaccuccacuggcacaccagugcaaucccauaaauacacaaauguaauuucaaaaucagagggcuggagaauggcuaaguagugaagaauguuugcugaggaaacauguggacugagauucaauuccuccuggaacauaagaugaacagacauguaaucccaguacuaucagggacaaagauaggaggacugaugguccuugcuggcuucuggcccaacuccaaguucagagagagacuuugcuacagaggaauaaggcagagaauaauaaagcagaacacuggauguccuccucuggcaauacacacacacacacacacacacacccagacacacuacauaaaauaauucaaacaaugggggagaauacaaaaacuaacaagaaucauacauucuaguaaauguuauguaaacagaaucacagcauuagggagaaauuacugacuuauuuuguaguuucaucuugugacucuuagucuaaaucuaucagcgaggagacaagcaacaugaggucgauguuugagggguugcaugcuggguaauuuuagcuuacauuguagcucuaagaacauucaaauauaacacugucaauua

SEQ ID NO: 3933 - RNA, 1865 nt, Mus musculus
cggucauugucauaaccagagaaguggauccugcccccugggagcugcuucgcuggaggacucacaccaaucuucaugaacugucuuuugugggguuucuugaguuccagcagggcguagucauaauccaugccgaugucauuggcauugcccuugauccaccccuugggcacaugggugcguuucacgcggauccacugaaacuucaucuugucuggcauggcugagcucgagcuguuguccccuccggcaccaucuuuauacuugggcuucaggaagcccacucggaguuucugugucccuuucacauagguuuucccaucguguaugcagugggcagcagugaggacgugcuucucugccaccagggugccagugcagccaguagacaacuucaccgauguugagaaaggauaauugagcaggaaguccuucccaaaaaugcuaaaccugccaucguagccauaaaucugccucuuccugcgagaucucccuguggccuccgagucucugccucgugcccugccuucaccauugcugaggauguagaugcccacccgagucucugugcggcugccauuggcauaaaggguuucauaggaaagguacugcuuggccucuucguaggugggcagugguguucccuugugacacugagguccacaugaggaggacaccuccaauuucgcuuuggcgucgaagucugccuuagcuaaguugaggguagacugaggcaagacuacagggaggcgauaagccggccauguggguuuccacggaacgguguagggacucaccugcaugaacacacagagcaggacaagaaggaugaagagccccgggauuccagccaugcugagugcuacuguagaaacaaagacaagaagucaggaggaugaaagcuauacaguucauuuacugcagccuggcagggcacagccgcacgcuggucauguuucuaagacugggaacauuccucagguuccaagcgagagccucccucagguaauggucucacuuacaugcaaggacuugcuugaccuuaggaucauuuccacaccucaaauccaaaugaagcuauuccccacccccuucaugaugaagaaguaaagaccaugggacauuacagggccacaucuagaaaauuuaccacuauucugugaacauauggccagcucucauuuuuaugagauuuuugaauguucuuuuaacuugauucuauauaccuuguccucuccugucuagcuacccacccacccuuggccccuuuccuuccuuguuaucuuauucuauuacaguaaguucuuacauaauuuucugggcaacaugcucacuuagauaauaaaucuaaagcagacacuuuacuggucgcaaaggcaucugggagggguggagucauacuagaaaucuuaucauuccuacaugaugcaugcaugcacuuggaagaugacaugagaauuuugcagauuuuugcuuugaauuuggaaaaaaauaaauuaggcauugccuuugauccaaccuucagcaacuugggugcauuucaccccaaauacauugaaauuuuauauuuuaggguguggcugaaacagcuguuggauccugaauaaccaucuucacacuuccauacaaguaaauaauuguagauauuugaauuaugcugcaaaauaaagggucaauguucaagauauaaagcuuuaaacacuguaucuaauaaccuuaugauuauugcuguugguuauucagaugucuguaucuguguuuucagcuugucuaauaucuuuaccuuggaccuaugcuaacaugugaaagaguuaugggauggaugcucacguugcuggaagaauaaauuaauauugcaauucagg

SEQ ID NO: 3934 - RNA, 1865 nt, Mus musculus
ccugaauugcaauauuaauuuauucuuccagcaacgugagcauccaucccauaacucuuucacauguuagcauagguccaagguaaagauauuagacaagcugaaaacacagauacagacaucugaauaaccaacagcaauaaucauaagguuauuagauacaguguuuaaagcuuuauaucuugaacauugacccuuuauuuugcagcauaauucaaauaucuacaauuauuuacuuguauggaagugugaagaugguuauucaggauccaacagcuguuucagccacacccuaaaauauaaaauuucaauguauuuggggugaaaugcacccaaguugcugaagguuggaucaaaggcaaugccuaauuuauuuuuuuccaaauucaaagcaaaaaucugcaaaauucucaugucaucuuccaagugcaugcaugcaucauguaggaaugauaagauuucuaguaugacuccaccccucccagaugccuuugcgaccaguaaagugucugcuuuagauuuauuaucuaagugagcauguugcccagaaaauuauguaagaacuuacuguaauagaauaagauaacaaggaaggaaaggggccaaggguggguggguagcuagacaggagaggacaagguauauagaaucaaguuaaaagaacauucaaaaaucucauaaaaaugagagcuggccauauguucacagaauagugguaaauuuucuagauguggcccuguaaugucccauggucuuuacuucuucaucaugaaggggguggggaauagcuucauuuggauuugagguguggaaaugauccuaaggucaagcaaguccuugcauguaagugagaccauuaccugagggaggcucucgcuuggaaccugaggaauguucccagucuuagaaacaugaccagcgugcggcugugcccugccaggcugcaguaaaugaacuguauagcuuucauccuccugacuucuugucuuuguuucuacaguagcacucagcauggcuggaaucccggggcucuucauccuucuuguccugcucuguguguucaugcaggugagucccuacaccguuccguggaaacccacauggccggcuuaucgccucccuguagucuugccucagucuacccucaacuuagcuaaggcagacuucgacgccaaagcgaaauuggagguguccuccucauguggaccucagugucacaagggaacaccacugcccaccuacgaagaggccaagcaguaccuuuccuaugaaacccuuuaugccaauggcagccgcacagagacucgggugggcaucuacauccucagcaauggugaaggcagggcacgaggcagagacucggaggccacagggagaucucgcaggaagaggcagauuuauggcuacgauggcagguuuagcauuuuugggaaggacuuccugcucaauuauccuuucucaacaucggugaaguugucuacuggcugcacuggcacccugguggcagagaagcacguccucacugcugcccacugcauacacgaugggaaaaccuaugugaaagggacacagaaacuccgagugggcuuccugaagcccaaguauaaagauggugccggaggggacaacagcucgagcucagccaugccagacaagaugaaguuucaguggauccgcgugaaacgcacccaugugcccaagggguggaucaagggcaaugccaaugacaucggcauggauuaugacuacgcccugcuggaacucaagaaaccccacaaaagacaguucaugaagauuggugugaguccuccagcgaagcagcucccagggggcaggauccacuucucugguuaugacaaugaccg

SEQ ID NO: 3935 - RNA, 2365 nt, Mus musculus
caacuucugcuucuuggccgcgggcaugucuguucccgccggcgcagucgacacuucccucucggacauguuccuccgccucccuccagguucuugccgccucgggcggggccuccgccacaccgccgucaagcacgcccggcccgagccugccgcaaagcugccggcgccgccaccgccgccgccccccccacugucgcaaaucgcgcccagccgccgaggcgggcgugcgugcgaccccgccacacugcugaaaaaggggcgcgcacgcgcgcgcccucccgcacggcuucccggcugcuucccgucccuugguccgggcgggcgguuuucccgccgcccucucgacacuuugcaccgaggcgucggaucugcuggcucagagggcagggguuuccuacgucccccuuccccaccagcgccuagagacgaggcggaacucaaagggcugcucccucacccccuuccuggccaagacguuucauccgcaauuggcucaauccuucgaucuccgacccgcugcaaacgaacgaaagucuguggccuggaucggcccaccacugcucccgagggaggggggaggaaagagaagucaccucuuguuuuagggggucugugucuacggucccugaugcggagcucgggagaacaacuucgaguuaguguuuacggaacuucucacagccuagauucuuuuuuugaagggagagauucaaaaucuauaggcuguucccugcucgccucccccaucgggcacauggacgggucccaccugcaggugcgcaugcgcugaggcguauucucgcgcuggguuacggagacgacaggccgccuccuggccccuccuccccucgguucugucugcugaaccagguagucuuuccaccgguuucugaagcuucggggaggauuucaaaacgguaccaaaucagugccuacggacacgccuccguucugggcagauauuuuaucuaauaaauacuuauuacaaugauugguuauauucaaccgguuggugccacuauuggcuuaaguaagccuguauuuuaaauuacauauuuagacuuaaguaaaaauaccuugugaugcaugauacauucuaguaauccaacaucggaagggcaacaacggaaguacugccugcucgccucaaucuuuagaucauccuggucgacauagcaaguuccgagccaaucaaggcuauuuacuaaaaaccuguuugaaaaaaaauuuuuuuaauuguauggaucggacagaguaugggggcaugccuuuuauuccagcacuagggugucagaggcaggucgauugcaguguguuagagcuacacacugguuuggucuacacgaggaguuccaggacagccugggcuucguuauagacccucuuuccaaaaauaaauaaauaaaaauuacaugguucugaauugucauaauucauagucuuaaguguucguuuuagcuguugaaagcugaggcucuaggaaacugacaagaccuauaagucacugugagcaacugcaugaguuugugagacuuagguaaaaggcaauuuuuuaauauagggaaagguaacuaaauuugcccguaucauuaaaaacucuuuaauuuuucauuuuuagauuaaaaaaaauguguguaugaguguguguaugucugugccccacaugucuguacugguacacaaagucagaggauguuggaucccugggacuggagucacuaacguuugcgagccagccuguagccagucuguagccagccuguagccagccuguagccagccuuaaccacugagccagcucacuuguccccucagguacaaucuugacagacaaauaauaaauuugugagccuuguggauuugguggguguauuguuaagccaugggaaugucugaaugaagaacuuccucuccucaauuauaggacagaauuguuucuauauugucauuugucauuugugaaaugaagagguagaaauuauaggacagaauuguuucuauauugucauuugucauuugugaaaugaagagguagaaacagacaagacauuugcugggcacccacuuaauaauaaaaaguauuuuccuuucgcccuccagugucuuagucuuucagaggaaguuuauguaagcuaaaugagacaauuuaggugaaaaaguuuaaauguuuaucuuuucuggaaaaguugcugggagauaaaacuuugaaauuugaaacaaagguuuacuuugcuuuacaauuauuaauuuuaugauuaagauuuuaaaucaacuuuuuauugauucuuugugaauuuuacaccaugcacuccagucccauucaucuuuguaucugcccuccacccuugcaaccuccucccca

SEQ ID NO: 3936 - RNA, 83256 nt, Mus musculus
uccuauuagagcaaucaauccuuuuaaacaaaacaucauaguaauuuccagcauuucuaguuuuguuuuuccagcucaggaagaaguccaagucucugcuuaaguccugguccauucagaccucagcauccacugagcuccugcagcuagcuagcuuauggugugcuggccuuacuggcaaccuugaugcuugucggaaaagaccaccaccaacccuuucagauguuuaccuuccucugcuuguguacaucuggaagcauuguucuccccaccucaccccuucacuuccuuuuacccauccaaaugccaccaugcucagcugguagcagcacuucuucccuugagugacuucucaaacacucaucucugagguacauugccaacguugccucucaucccuacaacuaaguacuggcacacggagagcaugcgguaugcuuaguaggucaaugacucgugaaucuacuucacuggaaacuucauuggccagccuguacacugguugucccugaccaaacuugguucucaacuaaguauaccuccauguuuuccuuucucaaaccugaguaauaggacuucugccucugcuguagagcuaaugaucaaaugccagacucaacgggaggguggggggggcuauacuucacucaugcuuaccauucucugcuucagugaaguccuuaaugccucuccccugguucuccuucaguccugauggcucacucuuggguuccguguaccccccugacuaauggcggugcuuuaaugagacucguccuugguuuggccauuccuuauacugacacggaagagauccuuuguuaaucucagccaccaugaauauuauuuugcacucuuucccaaauuuuggacuuuagacuugcaaagcaaugcaaaagaaaaauauuuuuuuuuaucaauuucuguuuuuuuuuuuuuuuuuaacugccucuuacaguaaguggagaugauagaguucccucccaggaauaguaaaguauaacaggcaaaacagaaauacaaugaaacagauauuccagaacuguaucaagggagagaaaauggguuaaccucaauagaagacccaagaauugagacuugagaaaggucacaauuauggaaaagaucaaacauuugaaaagcaauaucccacacagauacacuggaguccaacagggaagucacaagaucuacaagcuagaacuaaccaaauacccaaggccaccacagggcagguuauccccuuuuccagaagcuacuuuuagguaagaaauuaucaagcaagaauauuuacucuguuaucugauuuucauuuuuguucuuuguggagguuuuguuucuuguuuucucucuuucuuuuuuuuuuuaagggagagaacaaaguuggguggcuaagggaagugggaaagauaugggagggguugagggaggaggaaaacauuaucaaaauauauuguaugaaaaaguuaaaaaggucuuuaauuauauguaugugugccuauggcagguauauacacacgaauguaggagcucauggaggauagaagagggcaucagauuccccuggaaauuuaaucaguuaugagauuccaacucucgagagugcuaggaaucaaacugacuccugacucuacucuucugcagagcaguaugugcuuguaacugcaggcucaucucuccaacaccuugaaacaaguauucuaaccucgaaauaaaaaaaaaaaaaagucugaggcaaauauccaaaauauaaaaaaaaacaaaaaaaacaaaaaaaacccccaaaaaacaacaaaaaaaauuagcaagaaaacaacugaauuaaaaaaugggguagaaaucuaaagagaauucucaaaagcugaaacucagacgacugagacacacuuaaagacauguucaacauccucagucaucaggaaaaugcaagucaagacaacuuggagaguucaucuuacaccugccagaauggcuaugaacaacaaaagugacagcccaugcuggcaaggauacagaguaagaggcacacucaugcauuguugcugggagcgcaaacuuguggucaguguggugggaaugggugugguagcucuucaggaagaugggaaucaaucuaccucaagauccagcucuauaaguauugcauacauucaaaaggacacuucauccaaccacaaaggcacugcucaguuguucauugcugcucuauuccuaauagaaauugaaaaccaccuagaugucccucaacagaauggauacugugauggucuguauaugcuuggcccagggaguggcacuaucaauagguguggccuguuggaguaggugugucacuguggaugugggcuuaagagccucauccuagcugcuuugucuuccacuagcagucuucagauggaagauguagaacuguucugccugccccauuccugcuaguuacugcauguucccaccuugaagaugauggacugaaccuguggaccuguaagccagccccaauuaaauguuguccuuggucauaguaucuguucacagcaguucaaauuaacuaaaacagauacagaaaaugaggauggaauauccucacacaauggaacaucacucagauguuuaaaaaauaaaaucacaaacagguggaacaagaaaacaaaaaucaugcagugugguaaccccgaccccaaaggacaauuauaacacguauuuucauauauguguauauuaacuuuuaagucaaugauaaccaaacugaagucuaaagaaucacagagauuagguacggaguaagggacuaggaggagcgauauaucucccuagggaagggaaauaauauaguuauggauggauggggagggcugggacgggaagaucaaguggagagggggagaaaaaguggggcagggaggaaauagagagacaugcuaaaauuaagggccauuugagggauaguauugaaaccuaaaacagaagcuuaccaauauauguacacauaaaaaggcggucuaaaugaaaucacuaaauaauggggaaaacagagccucaacggccauuuuuugucaccuuccaguacuaggauuggguuacauuuaauugaguuguuggccaaaggggucccaagggaucaacaacccaggcuguugcccagauuauagguugauuucccaacuguuggcaaggcuccacugcugaagacaacaccuacacaacucacagaacauggagaaguugagcuggugccuacacagagccuucacccuauagucuaggucuuuguuacuggaagguacucugaacacuaccaaaggagaaauguaaacaccaagccagccacacaaaaccuuugucaucuccaauaguguccugcuugcaagaucugcuagggcaauagugacacaaagcuugugggagucaccaaucagugucugacuugggcaaacccacucaugagaaggaacccauacccaacacuccuguguggucacaaaccugagacuacaagcaguccuugucauagugacuuacacaucuaaggcagcugaucuucgaauucaaacugcugauuuacucugcacauuguauuuugauuaauguuauagauuuauauuuuauauuccucccuaucaacucugucagacuuaagggaaagcagcaggaaaugugcuucacagaagauccucagggagucaaaaguggccaacagucuagacugcagggguaugaugcccauucaguugugaaugaaugacagacagcaagccaaggaaccaugccacugucuagccaccuauucuaccugcuaauuuaacucccuggaccaacaccggaugugagcaauucuuacccaacagaccccagaaguauuuaagcaauaaaauggagaugguuauaaagcacuucauaugcacacacuaucaaaaaaggucaugaaagaauuuaagccacauaccuuaaaauacccauucaaaaaaccaaaauaaaucaauauuuacuaauuuaaggauucuuaauuuaaaacacaauuucucaguucauauggaaacauuuuaauaauagcgaaauuugaaaaucagucauuaacaaaaacacaauggcuaaaaacugugauuuuuuuccauaccagaacaaacacuuagcaguauacagcuuuugaucucucuuugaugcacucugaugcucguuuauuauccacuacacuauaugauacagacauucuuuagcaaacacagucuuacgcacugacgagcaaguacuuucucccuuaacuuaccugacugacggcguccccucaggaaggaaagugaacaagugcaaguaaugugucuaagcgaguccagacgguaacaagaauucagacauuauucuuuuuguauaguuaaacaaauuuuacauuuuauuugaccagucgauauaauaaccuccugggcauaauuuuauuagcaaaaaacugaugagacugauaauaauaauaauaaaaaaaaaaaaaaaaaaaaaaaaggaaggaaaaaggagaacacaccucaaaccagaacaccguaacauguuuuguggaagcugcauuuuauuugaaaauccacccauuugcuaacauacauuuuaauauuguaaacaaaaauagaaucugcagagacaaugcaacaaguaugcuuaacucauguacagaauugcuuuccuacaaugaacuguccuucuuaaggccccucucaacccaagcgauaagauguauuuacagaaagcaccgaucaacagugcaguuuaauucuucauuaacuaaacucuuggcuagacauugacuuuaaagauacuaucuccccuuauugaaaagguacaugaucauaacauggcacacgccaaauaaaaaguucaaggauuucuguucccucccuuuccccauaacaucuccuaaaguuuuacugaaaagaaggacagucuugaagugaaagcaacuccucacauucauuuggaaaggcccuaaugucaaauggaaaauaacgacaugccaagcacaaagcaguaaagauccuucccaaugcacuaaugcugaguuuuaaauguagugcuuuuccuagucagugaacuguucccuugcaaaauccuaggcacaggauugacuauaaggauuaaugcauuuauaaugcgcccuacaucccagagagacugagaauucuuaagagauucagaccuauggauuugccguaaaguauuuagugcucuguaugucagcugaaaagcauucugaaucagauucauucuuguggauaaaaaucaaacauacugugaacauccauacucauuuucuuaaggaggucugauauaauauuaauguuauguaaaauugauaaucauaaauaaauacaaauacuuaaggaaugucuacugcaaacugaauauaaauuuuuuuuaaaaagaaaaguuaacuucaauuaugguuucuguauaugugaggaguggagaaaagaaauauaaugcauaauuuaaaauuaugauuuugaucccccaaugaauccuguugcuaugguaaaggacacaacucuucucuccaggcagcuuuuccaacacaaacuccacacuuuccaaauacgggcuuuucuugguagguuacugauuauggguauuaauaggaguugaaagaacugaaguguuagucaccaaaaagacagaucuuagucuuaaaucauggcaauucuuggcuuuauaagugguauugacaacgcucuccuauaaacuagucccaucccgcugugggccuucauggguuacuggagcgcucuaauggaggaagaguuucagagacagcaguuucaauuuugcuggaaguaaggaguugccgccugugcacuuguauucuuggaguaauuccauucucuuccaucuaguuacauaaacuguaucuggagaaagaaagucauaguauaaauuaguuaauucaccgcauuauucucacagauaaaaacacucuaugccuuuaccauuuaaccagcccagagauaacaugcuuaugacagacuccgauggcaccaaaguaccaccagcucccaauauggcggaacuuaaucagugcagcauaugguagguauucuaauuauuuuccuagcuacuaaaaagcaagaaauagugaagaugaggggagaagaccaauaaacuuuuuuuuaaguuaaaaauauuuacgcauaagcacaaauguccuauguaacuuauccgggaaagcaaaauauaaauuauuuccaaauacauaauuagagaauaaaguaaaaaguaacauugcacugauucaacucuuugcuaauacaaugaaaaaucugaggaauuuauaaagaaacuuuucagucaggagucacuguucacucaaaaaaugccucgcucauuuaucuucaacugcuuaaccugaggcagcuaaaucugagguggauguaccugccaaguaagagucaaacugccaaagaccuagaugguaaauguacccugggccuggggcaucaagaagaacaaauuaaacugucucccagaagauaaaugugguguagaucauauccuuguagucaaaggguuagguauucuccugcccuuaaguaaaaaccaaguuguagcugggaagcagagguagguagaucucuugugaguuugaggcuagccugaucuacagaaugaguucuaggacagucaguacuacauacagacccugucuaaaacaaaauaaaacaaaacaaaacaaaacuaaacuaaaguaaaaccaaaccaaacaaacaaacaaacaaaaaaaucaaauaaauaaauaaauaauuuuuaaaaguuacuaucuugaacaaagggaacacauaaaauucaacucuuuaaaacuuaagcuacuucuaaccaagauguaaaaguggggcaggcauuuucuacaguucuuguaagaaugacaaacaccuuauuuuuaagggugauauuugaccacacccaguggcugugagcaguggaugcuuguguuaagaugguccccccucucacugauuuuaacuauguuaaagcuauguuccaaggugguuucuucuuuuguccuaucucaaacuguuuuuauucuccacauaaagaacagaagaggaggaggcagcugaggugcagaaggaaugcagacuccuuuaaauaaacaaaggagaaggugcaugguuucaguguuggcaaucuuggcuuaaguauccacauccccaucgcccccacacgcagcaauaccuaagugacuuauaagaaguccuccagagagagcucugcaaagggguccuuuccugcagcucugugaggacugugccuggaggggcuggaugcugccgacagcugggggaaagaagacagagacagggaagaaaaagaucucagaaugacagaacaugagagcagaaaguguaaugaaggaagagggguuuugucaccuuuaguaaauauaaaaguagccucuguagaaaauggguuuuaaaaaaaugcuacugcaugucaaguuaaaagauauucaauggcaugguuuuccagagaacgaaugcaugccucugaaacaugaaaugaaagucuuuaucuguaaaagcugauauacacugacuuaagucaagacugucagcaucagggaggagagggaguacaggagaaaggaugcauaacugugaucugaaaaaacaaauugaagcuaguuuccuguuuucagacaucuguccacagucaguccaaacugacuucuguucggaucccacauuuccaaaugcaauauuccuuccugccuucuucccacugggcacaaaguccugcccuugggucucuacccugcggcaggggcccacacaaugggaacuaagcgaagaaaucucugaauaagggaaacaggccucugcuuuguuuccagucugaaaauacuuauucaucaugcuuucagaauuugccccuucuuuuacuuugaagaggaaacugaccacugcaccaaguaacacuaucuuuacuaccaaagacaagaguuuuucugaauaauuaagauguuacuugugcacauguccaaguguuucaccaagcugaucuacaagcauuuaaaacucaacauaagcaacuuuuaguuugaaaaaaaguuuuauucuguuucucccucacuauaggaucauagaggaguuugcaauuacagagucauuaugaaaagaauuguguuuagggauauuuaguaaagcauuaaauuaaaauuaaguaaaacaacuucaauucauauucccaacccuuaaaucagaugaauaauuugaagucacaaaaugaaaaucucuuugcugguuuaaaaauuacuguccccccgcuucccacccugguuuuucaaaacacgguuacucuguguugcccugcauguccuggaacucacucuguagaccagguuagccucaaacacaagagauuugcuugccucugcuucccaaguucugggauuaaagguaugaucacuacagccuauuucaucgcuuuuuaaguuuugcuuuuacguuugcuucuuugcuucuguuuugcuuuguuuuaaagaaaaacaccauaaagaaugauuaggcaaugaguuucaaaaaauacuaucucaccaguguaaguaauuugccauucagggcauuauaaccaacuuacaaaucugaaaaucaucuuuuguuauucuggucaccaagauuguuucccaauccacauacuguuuuagaaauacguguucaaagacaguaagaagagacaauagaaggauaauggacuuguacacgcagcuauagacaggaggacagggcaauguguuacaauacccgccacucuaagggcagcguaaaguagaaccuagcuggaaagaugccccagccuucuuccugggaccauggacagaugacuguucagaaggcaaggguuucaaauacucauuaaucauugagauguggggcaaacuuuaguauuuccuuccacucuuaacuucacuuacaaaccaaccuguucauuuuacacuguaucuaaaugacacuuucuuacaagggcccuauacuaaaaugucuccuuaaaucauguuuucagguggguagcaguuugaagaccugauagcaucagaagaaaauguccccgaagaacacaaaagggacaccaucauucuuaaaacaugagcaugcugccaggaguccuagaguuuuacacucggcauugaaaggggucaaucuaccuuggauauugucuuauccaaaacuccuucuagucuuucaaagucuuaaagacacacagcugucuuauauguauacgcagaaaauuaaauguuugaggccaccagucaaaaaacaaaacucaguaucaguaucuaucuccacacuauguuucuuagccuuauccugcugaaacaggcaaaaccacgucccagagcagccuggcuacuguacuacuccagggccuggaaugcccagugguuauaagcaccuacucccauccuuucccuucaccagcaaaaagcauaaacaaagccugcacugguaggaagguagucagauggagggggaauaaggaaggacagaacaggacaugcugcccacauuaccacucaaagaaagcaggaagaaaagggauggaggggcaagaacacucaaggugguuaagaugcagcaugauuucaagucugaagaagucaccaaagauaaagugaugacccucuuuuauuuaucuuuuuuuuuuuuuugaguaaauuaaagaaccuagcuuaaaauugcccaggaacaccaaaaccgcaaaguuaauauauuggaggaaaaggaauuuuuuaaaaacucaacuugucaaauucaucauaaaaucaaauuuauaaacugguauaaaauaauuaacuauuacaaauauaccaucacaaaaauguguaacaaacaaaauuacaacagaaaaugucucaauccacauuuccaauaacaaucucuaacuugagguuccaguacuaagaguuaauauagucaugagucagcucaaaucaaagugacuuauuucauaauuaaagauaccuccuuacugaucuaacacagacauacuuuuuuuaaagaacaggaaaaugaaauacugcaaagaacaucauaugcagaaaacuacugagauuuaugaguaaucaauggugguagcugcuggcugaaauccuccugccacgcacgcgcaucacuguggaggagcaggaacggugaggcggcuucgcaguagaaagcaccgcugugugcccggaaagcgcacugaccccagaaugcugcaugcgcaggugcagagaaaaccaauguccccaggcuguccucaggagauccucugccuuccauacaucugccccagcauauauccguccccaugcacacauaugcacaauacauuuuaauaaaaauacaugcaaaaaugagaaaaccaucaacauuuccagaaagcucuuugcuuuagagcagagcugucugguuuaucuuuuccuguuuugguuauacugcgcucaguagagacugaauagugaaaucacaaauuaacaaaagaaaaauauuuuaaaacgcacuugauaauauacuucaagaaguugacaaauuaaacuucacaaaauaaaaauaguuguuuccuuauucuuguuuacuaccaaauuaaaaacugcagguuagaacaagaaacuagcaguaggcucagcgagccaggcuccaacagccuuaugagaagcugagggacuaguuuguaaaccagagagucucccaagaauucuaauuuucaggccagaucaagacacuuaguggaacugucucagaaucuacaaauaacuaagagagcuauagcucagggacagaaaacuuagccugaaggagacucuggguuccauguccagcaccacaaaaaaaguuuaugaaaauaaaauuucuaagacauuauuaguagcuuuguucuuaaguucuuagggaaaaucuggguucaucaacacuggccuauaaucaaggcaagaagaucagaaguuuaagguacgaaauaaacugaguaggcuauuuugagaccccuucucaaaauuaaaaccaaaacauuaacaaaaacaaaaauauagaugccuauaacuaaggaaauacuuccuuauaucuuuacauuuacacucuccaguaacucaaaggacuggauaguaagagucaaucuuauagacucuuuucuaaaaaaacagacuuuucuacaaacacagacaggaacucaagagaaaacugggccuugcuucuucuggaaugacucaccagguauuuauagaaagacaaauugaacuggauucagccucauuuauaaucugggaucuagagcacuuaagcccuuaauaccugaaacccaauguuuaugguaaaugguagucauaaagguugaguggcuguaaauacucugcauccugccuggcagaaaucaggaauucaaaugagcucauucacuacuuagcacugaccaucacacauuccccuaugcauacggaggcucucgucagaagccccugcaucuguguagcucuugguugucugcuguaucuguaccaugaucccucuuagagaagcucacuuuaccacucauucauuugugcuuccaaauggcacucaccuuaagguuccucaggugaaggcaacauuauuuuaccacuuauucaguuaucaccagggacuuacauauuaugaucauuccaaaauguauuaaaauguguuuguugauaaaauccuuuguacagacuugccuccaaauucagauaagagaaaauuagaacgucucuaauuuuaaaauuuaacaucuuaaauuuacuuuuacaccuaauguuuauuaguguagaaacauacuaauccaaccuauagaaauaugaaagguuauaugcuuugcugcuguuucagugcaugacaccugccugucugucugucugucucucucacauacacacaccccuuaccccucuggaacagaaaguaauuaacuguuguuggguuugggggggggggggggagaaaccaugaacacacagaacaaauccaguucuauaauaaugaacccauugcccuuuugucuaguucauguaguuggaauuuaagaguucuacauucugauacuaauaguucuacccauuccuucugucuaacccucucuucuuuccuuccuuucacaauuaagagugcuaggcaagugcuggaccacuggacuguauucucagcaccuaaaucaaccaaccauuuucuacgugaacacacacacacacacacacacacacacacaccaguguguucauucauuauuauaggaacuucccucaggcuguguguucaugaucacugcccuucuacugcaccaagaaagcuuuagcuacaugcuggcagccugacacuggauuucccauugaaacgaauuucaauucacugcacauuacucagcuuguguguuuuauauaguaacacuaauaaaacacauccucuuaaagcugaugucaucaagaaauauuuagcgauaacagacaguacuauuccaagaucccagagaaucagccucagaaaccguaaguugucucaggguguuuagagcacagccagaucacuaguggcacauccaaaucuacuuacuagaugggaauacacacauacuauacuguguuguaugccauuaguuuucuauuaaaggcagucccauucuuugguugccucuaugagaagcaagaggcaaggauaaguacucuucuagaggacaccaugugaggacagcuucagaauuccagccucugggacagaaaguaaauacucugcugcuguauuaauccacagagcuugccauauuuuguuacugcugcccuuggaaacuaauagacucuuaaugcacauauuucgggcucuaaggcuguuaacuuuuugguucuuaaaauuaaauuuaaauuccuauuuauuucaacucaauucuaucaugauauuuaacuuauagaaagaaguuuaagugcuaucagagcugaagugauugcucaauguuaaccagcacuugcuguucuuccugaggacugcgguuagauucucagcuuggcaucguacaugaugacucacaccuguguaacucuaguuccagggaucuggugcccucuuugggccuuuguaagcaucaggcaggaacauggauagacacucaggcaauauacccggacauaauacaauauauuuuaaaugagauuaugaaacuuucaaaggaacuuuugaagugguaacuuaagcguucuuuggaaagcaguuggauaguguuuugcugaggcaaacauaugaaagaauaaauggauacaggugaaagacuaagguagacuccugaaggaacauuucacugaaacagacacaggagagaggauggcuaaagaaacaugugaaaggauguguaaugaagaauucuuugcuaacauuaagcucccuuuguugggacuugaggacucuagauugacugaaugcaugugcugaagcaagaucccugcugaggcaaggcacacagaagauacaugauguuuggaggguauacagaaugacagagcuuggccugcugguacaguuagccaugcaaugcuguaaagaucacaucuuagcugaucuucacuuuccugagaggcacaacacagaacuucuccugauguuccugcuggucucucccacugacaagcucaggcuugugacaaggucuggcugugucugcuaagucgugucaccgcuguugcugacccgaaucuaccgaacuagacugcgggcagauccacgaaauguuugggaauggauugaucuacugcugcuaaccugugaacugaacugccaauuuccagacagcacagacgggagcugcuccaaagaauguuucuaaacaggcccacucacuuccccauauccuuccuuucccacuaccucugguggguggugggcuacaagggagguuaaagcguuuaagaaccaucauugaaaguaagguuuggaaaaaaaguuacaaacuuuucuagcauacacuauaaaacaaauguagucucacacuuucuauacacucagagcuucugaaguucacuaugacgacauuguaaaacuuuggccacccaagacuuuauuaaugcuuucuggcuacaagacaagaaauaaagguuuuaaaaaagaaaaccuagaaaguaaggccuuccgcuacacuuguuuuauuagcaacagagguuagagaugagacuccuaauauuuuuuuauaugauuaacugguauauaauaagggcuacagaaucaauuuuucauuuaugguaccaaaucugauucccaaaguaaauuuucucauaauauuauauaauaauaaguaggaaaagauaaaugagcauaaaguacugcugaaaauccaaacaacauuauucaugaagauucugcuagacaaaucaguugagaacuaucacuaucaacauccaagauugguuggaagccaagacaccagaaaaugaauuuaaaaaccccacaugaagccuaaaagcaaagugucauugcuuccuacaagaaagucauuagccccacgcauucucaggacuugaauuaagccagcaucuaaaggcagcagugcuuauuuauugcagaaacugcauucacaagucaguuuccuuucagacaccuaaaugaugucagacuugcauaaaaauguccacugccaacacaauaaaaacacauauccucccuagacaaaacuagcaguacuccauuaaaaaaagaagccuaguuaaugaaccaaggaaacucuuaaaauaaucuuauuuuuuaaaugaaaacacucauuuaauuuugugcuuuaacauauauacaaguggagagaauguggcaagcauaccaaccuuugccaucaucaaaaagcuucaacaaccucuaaagccaucaccauguaaagacccauuaaaaacuucauuccuaucacagcaucuuugaaaagaagacgaauacuagguuuaacugucuuccugcuuaagugacauaauacuuauacauggcaaacaaggaacuuacaagcuacucuucaucagugaacacucuauauaaaagaucaggaaaguguauuuaaaguucaaauuaaaacagaauauaaaaccccauucucaacaaauuaacaaacucaugaacaagcacagaaagaaagaaagaaagaaagaaagaaagaaagaaagaaagaaagaaagaaagaaagaaagaaagaaagaaagaaagaaagaaaacaaaacaaaaacaaaccuaugaggacccagcuuuuucuacauaaacaucugggaaaaugcaaaaccaagaccuuaauacucccuuuuauaaguaagauaaacaagugacaaucucuaaaagguacugaaugaugaacaugcaccaaaacaaaggaaggcagugggacuugacugggauguagcucaguagcaaagcuuauguucagcauauuuaagaacauuaaucaaugauuuuaauacccaaaaagaucaaauaugaaauggucuccuauucacugcuacguaucaaauagagacuagauucaaauugaacauacacuaucuuuauaacacuauauauccuccuaagccuacuagguauggaaauggaaaagaaauacaaguuaacugcugaauauuguuuucaaauaagcuucaaauuuauagucuaccaaccuuuugacuuugaaaaccaucuaggaaaccaagguauacauuaauaauuauauguaacgagcagagccacauagaaggauaaguuacccuguacuucauaagggcccuaucaaauagcauauaauaaacaaaauccagacugcucuaaugugcccuccccaaccccaaaagaauaaaauuaagaacauuuaaccuaacucucaggacaggagaguauaauauaaguacauuuaaccuaacucucaggacaggagaguauaauauaagaacauuuaaccuaacucucaggacaggagaguauaagaagucuccuuuaaagaaccuaagucagcauggccguccuaaugcuuugucccuuuuguuuguuuguuuguuugcuuuuaccauaauuuuuagugaaaaaaacuuaccuaaugaacaaauaacaaucaaacuuuuuguaggcuuucuaagagucugugaacaucuccaaagcaacacuuaaagcaaauaccaagccauuaaguaugaucugaugcucugaggcaaggcaaagcucugaugcauugagggucuaaaugcaaggauuauaaagaaacaaggauccucagccauaagcaugaaguuauaagaaguucccaccuauaaaaccuauaaucuacuugucacgucucuggaacuaaucaauauucugaaaaguacuugaaccaggaagauaaaaaagcaaguacuaaguaauauccaugacaaaaagcaaaguuugacgucuuucuugaaugagagaaauugauaauguuauagagcccuuccaacucagcauauugcaacaguuaugcacaucauuaguaccugugcuccugauacagggccaaagggguuugguggucucaugacaggcuggcuguauauuaagguugguugugucauuacagguacacuucccaucugaggaggcuaaaaagauagaauaaaauuaagaaauucugguuuacauauucauuauucuggaggaaguaaacaaggcuaacuaacaggaaugcaagguuaagaguaccuuugcucagacaauaaggacaaauuauucugcaugcaaguaagaguaauauguacuuuuaaaagaaguacuacuuucauauagaguucacucuuaaaaaguagaaaauagacagguggugguggcagcacaccuuuaaccccagcacucaggaggcagaggcagguggaucucuagagcucgaggcuagaauggucuacagaacaaauucaaggauagcuaguuaagcuacacagagaaauccugucucaaaaacaaaacaaacaaaaaaguagcaaauaaagccuagcuuuccuauccaguggguuugccaaacuuaaacuguauuauaguaaaacaaaaauauuucugaccaaaaagaaaaaaaaaggggguggaugggagaagaggaaggggagaagauaauggcagagaaagguuucccaaguacccaaguccucaggguccacauacagagaaagccuguaggcucuacagcuaaacaguaacauacucaaagcaacccaauugcuuugaguaucaaaucaaguuuuaugucacuauguaaacgaucauaaaugauggcugauuguauguguguauacauacauguguauguauagguaggugcaaauacaaguguggaguucagagaucaaccucaugucacugaugguaacagaauauacauugugggaauggugaaugguucaaagacugguuuuguacuccaacagucacugucagaggaaaaucauucuggccuauaccacacuaaauuuaccccuaauuaacucaauuauucaauuccacaguacuaaggugguaucaccucacuacuuguaacaaaauagcuugaagcuaacauuaacauuuaagucauuuuguaaugaaaaacaacauauacagcaaaguuaugagucgaaaaacaaauuauuaacacugggcacaccaaucauaauuccuauuuuacaacaaauauucuaaaagauacuuauggaagcaaugguuagguucuuaagcuauagggcacuacuuuaaaaaaaacacuaagguugaaauaaaucauguuaagaauaaauuacucuacuuuccaaaaauuauauuuagaaauauacuuacaauuccauauccuaucaugcccguugguguaguagcaggauaggccauuacagggggcgccugauacggcaaaagaaaaaauaaaacaggaaauguuaauuccugcaccucaugauuuuaaaggacugucagauuucuauuuuaaaaccaauugcuaagacagcuaugauuaagugacauuuaugauuacugguaacuaugaauuaacacucagugaggaaaaucucaaaauuagcagaaaagcaaaauugucaaaaggaaaaaaaaaaaaaaaacccacuuaagcuuagacucgaccacagucuaagaccauaacauacuuuauagcauauagcuuucaaagacugagacagagugcuuguccuauccauagcuccaccaaauaagaaaacaaauuaaaaagucuucagguauuuaaaaauauccaaaaguuccaaacuuuaaagcccaucauuuucauaaaaaauguuuaucaagaagaacauaauauggacuguuucuuaauauguuucuuuaguacuagaagggaaaagaaaaaccuuaugauucuacaucaauuaggaaccugauguucaaaaaaaccacaggaagaccucgagugacuacuccuaugaucacagcuuucacauaaguagcuacauguuagcuuucuaauuuguuccaaaacuaucaauuacuuaagaggaacaagcauguucuaaguuauauauuagugaggacccccguuuccuacuucuuuuauugaugacuuguaaacauacuagaaacauaauauuuuagguauggcugcugucuuaacaauauucccucucucauaaaaagcuaaaacugaauacaggugaaagaccaacacagcuaaaguauguuugaaaacaugaaauuauacaacaguuuuaacauaugcaugagguuaaauaaagcauaacuuuaaaaauaacacuaaagagugaaguuuaguauuuaggugagcauguagggcguauuggucucucccuacuucaaaaccaagaucuacaagagcaguaagacaaacugccaaguacagcagaagccuggaagauuacaugcaauuguuauuuuaaacauuaccacaaucaacaauucccuucauucaaaagucaucaagugcacgguggcagcacagauacacacacagacacccagccaucuggcagcaaauggcggaauauuaagcaagaaagaaaaauugguauuucccaugccaccaugagaaucaauucugcaacacacccaugaaaaucaguagaugcuaggaauaauuucuggcacacugaaaaucugauguggaaacaaagaauagcuggaagguuaugagauucugcugcagcggugguuaauagcaugccaauuuauugcaaaaaaaaaaaaaaaaaagaggcuaguuuuuggucacuuacguauuguggaaaaugcaugccauucuguuuuucccagggagaacaauuacauaaugcaauaacacuggauuagagcaaguacuuacacaacaaaauacacagagagcauuuuaguuuacauguacauucacuaccuaaaacucuggguauuuucuauaucuaauaaaagaacaucuauuaccaaaacacuaucaagguugauaaggggaagggacuuuuagcuaccccccccuuuauauaugcaaugcuuuacuauuuacaaauguauuuaaaacaaaauacauagugacauuaguaaggaaaauucaagggcauccucaaaauaacaugacaccacaugucuaccaccagggcaggaccaucauugaaaagagguuguggcauaacaaauauuuugauaaaauaaguguauuuauuuacaauuuaaaaaauuaaaaaccuugacaguguuuaagaauuaaucaaaagguuagaaauauaaaaaaaaacaaaacaccauaagcagcaguuuauucuuagugagucacaucacaggccccacacguuagucaucaaaaaauaaacuaucauauacacacaaauaucuuaaguaagauaucauaagagaugacccauacuaacauauauaauacacuguuauuuugacaacuuacauacaaugcuagaugguuagguguuuacuacauucuaguagucaaucuuaagguaaauauuaucgaaagcuuucggaugaauacugacuuaagauuaaauacacaaauacccacugugacuucauauuaguuguaguacuuacagcaucacacagacauuuuuaaugaauaauccuaucugcagucagaaagcccacuaacuuaacugcugccagcaguuuuagucacugaaguauguuauaaaggaaaaacacuacauucagaaucagguuucaacuuaaaucagcuguuuaacugcuuuucauaaggggcucuaaaacagcagcacagauaacauuguacuucaaagugauauauguacuccaacucuccugagagaguacuguacucuuacacuuacuguauaugcuguguuuguauguaaaaaccuaaacuaugaagcuagacauguuagaaaccugaaauuccagcacuugggaggccaagggagaaggaugguacauuugaagcugaucuggaccacuuaguaaauucagaaucaguaugggguauaucacauaaguuuugcacaggcucacaccugcauccucaaaacaacaaaauuaaacuugagucuuucauuuuauaaaaaguagucaagggcaguuaagaguacagacuggucuuuuagacauccuaaguucaacucccagcaaccacaggguggcucacaaccaucuggugugucugaagacagcugcagugcacucaccuacuuaaauaaauaaaucuuaaaaaagaaaaaaaaaagucaaaacuuuuacacagauuuagccucagcccacaauuuuagcauaucauauaagcaacccaaacaguaauguuucauaagggacuuuauuaagcacaauggagcuuccuauuaacaguuggggaagcuauacuauauauaccuaagugaucaaaacccuguuaucauccccacugaaagaaaggaguauguuuuucccuaacugagagagaagaaacuuggcagauuaagauaaagcaggaaaagacaggaaaguagccauaagcuauucugggccacaauacaauuaauacaguaauuaagaacaucaauauaaucucuuugguucuagcugcuacuuaacuagcacacaauuaucugcuugcuguuaguaaacuuuauaauccccaaauucaguauucacaguacuuucaugcacaugugcagagguauauaaauuguaacaugcaacaguuccuuccucaguaagauggaauaaauuagagguugucccugcaauuuuugaaauuauaggccaugcaccaguaugucuggcuuagaaugaggcuuuuuucaggaugugaaauuacaauauaaaauauacaaaugaauguuuucccuagcaaugacucacuaauucaguuaucagggggacuuaaaucaaguauugaauggccacaaauaaugaggaacuauauaauacuuagaagaccuaagaaaauaacuuguuuacucaucaucaggucuaaaggauauaggacuuaagguuacaaaaaauaaauaauaaauuugagagcaacaauacuaagaauacaucccauuacucaagaacucugcaauacuguugcacuucuuaguaacugugcauguacuaagugggagaaaauaauagcugcuaccacagccacacauuauucauuagauugauaucuaucauggaaucauuuuaaauacauguuaggaguuaaaaaugugccugacaaagacagucaaucaucuuuaaagaaacaaugaaguacuaaauaaaacuuaguaauaauguuuccacuuaugucuacuauguuauauuuguuauacauuuaguuaaaacauucagguauauauaagcuuccccaacucaccauuguugcagcgcuccaggcaguuguuggugcaaccuuugguugccaguuagauccuccaguuaacuucuuuucaccugguugacuccaacuuacaucacuuuaaauaaacauaaacauacaauguuucugaacuguaugaacauacugaacauuuauuguaccaaggugacaucucuauauguacuucugaagugaaagucagaauagguucuauaugauauuuaaguaauacaaacaagacacuucuuaguggguggguaggggagcagggugggaggaggguauaggggacuuucaggauagcauuugaaauguaaaugaagaaaauaucuaauaaaaaaaugaaaaaaaaggcacuuacuucuuagugguuccauuuccaaugccaagaucuaggaaaagagaaaagucuuuacaaacuagacucauuuuaacaauuuaagcuuaaaaaugacuggagacucaaaggacuacuuacugcccacaagguuggcuaaagaugaauccaagucgucagacacuaauuuguuaggcggaaguuuggcaacaggaagacucugguucugggaggccacuguugguuugagaaguccaccuaguucaucaaagccuuaaaguuacaaacagaugaaaugggacgcguaaggaaccucacgggcuacggcuuucuaaaggaauucucucccuucucuccuuguuugcucacugcaaguuuucccaggacaugggaaaugcccucacguggaaagaaaaaucugccaccuuuaacugaacuuaacagaaacugugugucuaaaauuuaauaacaaaauuauacccaaauuuaagggggugauaauaaagcgcuauaaaaggggagggggacgucucucccuauuccagcaaauuuuuucuaaacacuuuaggauaaaguccuuuuuuauguugagaaagaauauuuuauaaugucuuauauuggagcugaagaaauggcugagcaguucucaguacgcaugucaggugggaagcaccuguaacuugagcccaggguguccagugucucuggccucugcagguaccugcacucauguguacauaccuacccaccuccagacacauaauuuaaaaaaauuaaaucuuuuaacuuaaaaaauaacaacuaaaaaucguuuuugacagguccuuacugcacagcgcuaacugggccagaaugucuacguagaccaggcugacgucaacuucacagagauccaccaaucuuugcuuuccuagugguggaaguaaagguauaugccaacaugcuucagucacaacaaaccguucuucuaaaagugugugugcgugugugucugucugucugucugucugucugucugucugucugucugucugucuguuucaaaagaaaauccguaggaguugauucucuccaaugugaauccuggggcuugaacuaagguucuaaggcuuugcagauaagugagugcccuuagcaccgagcuaucucacaagcccuagaaggcauauauuagagagcuucucacacuucucauauuugggaauuuaagaaccuacgucagaggcuggggagcuggaccagugguuaagagcacugguugcucugucagaggagccaggcuuaguuccauuuauacacacgguggcuuacaacugccuauaacucuaguucuagggaauccaaugcccucuuuuccaaccuccaaaaugggccuacaugcacaugcaaaugagcuuucaaauacaaaaccuauucguauacacuaaauaaauuccuaguccaaacaagcuugcuucuuacuuuuuggauaacuaauuaaacauuauguaacuaaaaauaccccaacauguuuuaaaguuaaaauguaauuguuagucaaagucagugaucaucuccguguaggaauaaaauuagaacauguguacuuuauaaacuucaagcuaacaagaagcauaaaguacaauccucauucuagaguuuuauaguuuucaaaauauaaauuaguaggugcaccuuaauaauaaucaguacuaaaaugacuuuuuaaagccuguagccauaaacccuuuaacauacucuacuuaaguuauauagaaacuaucuaaauaaaccagguaccacgcacuaugucuucaguuuaaaaauaaucucacacacuguaagaccaacuggucacuguucauuucaguagaagaaaaacugucaugaccaaaagcuauaguacuuuccaaauagucacuaacaauuuagcacuuuaccaagaaauuguuuucuuauuauauaguggaacaaacaaaaguuccccuaaacucuaaaaugcuaccaagaaaaagguaaaauuaauacucuuuuaaguucucaucaagugauuugggggaagaagaucaauuucucuaauuuauaaauguuaaaagcagcauguuuccuauagaggaucgacauuaacaugucaccuaucauauuuuaaauaaaaacaacaaaaacucuccucuuaccaccagaaucuacagcaacauucguagauuuauuuccaaacacagauucaaagucaacauuaaggccagcugaagaauguggcugugcaacuggagaaggacugaauccuaagaggaagcaaacacaacacacacauguucaguucuccacucacugucucaucaguuacagaguaacuguaaguuaucuuuaagaaugggaauagaaugggaaaguaauacauugcuuaacaagaaaccuaguucuaaagcaaaaguucucuucauuauaucacauuccuguuuuuuaagauauacuaucacauuguuguccaagugauccucagcccaagugugaagauuaaagguaugaaccaucaacaccagcuacauuuccauuaaaaucacccacuaaaaaaacucagaauaaacaacauacauuuauuccugacuuuacuucauuacauaaaugaaaccuauucuuauauuuuaucuuaauuuugcaucugauaauuucuuaaaacuugaagucaucuaaaaccccacgcugucucucuaccuacgaccuucuguacucugaauuucuccuaccuacuuucccuuucccuacuucaccccaacugucacacauuaaaaaaaaaguuuuuugugugugccuggguauaugcuugugggcaugcaugugcuacaguguauguguggaagucagaagucaacuucugaguguuaguuccuuuccuccaccaugugaguuugggauacaaauucaggucucacugcuuggcagacagcaccuuuaacccacugagccauaucacuggcugagaaauuacaugguguaagauaaaucugagaacugcuaggauucuaaaaauugcaaucucacaaauguuucugccuguuuuaaaaacacuaaagaaaaaugauuuucuucuuucaacucccauccacucuuucaauucaacuuaacauuuuuaacacuaggaaugacgaguaaggggccaaguaugcuaauuagucuagaacuagccugaaacacacacccauacaagacacccuuacucuuucuuauuuuauucuggagcuaauaguguuaacauaacaaguaccaagauugagucucugaggccugcuaaggcugaguuaacauaaaugcuuuaauucucagguuauauuuuucuaaaguucaguguguaaaauugcagaagcuaaaaauaauuuaaaaacaucuaaaaauguuaggucuguugcaugacuugaggaacuuugaaucacugaaacuauuuagguaaauaguuugcaaaggaucacaaaaagagagucuuacgauauauaugaggugguagucacuugcuucuaaaaucucuugcuuccuagguucuaucaagucagaaugaaaacacauaaauaaaagcaccugauuuuaugagguuaucauuuauaucaacaagggaauuucugaaguucuacacagauucucuuccuccuagagaggagauccaucuucaaaaccucacuucaaauccccaagaauaaguuuuuguuuuucacucuuucucguguguguggugugcacaugugcgugugugacugacugugugagcuuaugugccccuuacacaggcaggauccuguagagcaaaaaagggcaucagaucucccuggaacuaaaaguuacaaacaacugugaaccugccaugugaugcugagaauugaaccuggguccucuggaaaggcagccagugcucgacccuucagcuaucucagcucuucagccccagcaaugguuugugacaccauuccuuacaaagugguaugcauaauagugacccuacuuuaaacuaguaucuggaguuaugaguauuuaagauccauagguuuuaagaauguuuaaaguuugaccuuguucuaacccuuaaauuacuuuuacaucagaaacacuggucucaggaugaagaacaaauacauaguacaaaugcccucuuucuacccuuuauagcaaucuuagaacaacuccauuauuuccuauuauagggaaaccaucuucugaagucuuuaaggugauuaauugaauaauuaaaaaauaauuagcugcaagugcaaaaagaaaggcuaaaaaggaaaaauguaauccaaaacauguaccucaaguugggguuuuuuuucuuuuaauccuacauagacaaaaauguaauuucaaauaauuuguaaugucuggggacgcaagcaacauauuucuaagguaaucauccuuucuguauaccacugugcauguacacacacaugcaaacacaaacacacaugcauucaagguacagauuuuguuuacuauuucaguaaauaugauuagucuaacacucuccugucacuuuuuuuuucagucacuuaucaggauuaucaacuuuuaaauuuuaaaagcuacuuaaaacagaaauacaaaaccuuaagguugagccaacaagauggcugagcaugccacggaaaucucaggaguagguagaccaaucaccagaacuccauaccagauaaaagacaaccaacuccacaaagcuaucuucuaaccuccaugucaggacauagcacacacacaccacacaaacacaucguauacacauauagguagauaacacuggggaaaacuguaagaacaaaaacaccuucagagaguagaagcaggaggcaucuguaucuggggccaaucugggccacauggugaaacccuacuuaaacaaacaauaagcaagcaacaacaaauccaacuaauagcacuacuucaaaagauacacuuuaaagggaaagaggaaaggagacagagaggagagaagaaaaggaaggaggaagagauagaggaagggaaagaagggaaggaaaagagggaagggaaagagaaaaucuacuccuacuuuuccuaagacccagagaaaacuguucuugguuggcaccaaucgacagacaguauuucuggccaaucucauaaagacauaauaaaugaacugagacacaaaauaacuagcacugggacagaaaagcaucccaacaucuuugaaaucaggccagcaagacaguucaauugguaaaagcaucaagccuaaugaccuuaguucaaucccagaacccacaugguggaaugaguacacuaacugcaacaaguuguccccugacuuccacauguaagcuguggugcuuacacacauacacccacaccugggcuagauuuugucuaacucuuguauuaacuuaauuggguucccaaaauugccggagaaucaacauaagauaugaagggucucugcucccaguugguucugacugguuaauaaaguugccaguggacaauggcugggcagggagacagagguaggacuuuaggauuugcgagcaaggggauuaggagaggaagaaggaaaaacaaccgccaugcuaggaaagaaauaagguccaagccugagagguacagaagagagggcauaccaaucauauaagagugggaaaagacccaauuaggucuagggcagauggaauauagauuuuaguaaguaauaacucaggaguaucagaggggagguguuggcagcauguagguuugagaguggcccagcuacugagcuguuuaaggcuaaaauauaauggugugugugugugugugucuucagaacccagaacauuguggaguagguagugaggaaucuaugccauacuacacugaggcaauuugaggagagguuaauuaaugacugcaacacccacacaccuacacacaaacacuaaaaacaaacaaacaaacaaacaaacaaaaaauuuaaaagagaaacuggcuggguuggcaaacugaauagauuaaacaauuucaucuaaggccaaagacuuauuaacacuugaauauccaguuaguugauaccagaauacuauugaggucuauccuacacacacacacacacacacacacacacacacacacacacacacacagaguguguguguguauucacuuuauauaaacaggagaaaaaaauauauauauuuacuuguuuuacauguaugggugcuuugcuugcaugugcgugcaaugaaugccugccugacuugugucccuggaagacagaagagggcacuggauccuuacaaccguaugugagauaccauaugggugcuggaaacuggaucaagucaccugggaaaguagcaagugcucuucacugcugagccauuuauccuuuccaguuuuuauuaacuaaaaguaaaucauuuuuaugaacuugaacuuuuguugcuacuucuggacccccaacacaaaugacucaacaauucuacaaauaaaagcaaugcaaauaaucagucuuaaagaugcuuaaauaacuuagguaagaaauauacaagauugcuuuucaugauaguuuuguaauauuuauaaauguuuggcauaguguuagguauuaagcauucucauauaaacuccugacuguuccacaagaauauaucaacuuucauagacucacaaagacuaaauguuuaaaguagaacuugaauucaaacaaaaauuugcaggaguccaaacauuuuccuaucaaauguccucauuaauucccuuuuaagaugucauuugugcuguauauauacauuuauugcuuuguuuuuuucuuugagacacguucuugcuguauagaccacccuggccgcaauaguagagauccaccucucugcuucccaagugcugggauuaaaggcauacaccaaccauucccagacuaugcauguauguauauguauauauauauuuaaugacaauuuaagggaaucaaguacugugcauaaauauacaaaauuaucugggcuuauuuuuaauuguaguacacuggcaaaaaaacaaaacaaacaaacaaacaaaaaaaaaacuggaagagcugcaaagaugaaucaaugguuaagaguauuugcagcucuuccagaggaucagaauucaauucccagcauccaaaucaaguggaucacuauugccuccaggauaacuaauccucuuuuacggcuaucaagagcaaucaccuacacaugcuacauauacucacacacagaaauacacauacacacaaaugaauaaauaagaaacccccaccauaguugaaaagaaaucaaugaauacauagagcuuuaaauucuacaagccaguaauauuaaagguaaaauauacucaugaaaauaucuaaguacagauuaaaagguauaauaagguaucuacuuauaaaaucauaauguacuaaaagaaaaauaaggaaaauaagaauagaaagggaggggaugcaauuuuaaaaaaucaaguaaggacugagauauagcucagugguauaaucugcagagagugcccaaguucuuagguuaaaucuucaguaccagaguaggucaggggagaugaagggagggugaagagauaggggagcaggccuauuuauucuuaacaaguuuaugaaaauuaagucagcuguggaagaauacauuuuuaaacucaguacuuaggagguagaggcaggcagaucuccaugaguucaaggauagccuggucuacauacugaguuuuccaaaacagccaaagauacacaguaagaccuacaucauggagaaggaaaggagguuaugaaaacuuacuuuacagggagaaaaacagaaacuucucuuauguaauaaucaacaaaguaagucaacaacaauagaaggcucaugacauauaagagcauaaggucccccaaugaaggagcuagagaaaguacccaaggagcugaaggguucugaagccccauaggaggaacaucaauaugaacuaaccaguaccccagagcuccuuggaacuaaagcaccaaucaaagaaaacacauagugggacauguggcucuagcuguauauguagaugaggaugaccuagauggucaccaaugagaggagaggcccuagauccugugaagguucuaugcccuaguauaggggaaugccaggacugggaaugggaguggguggguuggggagcagggggagggaggaggagauagaggauuuucggaggggaaacuaggaaaggagauaacauuugaaauguaaauaaagaaaauaucuaauaauaauaaaaaaagacacuauguuuaaaaaaaaaaaaagagcaguauuaggguaagcuugaguaccaagaaaauucugacaaggcacauaagcaagggacacaagaagaaagagaaaaggaagaacuggggauggaggaaccaaaggaauuaaaacaaaucagauaaagcagaccuagacaaaaauuguaacauuuuuuuucuuacuuuaaaacuuacuacuuccuaauuaacucaaguaaauuuggcuuuucauauacuacaacaauggguuaguccaaucauuuuucuaauuugucacuuaaaugucacucauacuuuuuucuuuuuucagacaaguaaugaagagauacccuuacaaaggggacuaaggauagguaucauuuagggcaauauggaauuaugauuugcaauaguuuuaauaacuccucuccuuccaguauacaaaaguaaaaauacaaacacauauaaacauauaaauguagaugcuacuuuuuaaauuaauucugugaacuaauuaacaggauacuacacaagauauuaaacuauagcagacaacaagacacagaaaauacacucaaagaaaucuguuuccuaaauccuacagugaauauaaccaggaguauuugaagaaucuuaggauaugaucauuucaauuaauuuaaaaaucugauguuaaaauccaaaguaauuauugcgggacuuuaaaucuaacuaacacauaaacaaacaaacaaacaaacaaacaaacagaccccaaaccucagcacagacuugaauggggaagaaaagguuaaaugguacuuuaccaacaaacaucucaugaguagguguccuaguaguaaaaguggauacaucugaagcaaugggcaggugaacaucaccacuacuuuuugugaggaaaggguuuaagcuuggaauggcauccucaacagcaucuagaguagcagagaaaggaucugugcagucccagugaauuacagcaaaaugaagaaaggaaguaauauauuaguauugucauuagucaaaagaugcaaagugaaaaguaguaguuauauuauuauuaauuuugcacacaaauauauaucguaaucacuaagaugaaagacuuguaucuagcacacagaaacccuuagggaagaauugucuccauuaacaaucacagcagaacauuacaggcguccucucccacgugagaaagucaauagucacauaguuaaauaagagaauaaccaccaaaauauaagggccacucaccuugcaccugcucuagcugagaacacugguuuuaauggcuuaaucuguuuacuccaaucauugaaauaaacauugguaaagguguaguaugaguaaauuugcagaaauauaaaaagucacuucaaauuaagguaagaaacugauucuaacauuuguaaaacuccugcuuaaguucaacagucaagaaacuaaaauaaaaugaauaaaagauuuaaugaaagggaaaggaccuacuuacaacuaagaacaaagaagacuuuccagucuggggacaacuuuaaauguccuacaggauaacagauguucccaucauauaacuaacaagcuuuucuccuucaaauuuucgaucuaaaguuauucuugaauuagauauuuccuguuccuaugccucauuuaagauagcuguucuagugaugaaagccuuuucuuaagauuuaaacaguuaacuaaaggaaaaaagaaaaaaagaagaauagcaaauauauagcaucauacuuuucuuugcaacaacuaaaaucaagaagaugguucuaucuauaccuucaaaaagccaccucuuuaaucuauugcugcuuuaagacuacaaaaaucaacaauaaccacacaaagaacuaagggccagcuagauaccacuauaacagguacacuucaaucaaaucaagagucaaucaaaucaaggcaagcauuuauuaacucuaaauguaacgacuuaaaaauucagaaaacacacacacaagaaaauaacaguuacagguuuaauuacaaagcaucuuuaaauaacauuuuuaauuuuuuuauccuaaguacuuauccaggaaguaaauauuccuauagauuaucaacucacacuaaaaaucauuuugaaacccaaaauauaguaauuaacuacucaaacuuaaaugauacuuuaacauccuucucaugcaugcagcaguggggggagggggagauggcaaaguaacaaaaaaaacaauucagaaaucaaccagucagauagauacaugaaguugacuuugguaggaaagccacaaugcaaugugcagacucaugcagauggccuggacuagcugccuugaaaggcaugugauauagauuuuucagguuagaguccauggcuccuguggcucugugugcuuuuaguuccugagaaaccaaggcacuccuuuaggcaguaaagcauucaaaccaccuuugauucugugucccuuagaagucagggaaguauguaucaguuuggcugaacgauuagauuuauauaugcuaguuuuauaugcuaguuagauuauuauauuuauaaauauauauuauauaaauacauaaaaauauauauaaauauauauuauauuuauaugcuaguuagauuagauuuauauaugcuaguuuuauaugcugcacacccugucuagacugcaaccaccauuauaucauagcagccaccauuacagucuguuuuuguaaguguauaaaggucugacugcuuagaauaaaccugucacagccuuaguguuguugagagcccuccagccuggccugguuuucauuuccacuaaccauaucagagagccugguuugguaaguaagcacuggugcuuauauuaaugcugucuccccauuguaguuagucccuuguauaauaaggacaucuggguuuagagcugacuaacagaguuggaaguauccuuugaaaauacuugaugauguagagguuuguuguuuuuugagacaggguuucucuguguagcccuggucaacguaaaacucacucuguagaucaggcuggccucaaacucacagaucugugugcuucugccuuccaaaugcucggauuaaaaguaugccugauguauaguuuuaaagugcauuuuacuuugcugagcaaauaauagagaauacgcaaaaaugugcauaugcacucauggcugaccauucagacaauaucgagcauuuguccuauuaaucuaggcagugcuaaucaguagacaaaauaguguaagugcaaacuauuaaauaugaugauauucuggcuauccuaacuuaaagcagcuccuagacuggcaaaucucaagacugucuucaccuuucucucguguguaugaagugcacuugugaguccauagcauagcagccugaagcagacaccugucccuuuaaucucuccaggcuagguuugcuagucagucuagcaagcuuacucauaagaugguguuuccaguuagcaucuaaacucugaaauaugaccaguagggcuccauaacuaccugacauuuacauggguuccaaggacccaaauuugccaccucuggcuuucucagcagcaaggacuugagggaugucccuagcacccuuaaaacuuuggaaaaauaaucuuguccauuauauuuacuuuugucuuaaacaaggccucauguuacccaggcaagcuucaaacuucaacucagugguaaagcauuugccugcuaugcuugagggucugggcugcagucacauuauuggggggaaaaaaaaccagaaaaaguuuuguuuugucuuuuuacuauuuaugaaauuuucuuauauguaagauuuuuuauuguaaauuggccucaauuaaaaaacgaaaacaaauccuaaccugaacaucaaggauaugaacaauaacucaacaauuuccuguacugacugaaguccuuuaaauacuucagcuacuucgucaugcauaaaccaaaacaccgaaacuauuaccaauucagaaguuaaauauuuuuaugagaagguagggauuuaauucuguguaaauuaaaggaauuauaguaaagacuacaucccuuuucuuacauguaacuaagguuuuggaaaagaaacugagauuuuuauuccuccucuucagacugaguuaguuccauuuuguuuguuuugagacagagucuuuuuuuguagaccaagcuggccucaauuuuacaaaggaucuaccugcuucugccucauuuauauuuauagcuacauauaacaagaaguacucuagagcugggcgugaugguuccaacccuacuauccuaacacuuagaggcugaggcagaaggacugccacgaguuugagaccagcuugggcuacagugugagaaaacaacagagcucagaguagagaccugaguuggauccuuagaaccuacauaaggucaauggaaagaaaugauaccacaaagucguucucugaccuccacaugugcaucuugacacacaagcaagcccccacaacaaccaucacaaaauguucucuaugauagauaacccuugccuucaccgagcuuagauucuuguauacaaaacagcgucuuugggcuggugaugaagcucaauggcagagcauuugccuagugugugcaaugcccuggauucaauacucacaaaaauaccacaccaaaaaaagaaaaacacaaaggagccuuggagaggaugguaagggagagggagaaaggaaagaagcauccaaacuauauuguuaauucaaaugauuaaagaugaaaaucuauuucaugugcuguaaaaauuuaauaauucaaauguuauaugaaagcaaauacaaauuucaacauauuuuauaguuuucuucuuaguaucauuuuucugauaaucucuuuccagcaauuuuuggugacuauauaauacacauaauacacauauacauauauacauacauauauauguguauauaaauacacacacaacaaaaccaugcaaaggugaugauguuaaaucaacuaaagcuguauaauagacauacauuaccaaucugcuuuaaagguguuaaaccaugaucaucuuagaacuaaaaaccuacugaaggacauuccuguuacaagucuaaccaacauuuaacauaaaauaaguuaauuauauaaauaaauaaaaguaaaauacaauuuaaaaaaauacaagaauuaccaugugaucucuggccacacuaugcuucaccgguugauaacaaugugcguuuuacuagagccuuaucauauugcccacuaugaaauguuuccuaccgcaaacacaguaacuacuguacacuuaacauccgcauuacaggcgugaccucauccguaagaaaguggcucuuacucuuauauuuaauuucaucuucauuaaaccuuauuccauaauuaacuaugaauuuaguauuucacuuaucauaaauuuucaucaggagauaaaaaucaguuuacugucauuuuauuauuucucaaauucccaugcaucaaguauaagcaaaaccucuaccagaaagaaagcugcuuacugcaagggaagcugcccacacaguacccagaagacagugacacucaccuccccauguacucgcucccugaggagcagccgacauggcguggacagacgggugaaagguuggcugcugcaagucaagcaggucauuuggcagcuuagaugugcuagggaaagauuuugaaaaucaauuuuauuucuagaugaaguuugcuauauuaguuugucaccugccccccuccaccucaaaaaaauaacauaacauaaaauaaaaaauguaaaaguuuauuaugaauaaaauaaacuuaggccaaguuaacuaguuuacuuguaaucaguuugcuguuacgugcaugauaugaauaacaaaccauaaucucauguguauagucuauacauaagucauaaaagggcaaauuaaaaaaaaauuuuuuuugaaagugaaaagagucacuauaagccuaaaaagaacaauuguagccagcuaacagugccauguuccucguuuaaccuaauucuaaagaggcccagaaaaauauuugagcaucacgucuuaaauuucuauugaauuugagucaacuuuucuggaaagacuuaauaaguaccccucaauaaaaauauccauuucauuauauuauauucuaauuaauaauuagcaauuuagccauauucuaauucccaagcauacaaaauauaacccuaaccuuauucauuuauauuuagauaguauaccaauuguguuauuuuacaccuuuaguauuaauuugugaauacaaaaucauaaaucaaagcaaacucacagaaccuauaaacauauaauuugaagacuaucuuacacuaaauacucagacauccuuauugccuguuguaccuguuagaagaacuagggguagaaaauaugucaauggcuggugcagucauuauucccccugcugagguggacaccggagaggcugcaguuguuagagagguaugcgguuucuuugcaaguucuuuuagacgcuguuccuguugaaaaaggaacuaagcauaaggaaucgaaaaccagaucuguuuugguucagacucugaaaauggacaucuucuaagucugcuuuaaaagcugaaggguacucccugacuuuucaccaagcaucccauguaaguaugaaaaauaaacugaguuucagccuguaggacuacuaacacauuuaaaaccuaagagguucauuuauauaaugauccccuacuuguucuuccaaacaaaaugcccauacuuacuuaccuuuaaugcuuuuaaacgagccuguucuuccucuaaugcugccuguuuuucccuuucauccacuuuggucagagauaggccagugcuugccaaagaagagacugcauuggaaaguguuguagcccuaggauaaggggauaaaaguaauuuggcuucaugcuaagcacuucauaucuagaacauaaaaugaagugacccuacuuuugacaaacuaaaacaaguauauggacuuaaaauuaguacuucagauagacccuucuacucaaugaccuagaaaagucaacaauuuuaacaaugugaacuaaaaugcaaauguguggcuuucggaguuaaauaucagacucuaguaaaaguguacagcacugaacacacagcuucucccaagacaaagaagcaacaggaaagagacuucacauuccuagaagaguccuaauacaaaaacaacaacaaaacugauuuaguuucucagagucagcucuugacaggucuaccacacaagcaagccuagaagaggaugacucauugcuggugcucaaguuuugguguguucgugugguagaccugucaagagccaggguguuaauuggcauaggagcugucuacaauaacacucacaaaaccuauuccccaauggaugccaggucccuugaaaaggaauacugacuuccauucagucaucagucuguguggcacccucuuucuauguacuggcugcuauuuugacaagccagcauccucuuuucaaaccuauuacacacgcacaguugauuacaucucacauucccacuuuguaagcauucauccauacuaagccaugaaccaacauuaaauucuaggggaaagaacugcaccuugacucaauggaagccauguaauuaugacagaaauaaagaugcuaaccacaucaagauaaguccuaaggcaugugucuagauuguuuucauuacuguccuauaaugaacuagucaaacauuuggugacuauacuacuucuaagaaccuacuauaaaauaaaaaucuugcacaaaguauuauuuaacaacucauuaguggacuuuccccuuuggaauuggggaaggggaaauggagggcagaccggccuuagcuuacuauauacagcccaaaguaaacacaaaauucauugacuuccuccuaacucaacuuuccacauucugggauuauagagaagagucacuguaccugacauugcuuaaaaucuauuacuaaaaaagggagaaaucaacacaauaugaauuaaaaauaaaaaagaaccaaaggaagccuuacugucuauuucauauauuauuuuauuauuuuaaauaaagaggaaaaaucuucauaaaaggguaauuauucaauuacuacacccaaacaaaaaauuuuauuaaaggaucaagagauaauuucuauuauugcuaauucgauagauaaacuggggaauuagcccaaaaguugaacugauuaaaauagaacaugacaauaaucaaucccaucaaaaggcacaaaaauuaaaauauaccaggcauucaaggcuugaauccugguauuacuagugcaucuaccgcaaggauauuauaaaaguugagcaaguuaauacaaaauuaucuuuuauaucaucuuaaaaugucaauacuuacugauaucaagaacuaaaccaagaacuaaaauuaaccccauggaauccuguuacuaauucuaauguaacuaauuacuagugacagugacacucauauuacuuaaaccuaucuaacagauaaccaagucaagauagagaaacuacaguuugaacuucagcugguuuuaucuacuccuucugaaaaaauaacucccaucuucaacuguuaaaaaauacaaauauauaaauauauaccugcuugcagcuguggaaucuuugauuuucuuuccuuccaaggaagcuaaauguuguucuaaagcaucaagaagacugcugggggccugaaauaacacaaauauuaagaauuucauaacuauuacccuacuuaacaagauaaaucaaaugucaucucacauaagaaaucagaaauacauacuccucauguacuaauuacuggugggcauuuuuuagcuaccaaaauuauaaucuuuuauuauuauauuacaacuacuauuacuggaacacaaacuaguugaaguuacuaauaaucaucaccaaaaauguuaagaacuaaagauaaccauaaagccuaagaaacuuauaaaaaccuaaaguuucuaaauauuuaauacguauaaaauuuuaguaaaaacauauuauuaacaauauagcacauacuuauuuuaauuugcauauuagauaauggauuucagggcuugaaaacuaguucuucaggggguaaugucacuugcaguaagaauagagaauugaaaguaguccucugacuuccagaaauguguugugguguauguuugccugcagucacaaaugcugcccacauaucuccaggggauucagcacccuuuucuggccucccugcacacacaggcuauauauucacauaacacauauaaauaaaacaaaauauuuuauaauaauaaaacuaccaaaugacccaccuaugauacuaaauaaacauaccagagagacuugcucagccaugcuuaguucuaacuacuaacaauuacuauaaugucuagaucuccaucaguaugugaauggauuaagaaacaaauaguauacauacauagugaaauuuuacugaauuguagugaaaagaaaugauacuacuaguagaauagauguaaguagaaacgaucaagcuaaaacaugcaagacucaaauaccauauuaucugccauauguggaauauagauuuaaauauguauuuguguguuuaagaguacccuaaggagugcaugaguacuuucaaaacuaaauaauucccuccugaagggagaaggaaaacgugcaagacucauaaauauuagaagguucuuaaggcccauccuuagggcuauauaacuagugagaaucuauuaggaaaguugagacucuaagugagacugccugaaagcuggauagaaaauuucagagauacaauuugcaugggucauuuauuacacaugcaggggugagcuuuuccauggugcaacuggauagcacuuggaaagacccaccagagaagagaucaauugaccauucauucauugugucacaaugaaaaaacaaccaacccucuucaauaaugcauugcaauguuaaaauacagaaggaaaagcacacgacucuuaagagguguugcuauagcacuggucaucuuggcacugcagcacacaugacagugacuucaugcuuuaucaaucuacucaccugugaaagaucuggaauaucuccucugucaauuccaacuugcugcaaaaagaaaugcuacauuuaacacaugaaauuauaauaauaugaaugcuaccucuucuggauaguauuaaauguucauaaugauauuuuuaggguaugaaaggauacgaauauaaaaguugaacaaauuuuuauguauuauuugauuaucaaaauacucaauguuauuacuauguuugauguauaaaaugcauuuaaauaauaaaaaaauuuaagaaaaacuauauaagugaucaaaauauccugaagagggguaauucuaguaacgauggacagaggauaaaggaagggggaaaucuuuaugaacugucucugcuaacagacaggaugccuacaaacacaacugccuucuguaccaccuucaaaacaaacacuuuuaaggauuuauaaaauuagauuaccauauaaccuucucauaguaagaaaugaauuuuaauucauguauguauuauguauugugaacuacacuaugaacacugaaguaugcagcuccagcugcaggcuugucuggaggaagcgcuuaggcugacacugagcaguucugaccagcaccaacagaguaagccaucaaaacugaauggcuaauucuaaacaaagccaucacugucaccagcauacaaaaaaucuuaaugauuucuucaaaauccauacauauuuuuaaaaagucuauagccucugaagauagcuuaccucugcaacuuucagaaacucugagauucuugucauccuagucagaaacuucuuauagaugucaagaccuucuuugcacugguucuuuuucauaucaaaauauuuuucugcccaaagaaauaugaaaauauucuuauuuacauuaaaaaaaacuaaaaguuuccugagacaggaaaaagauugaaauuuucucaaaggacuuacucuacaacaaaaauuugugcuauuaguuuggauacuuaaagcaaauuagaacugagguccuagaacguuaaaaggagaaaaacugcuugaagguauucacauuacuauuuuauucacaauacugcuuugcucacaauucuccaaguauauauuugcaaguaaacacacagaauacaacacuuaaaacacuaaaaucuguuuauaaauauuuuacuauaccaguauuaacauucuaaaauuucaacuuuauccaauguuacuucaaaagcucccuuaauuuguauacagaaauauggagcaccacauuuaucaaucaugaagucaaaggcuaucacuuccacagccuuauuuguucaguuauaaauuaccccucuauauauuugucuugucucagucuaugaaaaccacauuuaaauaaauaaacugucuaagaggaggggcauacuagaguaaauacacucggcaucugauaauaacuuggcacuuuuuauuauuccuuuucuaguccuugaaaaccucaauaaaaauuuuuaaaaauuuaaaaaagagguggggaggagcugaagaaguagcuuagagguuaagagcacucgcugcucuuugggaggaccagaguucaguucccagcacccaugucaagcagcucacaacuaucugacccuccagcuccaggagaugcagcuacccuccacaaacaccugaacacacacggagagccacacaaacaaacccauuaauaaacauaaaaauuaaacaaguggaaucuuuaaaagaagcauuucuacacaaaacaauuucaaauacaucuuggcauguaagacaauaucacaaauuguaaaacucccccaaaguaaaaaguccccccaauagugccuggcuuuaaaaaaauuccuaacuucaaaauuaaguuuagggacuaagcauacagcucagugccaaagcacaaucucaacauucaagaaaccccagacuuacuacccaggaccacacacauguaccucaaauuguggagaaaaaauuauauauauauacacacacacacacacacacauauacuacuuucauaagguuuacuguagaagacauacugaggaaauacacuuuuucugagaaaaagaaaauaaaaggcuuuucccaucuaacuuuacagauuuuaaguauuucuaaaaacuacaaacaauccaaaaaaauacuauuauaucaaaaaauaagguauaacuagcuaaaauauuccauuuauaaaaaugagaauuuauucacgugugguuguguguguguguguguguguguguguguguauagagguaaaaaauauuuuuucaaauaaauuuucagaaugaacgugagucauaguggacuucacagcaguuuaagcaacuacuaucaguaucacuaauccguacaacaugaaauaagaaaaguuaucaauaauauuuuaguacuuacccaauaaauuaauaauuccuucauuguaugcugcaaauagucuaauggcaucuuugaagaggagcaugaaggcagcauuuauuaccccauuuguaaguucauuacuauuaaccuagggaaaaaugguaaauaagauuagcucauuucauauuuuaaaugacacuaacaaaaugauucuucucuaaaauucaaugaaagcacgucagcucguuaggaaaagggggcuuacuuucccuuaugagauacauuacaaguaaguuuuccaauacgggaguugccugauuucucaccuucagaauuacaugcaaacacuguagaacucuuaaguaagaaaauccagaagcaagcaaacagcaaaaacauccuuuaaacauuccuucuaguuuacaauuaugacugcaaauaaaaaugucauuuaucuuuuaacuuucaaguuuaacaucucaagucucuuaauuauaacuuuauuacaaugcucuaaguucacaaagggcacauacacgcacacauauauauaaacaccuauuuagggugucuggcuagaaaagcuaagaaccucuaaguaagauccaguaaauuuuucuauauacagacacuaaaacaaguagauaauuuuacagagagcccaaacaauguauuaagugaaaaaccuucugcacauccauagagccaaaauaauacuaauaaacacaacagcuuucugugucuuccagggccacagucuuuaaccaagugcuuuucuucuuuguuuaugagugggcagacuuuuaggcacugggaauuauguucucuucuguaguuagucaaaaacuaccaauguaacacaaaaacagucagagcaguauacaaaccaaccaagaacagagucuuguaccacuagugcuauuguagacacugaaauuuuaauuucauaaaauuuucacauaacacacacaaaaaaacuuuucgacuauauaaaaaauagaaaaaugguaaggauucucaagucacuagucacuauagucugacacuuuccagucaacgcuuacuacccaaauaacaucauuuuaaaaauccaggggaugcaaugucacugugcaauacauagcaaucuaucaaaaaugagauuugaaccuccuucuuucuaaaugcuuaucaugcuuugaguccuaccaagcauaagugaaacauuaagaaggccaaagaaauccuuacacuuuuaaucugaaacuccucugaaguuucaauuaagcacuuuacccaucacuugcuugcuuuagucuguauaaccuaaauuuuagcacuagagaaaauccauacuguuaaccaaagaguauuauaaaauggacaaaacuaugaaaaccugaggcuagagcuaaccaguuaugauuaucuaauguuuagaaaucuugaauuacaaaaacauaucaacuuacauuaaaaucaagaagugcauccauuugauuuuggauaauugguacaguuuuuaagaguuuuucuguguucauuguucucauaacuccaucagcucuauuaagaaaacaaaucauaagcaauuccuuauuaaaucucccauuugguucucuacauaaauaacaagacuaugaugaacuccacacacaccauagcacaugcauaauggcgcucacacaacaauaacaauagauaaaauuauacgauaaaaauguucuagcaugguaacucagcagccgagugcuugucuaacacauauccuaaacacaauccccaacaggagggaagggcggaacaauauuugagucaaauaucaaagacuuuugaaagaaaaucaguuuuacaaaauauaauuuuuaucaagucacucuaauuuaagccauacuaagaacacugucaacuaguuucaaaaaguaaccauauugccuuauggggauuccacagaguuuaaugaaacaaauacugucugcaucagccaguuuugauuagcuuuuagauaauguacccaucaaauguucaacauuguuuucucucagguaacaaacacacugcuggaaucugagaggacacaauuccucuuugcaacuuguccucauuuucaguuaucauacuuucuuccuagaaccaucauuuuucaucuaaucccuucuugcugaugucauuuuuuacuuucuggacauuucuccaucacagaugucuugaauguugucucagucuucuuuguuuagcucaacaucuaaaugaacaacucaacuucuuuaucuuaaaagugagcagccucuuagcccccaaaugaaaaaggucaaaauuguuacuaucguagacauucuuuugcaaacaauuuucuuacaccuuucucccuugcagucagucuccuagcaaauucacaauccugggugaaaaaauaauucacucacauccauacauauacaaauuaaaaaauaaaaaaaaaaaaaaaccccacacaggagauauagucaaugagucaguauuagucuuuuauguacaauaaauccuuugguuuuuaaauacuauacuacgcaagcuggcagacacauaaauucaugauuaucuacuucacauagguaguaaagaaguccacaaauccuuagucuuuucuacagaacuccaaagcaccuucaaaccucccucuacuucugugaccuagccuaccuguagauuccccuuccccagccugaaaccugcuugcucagggguggagcuuccugcucauucguucugccacgcccacugcuggacccugcugcuuugcuguuuggagccacacacgugcucacccugcuacuggaccccgagauuauuuggcgggaaucgggucccuucccccuuccuucauaacugagugucggaacaguaaaaauggagcuuugaucagagugacuuugacuuggcuccguucuuucuuccgcccgucuaguuccucucuugcagccugaguugccaucucaguugaaccguucguugugagcugcuggucggccgcaacaccuaccaucccauacucucagaucauuaacucucaaaaugauucaggaauaguccacauagaaaacaguuuauugaacagggaaguaagaaaguagacuccugauacgaaccucucuacugcaaucuuguacagacugucuacauauguaacaugaaaucuguagaaguuaguuugguaaaaccaucaacucuccaugauugaaagaaaguuuauagaaaaagacuuuauuucauuuuuuauucaccuuguauaugucuauauuuuuaagauuuccacugcaggccagaugguggcacagugggcagaggcaggcagaucucuggguuuaaggccagucugguugacagagugaguuucaggacacccaaggcuacccagagaaagccugucucaaaaacuacuucaguaacuauuuuauaauuuaaagagcaagcugacgcccacacccagcaagugucuagaucucuaagauguggaagcugcagggcaguuuccuggaagggcauucaccaggaaugucugucugcacauggcucacacuuacugcuccuuuggcucuuuccugagcuaucauaauucagccugcggggaaaaaagcugcagaagacacuacagagaucaaaguacuggucacauuaucugugugauuaguucuugugcuaagaugaucaauacucagaaugcaauaaaauuaaacucacccuuuauaugcaugaugucugggaaagguuaccuaauuucaauccucagcacacacauaaggguagaaaaagagacccaauuccuugaaacugucuucugaucuccacacaagugcucccaccucuccaugcacacacaugaugauaaauaauuuuugaaaaaagauguugacacuaugggaccuggccuuggagcuaaagucacguccaaagcuaucuaccuccauauggcuccauguucccaaugggagggccuaugauccaaagggccugcaguacucagcgcuaugcuccugaauaagugcucugaaagugagcccaugcuuuccccugugccacaaggacccuuugguuucugucuagcuuugccuagguuuugcuaugggggcuaggggggagagaagggggagcaacauaaguggaucacuaacaggcaucacagccuagccacuuaaacuacaccaaguuggguucugucauaagcugcacugugagcacuaaaggaagccaggauguucuucagcaccuuuuccagagcugaugacaggcagcaaugggaaaaccaugaugcauauugguggcaccuuuggccuauuuaagacaaccaucaaaacugccacacaaugcaauuaaaguaucuguugcauccauacuuucucauucaauaccuguacuaugauggaaccuuuucuucagaaaggagagagggaggacagauaggugaacagaaagaaagauaauggggaggggaagggaggggaggggaggggaggggagggagaacuugugguuuccaugccuuuucucaauccuuggaugauaagcauguguuaccacaacuggcuacaaaaaaaaaagggaaggaaugaacaagcaagauauccuauguuuauuagaaagccaagcuaggccuuaguaggcagacagaucucuugagaauucaagaucagcuaggaaaacaugaguuacacccugccuguaaccaaacaaacuaauuaaaauucuuggcuguuuuucuaccaaaacugauauguugauccuaaaacucguauagaauuucaaaguaaccagaagguaaacauaauuaacugaguagaguacaggacagauauuggggcuaaaggaagagauuauaggaaaugaaagcauaaguaggguuaugucacauaaauuuguaaacauacuaaaaaguguuuaguuuaaaaaaaugaauuuuaaucaugagaauuauaacaauaaaguuguuauaaagauaauuuaacuuuuaaaaaucuuacuacagaaaguauauauggcauuucuucaaacaaaauaaaguuuguaaaacugaauaaaguucuguaguucacaagguaaaaauuccuguuuuacaccauuugauauuugaauuagaaaugaaaacuuaacucacccucucuucacuuuugugaaaucgaaugcaacuugucuguaugaaacugcuuuuucauuuaaguaucuacuauaccgucuaauaaauguagacauaucauauccuguaaaagaaagcuuucauaaaugauuaaaauccaaagguuaucuauaaaacuuuauuauuuaauagcaaaaauaugauaucccaauuacauucagugauacaaauuaaauaacuaauaaguuccacacuaaauucuucaaaauuuuuaaagucagguauaucauaugcagcuuuaaaaucuuuucccuuaaaauuccagcuaugagucuaaaaauaagucuauuuugcuucuucugacacaugugccuauucauuacuuuucaggaguuauaaaaauguuucuuucacagccagaaucucagaacucaccaggaaguggugguacacaccuuuuaauucuaacacuugggaggcauaggcauucagaucucugaguuucaaggucacccuggucuauagaguaaauuccaggacagccaggacuaaagagaaacucugguuuuagguuaaaaauuguguguguguguguguguggggggggggggggaaggcauaucucagaacucaagcacaaauaauagaaccauaaauucccucaaaucaaaugaaauugcuauuguuauacuuguaaaaccuguagcugcauaauauuuaggacaaguguaucucauaugugccaaucuugaaagaaauauaaaagcaccguccaauaaaacagcaauauguaugcugagggaacaaccaaaacaguuuuuaaauauuuucaauaaaaccuuguaaaguaauguaaauuacucugaacagugcuucagcagcagcagccgcaacaacauaaaaucucaucgguauugcuuuuuaagauaccagaaaccuuauauuuuagcuauugacugggucaaaggucuauaaauuuuugcuccucaaugaaaaaugaauggguuucuuuuaauuuggcuucaccaagcagauuugacuugaucuuacacuuuauaacauacauauacacucacacacagauauacacacauaaaacuaagauuuggcauuaauacuuaucaauuugcaaaugcuuacccagcugccuaguaaaaaucagaacaaaagagauaagggggggaaaaagaggaauuacagccacuacccagucucauaccuguuaacauaauauaaaguacacacacacuccuugguuuguucacguuguuccccacuaguuuuucuuaucuugaaagggaaaauaucccuagcucuuuaagccucaaucaacuuauuuaaaaauacucuaacuuuucaugcuccaauauucuuuccagguauaacugguagcuacuaguuauaaagcagguccacccuacugacuaguuuaaaguuuuuauaucagauaacagggucuaacaagacacaguaccaucacugauaaaaaauuacuuugcaaaaaccucagugacuacauguuaacuauuauuuaaucuuauuguuaaaaaaaaaaaaaaccuuuaggggcuggagagaugguucauaaauuaaaagcaccacccgcucuuccagaggacccagguucaaauccuuguauccacauggcagaucaucgcaacugucuacaacucuaagaucugacccucacacauacauauaugcagacacuuuauugguuucuguguagcccuggcuguccucaaacucggagauccggcuguuucugccucccaacugcugggaacaaaggaugugccgccaccacccagcuaaaauauauguuuuaaaaacauauagauaagagagagauuccuggccacuguaugcaugugaagaccaaaggauaacuuguggaacucuucuuuucaucaugugggucugggaaucaaacuggcgguuggguuuggcaaaaaacaccuuuaccuacuuggccaucucaccaagaauauguucuauaacucaucuaccucuuuguaaaaggaauaaaacgcuaaaauuuuguaacacucaaucuacuuaaccuccagguuuagagaaauggcucaguggcuaagaaccccagcaccuacaagguagcugcaagcaugugguacagaaaagucucacaaucaggcaaaacccauuacacaucaaaucaaaauacaaguuaaaaaauuaaaggaaauuuaauuuuuaacuuaaagaaaugaaaauuaguaacugagaccaaaauccaaacaaacaaacaaaaaacuagauagcccccccccaagacuuaaaaguaaaaguuuaagagcagcaauaaaaagaucugcaagcaaaguagaugugaugggucacggcuauaauccccaagcaugggaggcaaagcacaggacugccaugaaugauguccaagucagccugagcuacagagaccaugcaucaaaaauaaaaacaaaaacaaaagcaacaaaaaauaaggggagaauaugacaagcaaguaguuucuaucuuccuaucaaucuguuuuaauauuuuuaucgcaaaagggguuuauugaugauuuucccucuuaauauguuucuacuauuaaaauaaauugaauaugagggguuagagagauggcucagagguuaggauuacuugcuguucuuaggaccacaaguuuccagcacucauauuuaguggcucacaaucaccuccagcuucauggaucugauacccucugcccucuucuggcuaccaaggaaaccugcacauaugugugcauacaaacaugcagauacacauaaauaaguaagucuuuuaaaauuaacuauuaucaauuaaucaaauucuguaucacuggguccucugcacuuacagagauucauucacagcagugcauguguucaugcaaagucacuuccacuuaguaaaggaaucaagcacugcacuaacuacauucaauucuaucauuucugccuuuguaagaaccauggccaagcccucacuaacuugcuacuaggacagaaguauaacuagaauaaucucgauagcuucaaaacaaacaaacaaacaaacaaacaaacaaacaaaaucaguguacucuacuccaaguucaccuuaggcuacuccuuuccuuauaauacauacuucccucucuuccccaaagacacaagaaagccuuugccaguuuuccuacuacauuauaaaauuuaaccccaccaaauucuucuaugugugauuuggcuuuaaguagcuucuuaagaacuguguacaacuacauguucuccagugugccgugcauacaucaaguucauaaccauucuuccuaucagccuuaacuacuucaugucccuucacaccuuggacauuuguacaauugugcuaaaguaaguaaucucuuccaccucucaaagccccgcacaguaggucucaccuucucugaaauauuucccagacuuaaccucacuguuaauguuuccaaauagcuuugcaauccuuuaugugguccuucccagcugugacagucuauaauauuaauggccuaauuuuggaacuaaauacaacggaccccauuuagacagaagaacacgacaucuguaaccgaaacaugacaauucaaagugacaagauucaaagugaaaagggaaacuguuaaaaagagaagcacaggaguuauuugauuggagugcucaauucacaaucuauacuuggguaaaguguucuuauguaacacaguaacacagauaaggaauauauacaauuuuaaaaaccuuguaaaguuaauuuaaacagcaacagacaugcuaugucauuaccacuggacucaacuuugucccuauaauguauaaugucaacuauauuucuuacaauaaaacaaaaugaaaaagcggcaauagaaauuaaggcaguauuuguuuaguguuuccuauguggcaggcauuauucugaacacauuaggguuaguuacuaacuacauuaggccacauaacaacaacugagcagggacuaucaucauuccuaauuuuacagacagcaacacagagguaaaguaaacuugaucaagucuauauaguuguuaagugguaaagaguaaauucaaguccaggcagucgaguuccagaauccauauuugaaaauaacuacccuguauugucuuucagauugggugcuagguuugaaaucugaauuucaaaucaaaagacucacugaacagugaugugaagcaucaauauguuaauauagcugaaugcugcaauaaucauuauguggggcuacucuugauuuucuagaaaaagaauaaauugucuuuaccuugcaauccacuuuuauccaaaaaauugcuuaaguuaaacaauguguuucuugaagccaaauacugaaugaaacgcuggaaaacaaaacuuacaauaagucauggugcugucaucuuacaaacauaaucugaaaguaggaggaaaguacugguuaacuuauuucacuaagcguauugcaaucuuccauccucacucucauuaguuaccaaacauagaaacguaauaguuuuuacuaguagacauuuauuacaacuuaaugaucaacuacaauacuaaagucaagauaauuaaaugaauuaagcacuuaacuacaaucaagaacugucuuuacuauauagcauagugggacacggauuaaguauaaucaggucauaucugcacuuccaaaguacucuaucuauucuguuuuuguauggcacauacuggaggucagaggacaacuuuuagaaaugaguuccauucuuccaccauguagggucuaaagaucaaacugagaucucaggcucggcagcaagcggcuucaccggcugaacuuacccuuuuauagacauucagcugaaggaguuaucaucaaaguuaaucaguaaucacaacgauacaccuuccuaaguuuuuccuaggcuggcaagaugucucaguguguaaagaugcuuagccugcaagcuuggugacuugaauuugaccccugaagcccaaccauucaucccacacaauaauaaaacuuuuuaaaaaguuauucuuaccucauuuccauacaccaucaaaugaugaguuguaaugagugauuugaagaccaccacccaacuacuguuaguaguucuuucaaacaaacuguccgccaacugugggauguucacauucaucucauuuguacacugaauuaagucuguaauuuaaaaagaaagauuaguuuauucuucgguuguaauuuacuacuagugccagauuugaagaguaauaacuauaaaaaauguaaguagaguaauaguuuggacaaacuuuuaaaacucuuccaagaggguuggcaagauggcucaguagguacuuguuaccaagacugaugaccaaagaucaaucaauacucaggacccagaaggugugggggaccuaaacacacacacacacacacacacacacacacacacacacacaccuuucaaaagaaauuacacauaaagaugcuugagcaggaaguaggccggccacuuguaggaaugucugcacuaacaggaaaggagcagugacaagucugugacaggggaaaucuuagcuuauguaaacuauggcucacucuugucccccucaauucuccuaguuaacucagacccacugguuagaagauccacuagcuaauucugacaaacaaaacugaaaucagauuuaaguuaccaaauuaaaaguuauuaauacugcuaaagauauaucuaaauuccaaccuuauuuacuuauuuauuuugagauagggucucuaucgauuuuucucuccuuccuuccucccuuccuugcuuuccuuucuuugauuuugaggcaggaucucucuauguagcuauggcuauccuggaacucacuauguagaccaggcuggccuccaacucacagagaauucaccugccugugugcugagauuaaggcaugugccaccaagccuggccuaaauuccagucugauuuaguucaaacccaaaggcauuauuauaaaauagucaaauagucuagcacacaacuguuugacugaaaaaagaaagaaagaaagaaaauuagcagaccuccgaauuuuacuuacaaucugcuuuaaaaauuuuagugguaaauucaauauaggaaauccaaacuaugauccaaucuagagacuagagagguagaucuagacaucuuuuacuuucaacauguguaucaaauaugauguacaaacauaucaguuauuaugauuauaacaaaauuaguaauguuuucacuuuuacuguuucguugaaaaugacuaaauagaaauucagaaaaccuaacuuggccuugacuccuuacaagaaaugacaauauaacuaagaauaguuauauacuugcaauaaacuuuaaaauacuugcuuuaguagauccagcugguaacauuugcuaagcaacugaauuuagacaaguagcuaacccuaacccuaacccugauuuaagccaauacugcuuuaagaauaaagcaccaaacauuguaauaaaaaguacauacaacaucagaauaacaaaagcuuucaaaauucggaucaauuguaacaaaacaauaaauuuaacuuggggauguauugacaaaauuuuaaaaagggaaggaguccaaucuaccaucuuugaaucuucauacuacuuuauagcuaaaguucuacuggcuuggaugucugcugcuugcuuuauuccaaauaaaaucugaagagggcaaaguuguuacuuuuuuguuuaaaaacugggugucccuaucgccaggcuggcucugaaucaugaucuuccuagucugaccugauucuuaguuguaagcaacuaaacucuuacuucccacucggcuuuacagcccuagacuuuucuucuuacccuuccagaagauaucuuaagaaaauuacugaaguucuagaguacagaaaaccacucccuaaaaauaccguuaauuuuuuuguuugguguuauaugugauuugaguacauacucauguggauauaugagcauauguguacaaugugcauacaugugcgcauacacauaggccagagaucaaugccaggugucucuuagcuauugcucuccauguuuuuugagacagacugggauaaaaggugcuggccccugugcccggugguuuacaugagugcuagggauccaaauucaggcccucauccuaguacagcaaucacuuuaccaacugagccauuuccccaaccucuuuggcauguacuuccaaagcugaaccugccaucaaacugccaaaacaguguuccuccuacuucucucuacauguuaguacagaaauacauucuauauaucauuaaccaaagcuuucucaucaugccuccuaaaucuccaaaacacccaccuugaacugggcacagcaguacaugcuguaauccaagcaguggggcaagagaauugccacuuggcacguguuauagugaacauaaggccagucaaggccauacugugagacgccucagaaaacaaacaaacaaacaaacaggacugucaaggguucaaaacacuaaucagaucaguuccuuuauuuuugguaauagcugacuugggaucucaccuaccccacaauaccucccagaagaguguucuacaaagcaacacuaucuaucacuauccagccuaaauacuguccuuaccgacagcaugggacaagucgcugaaccucugcuaucuuucuucuugcaucuuacugacccuccaacagaacaucauugcaauguugugugguauaguuugcuauuucauaccugaaucuuuccauucaagaucauuauugaaaacauuauguuuuuaaaugaagauuucccuucuacaaacuaaucuacaaagucacugaaacugcuacauaauaauucuauauuacagaacuuucuucuaaacuguauugauuuccaaaucauuuuguucuacuaaucaccauaaaaggugcuacauuucuuuauccaucaagauaaauagauaagguuaaacaaaaagccuaguuuuucaguagaaugcauuccagguucaacuacacuauacacaaguacacaaugggugugcaaaaacacugaguuacauguacauguauacgcauagacacuacuuacauuauacugugccccuuacacucugcuuucccccugcacauauuuuagucaucccaauaucuuccuuuacaacacuucacaaaugccaaacacuguuuuaccucagauguuucugacagugcuguuccuucuaacuggaugcuuucuccuaauacuugcguucucacuuucuuccuauagaucuuugcugaaaugucacauguaccagagacucgucuuugaauaucaauuuguauucacaaauccuuaggguacuuugguuaacuacgccaucauuagcuacuccauuguguacuuguuacuacuuagcucaucuuacugucugucuccaaacuuaguuuaugugugcacagaguuguuuuguucuccacuauuuccucagaggccugaaacaaugccacacauacaauggucauuacuauuucuuaaauaaacuauucauuuugauauguauuuuuuucacauuccuuuuugaagacauauguaccuauuuggccccggaccucccugaaauuccaacuuccugccugucucccaagcacugggaauuacaggccuaugcugagugcauagguuacacuuaaagcacccagcugcgcaccgcaguacaggcaggagucuaccacaaugccuaggcuggguacaaagagaaguuaagaccagucugagcuagugagacccuaucccccaaaauaaaaaaguagggagagaggaaagggagaaaagaggaagaggcacauaaugaagcaaaugaggauaaauccauccaucaaaaaugguuucucuuagcuauacuaaaucagcaugcuacaacuauuugcucgucuuaaaauuuugaaaaacaaacccaaauccauaaugugcaauuuucaaaucucaaguuaaaggacaucuaaacccuuaagaacucugguuagguuagaaacaaucaaaggaaaaaaauggguaacuccggaggcuucacauacaacaagaaaaaugaauucaggauaggacuauguacuagaccaaaccaaaugccaaacuaccguuacacaaauauuacuaggguaagaaacuguaugaacucugcuguguguauuuccccacacuucuuuaauucagccagucgcucucuucaugaagguaauuuuuccuaugugugaaaauucuaccauaauagcaacuuaaaaugcuuacaauguugaaaggaaaaugcuuuuuucccacauguaacuaaucaaaagcaaacuucuaaauaaaacuuucauuuacaagaauuucaauggcuauuacuugucccacucugaauccaggauaaagugaguggcuguguaugugugccccuggcugguauagaauuuacuauguaaaucaggcugaccugaaaaucccagaaauauaccuuccucugccucccaaguguugaaauuaaaggcauuugucaaccaugaccaaccaggagacauuauuucuuaaaagcaaaaacucuguuacgaaguugacaugcacaugucaaaauguuuaauaauuacuuaccucgagaauauaaacacuaaaguucuucaucaacauuuuauuaacaauucccaaaccccaaacuaaauaaugagacuuucuagaguuuagugucaggaagaacacucacaacagugagcaucacugcccuuacacaguuacugggaaccucagccaccaaacaaaauguuccugcuuuuauuauuaauauauccucucaacaacuauguaacuagaauuagaaucugagaaaccagauauuauuucuauuuauauacacauggcucuuucugaaagguaaagaggucacaggacucacuacuaugugacagauucaugucuagaacuaaaucguuguaaaggauaaagacacuuaaaaacuuauaaaaaaggaugcccaaguacuuuaaaagacagggaaaccuuaaacucaggugaaccuuaaacucagucuugccucagcauccuaaguaccagguuuguaucaucauacccagaagcaacuguccaauuuaaagcaaguccuaaauugugaauaaguaauaauaaacauaauaagaaaaauaggauaaacacaacagccuguauccauaggaaauuuuuuuagaauguacaaaaaaauuuuaacagucaccaaaugguuuaucuuauaaccauaaguaaaccucuauaguuaaaccaacuucaacaacuucagaaacuuaagcaaaaacauuuaguauccacauauacaguauguauagcagcuaaguaaugccaaucaguggcauccgaaacugaaaugcaaaggucucaaauucccauguaaaaauggccacucaguagacuucuggcaaacaggauuuuucuaacacauauaagcuucaccaaaaacauaaacuuuuuaggagugguauuaaaauaaucauuaagcaaauuaucucuuucacaagaguuguuugaaagacaacaucaaaauggaugcucacagucaucuauuggauggaucacagggccccuaaugaaggagcuagagaaaguacucaaggagcuaaaggggucugcaauccuauagguggaacaacaauaugaacuaaccaguaccccggagcucgugucucuagcugcauauguaucaaaagauggccuagucggccaucauuggaaagaaaggcccauuggucgugcaaacuuuauaugacucaguacaggggaaugccagggccaagaagugggagugggugggcuggggagcaggguggggggaggguacgggggcuugaaggauagcauuugaaauguaaaugaagaaaauaucuaauuaaaaaaaagacaacaucuuuguuacuucagguuucuguuuguugcuaggagaaaaaucaaguggucaauuaaacagcacuucauaucucaaaaccuugggucuuuucauggauggaguacaaguaaauggagcaaugcucagcaauagucacuuguggguaagaagacagcuucagagguucuggcacaaaguagcagaacguuuuaucacauagcaagaaaauacauguauuuagugaauaugguagcugcaaccagacuuaaaccaaagucaucuacccuagucuuaagcgucaaaugauuguuucuuccucucuuuguaaggggucacaaagguguaacugcuaaaacauuauguuuaaagcugggaauuucauacaagaacauaaggcuguauuuuuauaaaacuuccauuaagauauaagguacaauuugcuaaacacaugaaacucaagaagaaugaagacugaaguguggacacuaugccccuccuuagaauugggaacaaaacacccauggaaggaguuacagagacaaaguuuggagcugagaugaaaggauggaccauguagagacugccauauccagggauccaccccauaaucagcauccaaacgcugacaccauugcauacccuagcaagauuuuauugaaaggacccagauguagcuaucucuugugagacuaugccggggccuagcaaacacagaaguggaugcucagucagcuaauggauggcucccaauggaggagcuagagaaagaacccaaggagcuaaagggaucugcaacccuauagguggaacaacauuaugaacuaaccaguaccccggagcucuugacucuagcugcauauguaacaaaagauggccuaaucggccaucacuggaaagagaggcccauuggacacguaaacuuuguaugccccaguacaggggaaugccagggccaaaaagggggaguggguggguaggggaguggggguggguggguaugggggacuugugguauagcauuggaaauguaaaugagcuaaauaccuaauaaaaaauggaaaaaaaaaagaaaaaaaaaagauucaaauguauacuuguuaaaagucuggcaugaugucacacacguguaacucaauuacucuggccaccagaacaggagguuuauuacuugaggcuagccugagcuagacagaagaucaaggagaaccccgacuacacaugagaccugucucaaacgcaaaaacaguacuuauagagucauacuuguaccuuaggaaagaaauuuaacaucuaccaaacagacuuuaggguaguaacagggaaacagcuuuuugaaaagguaaaauauacagugcccauuacaggguagugacugagcuaaccugagauggaaaaggacuaucugagguauuaaaagacaaaauaaucagaugacucaggggaaaggaaaaaaaaaaaaaaaaaacaacccaggaagguaaagauccuaacucacacuauaaguggacaugccuaauaauucagaauuaguuggcuaaaagguauaaugcgagacuauuaaaaacaugacaaaguaaaagcugacuaggaagaaauaguuaccuacuguugagcaaaagccacagagaagaaacagacucauaugcauacuuaaaguaagagugcauacuuuaguucuguauuugcuggcacacacuguauuugcccaaauacagagacacaaaaguacugaccucuauaguuuuggcacagugggucggguugauauacaaaaaagcuaugccaguaccugugugauucugggacuaugacaagcacuccucagucacacauacauagcaaugcuguacuacuuagacaagacucuuugaaacuuaaguccaauggccaaaagaacaacaagcuuaacaggaaacagccugugaggcaaaggcagcauuguuauuuccauuguuuaagagcuuagaauuuaguccaaugucauggugcaugccuuuaaucccaggaugcagaaggcagcggcagaugcaucugaagcccgucuggucuagagcaagcuacaggacggccagaacugcauaaagauccagugccaagcaaguuaucagcacagaaucucaaguauacuauucaaugacuagcuaaguauuggacuuaauucaguuuucucaauggaagcccuaaggaaucucuaaauaccaaaauuaaacuaagguaguucugucaauccuaggcagaggaccagucuguuagcauaaaguugguaugcuauuucugucacuguguucacaaaaugaacaggaaaagaaacauuaagaaauaauucuacagcuaggcggugguggcgcucgccuuuaaucccagcacuugagaggcagaggcaggcggauuucugaguuccaggccagccuggucuacagagugaguuccaggacagccagggcuauacagagaaacccugucuugaaaaaaccaaaaaaaguaauucuacauaugcaucacaagauacuauauuuauccuaauuaauaaacuuucucaacccuuuuaacuaauuguuguuacuauauagaaguaaccuucccccgcccccccccaaaaaaaaagaaaaacugcugugaaaucucugcaaauucucuuaccugguuuacuuugucuuuuuaaaaagaaggucuuuuuaaaaaaaagaccuccaucaaugcaaguuccagcuuuuagaauauaauaaaggcaacuuaaagaaaauuauucuagaaaaauaauuuuaaagacugaaugcaggagcaguaaauauuucuggaaauacacuacaaaacuccaaguaguaaggaucacagaaacuuucuuuaaggcaauaaaauuaguuaccuugaagagacugaggccauacaugaggauuaaagaaaaaaaucucaauguuagaagaaugaugguugugccccaggaauuuucaauuacauugugugugugugugugugugugugugugugugugugugugagagagagagagagagagagagagagagagagagagagagagagagagagagagagagagaaugcaugagcuuaauagcaaacagcuaugucuacaaaguaaagaauuuauaauuucucucuaaaugacguuuuuaaaaaauaaagucuggcauuauagucauuggcaucuaaauguauggggcucaaacagaauccaggagcaagagguuaucaggguguuuucccuucaucacaacuguagcacuugaacacauuucauuaaaauuaguggaguauaugugacuuccucugaucuuaccagagcagcacuaucuucuccacuguguuaccagcaucaaacacaauauguccugaaggagaaauuaauguaugaggguugcaguauagucagagugguugcuugccucguacacgugaagcccucccugcauucaaucuccaacaauucaauaaaugaagaugugugcagaaaguagcaauauucuaucuaaguagucuaaggucuggugcagugaugaucugaaagaacccuguuaacaacuucgcaaucauugugucauguuuacaauacuccacauucccagagucacuacagugacacaguaucaaacacuguaaucacaaagccugugucucaauacuaggacaagaagugcucccaaaaaagaugucuagcuagcugagaaauaacugaucucccuuucauuuugagcagaaaaagucaaauaggaauaguuaaagauaugucuacauggagaaaagguacaaaaagccacccugagauauuauacacuaagagcuggccgaucacagcuaggcacagacaaaucuauagaacuucauacuucaauguaaaaguaaagauaaauuauuuaaguuaauggaaagccauuuuguaauugccuuuccuuuuaaaauugaaauaaaaaacuauuucuucaaaucagguuaacuuacugucucuuaaaauuaucuauuauuuuguuggucuuuuuuucaccuacuaaucuaucauaaauuaaaaaaaaucuuacaacaaaagcuaagguuuguuaugaagacgcuauauagaauaauauauacuuucaaaauaucaaguaucaaguauugacuauaggcucaagucagagccccaauccucacacuaucaaauugccucugaugacugugugagcacucuugacacagagcuucuuucuccucuguguucugcuggacucugcacgccuaccacuggguggcagacacuggcaagaagaguucaggcucuuuaacuuggagguuagggcucuauuuucauuguccuuuagaguaaugauuuccaaaccuacauacccugacacaaauuacaaauaagaaauacacagaaacauuauuuuuuacaaguauugccucaaaagauuucuaugcuaguuuucaauuuaucagaaaaugcaaaaucaaaauguuaauagaauaaaaacccaucaccuaauuuaagaauuuaaaaauauuuauuuaaauggaauaagaaaaccaaaaugaaagcauuaacauaagaucagaggauaauaauaaauccaugauaaaacaaaagguguuuuccucucuucuuugaagauuugaaguuucagaauuacaaucuguccuauaggaaagaaaacauuuuaaguaucaagcaguaugaaauucaaauuuuauaugccaaauuacaaaguuuauauucuaaaaucucaccaaauuacucuaccugaugacagagauacuaauucucaguauucuaaaaagcagucccauauaaaaacaagaauuuacaaaaaccaacuccuaggcaauauauuauuaaccccuuguaugaugaccagucuccaggagaugcccacacccagaaguuuaugggcagcacaaacuggacucguuugguuauuuaaaagaaagagaagacaugagguuggggguggguagagagguaggaaugaaucugggaggaauuagagaggaaguuggaggacaguaauaugauucaaauacauuguauaaaauucucaaaacauauacaauaaaaauaucccauuaaaacauauauuaugaguacuauccuuaccuccacuaaaucuguaaguccaggguguaucauauagaaaaaauaaauuaaaagaauucuccaaaucccaccaagaacaauaaaagggaagccaaguuugagaaucucugcagagcagauuacuguaaaauuuuaaaaagcaccugaauauguucguugaaauugggucaauuuagagaaaaccauguucuaaagugugaauaaccaaguguccugguuucuaccuguccccgugcuaccuuuucacuuacaagugagccaauuuggauaaaaauuaugucaccuuaguuaucacuuaaccuagagaaagaucacaaguagcuaaggagcugaugcaccaccaacccgcccuggguuguuuguaguucugucuuggagugcugcguugugggguuucacuagccuuccuaaagcacuuacaugauucuucucuucuagccacuggguccuuucaucucaucaggagauuucaccuuaugucucacguacucuuggaaaaccaucuaauuuaucuucaacaaagucccauuucuucucagaaaaaucaacguuaggucuuuggggaguuggaaauauuagaauuuuuuauauuuauguccaaaaauuuuuacaccuuaaaaaaaaaaaagaccauaaacacuuguugggcagaaguaggauuauugcagguuccaaaccagccugaaauauacaacaaaacccacaagaaacuauacacagacuguuuuauuuuaauaagucagaggcauucuucucuguuaacugcauuucuggaauuuauguugcacaaugugaacacuguaucuaguagaugugcugauaugaugauauaaauauauuuggguucagaggugaagccaagcccaccucuccacuuuugaguuccaagcagaacgagcagagccagugaaggcuucuucccugugcccaggucacuguuauuuuuuaaccaccaagccaagguaagcagaaauucacaggacuucccacaucuaaugauuuauuuugccuauucagaaagaauacuggauuaauucaauucucugccuaucuuccucacugagaaaacacaaacaccaguccauacccccaaccccaguccaacuaggaaaaggaaaaucuuuauggucuaccucccaaaagcuuugcaaaccucagaagaaacagaaaucccguuuauucuacauauaauauauucacaauauggaauaacugaccaauuucuuaggacuacagaagaguuaacaaacaaaaccuccaccucaguguaguauacauggguauggggagauaaucaggaguuuauggaauaguggagagaaacaaauacaggcagcuggcaguauuugcuaguuacauaguacagagaugggguuuaucuggaggagguuuuuauuuucacaugacaguaaugaagagaguccuagauaaaaaguagauaaagcuaucucagcacguacuagugggccgugccuaugaaagucaacuucauagagcaguuaguauggaggcaucccaucuuugccaaagugaaauaaaugacccugaacuguaucuucucuacaugauuuuacaaugccucuagauuucaaacuguaaauacaaacaguagaaucucaguauuugccacacauuuagugaaccuuaagugagucaaaaucaacaucacccacuuaaaacacuucaucaagcauuacuauccuguggcaaacaggcacgaagaccacuaagaaagcaaaacuaccuuuauuuauuaugcacaaagcucuggcuucaaacucuagcaccacauaaacuagacaauggugcacaucuguaauaccagcacucugaaaguggaggcagaaggaucaaaaaguuggaagccagguuuaguuacaaaacaaauucaaagguagccugggcuacaagagaucuucaaacauuacccuccaaaaauaguuugugugggaggaaggacaccacacuauuucaaaauauauacaaauaaaauuugaucacugaaaauaauguuauuuauucaauucacuauguaaaaacuaucaacccaucaacccaauauacuagaauaagaaauuacaggacuuaauauguuuuuaaaagcaguauuagaugacuucuucuauuaaaauuugaaagacaguagcauuuuacccaucgacuguuaauuaugggcucguaggcgucaaguauaccucaauacaaggaaucuucauaagcaugcuucugcuacugaaaaaauaugaaaauaagugcagggaacagggacacaccuuaauuccagcccuugagaggcagagcaggcaaguaucuauaauagccacucuggucuacagagugagcauaugcuagccaggacaacauaauaaggcucggucaagaaaggaggaacgggaaggaaagaagaagggaggggaggggaggaaggaguaagaggagguaaagagagaggagggaaggaaagagugagggacgguagguaaggaggcugggaggagagggagggaagagaggagagagagaaggagggaaggaaggagggagagaggaaaggaagauagcuuaagaauacaucauacuuaaugccucacuguacuuuaauuuggcucacauguguaccaaccacaguuaacaacugcaguaaugcuaauaauaaaaaccucaagacuaaaagcaguuguuucuuucauuuaaguaucuguaaccaaauagaugucacaugauaguuucaaaaacuaaauucaaucuauggaugauauuugaaaagucuguuaaauuucugaaaggauauuaugguuuuuguuggcuuaucaugaggaaauaauguaaaccuuaaguaguacagagagcuagccaccuuuaaaaaacuuuaacuaccuuucuacugucguuuuacaaugucaauauuuaacuuccaguguaauuuuaucaaagaauccucaaauaaaucuuaugcucaacuaauaugcuacuacgggaaauauuacuuuucuaguugagccuuccuuaaacuuaacagacacuggagcacaugaaccagcuuaucuuuucacugcugcuguuggacaccaccuuuuagaaugacuaugacuggcaagugagaaacugucuauuuuuagaccuuccuauuacaucauccuuuaaaguucaucugucccuguuagcaagcagucuuuggagucucacuagugagcuucacucucuuaauaguuuguccuaagugcuacuccaucucugcuucaguaguaaugaagacauaauuucuccacucuuaaaguucagcuuaggguuuccuggcucucucaagcacaugucauucagcuccaugggacacgacuguacuacgauguaacaggucuguaaccuaacaaaugaguaaaggaucuagaaauaaauucuaaauucauucuugaucauuguguuucagcuaucucagccauuuaguuucuucuuuuuauuaguuuuggccagaaaugcgagcacaaaccugcaauccuagggcuuaggcugcugaguagggaacacugccaaagaguugaaggucaccuguguuacacagugaguuccagaccagcauggucuacauuguaagacugugucucaagccccaaaugagcaaaccugaacgacaugagacuccaucucaagaaaaaagaaaaggaaaguaacguccaguguacucacuggccuuauaaauaaaagcccaaauccccguaggcugcucaccugaaauaacauuagcaacuaccauuugaaaucaguuuccuauucuacuaaccucacagaaaugcuaccaaauuccuccccuuccuucccaaagauguaaucuaaaaacaaacuggaagcaagcaaauguuaaaaggcaaauuuucuaaguauaacuacaaacugaacaugauuaaagauuauacaaacuauaccaguaaguuuucuauuuaauugucaaucacuuagaggaccaaaaacaaacaaaaaccaaagggaaggggaaauaccaaaucaacuaaccuagcuguacaauuuacuucuuaacaccacaggcagcaugggagucucacaagaacuaguaaaucauucacugcaaguaaacacaaacuccuuucaucuucuacuagcaguuaucccagcuacacagagauuucaguccaaaccuauacauacaauuacauacuuucuaaaugcagcccugaucuacuguagaauucuaccauuaagaagaaaauguauaaacacacacacaaaagcagcaguccuuucaacaagcaacuaaaaauucuuaauaguaaaaaauguaauauuccuauaguuguguuaagcaaaaugaaacauaaaauaaggcuauggcaagaaccuauaauucaucauuuaacuauucuaagauguuacuuucuuagaaacaguacagaguaacugguuaaugacacuucugauaacauucucaacuguucuauuaugauaaagccaaaaauacaggaaaauuacuuacugcaccucaccucgucuaggaaaauaguuacgagcacugcuacuaacacccuuuaccuuuuccuaauuaaaaacuaaacuaauucugguauaaguucucugaacugacaagugaaccaacuuaagaucaauaucacauuaaauguuuucaacauuaaaacauuaauuuuauucaagaacaaguuaacacuuaaaaacuguucaccgaaagguucacuagccuaguacacuaaacccacugucgucaucaaaggcacauuaaaagcagauguaguagagcacuccuguaauagcaacauucaagaugcaaaaccaggaagaugagggguucaauguuagccucaacuacaugaggaccuuuaucaaaaccaaagugcaacauaaaacacauuaaauccaggacagccagggcuaaacagagaaacccugucucgaaaaacaaaacaacaaaaaaaaaaaauuuacaaaaaauacuuuuauacaacaggcauuaaucucaaaaaaauucacaaaaauuacuuuuauacaacaggcauuaauauucucaguucaagagauacagaagcaaacaaaacagucccuauuuucaggaauaggugccaugaguauaaaauaaaaauaaaacucuuccaguagaagcauggggagcaaccuuauugcaguugcuacucauggcugcucaagugugucccaccuagacagcugugcuucacugaacaaaggcuuccaaccuaaugcacaaauaaagagauccugugacaaaccugaagugaaaacuuugaaagcaaacaugacauauauuugaagagacugaucggaagccuuuuaucauauauauuuauauucguuacauauuuucaauaaagguacaagaaauuucacauuuuguuagccauuuuuuccuaaaaacaaaaucacauaaaagaaugucaacagcugcaugacauacaagcucucauuguuuuuuuaaguaauaauauauuaguacaugggacugaaaacuugugggaaauaaaggaagagcuaaguagacaaacaguuucuugacuguaguuuucaaagguuaugaugguaauugccaaagccaauaacgaaaagcuaaaggagcacaaauuuagcaucacagaauagcagagaaaaaggcaauuuagaaaacaagcaagcugauuuucuaaggucaugcagagagaaggcuagcaccaauacuccacaaggugaguucccucuugaaguugcuauucccaaauagaacuuuacauacuuauagaaaucauuauuuguugggaaguccucuauuccccagucucugaaaguuuucugugagcuagauaagggguuucuccagacucccaggcaagguucuuuauuaucaucugaaaguaaauguacucugaccaaaaauaaaaaaguuaaggcuagggauauaucauggaaguaggaaugcuugccuaguaugcaaugaggcucuggguucaaaccccagcacugcaagauaagcaaauuaaauggauaaauguccacauauucuuuccuuuuuuaagagugaggaguugagacaaggucuaacuauauagcugucaauguccuggaccucuagaccaggauggccuugaacuccuaaaaaucugacugccucugccuccugggcgcugggauuaaaggcaugugccaccuuuauaaaccagaacaagauuauuaaacagauuuuuuagagguuuuuauaaauaugcuacuacaugucaaugcaaaacacaagaaauaacaacccaaaucuaaguuauucuccaacucuguguacacuguauccuaacuaaauuaauuucauccaacucuguguaauauugaaguuuucuuaaacuuuuaacaaacuuuuagcuugacauagugguacaugccuuuaaacucagcacucaggaaacagguaugugggcuacauacuaaaaccuagucaaaaaaaaaaaaaaaaaaaaaaaaaaaaaccaaaccagaaggaagaaagggagggaucuacauuuaggucaaaauuagauagauauuaagccuuuuguuguucuucuucaaugaucccauucaccugaaagacaaauaccccucaaaccugaguacuuaucacuguauuauuaauaauaaucuauaguaauaaaguaacauaaaaauuuaaaugauaguuuauaguacaauaauguaauaaaauaauacuauauaaauacagacauuggaacuacucaaaauuuaaaagucuggcccagaguugugauaguuauucuaccaguuggaaggcugaggaaggggaaaucccaaauuugagacccgcuugggcaaacagugaaaaacucugucuaaaaacgaaauagucuagcuuagaggagccaccuauaauuccaauauucaggagucugaggccagacugggcuaaauauaaaaauuagcaggccaacuucagcuacauaguucugucucaaagaaacaaaaaacgaaggcucgaggucacaaucuaguagcuuacacuuguaguaagcaaaaguagaagauaacauuuagcuuucaaagcaagcaaagccuucugcucccaucuucagacuggcaaaagagaagacacaguagcuccaacaacagugcaaucugaccaaaacuccugagcaauaaccucugacgaaaaguguguuguuaaaauucaacuccuuccacaaucuggccuuaagucaaugacuucagcuauauuuugacccuuagaaucccacuucucaacaaagcaccuguuaacauaaacacugcugcaguuuuccuaccuacaugucuauaccuucuuuucugcugcacggaauuccuauuguuccucauuacucaucacugaaggcccaguugccucaccuauuaaaagcaaugccuccccucugauucuaaguaucacugaauuaguaucuaucuuugauugccugguaauacuauuauguguauaugucauuuuccuuacuauauuaaggacccagucagcaauuucacuucuagauuugccaauaaucuccacagaguaaccugggcauauaaauaguagacagucaauauauaauuacuaagaaguuuauuaacuccuaccaaacuauaagccucauuuguuagacucagcucuuaaaacauuaagaaugacugaccguuuacaaauguaucuaaauaguuaaaucaaaucaaagaaaaccuccuaaaaucuuuaaaauuuacuaucaucuauugaguuuauauccauucauaaauuuagaggccccccaaaagcauucccuggcuucauggcacuggcaucuaauaacaguaaagggagaggcgcucuaagaugaaggucugugaagugaagguugaagacaaagccuaccaaaguaacaagaccuuuaagggcuccuauccagccucaucuagcaacuucuccaaacccaggacuuuguaccagguaaguuaccacccucccccagcacuauaaagcucuuucuuaccuucaugucacugcauaugcuaguuuaaaaagaacuuucuauccuucugcaaaaucacuauauauccuuuaaguucugguccccuccucugugugucaccaaccuccuuuagauuuaauuccuaccucuuacuuugaaauuucacacacaaauuauaugcauguaccucaauuacuugacuguuuagcacucgugguccuuuuaagguaaggaaaaagucacauugcuaugcucuuuccuaaaccuugaucacccccauucuauucaagacuggcauaaguccugcucaauauuaacucaaagguaggcgcaguaguucacaccuguaaucccaagaggugagaaagacugcuggguuccaggucagccuaggauacaguaaaacggugcacaaaagaaaacuuuuuucuuucaguaucaacguuucuagaaacuuucauuaaaaugccacuaaauaagucucauuuugucaucugacccuucuucaggaaaaauacucucauucaaggaugaacccacaagucugccuucuaagccagcauggagaucaggagaggaaggauacagcugaggcagucagaagacucccaccaccacucacagcagcauauugagggucuagccuucaguucuucuaguacuuuuacacuuuaaauguuuuuacuaauacuuuauaucacagcacacaagcauuuaguaaauaaagucuuauauccuaccacaagauacaaacuauuggaaagaaccaaaaauuuaaaaccagugacuaucuagaauccauuuuuaacaacuagauaagcccauaauccuagaaagcaggaaagcugaaggacuuuacugacaaacuguuuaaaaucaaauacaccagcaaaaggcagacucuggaauaaauacuuuugugucaaacugcccuaguuuuccaugaacuaaauccaaauauuuauuucccuguuuccaucauuccuuuacucucaaagcagaauaaaaauguacuuaaggggaguggggguggguggguaugggggacuuuugguauagcauuggaaauguaaaugagcuaaauaccuaauaaaaaauggaaaaaaaaaaagaaaaaaaaauguacuugagucugaaaagaaacuguuuaaacaaaucauuaacagagcaaacacuauuacuuuuagcaaucucucucuucauuucguaagauccgaaagcacuacugacuauuacuucagggaaacccucacccugacuugacccagucagcaucuuuuauugcuuauuugucccaugcugcauuuuaaacauuucacauguuuaaagaagauacacggggauccuuuccauacauauaauuacaagaacuacuaaaaaacaaaaacaaaccuugauaugaaaaguuaucauuagagggcaguacaagacauuucuguaugaccaaaaccauuauuuauugauguuuuaccuccaggcaauuaaaaaaaaacauaacucaaucuaaaaacauacugaucaagugauccauccaacugagagaauagaaugcuugagacaaauaauuuccauucauccaucaaaaaacuauaaccaguacuauagguuaacauaaaaaaauucuauuuccauauuacacugagguaguauaacuggacuuuauguugagcacaaaagguaguuuaaaaaaaaaaaaaagaaaagaaaagaccuucaaccuucuuuagauucucuuaaucugucacuacuauagcacggaugagccuucaaagcgaucauacacuaugaugugacuaacaugaaaugccuagagcagacacacagauuccuggcugugggagggcugaagaaacuuggaaugacuauuaacauuuuuuuuaguaggggaauggaaaauguuguagagcuagauaauagugaugggcaccuacauaucaugaauacacagcacacaccacugaacacuuugaaacaguaagcaguaggcaaugugaacugugucucaauuuaaccguuacaaaauucucucucaacuuaaaaugcguaaauacaauaucugaaacauaaauauauacauacgguguggggguuggggggaagcauacugcuucacaauccccuucaugccaccuuagaacuauuuauauauaaacauaacuuuaaauuacuuaaugaguaaaugaaauuuuuuuaaauaaauaccugaaguauaucaaaauuuuaucaauacucuauauaaacauucccuacuauuugaaguacuauaucuaauuccucucuccccaccccaucuuucucucucucucucucucucucucucucucucucccacccacccacccacccacccacccacacacacacacacacacacacacugccauuauagucacguaagauccauaaucaauacaaguauacacuaaaauagaacaacugaccauauccugugaagacgccugcaaagcaaaccugcgaucuguagaaaggaaagucaacugcaaaacaugccucucuucuucaccuacuccuuggaagaacuauucuugaggaauauuuggccccuacaacucuuucaaguaauaaguuguugcuacaguuucuagcacauuucuaagauuagaauucccagauuucagagaaaacuuuucaucaaucccuggcaaacacuuaagguuacagauagagugauauuuuuacuaacaucacuaccucuccuaauccuuaccucaaauuucacucuaaaacaauuauuucauuucuaucugacaacuguuuauuucuccuuuguuauaucaaauaaauuaauagguaggcagauagaugagacauugccacauaguuguuaccuuggaggccaaugugaucaguaccuccuugaagagacucaaacaucagguccuacuuuauuuauaguuagaauugcacuucuacuuucaagaacagccuucaagauaugcauuuuaauaccgccuucaaacugaacggucauaaucaaaguuuuccuaacuacaguguuacucugucaucaucaaccaacaacuaaacuaaaacaauucucuuaagggcuucugaggucaaagaaacccacagcaggauguuacagugucuuaaugauguuccaucagagaacuacaauugacuuuacuacaaguaaacugucauaaggaaacgcucucagaguguugaaacagaucucucugcuguuuccucagacuuuucaugauuuagucugaucuauaaaggaaaauauaugcucacucgcuauuuacugaacacucagagagcugcugaguauguuacugaagggauacaaaaaagccaagacacaaaaaugaaacagaaaucccuagucuacaaagaaaacuuuucaaauaaaccacacaauuaugucugcccuaacauaaguuuuauaaaugguaguaaauguguuggagagauggcuggcucagugauuaagagugcuuacuuggugaaacauuuacaugagauucugagcuuagauuccacaaaaaaaauauaugugguaaaauaguuuuuaaaaaagaaagugcuaguuagcuauuggauggaucacagggcccccacuggaggagcuagagaaaguacccaaggagcugaaaggaucugcaacccuguaggggcaacaacauuaugaacuaaccaauaccccagagcucgugucucuagcugcauauguaucagaagauggccuagucggccaucacuggaaagagaggcccaauggucuugcagacuuuauaugccucaguauaggggaacaccagggccaagaagugggaguggggugggaggguauggggugggaggguaugggggacuuuugagauagcacuggaaacguaaaugaagaaaauaccuaauuaaaaaaaauuaaaagaaaaaaagaaagugcuuauugcucuuucagagcaguaagaguuccagacaucuuacaauuaccaugacuucaauaggaaaucaaagccucuggccucuguggcacugcauuuauauucagacccagacauacauaaauaaaaauaacaaaucuuuuuaaaaaaucuuuugcacaucaaguuccuccugaaauaaccuuuacuccucccuaauagccuucccagaaguaugucuuuuagucuugguacuuuaacucauaaaaacugggacucuaaacaacauuuuuuuaugagauuucugucaguauuuacugucagaacuuaaaacugaguuuuaaauuuauucauuuagaaacaacaaacucuacucauuguauuaacagguuuuaugaaaauuauauuuaaaaucuagaagaacagcaccagaagagacugguuucuguaagucuuugacagagggucaaguucuuuuuuuuuuuucuuuaaaaauuuauguauuucuuuuauguauaaguacacuguagcuguguacagguuguaugugaguauacuguagcuucaagguugagagccuucaugugguugcugggaauugaauuuuuaggaccucugcucgcuccaguugacuccgcucacucaguuccugcuugcuccagcccaaagauuuauuauucuacauaaguacacuguagcugccuucaaacacaccagaagagggcgucagaucucauuacaggugguugugagccaccaugugguugcugggauuugaacucaggaccuuccgaagagcagucagugcucucaccugcugagugaucucaccagccacaagagucaagcucuuaugguuugcuaauacacucaaccuguugcaauaaucacacagcacaaagcuucugggaaacucagaauagggaagggaaguuguaccuuaaaauauggauacucaauuuugaccucacaaaccugcugaagguuauagauauucacagguguccuuggcucauaccugaagaaucggugcuaacaaaggagcccaggucuaugcaaugagaaaaggugaacauaccuauguaaaggagcccacugaaugacacaggccuuacaccuuucacagaaauaugcacaaaacuauuacaaaaccagauggaaaauacaaaacaagguuuugggaagacaauauggggaguaauccaaaugacuuuggguuuggugauuacauuuuagaaacaacacuaaaggaauaauccaaggagugauggucuagaccaaugguucccaaccuuucuaaagcugcauacaacccuuuaauacaguuccucauggugugguaaccuccaaccauaaauuacuucauuacuacuucauaacuguaauuuugauacuguuacuaauuauaauguaaauaucugauauacuggauaucugauaugugaccccuaugggaaaaucauucaaaccccuaaaggggucacaacccacaggugagaacugcugcucuagacuacauugaaacuaaaguuuucugcuuucuggaagacacugucaagugacaaaaaagacuagacacagauacaguauuuggaaaagaugugagaaaagucaacuauccaaaauauacaaauaacaaaaacaaaaaucaccucuuaaaaugcaguaagaaaacaaucugacuuuuaggaauguuacagacuaguguauggaagauccaaucacaaggcuucugaaaccaggaaagcugagaagacagaaaagaucagaggcuucaagggguuuuggaaaaccacaaaacuuuucaggacagucaaauuaacuuuuuaugacgauguaauaguggauauaugcagauauuugcccaaaccuauagaauguacaaaagcaaaaaugaauccuaauguuacugcuuccuuugggugauguauuaaaauagguuuaucauuuauacacaaguagcacuuuauuuaaauagaguuuuugauaauaaaagacaugugggaauauguaacuauaugagaaaucuuugacccuaugaacugaauagugcucuaagaaauacucauuuccugggauagaaaauuauguaaaaagucacugaaaccuuagcauacucuaauccuagacuugagcucaauguccagucuaccacuuccuggcugagagcuuguacagaaacaaagccucucacauuaaguuauuaaaagcaaaauaguaguuaauaaauguaaaugucuccagcauacaauaaacccaaaauauucaucaaaaaaagaaaaucaguuaaggucaugguggcacaugcccauaauccuagcacuugagaaguacaggcaggaggacuagaagguuaaggucaucaccaguuuacauugugagcuugaggcuagccuggucuaccugagacccuguuucaaaauaauaagaauaaaaaaaacaaggcauaagcccaaaaacuauccaccaacuacauacaaauauaugagaaauccuuagcaugacgacaaaaaaaauccagcaaaucacaacucuaaauuuaauuuuuaaugcaaaaguuucgguucaugaacccuaccacccaccuaaaggguggacaaauccagaaugaaacacauaucaaaugcacgacaggauguguuuuuaaauaaauucacuagucaaaacaaagugaacaauucuucaugaaaagaacaauauacauaaugaacauagaaaauucuaaaaggucauacucaaaauuccaauucucuaaagaaauauauaaagcacuucaacuaggaacacaaugaaacagaacacaaaguaacggaaaugccgcuuuaaccaccaaaggagcaggagucuaaggacuccuccccaagaaacguuuaggcuuuauuucuuguuugauuucuaaaaacaaacaaacaaaagugaacuuaagcacuuugaagcuaaauaaaugugcaacuuucuaugaauuauuguaaacuuucauuuuacuauucuaaauaauggucaauaucaaaguaaacacuuuuaaacuacagcaaaacacugggccuggugccacaggccuauggucauaauacacagaaagcuaaggcagaaucaaguucaaggucuugauacagagaaaauucaagaccauccugucucaagaaaaaaaagaaagaaagaaaagagcugaguauauaacucagugguagaacauuugcccagcauguauaaggcccuagacucgaucccuuuuauuguaaauuaaaucaauuuugauaacuaaaauuuuuacaaaguauuuucagauaucaauguauuucaugaaaauguucugcaagcagucauggagguacaugcuugucaucaaucccaucucaggcaagacuguggguucaaggccaacacaggauacauaguuuuccaggccaaccuaagcguucaaaacaugagaaaauagccuagucaccaugaaguguuucauuucucaccuuuaaacuaaaagaugcuuuccaaaauuauccacauaagagagauauacagcaaacuuaagaaaacaugauugaccaacuauguuuuuuguuuugucuuguuuuguugguuuuucaagacaggauuucucuguauagcccuggcuguccuggaacucacucuguagaccaggcuggccuugaacucagaaauccgccugccucugccuccagagugcugggauuaaaggcgugcccagcgugaccaacuguguuauuaaagcacuccuuaaauauaaucacuuuuuaaaaagcguuuuagaauucauuugguuaacuacaaacagaacagcucgcuacaaaggaugaaugucagcucucuucuuuuaauacagguaguacaguuggcccucuguuuacaugggucccacaacaucagaucaaaaacaucucaauuacucauuuuauugucauuguucccuggacaauacacuacaacuguuuacagagcauuuacaucauacagguauaaaguaauguggaaaugcuuuuaagauauaugggaggguguguagauugugugcuaacacuauacacuuuauacaaaggaucugaacagcuauggaucugggugggaagauagcuguaucugaaauuuuaaggguugugcucuucuaucuugauuauaaauggccauuagaagccugaauuuaaaugaaaaucugucaaguuuaacaguaggaacauuaaaauacuguuacgcauuaauacuuauaagcaaaaagucuucaguaagcauuaaauguaauaugaauugacucaaaauuuauggacaauaaucacuuccuaauauggaaaaaucuugucagaaguacacaaaagccacuuccacaugcuaaaggauugaugagagagacaaauuacuaggcauauuuuuguuaaaugcuaccauuuuaaagaugaaauuguuucuuacucaguucaaagaaggagacguuaguaguugaagauauuaaaaggcauaagaaaacuaacuuucaaaacuaagaaaaauucuuaaagagccaaaaauuauucaaaggagcaaaaauuacuugaaaugaugcauuucucuauuacauauagccugagauuaacaccaaaacuugucucuagguaacuuuucaaaacaugcugaagugugaagggaggguuggaacccauucaucaaugagauuuuucuaaaguauuagagaaaaacagcuuacaauagaagaaaaauaguaucauuguucguuuaaaaaccucauuaagaaaaagacaagaggcaccuuauuuuuaauauuaaaaaacauauuaaacauauauuaaaaaacauuaccaaguauacucaagcucuacaaguaugggaguuuguagacagcagagaaaaaguuagguuauccuuaaauaccaacuaguuccaaucuauaauauugacaaaggucacuaacuagauaaaaaccaccuuugcuucuaaccuaaaaaagggaaaaaaggaagaaaaaaaaaaaaagaaccaacaaccuaucuucuacguucucccccauucuagcaacacuucucgauaagcauugcugcagcuggagaagcccuuauaaagaacauuucaaugcuguuucugcugcgauuuaccacuuugaguuaaagaacauuucacagauuaccaaguaucuuccgcccccuucacaccaacaaaaacaaaugaaaacccacaaacagcacugacacaaaaacaguagaguaggguuuuguaccacagaaccaacccagcauuguggagggcugaggaagaacuauggucucugucccaaguucaaggccagcuugggcuacacagacaaauuugacacaagucuggaaucggaaccauggaaaaaagaaucccauggguagucuuucaaaagaauguaaacaaaagcaucucuccaaguauauauuuuucaaaacccauuuauaauuuauucacaauccccuacagaauguuuauaguggagucaccauuuaaauaucccuuccacuuuccuacaucgggucaguuaaaaagcagccugucuaaguaccacagccaaccaaaggauggcuucuaugaaacguccacagccagggaacaaaucgcaacgaauaauggguuuugucuguggcaacaacuuguucuaacagcacuucaugaccagugggucuuagaauucacaccgccguauuuuuuuuuucuucaagugcaaaccucacagccaaaguccaagugagaaacaagauuccuuacagcgaauucccuuucaggacaagcucgcucuugcuucacagggcaaagcaacuuucauguaugaugaaagucaguuuggcuaauguguccgggagucauuuaaaaagagaauuuacuauccuugcuauaucccuauuuuuuccugaaacauuccacugacucaaggacugagugauccacugagcuuuguacccuagggcaaaggagcaacaagaaaaaggaggugguuuuacagguggcuccuagguuagaaagcaacugggaggaguccgcucuauuaacuguaccuaaguuuaugcuggaguuacauuaugccgcuuaagcaagauaguuauccaaaauacagcuagcauaaauuaaaacguuuccaaaccugauuauuuguacuuaaauauauugauccauuucgaaccgcuacacaucacacucaagcuucuaaauucaaaccaccaauguuaacaguuccaggaacugauaccaaaaccagcaaagcccuuauccauauccucauauggauuacaaaagggggggggggguagaacaugcacaacacacaacuucaaaacucagacaauauaaugauggcaaauaaaaauaguaacuucccacaaagccuuccccacaccacacugaaucccuuuguuucuacuccccacaagcguaaauggaauaaaagccgaguaacugggcauaguauugaaagaaggaggugacaagaagucaaaggaacuuaacggaagcuagaauggcaaagaugaccgaaaagguagauagaaagguagaaaaggaaaccacaaagaaaugggaggaggggaaaaacacuucaagagcugagaagugacagaaaucuggucccaccaagcagaguuaguacggaaauacgaaaaaaaaaaaaaaaaaaaaaaagaaaggaaagggaauuuuaaaaagcuaauggaacaauggggcggugagccugaguccuggagacauuagccggggaaucacugagcggacggcugcuaggagguacgggacgggugggauggaagggcaaaaggggcugcaguagcugggagaggagucugagugaggagcugggugggaggcaaguugguggagcgcgaugggcuugguggugccgggggcuaggaggcgagggucucaggggaucucugggggcgcaauggauugucacauuuuuuuucucucuuuugagagaagagcagaggccguuaaaggcaggugugaugggagcagaaaagaacacacagcucgaccaggcacaggagccaucgugcagauaagacgcagggagggaagaggcagcccaagagagagaggaggacgauggagaggggucgggagaggaugcggggggucuucacucacaguccaggugcuuuuucuuggggcccaugaucucgugggucguggccuugcauacugucuuagauaccgcggagccagugacacugugcugggccgcggugauucgguccgucaggcucuggccagacaucucugcggcucguccgccaccccuuccgcuccgcagccggcggggccugggacccccaagcgcccgaggguccccaccccccaccgcacccccuacccccaccggcuccccgcccgccugccggccuggggcggggcucagggccgcgcgccgccacccgcuccgagagccccggcucgcguguucccccggcgggcucccacaccaagucggggccacucccgggucccgcgccucagccucggcccaccccuucccuggucagcuggagcccgaccggguaagagggccaggcagcugcaggaaaauggcggcgccaggcuccuccucggagcuuuccgggcugccccuaggucacgug

SEQ ID NO: 3937 - RNA, 6537 nt, Mus musculus
uggacaggaaacagaggcggagacagagucacgugugagccaaagauggagcucagacgacccuagcgaagguugcgguagacucggcgcgggaggacccgggcaagcaccggcggcuggggaggcugccauuagcugccuucauucugccgaauggugaguagcugugccaaugucgcgcugggagaggcgcgggguggccacgaggguggggaacgcugugugugcugacccggucuucacuuuccacccgugagggggaagaccuggcugaauugauugaguugaagaaucacugccaauuuacaaauugcuacguuuaauuuuccgaugcuugguuuuuaugcagaaacuuucagagaucuuuguaguauuucaaggugucuuugucuuugauggggauuuauuaacugagaaauaauaccaggaagaagaaacaggacuugaauccugggauccugaucuaaaccgcuaaaucuguauuuuacuuucgagguuaauuuuuaagucaagauuuauggaauuuugcacaugcagcauuuuccaaaucauuguauauauacaacagguacccaagauuugguaagacauuguuccagugcugucacagcuaacuaauacgaauggugacccaagacaggcugauuuauuaucagguuauuucugaguuuugguuuauugcuacuacuguuuuaucuuuugaaauagggucuuggaguacauccaggaacucacaacccuccggccucagcuucccaauaguagagguaucaccacagguugcagacuuuuuuccugucaccaggaaguauguuuuuaaagagcccaaucuaguaaaaacgaauccaccauucuacacugauauucauccuauguguaccaugccugcucaggccagaaaagggcauuagaucacccuaggccugaaguuacagcugugugugagcuuugacgugggugcuagggcucgaaucuuucaucauguguccacaugccugcaaugccuaugaagggugaagaggauuccaguccccuggaacccuuguucuuugcaauaguguucucucaaaacuacugagcccuuucuaacccuugacaccuaaucaucuuuacaaaguggcuauuacacuugaaauacaacuuauaguuccaccagcagaugucacagcuuuccugaaugcuuccaagugaaacuaauuaccuguguaccuaaugacaucccuguuaucuuagcuuccaccucauguuuuuguuguuuacuggauguuggcuuucucucaugaugugaggcucugucuguugcaucaccccuccaccccacuugucuagcacaaauucuuuggauuuuuguuuuccuguaauaaauuuucauguagcucugcuggccucaaauuccaguauuaucaaggacagcccugagcccaccccccaacuguuucaacuacagucaugucaccaugucugaauuaagucauuuuuuuaauguuucauguauguaguaauugcuuagaaaaucaagauuguggagugucuuagaaacuuaugcgcugcuuuucuuguucagguuucugguaugcuguauugggagagggaaaucuuauaugcuauauauacauuaaguuaaucuacaucucuuacauaauuaugcaucucaaaagacuuuuucuagauauacuuuuuaaauugggauuguuauauuuuuuuuuagguccaagauggaaagucauaaaccaaguacuagcaaagaugauuuaauacuuaauaucauauccagaaaaauuaaacaacuuccagaaucagacagguaagauuccauagucuuaaaaugucuuuaccuaaaaguguuucaaaagauuaucuuaaauuugaaggacuaugcauacccaaaggaaacugagcugucuuuuugcuuugaugaaaaaacaaaaaccacccugaagcccagugacacuaaccauuuugugcaucguauaacucauuauggaaacugaaacuagaacuuuggaaauauuuaauugaugaacccaccuuuccauucagcuuuuggggugaaaaaaacuguauggauccauuuauaaauaacuuaaaagaccuuuucaaguuaaccccaucucuuaucuucucaguguauuucuauguuuaccuuuauuaagaguaccauggccuggcggugguggcacacgccuuuaaucccagcacuuggaaggcagaggcaggcggauuucugaguucgaggccagccugguccaggacagccguggcuauacagagaaacccuguauagaaaaagccaaaaaaaaaaaaaaaaaaaaaaaaaagaguaccauggaauauuuugcaagauggaugacagaaauggauguuuaaagaucuuuaagaugaaaaagaguuuaaggagcaugcugauauuaaaaaguaguauaguacagugcccuucuacagaauauucuuuaacuccuuucccaucagaaagccugaguggguuacagucacaguaacuucagguugaucugugucuaugcaccugugcugagggcaacugucgggagucucucuucucccuuucuguguggguccuagguaugcaacucaaagguugucugucagauugauuccacccagucaugagugggucaugaccucuaagagaagaacagaaacgggaucaaagaaaugacaaagcaaggaucugucauauuugaggaaaacaguguuacugaaacacaggaggucccuauauuaggguuucaagcaggaaaaaacagauccaacuaacuuuacugccuaaugcagccaguuuggguaauagauuuaaaaaguagguaagaggcacuagugaagugggauagaagauagaaacauuagagauagaagaugugaaacauuacuguggcgauugaugcaucuucuagugugaacucacaccaauuccacuuuugguuggcacuuaccgucuuacaauagagaaccuaauccguaccugagcaguaguuaccaccaccccuacauagacacccccauuuaguuguuuccugagauacaaacagagcaccuacaugagguaggggaagcuguaaugacuaguguaagaaagugggaagagagcaggcucccagugggaucuucaccaaaucagcaaggagcacugggaacugagcuggaacuccacuuuaagacuuugcuugcaacagucaaaauguuucauuuuacaaccacagcaaauuacaauuuaguugggagacaaccaaguguucaaguuucagcuccacuauuucugagcaugguuaaaauaggggugaguccuauuucauggcuuuuuaaauauuuguaaaagugcucaaguuccccuguaaaauucaggcuucucacauuggggcuguaguucuuuaauaguuuucuaacuuccugagcugucuuuagacuucugaaaaccucaacuucagucauguagcuaacgaugagaaacuccaaagcagaacgcagcuuuccuugcaucuguagcaagaagucaacuuuacauaacugguucucaugaaugaagugaaaugcaagcaugaugcuucaguaguaaugaccuagaaaagcuuuaaauuuaaaauaagcaaaaacuacagaaccuaguggaggugaagaaaugggaaacaugaauuaguaaaccauacugcagcucauaaaacaaguagugaaaaccagacugaguuguaagcugaagagcuuauucaaacuguacuauauaguuuuagguaaacacauagaacacguuuuggcuuaagauucauuuaucucaaauuaccaguuaaauuuucaucaaugagcuacuaaaaacuaccuaguauaucuacuguaauguuaguacccagacuccuaaucuggauauuaauacuugagggaugaguacaaggaaacacacuaacuguacuacucaguuggauauacaucugaaguuguuuauagauacaauggguuuaaagucaguaauugauaaacaguacuaccuuagaauguguuguguuuuuaucaugagagcucaaaagagccaggcaucuuccucuucagagauguuuccuguuauauaauuuggggcaaaguucugaacaguucuuuacuuaaaguaucauaaaauacauauauaguuagugucauggucuccuuauuacccaaauccaaaagccuuuuuugaauagaaauguaggugugaagcuauaaucugucuuugguuuuaugauccuguaagggguuaguuugucugguucuucgcagggugcugauaaguucuguaacacaccagaauuagagacuuacacgucaucacuucccucauccucaggaaucugcuugaauauggaucagcauauauuggacuuaaugcugcuuuugggggccuaauagcaaacagucuauuucggcgaaucuugaacgugacacaagcucgauuagcuucuagcuuaccaauggcugugaucccauuuuugacagcaaaccuguccuaccaaagucuuguaaguuuaccuuugaguacagguauguuuuaucucauuaucacccaaguuugcacuaguguauacuaaccauagcuuaacucaaaauugaaaauauuagaacuaaagauuaccagauucguaucugugggcuauaaugacguacuuaaggaagagagaaucuucugcaacaacugauucacauuaggucugccaaccaaccagaguacauacauacgcagcaguuccauagugccgccuuuguuucuuguuaauuugcacaucuauuuuaaucucuuuuaaaauauauauuugcauaugaguguuuugucugaauguacauuuacagaccagguaguggcacuggugcccauggacuauagauacagauaauagugagcugccacauggaugcugggaauugagcuccgagcacguguacaagaacagucguuuuuuuuuuuuuuuuuuuuuuuuuuuuugguuugguuugguuuuuugagacaggguuucucuguguaguccuggcuguccuggaacucacucuguagacuaggcuggccuugaacucagaaaucuaccugccucugccucccaagugccuuuaaaggcguaugccaccacugccuggcccacagccauuucucuuaacugagcuaucucuguauggaaguucuuuaaaauaagaguauacuguguaccauguacauauguaguauuuagcaagaagagaaauguuuuaacuuuauuacuguaccauguguucugaaugaguaguuucuguuauguguccuguuagguguguauggcccuccugauuaaaaacaaacguaucaucacaggguccaagggggucaauuuuuucuccgaaauacugagaauccagagucaagauuugucuuccuguuucucaguauuuccuauccaaggccuuaauacauguauucacacuaccaagcuacaguccauccuauguaauuauuccuuugggcacauuuccaagaucauuuuuguugugucacugaaaauuaaaugugaaucuuauauuaaguccuuuuuacuuaaauaucauaaccaucacuuauuuccuaggugauuugaacugugaaaccuguaccacaacacggggugcacuaguugguuugguuauggguggucuguacccuauccuuuuggcuauacccgucaaugggggccuugcugccagguaggacuguuuucuuauuuaaaaaccuucaauuauaugacuaccuaaggaacucugaacuuaaaaaaagcaaauauacccucauguuaagucauuuagacuaaacgcaguguuucccuccucaggaguuuuuaagauacucugucaugcugugccucuugguucuguucaggucacuaaccuuuauuuguguauuaaaugcuuccuagaaaacaagccaguauuagugcugcaggucuagcauaacagcuggagcauauagaauaccauugagaguuuguacauuuguccuaaaggaauaaauaugcuaucagaaaacugcuaccuguaagccucccacaauuccaguuacuuggaauucuuguagcaaucuauuuuguguuaacuccagagagagaaagaggcaccaaaaaaaaaaaaaaaaaaaaaaaaaaaaaaaaaaaaaagaccagaaccauuuuuaagacuaagacacaaaagagaauggcaguaauuaaaguauguaugaaaccaaugaauauaugccaauaagagacugcagcuauguuuacaauaagacuuacaauggagaagaucaaugucugaucaucaauaugcuuccuuacagguaugaaucaaguccccucccacagaggggaaacaucuucaacuacuggauuacaguuucuaagccugucuuuagaaaaauguuauuuccuacuuuacuucagacuguguuugcauccuaucuugggucuagacaauauaaacuccucauaaaggcccuucaguuaccugaaccugacuuagaaauucauugaagcaaauauguacaacaaaaauaaaauggugaaaauaaucuugucugcaaca

SEQ ID NO: 3938 - RNA, 4112 nt, Mus musculus
gacucagcauuccaagaccuuagucccaggauuuguagaggaagauggaaaacacuuuuuuuuuuuuuuuuuaaacacagcaaaugaauucagagaucugccugccacuguaaggcgcaaacaauaaauuuaucugggcaguaucccacccuaaaauuuacauucugaccaugacuaaaccaaaauucacucugcccuagacugaccuucaauugaggacucugacugccuuuguaucuuucugacaagcuggcuuuuagugaagcugccucugcuuuuuuaaaucgaagaauccccucauauaauucauauugcauccuuaaauuucgcauaguagagaaauuauauauuuuugaacucguguuuucagaguucuuuccuacagcagugagggcuauacugaaagucagagccuuuaccauuuauggacauagacacauccuugacucccagacucauguugucuuugauuauuauggggacauuaaccuuggcagagaggauauuuuucaauaaccuuugcaaggagauuauuucccaauaaacaguaggcagaauauuuccugaagaggaacauaauguucacacgcacacgcacacacacacacacacacacacacacacacacacaccccucacacccagcaacugccaauacuuguuaaggcccaugcccugcuggcucuguucuaggagugggaaccaugucacacugaccuugcacauggacaagcagaacuuggcacaagcaucuguaauaccagcccuccucaggggagauuggaagcagggaaaagagaaucccuucaaauuuguggagcagauaaacaggaauacaacaaagaccucuucuugaacaaggcugacaaauaccuugaguuguauucacacacacucacacacacauuugugaguucaguuccagauagagcuucucauuuuuacaauacuaauuuuuaaauauaauuacaugacuauaaugugucuuagucacauuuaucucccauuuccccucuccaacuugucuuguuuuuccccaacacaaauuucuuuccaaaccucauguucucucuguguuucugucucuuuauaaucuaaugugaucaaucaguggugcagauacacugaugggucaagguguauccacugaagguuggccaaucucccagggacccauuuguaaaaaaacugacucuuccucccugagcauccauucaauagcuuuucauucuggggugugggaagcugugccccucucucauauauacuagaauauaaccuagcuugauuguguacaggucuuguguauucaaccacaguugcuggaccgugucuagaagauaguuugcccugguccucccugaccuaugauucuuuuuuuuuuuuaauuuaauuuuauuuguaauucauuuuuuacacuccacauuccauucccuacuccuccccauccacccucugacuguuccacaucccacaccuccuucccaccagacccugucuccauguggaugucaccacaaccccaucugaccucuaaacucucuggggccuccagucuuuugaggguuaggugcaucaucucugaaugaacacagaccuggaaguccucuacuguauguguguuggaggccucagaucagaugguguuugcugucuguuugaugguccaguguuugcacuugggcacuucaacuuguugagccuuuugaauucuguggacuguaucuugaguauucuguaugggcucuuccuuucuucuuucuuucuuucuuucuuucuuucuuucuuucuuucuuucuuucuuucuuucuuucuuucucuuccuuccuuccuuccuuccuuccuuccuuccuuccuuccuuccuuccuuccuuccuuccuuccuuuuguuuuuuggcuaauauccauguauuagugaguacauacuaugcauguccuuuugagugugagcuaccucacucaggauuauauuuucuagcaucuucaauaaauggugcugguaugacuggaugucuguauguagaagaauuaaaauagacccauauuugucaccuuguacaaagcucagguccaaguggaucaaggaccucagcauauaacagauacacugaaucuauuagaagagaaaaugggaaagagccuugaacuaauuuucacagggggaaauuuccuaaacagaauuccaauagcucuugcucuaagaucaagaauugauaaaugggaccucauaaaacugaaaagcuucuauaaggcaaaggacauauuugauaagacaagucggcagccuacagauugucaaaaaaucuucacuaaccucacauccgguagaggacuaauauccaaaauauacaaaaaacucaagucaaucaccaaaaaaccaaacaacccaaucaaaaaaugggguauagaacuaaacugagaauucacaacugaggaaucucaaauggccgcgaaacaccuaaagaaauguucaaaguccuuagugaucaagaaaugcaaaucaaaaugacccugagauuccacuuuacaccagucagaauggcuaaggucaaaaccucaggugacaauacauguuggugaggauguggagaaagaggaacacucuuccauugcugguggaauugcaagcuggcacaaccacucuggaaaucaaucuggagguuccucagaaaauuggaaacagauguaccugaauacccagcuauaccacuuuugggaauagacccaaaagaugccccaccaugcuacagcggcacguguuccacuauguucguagcagccuuauuugugauagucagaggcuggaaacaaucuagaugucccaugacaaaagaauggauacagaaaaugugguucauuuaaacaauggaacacuacucaacuauuaagaaugaguacaucauaaguuuugcaggcaaauggauguccucuguuuccuaaaauugcuaaccaccucucuaaugaugcucccuaggccuuugggagaggcugaaauguacaugucucaugugccugugccaucuguucauuuguucucuucacguugacuagcagagucggauuuuuaaaauuuuuuauuuaauuuuauuuuauacauuauauuuuugucacauucuuucuccuccccaaacucucagauccaccccacaucccuaccuaucuaacuucaugcaugcuauccccacucugaaaaacaaagaagaaaaacaacaaaaauccaaauagaaaaaauaaaaaagaaacaaaaucaauaagacaaaacacaugaagaccaaacaaauagcuaguaagcaaguguauacacagagacucaugaauguaucguuccaggucacucauuauuauaguuuguacagcguauagcuggauaauacuauaauaauugauuacucuucuccauuucugauaagaggaaagcuaucuaguauggaagaacuuccaguuugauuucugcaaguccugugacagaagacuaguguuuauaauauaugaaaaagcuaaggaaagaacaacaaacaaaaaaggcaacuaagcuccaagaaaacaaaguucucaauagaaaggugaaauaaacagagguuucuaaaaaaauaaaggauuaugaauaaauaacauguuuuuaaaagcguucccuauucuuaauaauccuguaaaugcaaauagaaucuauucugagacaucauucuaccccaguugcucaugaaaacaacugcugguguggguauggagagggggaagcuuaugaagagagagugaaaacaggaacagcgaauguggaauucaguaugguuauuacuaaaaagcuaaacuagaucuaccauauuacccagcuaaaccauuccauuacauauguccagaaguugucucuuuuuaagauaaaagccuagcaaaaaaugaauccuuacuauggccacacucuguuauugaggcaagucacagugguuugcuuagguucaagggaaugguaugaauauucuauuagggaugacaaaguuuggucaaagcauacacuauggaaauuuucauaacugauuuugaaaaucuaaacuuguagaaagugcuacucuugaguauagcugaagaacauuucauuuuucuuauacugacaauua

SEQ ID NO: 3939 - RNA, 29987 nt, Mus musculus
auuucgcacgacgcagcgguugggaacacagacauuuucggagcuggagccgccacugccgccgccauuuugugucuguggagaaagaagccccggcggcggcuggaagcggacggagauuccccgugaggcugcggcguuucuuccccgagguucccccugggucgucccccauccccccuccguggucagcauguggugaagccgcagccgccggagacccggggagcgaggccgaggcgucggaagggaggcggggugucgagcggcuucagcuucggcggcggcggaccucggaggggggccgcggcgcaaugucagagcagacgccggcggaggccggggcugcgggggcccgggaggacgccugucgggauuaucagucgucgcuggaagaccugaccuucaauagcaaaccgcacaucaauaugcugaccauucuagccgaggagaaccugcccuucgccaaggagaucgucucucucaucgaggcccaaaccgccaagguuuuuauacaccccgcagccuccuauucuucuaauacuccuugauuuuagugucagccucaucccaggucucgcuuccauccgaagggggacggaguuccuccucuccaaccccccacccccgacucgggcuuggucuuuggccccggcugggagcgugggccucuuucgggagggagcggggaggaugcaggguggagccccauuuccgcuuaccaacucccuauuuaggccaccucugacuacguccccacgcuccacgcaucggggacagccuuucggaugggggaaauacuuagaggcaguugguguuuggggagcgaaagaguuaaaaaacaaaccaucuuaagcccuugggaagguggggaggggcuuucccucaguguccuuuuuggggaauugugcucuguggguuggaaggaggugaagggggaccugggagcgagcugucgguggguuggguauagggaauuggccccgaguggagcagcggccuguuagcucaacauggcgccugcaaagcacaugaugcgaaagggaagagaggagagaacccauucccugccagccaggcagcugcucucacccgucagccccauuuuggggugggggcuguuggaucaaacuuuuauucuccucucggagggucugauuuugccccaaugguaggaaaauugggcugaggaugggguuugggugugugggggaggucuuauccaaccuguagguggagaauuggcccaguggguaacaaauacuuggaaguuucuuugaaaaauucagucccuccuuuuccuauucucguuuucucccuucccugauagugaaggcuugcuuuucuucaccccuugagcgaagugguccuuugcuaccuucuguuuucccucuggucuugcucuucuguggauucaugugggagcgauauguuauuuaaguaaaguuacuguuaaacuuaguuuauauugagucuuaaccguuucccaauuaauacguuuuaaguuacuuuucaagcuuguacuuaagguuuaguuuuuuuucucuaguuguuagugauugcaauuaucaggaugagccuccuuuuagcagagugaaccccuuuuaaaaggccacuuuaacaacaaccaccaauauguuguuuagagacgguuucugucuaguguacaacugaguggucugacucuaauaaaugguuuugaaaugugugacugguauuauaaaauuugugaauaaaacauauaaaauauguauuugucuuuuuuauuuaccuuuguaagguguagaaucuguuuccaagaauuuuuacuuuugugguuguguguuuuaaacaaaagucuuuaagugacuuggguucauucuucuuuagguccauccacucuuuuggguaaaucaguucacaagauacacgguuucacgugguccuuucaaaucuuaauuuaaagagggggaaaagguuuuuuuuuuuucuuuaagggcccagcaaauuuaucguguucauuuuugacagcuaaaacaagucuucaccuuuuccugucgaaugccugugaagcagcugguuuuuaaaaguaguaugagguuuaagaaggaagugcuccucauacccaacuuuuuguugauaacuacauacauguuggcagagaaaauauaccuuuuuuuuccuuguugaagacuuaacauuaaauaccuuuaaaaaaagaacagcacuuggauuuauaagaacaaaaguuuucauacuauauuuuggguuuugguauucacagcacuuaauauuuagcagcucagauugcauucaaaggagacagcuucuugcugguuuuaaaauggaccuacaagaccuuggagaacugaaaacuuuaugcauuauguauuuguguguuuuguuacacaaaguggugaaaauagguggacuacuuuuucaagucaguucaaaguuuuugagcacauguuuccugguuauuuuuguaaagccagacuaaguggcagauguaaaagccccuguggggaaagacucguaaccugggccggggugaggggagggcucgacauuacuugguagcaacuggcuugguuuaaugcuucugggaguauauguuuguguccuuacucuuuagcaucucagcaauacuaaacuaauggacucacaccuaauuucagucuucucauaacaguaggaaaagggauauuacauggaaggacuucacuuguacaauaaaacaguagccuauugaacagauuguggugguaaaagagccuauuuaagugcaaugauuucuuaaaugguauaaaacaagacauaaggugaagacacagcaaaaaaacauuugacauguugguacuuaauaguuugcccccacacaguggcuuugugaacccuuuacuagcacauaaguuuuuuuuuuuuuauacagaauuacucaaacauuucuuuagucaacuucgguuguaagggugauaacagaagcaagagcauuuccacacacuuguuagggcaauuugcuuuaugaaguauggcauugcauaccccagaagugugagcuugcccuagcuacagguagcucuggguaaguguuuaguuagauucauguacacaugggguggguaauuggggguucaccuaaguuuuguguccuuaaauccuggguacuccuguggagucaguuaacagcuuguauggcauguguguuagugcuccucaacaagucugugaaccugcugaugcuuucuggaagcuugcuguuccuugcuguaaaagccagugguggguaggcucugcaguucaacuggggcaaccuuacccuggaagggcugcuaccuuuaucagcaucaccacacuggcucagcacaaauuuagacuccuugguuugugcauguaagaggagaacucuuucgacgacaguccaugcugugaagaaaaucuucaggacauccagguuuccaguccaguugaaccugacuuacaugacucagcggcuccucuauccaguuuuucuuguaucaguaacaagcuugcacuucugcauguuugugugcaagguuuaaacgucuugccguugacuucguaugugaaguguguuuaaguucauuauuuggauuguagaaaaguaaucuugauuuuauagguaacaacaaagcguuauagacuuuaacauauaaaauuauccagugaaaccagggcaucuaucagaguauuugguugauucaagguacaacauaaacacagauccccaagcugacacuuggauuacagaaaauauuuuucccucuccuuuuauugccacuuugaacacuaccaaguacacacaaauuuauguuaaguagagauaaugguuuuuccucuugauaguucugaguuuuuuuuuuuuuuuuuuuuuuaugcacaacuaaaacauuuuaagagacaaguacuuuugaaaacuuuaaaggcuuauaaaguuaacaucaaaagcauuuuguaccaacaaagcuagaggucuguauuguaggcuuaaaaccacuuugaaaguuaauuuuuuuuuuugugguacuucacuauacuaaacuucucaguuucuuuuuuuauacuucaggcuccuuccucagagaagcuuccaguuauguaccuuauggauucuaucgugaaaaauguuggaagagaauaucucacugccuuuacuaaaaaucuaguugcaacauuuauuuguguguuugaaaagguauauauauuuagaaacauuugaaaaaauuuuaaauguguuccagauuaaauaaauacuggucuuguguuggguuuucuugggugguggaauguuucauuguuuuggacauuuacuguaaagugccuuuucaaggaaaguggcaaaugcuaguuuuuuauguuagaauauuaaaauggauacuguuuaauccauucaagauuugaauauaccuuaauuauaauuguguguuuuugaaauguuuugguuaugugaaguuauuuguagaauauggacaaaaagcuagcuuccagggugccuagucuuguaguuuaaauaguguuagggaguaugaagccugagccucccugguuccuauuaagucuuuuccccaaaauguccuuuagaguugcuaccuuguuaaaguguuaaaguuucagggaugugugaauguuggaccaguuaauugcuuuaaguuauucuguaaauacuuuaauuccucuuuagugcuugagagaaaugcuuguuaguguucauagcuagaaauuguacauuccauugugacauuguaacugguuguuugguuagcaggagguguuuucugaaguaauucacacugagcaguagggcccuugaagauauauauuuuaaagauuccuaacaauguaguugaugcuauauuuuaaaacuuguuauagaaaguaccaggugucugaaugguagaauuggguaguaggguuauuuaaguagguagaaaagaaauaguauauagaggaauaguuugggaagcuauauuucagauacuaaaaagugucagugguaugaauauuugaucuuugcuaaguacuaaucacuggaggcuaaggacagccuacuuuguaauaauuaauuuaggggaacuuaaccugguuuaaauuucaguauguuccaguuauuugggguuuugguaucuuacugaaucuaguuuuauuauaguucauaaaagugaccuuguaaauauauucucuaacaacaugaauauagauauagggcuaaaguuaaaaaaaaccugucuuacuaauuacuguauuuuucuguuuucuaaaaaaucuccuuauauacauuacagugugaacaggcaagauauauaaugcccauucuugccuaguauuuuguguauuaaaauuaugaggauaucuuuuguacccaaaguaguaguucaaagauaauagucauaguguauugcauuugguuguuaagauaauuuucccuuucuaacuguauacuacuagcaaguaacuuuaaaaaacauuaaccaucagguaaaccaauuucuggcuuuauguuuucauucagugaguuuaguaggagcccuaaaauguggagacuugugcuuuuaagaagauaaaaaguugccugguugcuugcuuaagucuauuagauaaccacuuuccugauuucuuugagaacuaauuuuguuaacuuuagugaucaaaccugccuuuaauaagucuuugugauauuuauguaaaaguggauaauauaaauuggcaaguagcuuuauacuuaaaauauauaacauucuauaguaacuuaacaagccagagaauuauucuguuguuuuagguggaugaaaauacuagaaaaaguuuauuuaaauuacguuccacaugggaugaaauauucccuuugaagaaacuuuaugccuuggaugucagagucaauucauuagauccugcuuggccuauuaaaccucugccuccuaaugugaauacaucuagcauccaugugaaucccaaauuuuuaaauaaaucgguaagucuuuauaugaaugguguauaagguaguacaauuugacuaucaagugcuaacuuauguaaacuuuccaaaaagcaaaacuagaaucaguuuaaauugaaaaagucauaaauguguacguguaaucauauaccuuuuauauaacuuggcauuuuaaaucccuaagcuuuuuuuuuuauuuauugcaaacuuuuguauuggauauuugcgauuauggauaauaguaagguaaaguugauaaguuuuaguugaccuuuggcaguucuagauaaauguuuugcuuaaaaaguauuuuuuuuucuuauagccugaugagccuucaacaccuggcacaguggucaguucccccaguaucuccacuccucccauuguaccugauauacaaaagaaucuuacccaagaacaacuaauaaggcaacaguuacuggcaaaacaaaaacaguuguuagaacuucagcagaaaaagcuggagcuugaguuagaacaagcuaaggcacagcugguaaguaggggaaauuugauauucaagucuuuaacuauacugacagggaaauaguuauuugaauauuuuauugauuuguuuuuucucuauuuuagaaauuauguuacugguucagacaaauuucuauauccuuauuaaaaaacacuugauuaugaauugugugcuuuuucuuaauauguucuaguagauugcugucuuaggcuacaaauguguguguauaugcgcacacacauaguguauguauauauguaguguguaugcguauauauguaguguguguauauauacauauauguguguguauauauauuguauauguguauauaugucaacuaaauauuaaucaacuuuaucuuacuauuauccauaaucacaaauauccaguacaauauauauacauacauacacacacacacacacacacacacauguacguacuggaaucaguacuggggucccuauuaccacacagaaccagguuugaugguacaagucuguaauucuaguaguugggaguaagaggcaggagaaucagaacuucaaggucauuguuagucacaaagcaaguuugaggccagucugggcagcaugucucaaaacgcuaggaaauaaaauacuacucuuaccagauuagcacuguaguuuuguuuuuaccucuguuuuuaauacgguuuaaauauuucaauucuaagaugguguauuguggugaauaucuuuaauauucaugaagaaaucagauuucuaaaaguuuacaaaagucaucaaaaauauagagaaacccaagaguguauguguuugugcucaugaaagacuguaguuuguacuuagcaucuaaguuuguuugagauugaaguguaggaagacagaauuuuuaaguucauuaacauuuugagaggaaccauuuuauaacaaaguuuaauuagaauuauucuaugucuucugcagagcaguuggaguuuagucauguuacuguuuugagcuucagucugguuuagaaucauggauaguuuugaggaauuguuacuuuuuuauguauuagaaauuauauucuaaaacauaaaggguuuguaagaaguaaggucauuuauguucuggacucuucauuauauucauauauuagaaauagaauauugccaugcuuggugacauaugccuuuaauuccagcacugggagcuagagacaggcaggacucucucucugugaguuccaggccugccaagguuauauaaugaaacccuuaaccccuucuuucucccccuuucuaccccaaaaguaugcaguguuaauacaguauuaagcaaauggauauuuggaaguguucuguauaaugacaaggaaauaaaacugucuccaugaguauuaacaugaauauuuuguauuucaggcaguaucucugaguguucagcaggaaacagccaacuuggguccuggaucagugccgucuaaauuacauguuccacaaauucccacaauggcuguuaaaacuccccaucaggucccuguacaaccugacaaaagccgagcagguccauccuuacaaaugcaagacuugaaaggaacuaaccgggauccccgucuuaacaggaugagccaacauucuucccauggcaaagagcagagucauaggaaagaauuuguaaugaacacaauaaaccagucugauauuaaaacaaguaagaauguacccucugaaaagcuaaauucauccaaacaagaaaaaaguaaaucaggugaaagaauaaccaagaaagaacuugaccaguuagauucuaaauccaaaucuaagucuaaaucaccaucaccuuugaaaaacaaauuaucccacacaaaagacuugaaaaaucaagacucugaaaguaugagguugucugauaugaguaagagagauccacgauuaaagaagcaucuucaggauaaagcugagggcaaagaugaagauguaaaagaaaagagaaaaacugcagaaaagaaggagaaagaugagcacaugaaaucaucugaacacagggugauuggaaguagaaguaaaaucauaaauggcauuguccaaaaacaagacaugguuacagaggaguuggaaaaacaggggacaaaaccagggagaucgaguacuagaaagagaucaagaucaaggucaccuaagucucggucaccaauuauacauuccccaaagagaagagauagacggucacccaaacgaaggcaaagaaguaugucucccaauuuggcacccaaagcuggaaagaugcgucagucgggacuaaaacagucacauauggaagaauucccaccaccuuccagggaagaaagaaauauuaagagaagugcuaagcaggauguuagagaucccagacgacugaaaaagauggaugaggaccggccucaagaaacugcaggucaacauucuaugaagucagguggugacccaaaggagaauauagagaauuggcaaagcucuaagucugccaaaagauggaaaucuggcugggaagaaaauaaaagguauguugcugauguucuugguaaaauacgaaauguaugauuuuuguuuugauauuuuuacuuuauuaaggcaaggcucaacgguauugucagucuagccugaacucacuaaguaaauagugcaggauagcccccgucugcugauagucuuacugcuucagccuccugaaugcugggguuauagguggauucuucuuuccugccuuuaccaugugcaauucagagguaguguucauuuagguguuaguuggauguuauauuucuaguuguuaaacacaacucacuggguuaaauacuuuguauuucauuagagacaugaaaguuuagaaagguuugcucaucagcuugaggugguguauguuuauaugcaugaaucacaguugcuuguuuuuuauuuuuaauuguugguauuuuuugacagggucuagcuauacucugucuuugaauccaugauucuacuccaucagcuuguuuucuuuuucuuuucuuuuuuaauggguguguguauauguguguguguguguguguguguguguguguugguaguacugcugcuggggucaaaccuagcacaaaccuagauagucuucuccugagucaagucuuuaaacucuuaagaaucagaaaucuuaacacuauuuggcuugcuuuuuuucaaaauuuucagaaaaacuuuauauuccuauuuaaccagauccuuaaaguaccgucaaguacagucugggaguugcauuuugaaaguaaaggcuuugaaguaacacugcuuuugugguuucagcuugcagcagggugaugaacauaguaaaccuccucaucuaaggcauagggagagcuggucaagcacuaaagggaucuugucaccucgagcccccaagcagcagcaccgacuaaguguagaugccaaucuucaaauuccuaaagaguuaacucuugcaagcaaaagagaauugcuucaaaagguagugacugucauuaauuuccuguaguuauuuuuuuucacuuaguuuuuuuuuuuuuugguauuuuuuuauauuuaagauacuuaauuuuguuuuuuuaucccuaugcagacgagcgaacguuuagcaucuggugaaauuacacaggaugaguuccuuguuguugugcaucaaauucgacagcuauuucaguaucaagaagguaaacauagaugcaauguacgggauaguccuaaagaagaaaauaaagguggauuaaaaaagaaaccucucuuaucugaugcugaauuaaccuacuaugaacauaaagcaaaacugaaaaggacccagguucagcauucauuuccaagacuugaucucuuagauccugauauuuuugacuacccuuugacugaugccuuguugucuggaauagaaugugagccauccaaaaguaaacaugcaaguaggaauaguggagcacaguuugacagaaaagaacaauuuagugaaagagcaagacguccuucuccuauaucugggagucguacuuaugcugagaaucuuucaccccaugagggccggagaagacaugacgagcaagucucugcuaaagguagaaaaaguuaaaugagauuaugccuauugaaucacacagcagugaagggaaaaugaacaagcuaaguggggcuggauuuuaucacuguucugacuaacuuuguguguauguguguguaucucuguuuugcugccuuuuuccauggaaagggaagggaccuaguuaauaauuuauaaaguuauauuagggacuucacuagguuuuauuuucuaaauauuuaauuugguuaaauccacaaaacccaaggaaauauguauucuucuaguuuuuacacauaggaaacaaaacuagagauguuaaguaauuugcucucaaagugaaaugacaaguaccuugacaggaugggaauuuuuuaaugcuagguguaucugaaucaaaagggcaucuucuuaacuuacuguugcugcugucucuucccuacccacuaauauagugagauaaccuaucuuuagacaaguuuuagauaacuauaagacauagagauaaguggauauaaagucacuuuagugaaaauguauauuuuucuuuuugaaagguguacgagaggagcagagaucaccauucaaugaucguuuuccacuuaagcgaccuagauaugaagauucagauaaaccauuuguagauggcccagcaucaagauuugcuggccuugauacaaaucagcgacuuacagcucuagcugaagaccgaccauuauuugauggaccugguaggccaucugugacgagagauggcccagccaagaugauuuuugaaggaccuaauaaauuaagcccuagaauugauggaccuccuacaccagguucucuucgguuugaugggucaccaggacaaauggggggaggaggcccuaugagauuugaaggaccacaaggucaguuaggagguggguguccuuugagauuugaagguccuccaggaccaguaggaacaccucugcgguuugaagggccaauuggucaaggaggaggaggugguuuucgauuugaagguucaccuaguuugagguuugagggaucuacaggugguuuacgauuugaaggaccagggggucagcccguggguggucucagguuugaaggacaucguggucaaccuguggguggucucagguuugaaggaccucauggacagccugugggcagucuuagauuugauaauccucgaggucagccuguaggaggacuuagauuugaagggggucaugguccaucaggggcugcaauuagguuugaugggccucauggucagccagguggugguggugguaucagauuugagggcccuuugcuacagcaaggaguuggaaugagguuugaggguccccauggucagucuguagcuggucugagauuugaaggacauaaucaacuaggugggaaccuuagguuugagggaccacauggucaaccagggguugggaucagguuugaaggaccuauaguucaacaaggagguggaaugagguuugaagguccuguaccaggagguggccugagaauugaagggccucugggucaaggugguccuagauuugaagguugucacucuuuaagguuugauggacagccaggucaaccaucacuuuugccaagauuugauggauuacauggccagccagguccuagauuugaaagaacuggucagccagguccacagagguuugauggaccaccuggacagcagguucaaccaagauuugaugguguaccucaaagauuugaugggccacaacaccagcaagcaucaagauuugauauuccucuuggucuacaaggaacucgauuugacaaucauccuucacaaaggauugaaucuuucaaucauucuggcccauauaaugauccaccuggcaauacuuuuaauguuccaucucaaggauuacaguuccaaagacacgaacaaauauuugauacaccucaaggaccaaauuuuaauggaccacauggcccuggaaaucagaauuucccaaaucccauuaacagagcuucuggacacuauuuugaugaaaagaaucuucagaguucucaguuuggaaacuuuggcaauuugccuacaccaauaucaguaggaaauauucaggcaucucaacagguaagcuguccagcucuaaaguuguguuaauuauguagguaaguaaacuuuuaggacagauuugcagucuaggcugcucucaaauucugucuguggagguuaauuuucaagguugacuuaauuuuuuucuuuucuuuuuuuucuuuuucuuuuuuuuuuuaaauguuuuuaguauuugggaaaagcuuuaagaauguacuuuauggaauaaguuguuaauguaacaccugaguauuaggaaagugaggugagaguuuuuuuuugggaguugauguuugccacuuaaacucaaaaugauuguagcucuuaaucguuuccguuuccuucucucuaauggaauaugugcacuuauuuuauuuucaaaagaucauaauuuauguguuaugugccugucuuuucaaggguguccagguaacuuacaggucagacacggggcacuggagcuccugugggcuguuucauauauaugcugggaccugaacuuagguacucugaaagagcuuaacagaaaguacuucuaacaacaaaagcaucuuuucagcaucaccccccccccuuuuuuuuuuuuaaagcucucauuuagcauugacugauagcgagcucuguguaccagugggugacuuugaacuugagucuccugucuccaccuauggagugcuggaacuacaggcguucccauuguucccagugcuggggguuaaacaagggcuuugugugugauaggcaagcacucuacugacagccacuaaacuguuuuuuuauuaauuguauuuuuguguguuuguguguguugguaugcagaugugccauggugaggucaaggucaacuggugggaagcacuuuucucuucugcccaugugggcacagggaucaucaggcuugauggcaggcacauuuccccacugagcuaucuugcuggccucacugcacauuucuguguugaauucuuuuuuguuuuguuaugcuaauauguuuuaauaaccuccauuacccuggacagcuguugagcacucauuuguucagaagaaaucuuuagaaccaguuugcuuugacuuuuuuuuaacuaagaauuuccuuagucugaguuaaguaagaaaugaaguuguauauacuuuuauaauuuuuaauuuucuauuuucaucacauuuuuuuagguucucuaguuggauaaaauugcuugauauuaauguccacauggcaaacuugcuaccugccuucugauaugauacauauaugaauguguagucauccguccguauacuugugcauuuuuuguuguuauucguagcucaagcugaguagaacuuguuguguagcucagguugcccuugaagucucaguucuccugucuuagcuuuuuuuuuuuuuuuuuuuuuuccauuuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcaaguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuuccauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccacuucuaaggaggggcauaguguccacacuucagucuucauucuucuugaguuucauguguuuagcaaauuguaucuuauaucuuggguauccuagguuuugggcuaauauccacuuaucagugaguacauauugugugaguuccuuugugaauguguuaccucacucaggaugaugcccuccagguccauccauuuggcucugucuuagcuuuuuaauugcuuacuuuacaggccuguuuaaccauccuuggcucuauucugcauacuuuuuuuucuuuaagauuuauuuguuguguucuauguguauggauguuuuccugcauguauguauguauagcacgcguggguaguuacacuggaguccagaacuggaacuggaaugacaggugguugugagccaccaaggcggugcugugaaccaaacccagguucuuugugagagcagccaguucucuuaaaccacugagccaacuccagcuuguuuguuuguuuuugagacagagucuuucuguguagcuucacaugaucuggaacucaaucauguagaaaugauacuauuauuaccagauguuguuuaaugguguuuuuaguccuuuuuuuuugugauguaucaaauggguuugugugugugcuacaccauugaggugucacaaggacagugaagauucaggaaugauuuauaacaguauauauaacauauacuguacauauaaaauaauaauagaauaaaagauuuauauaacuaaauccaaaauaccaaucuuuaucuuuuuaugguucuguagcuugaaacucagagacucucagcaggugauauaagaugauguggcuaagccauaguuuaaggccuacacauuuuuuuuuugccaacauuuuuuuuuuaaagauuuauuuauuuauuauauguaaguacaauguagcuguccucagauacuccagaagagggcaucagauuucauuacggaugguugugagccaccaugugguugcugggauuugaacucgggaccuucgaaagagcagucagcgcucuuaaccacugagccaucuugccagccccggccuacacucuuauauuugguuuuuguaaguaaggucucaacucuguaguucaagguguccagaccucaaacuuuauagccuaugccugucuuaaucucucaagugcugggauuauagaugugagcuaccauccccagcuguuugguuucuuuauucccuuugaugacuuuuguaauguacuuugaacucagcuauagccuuacucaaaaaugauggcaaagcaggaugacuacuugaaguucacauugcugcauauuuuucuuugcuuuuuuuuuuuuuuuaacauggucuuguuagcauaacucagaauggccuuaaauuugcaguucucuugccucagcucccaaguuaccauuuccugggauuauaguuaugugcaaucauaccuggcugaaacaaacuuuuuuuuuuuuuuuuuuuuuuuugguuuuuuuucgagacaggguuucucuguauaguccuggcuguccuggagcucacuuuguagaccaggcuggccucgaacucagaaaucugccugccucugccucccgagugcugggauuaaaggugugcaccaccacgcccggcuugaaacaaacuuuugaguggaaaaaagccaagguuaggaauucugacuucaacuuugcuaacuagcagcucuuugugaaauaaggaaaagcacccucaguguaaagugacuuguauagcauaaacacaugauuucuuuuaaggaagucuccccucauuauuccccacccucacaguuucucuguguagcccuggcuuuccugaaacucucucuguagaccacacuacccugaaacucagaguccuaucucuguauucuaaugcucuuucucacuuaaaggaaguuuuaacuuagucucauuuccuuauaacucggaaacagaagauacuaaaguuuguggaaguacaacaguuguuacuuuuuaaaucuuuaucaccauugaccugggccuuaggacauuuguaugcgauuuguaugugauaagaaugugaguagaaauuuuuagaaagaauguuuuuaaaauuagcauuuaucuugaagguucuuacugguguugcucagccaguagcguuuggccaaggacaacaguucuuaccaguucauccacagaauccuggagcuuuuauucaaaauccuucagguauguacuuuugcacugugugauauuuucaagacauaacuuuuguuuaauaucuguuaguuuagaaaauggcauuuuugagaguuuguguucaauuuauagaaauuuaaucuggcuaaaguguuuccucugaguuuauauuguugaccuauggucaugcaaaccuuguuuuauagcuagagaugauuaaauuggacauacagagugaaaugaagagggaaggaagucuuuugaguagagguuggcuagaggaaugauaauuuuguugugauagggugaagaaaauuauaaauugcagaaacuuuaguuguuauuuguagcuuuuuugagugugugcuaugauuaguaaauauaaauacggggggauaccaccucagaaaaugauucauuugaaagcuuuuaauggguggaugaauagaaaacaacccuaauuucuuagccaggucucccaguaggaauuuuuguuauuuuagagugaauaauaauggauuuuaaaauuaauuuuacuuugugguaaaugggaaauauauauauuuuuguguaugcauauauaauauguauuauauacugcugugauacuuguucuaguuucuaaaucauaaggccugggaauauaauacagcuuaguauuagaguacaacaugcaugaagcccuggguucaagccaaacaaaacaaaacaaaacaaaacaaaacauuucuaagcuguuucagaagcauauuugggggcuagaaaguagcuugcgcgcagagcacuugccuagcauguccagagccuugaguuccaucccuggcacccacaccacacauaaacaucucccaaacaacacaaucccccuccaaacaauacuuuuuaacauaauauuguuacugacucaucaaaguuuuaaagaauugucauaacuuacaaacuaaggaaauuuuaaugaagcuauauuuuaugaguucuuaaaauucugucaguuugaauuuaauuucuuuuaauuucuagauggauaauuaguuagcaaaaugcccucuccccuccauuauauaguuguggcugggucaagcauaaacaaguguccucguucaguuuuuccucuauaaaaggagauaguagugucaguaauucuuggaagaaauauuaauuucuuaaaauuuaaaagaaaauaaaaugagauguguaaaaguaaguuuuaagugucauaugaauauauuuuucuuuagaaacuacuuuuucuuguugaguaaagaauucguuggggauguagagauggcuuagaauauaagacuauauacagcuuuuguaggggaccuauguuuaguucccagaacccacaucagguagcucauaaccuguagcuugaguuacagggagauccaguaccuguggucccuauggguacuugugcaugugugcacauaucuuuauacauauguguacacacauauauagacacacauauauguacuggccucuauggacacuuguacacauguuccuauacauacaaauaaaauaaaauucuuuagaaaaaguuugucauguugagguuaauggcauaaaguuuaaaaacuauauacuuuuuucuaguuuuuagaauguugcguuuuacauauauauauauauauauauauauauauauauauaaucauguaagagcuguaagagccuuguugcagaugaaaugacaguuuguucccugggcugagaauauuggacaaggccuuauauguauuuuuucuuaaguucuacuuuuuccuucaaaaaguaugaacuauuuauuaggaagcugucuuuaagauucucuuaauauucuuuaauugaaagcaaaaaaaaaaaaguccuucuguaguucuuuucuuguucauuugcugcauugcauguuagacuuugugcuaggaggaauuuaguguaagauucauccuuuaaagaacuuuuaguaugucacauguucuucccccauaaguacuguauauugugucaaauaacaccucauugccuuacagauacuauuuauuuaacccucaugucaaccucaggcaggaacuauuauuccucuuuuauaagcaguaaaaguuuaggccgcaaugagcaacuauuucacgucucacaauuagaaaguagaauuucuagcuaaaauuccaggaauuaguaucaauguucuuuaucacugcagaacuuggauacuuccaaacaaaugaauagcuaauuaucccccuuagacauacauauaaauaucucauucuaguggaauacaaauguugaacuuguguaaaugccauuguaaagauugaggcaaacuuacuccugcauucagauauuuaaguugaauagacaguuaauuaauuacauauauauauaugcacuguguuggauauauguaauggucaaagguaggacuauauguauuauggauacaaguugauucugccauucaguggaacaguuaauagaauuuuuuccugaagguguagacagauaguuaacagugguaaacacuaaaauauuuucacauaggaucucacuauguaguccuggcuggacuauaacuucuguagaccaggcuggccucuuaguagaucugccugcuucugcuuccugaguucuggggauuaagaggaugcaccaccaugacugauaaaauacaccuuuucaaauggugcuagaacccaaaucuagggcuuuugaguuugcuagguaagcacuuuucugccuaccugcuguccuguuuuuacaaaugaguuaaaggauuaguuauuagcauagugcuagcaaaauaaugggguuugagaagauuuuugucuuacucaauuuguuaaagcuuugauaaaguugauaaugcuuagcaaugguuugaauuccuuugcaaggccagcucaacaaauaucggggcuagguguccugugcuucaggcucauacccuuccuuucaugaaucauuucucugcuuuaucaugucagggagcaacagucagcagcaccacacuuuuggcuuuggguuuuuuaaagagaugcuucaauauuuaauccuuggagaacuacuuuuugaggugguuagaucagggcuagcgaaacagaaagguagaaguuggucuuagacacgguccugcaugcauagaagaaucaugaggcuuauuguucuuugaauccugcuuuuauuugguaugaaaauaaagugauaaagugacaaaguaauaccaccuuuaaaaauguaaauauauaaaaauuaaauauauuaaauacuuaauaaguuaaauuaauuuaauaaauuugauaauuuaaaauuuaaauaauuuuagcuuaaguaacuuuuuaaaauauaugcacauauauauguauguguguguauauauacacacacacacauuuuuauuguaaaauacucuaaguacuuuaguauuuauccuggaauauuuuucaaguaaugauuugucagccaaaaagaaaaccugagcuuuuaaaauaauuaaaccugucauaaaaagguuuguuguugguggaauaucuugaagaaaguuguaacuuugaagaaauacuaugauaugaaucuuuauguucuauuaagaauuucuuuuuuuuuuuuaaauaaggcggucuucccaaggcauauccugauaaucaucucagucagguggauguaaacgaauuguuuucaaaacugcuaaaaacaggaauucucaaauugucacagccugauucagcuacagcacgugaguauggcuguauauuuauauacaccaagcuuaauuaagucagagauacuauuauuaugagguauaauaaauuauuguaaaguucuacucuugaauaaauuaguauacuuuuuggugucuuuugaaaaacaagugugauuuuuuuauagugagaauguuaaaaauuucaaaagauugaacuauccuccuggcccacuguuuuaaauaacauuacuacaaauaucauguacugauuuuuacuagcucaucuauuaauuugguguuugaaaauaauuugaauguuaaggaaacaagauuuuaaaauuuuuuaagguuccuuaaacauacuuaacauacuagauucuguaugcuuguaaccagugucuuacuauaaagaacagaguagacuacaguacugaaaaaugacucuuguccacugcagagguaaccgaggcuguugcucagccucccccugaggaggacgaggaucagaaugaagaucaggauguuccagaucuuaccaauuucaccauugaagaauugaagcaguaugugauguuuuacauuuuaaucauuaauguacauuguucuguccuuuugugugugaguggaggugcaugcaugcauguuacuguguuuguguaggcuagagggcaaguuuugggaguugguucucuccuuccauugugguuucuggggguugaacucauaccauggagcuuuugugacaaguacuuuuuaucuaugacaaucauucagauaacaguggcuugaauccuaccuuugaucugcugcucaaguuuaaauguuacgcacuaauaguuauucauggcuuuauuucauauuuuuuauauuuauuuuuuauuuuuauuuuauucuuucuuucuugagaugucuuguuagccugagcugaaucuugaauacuggguuuacaagugugagccaucaugcucuacuuuuaacuguucuuuaaacuggaauaggacauuugauuuauucaaaacauuaauauuguagggaggugagaucucuugcccuaucuuucuacuaaucaugucuucucuauauugauaguaacuucauacuaaggaguugaauugcuguugccuuguuagccuauaguguuacuccauuuuuagccaaaagggaauaaguaaccaaggcaaauuuguaaauaagaaaauaggcuccauguuucacacuuaaccaaagcuaaaguaaaaaggaucaguaagacaguaaauuuuacauagaucauucugcuuugauuccuguuaagauauagaaaacuuaaguauuuuguuuuuagccacugucaugucuuaaaacuuuuuuucccucaaaauagacguuaugacaguguuauaaaccggcuguacacugggauucaauguuacucguguggaaugagguucacgacaucccagacagauguuuaugcagaucacuuggauuggcauuaucggcaaaacagaaccgagaaagauguuagcagaaaagucacucauagacguugguacuacagucuaacaguaaguaauccauaugccucugaguuaucuagaugucauuuauacucugaaguauauguuuaaguaguugcuggaaguuaugaacuuucugaauaaaacuugauccauggaaaauagauuuuuuuugguuuuuagauuuaugguuauuuuguguaugagcaucuuuccuucacuucaagcuuuaugagaucugacacuucuagcuuccuuggagcaccuguacucauagcucuuuuaaaaauauguaaauuucuaauuuuuguuuaguauuuguuggaacuuuuagcuauucuuuaaaguagaaugcacuuauguauauagugcuugaggaggccaaaagaggguguuggaucccuuggaacuggaguuaacagaugguugugagcuaccauguuaguggaacugacccauggucccacaagagcaauaaaugcucuuaacugcuaagccaucucuccaguuccaaaauuaaauaaaaaugaaaaauugugaauuaucuuaaguuaaugguaucuuagaguuuauaggaaguuagcauuaagaucucucagucacugccugauuugguggcuuguaaucuuaguacguggaaggcuaaggcacaaggaauacugccagaagacugccaguaggccaagcguggcuacaugauugacggcugggcuacauaauaagacccugucagaaagaaaaaaauaaagauuaguuauacggcucaaagaaaacaaguauauuaaaauaacaucagagcauauuguaugaaaaugaacccauaacuuuaaagugacuacaguuaugacaaagcuauaaaaguguggacagaaauuaacguaaucuuuuacaucauuuccucuuaaggauuggauagaauuugaagaaauagcugaucuggaagaacgugcaaaaagccaguuuuuugaaaagguucaugaagagguuguccuuaaaacucaggaggcugcuaaagaaaaggaguuccaaaguguaccugcuggaccagcuggagcaguugagguaacagaaagguguuucaauucccugucuuuggcaguguuaaaguccuuuuaagucauaaacacuuaugcuuuaucccuggcacaguggaucaggguucaagaccaggccccgcguauagaguuggaugccagccuaggguacaugagacaauauuguaagcaaauauaaaaggauuucuuguaagcuuuuuaaaauaacaaaacaaaaucuuggcuguuucaugaccaauuuggguuggaugccaucagugacuaauauagugaaaugcuauuaaccuuuuuguaaaaggcuggaacaauccauaaaacuauuuauugaacauuccuuaaaaauuuauauuuuuauugaaaaggguuuuaucuuaaugaacaauguaaauuucauuuuaugauucuauuuuagaguugugaaaucugucaagaacaauuugaacaguacugggaugaagaggaggaagaauggcacuuaaaaaaugcuauuagaguagacggaaagguaagaaaggguuaaugaucauguuuggaguaacucacccuuuuaaagaugauucauaauccucucuggguuugguuuuuaaaaaaaauucuggacuuuaaauagucaauguuuccuuuggagggauucuagcaaccauaugagacugaugcuagacucaacuagauuuucuucuaacuacacgauauuuaacgaucagaacuguuuguuauucgcuugaaaauaaagcuaggcguuauaaguguacaaagccaaguuuaaaagaaauagguaugguuaaauguuuagauuuuacuaauuuuuuggaccaaauaaauuuuauccuuugauuuaaaaauuaaagaaaucagaauaauauauuacaaaugaacaugcauguaauagcuauuuuuuucccucuucagauuuaccauccaucauguuaugaagauuaucaaaauguaaguucuuuuuggguauuguauguuuuuacuuuaauuuuuuuuuuaaaaguuaguagguugcuuauuaaauauuggcauuagauaggcucugauguacuugauuuaucacugauaaaauacaaauuaaaauucguaguaauguuuuuguauuucuugcuuuguuuacuugaaucuuuuuaacuuuuauuggaccacuaggcagagaaaaguagaaaacuaaaggauuaugaugggcaaaaauuuuuaggggucuggaaagaacuaauuuuuuucuuauguauugucuaguuacuuaguagaggaaugauauuuugaaaauuguuaggcuaggcauugguggcacauaccuuuuaaugacagcacuugagaugcaggaggaucuuuagaauuugagaccagccugguccacauaguuccagaauagccaggaccacauagcaacacuguaaauaaauaaaaauuugugucuguacuuuaauguaugugaaugcaaguugaauauguaccacaaaacacaugcggaagucagaagacaaccuuggguguuaguccuuaaccuuucaugagucucuuuucuuuugugauuguaccaggcuagcuguucuacacguucccagggauucucuuauguauccaaauuuuguguguucuagagauuugaacucaggcccuuacauuugcauggucagcuuucauuuuauccacugagccaucuuuccagcucucauaauauacuuuaaaugaugacuuauauaaaauuggcaacauggcagucuaguagcccuaggaauccaauuauaucucuaccuugacuuuucuaaaccaguggaacauguugacuacucaugacacugcuuugauacagauuuuaauacauauuuagguaacuggaagacuaguguuuccuagaguauuucugaugcagagauuuuaagaaaucucaaaagacuaacauucacauaacaagacucacaaaguuaagaaaggauugcccgcuguuuuauaacuacugacgccucucugacuucuuuuagugguaucaaaguuaaugugcuuucuggccgaguacauacugaacaguguuauuagcuugcgagaagcaagcauuguaauuggaugugguaguccuuuguuugaacucuuaaacauaauuguuacuuaauaugauuugaaacuucauuaguacuuauagggauuuucauuuuguagacaucuucauuugauugcacaccaucucccagcaagacaccaguugaaaacccuuugaacauuauguugaacauugucaaaaacgaauugcaagaacccugugaaagucccaaaguuaaggaagaacaaauugaugccccaccagcuuguucagaagaaaguguagcaacacccacugaaauuaaaacagaaagugauacaguugagucaguuuaaauaaaaugagaaaaguaugcuuuucuuuuuaaacaaaagcugcuguuggaucuaggugaagaauuuuuuuauguauauauagaaauaucuauauuaauugucuagcuguggcagggccuucagcuaucauuugguuaauaaauacauuuuaguauuugcauuuccuacugccugcacaguuucaggugcuuguugugugaaaguucuguagaugagugcaaauguaacaaaaugaaauuguauguguacaaauguacaauuuucacuugugaacuguaaauuauaaauaaaaaauauuuuugcuauccauggaguguaauauuuaugcacaccaucaaauaaagacaguguuucuauacuuuuauugggcaagaauggaacugaacagcaaucuuaacaugaugguuuuuuuucuaguagcuuccugggacuuaaugcagcaaaguuucaaacuuaguuuuucucaaauagaaaagcaagauuaaaaaaacaaaaaggacauaugugcuuacauauagauauguaucuccagcuagagucauccacaauguccacuuuuggaaaguauguaaugaaacaguaaugcuuauuuaaacuuggacacugaugccaucaagcaacuaacaaauauauuuaaguacuaaaagugauuuuacuuuuuagaaaauauuuuuaaaauugucaauuuaaugcagaugaacacauuucuauuuuaaguuacagggauucuguauaagaauguucauaugaaaaacaugguuaacuuuuuuucuuuguugguuuugauugaauuagauggguaacaugagauguuaauauucauacauguaauaaacugaaugaugaacaaucuugguuuguauuucuugagugaccuuagaaugugacccuuauguuuaauguguguuuuaaaacaugagugcagugccaguuaugagccauacucccagauaugauauuauuccauuuauagaagauacauauacaguauuaaaacuugugauuuuuuuuccgugggagauggaaggcuuuuuucaugugauuucuuugauuauagcacuaaaggguacucugguuugugaauaaaauugagcaacuccaaaaguacagugugaaaccugguuuugucuuuaacuaagauaaauguuaacacugaaccaagcauaucaaaaaguauuggagaauuuuaaaggaauaauuuauagaagugguacuacaguauagcuaagaauggaaugaacauuguuaugcuuaucacuggagaguuaggcuugaaacaguuuaaaaguguuaguuuuuuuucccaaugugucugugcaucaccaguguaccuggugcccaaggaugcuagaaaagggcauuagguccaguggaacuggaguugcagucaguagugaguugugugugggcacugagacccagacuuuguuuuuuuccgcaagagcagccuguguucuuuaacuguugagcucuuuccagcauuauuucaaaaauuuacauaugguuaaacccuagugauuuuuaagagacuaaauccguuucuuguucacacuaaggagucuguauuaugauucugaggcaauauuagacauuuuaaaugaaagcaauguccuguaucaaguuuuuccucaacaacaaaugacuacaauuuuaaagagcuuguuaaucugaaagucaggguuggagauggcucaacaguuagaguauaggcuguucuuccacaggaucccaguuugauucacaacauacaccucaauuucuauuuacaguucuagggaaucuuugucuccaaggguaucaggcacacacagaguaaauuuucaugaagaaaaccaaacucccauauacauuaaaaaccaaaaccuuaacauuaauucuccauucagcaccaaauuauaaaugcaucaugggacaguacaacugaugguauacauuaacacugccauggaagaauuguaccauccaacaauguagaccacauuuccugcugcacacccuuuaucuugaaaaaccacugauagcuacuagcaaguacuuagaaggggaugaagaguccugagauaagaaaauacagggggauaggaagaaagagaaauuaccaauagaagaaaguguugguagguuaagucacaaaaauaugguaagauuuaagacauuacaugggccagacaucaugcauuaaucucaguacuugggaggcagagccugcaugauacauuaugacuaauaaaggccaguggaauccugucucaaaauacaaaacuguucccggauauaauauggguaccuaggcuagguacaacugauuggguugacaggaaguaggaagacauaagagcuacuacugaaauuaaacuuaguugacaugggugaaaucuacagaggauaguauuguuucuaggaugacuaaugguauucauguuucaaacugacaaguuucuaauucucauuuucuccuuguaagaggccaaaugugagauuguggcccagaucuccaaauuuagcuuagccuuagauucacuguacauaguagguuuuguacaaagucaacaaguaaaaaccuccaaguuauuuuuacguacugcuaacuauccuagaaaugaccagaauuauacuucagcucccaaagauggaaaaguuuuagaacuauacugcaaaguaccacaaucaaaacuaaagucuuacaagauagaacauguucugaaccaaaagcuaaaagucuugagagcuaaagaaaugguuagcaguuaagagcacuugauguucuugcaaagaaccugguuuuauaucccagcacccucaauguguggaucacaaguucuuuuggccucugcagcuaccaggcagacaugugauguauauauacaugagguacucacacacaaaaccuauuuuaaaaaaauugaaaaauuugaggccacaugagaauacuucuaaaaguggauuguagguugauucuacaauguaauuuucuuaacguaaagcuucugaacuuagcucuucuggaaaacacuaaacuacacuaaauucuguugggaaggaacauguaucaugugaaugccuuaaagagaauuauauucuacuuaauuuuucacugaguggcaaaaguacauuaaaagguuaauaaaauuugaggcaucuaacucugccuucaaagagauuaacugaccaggugugguguaaucccaguccuucugagacaaaggcagggaaguucacaacuuaaaggcuggccuaggcuacagagaccucaucucaguguggagacugcacagugguagaacauuuccuguggauaaggcccuggguuugagcuacaaaaugagaaaaugggcaggcagagggccaaucucucuugugggccagagagauccaguagguaaagcuacugacugcugaagucuuuaugagcuggguuuaauaccaaagaaccacgugguguaacaacuucccuaagucauucucugacuucgacaugagcacuacauguaugauucucuccuccauucacauaauguuaaaaacagaugccuucaauucauaugaugcuaguuuucugucauucaaaacagugucaauuucuugagguaauauguucuuuagcaaaggaguaaaccaagaaccaaaaauuacccaugucaaggcaaaggacaucuuaauaaauggcauaauaugaagaggcauugucuuugaggagugcaugggcagaaaaggguguaauggcaugguccuagcuauugagauaggaaaucacuugagcccaggaguugggcaaaacagugagccucuuauuuuugaaaguaaacaaguuuauggagcacaugaggauagaggaauagaaacgggugucaaaacuuaauuugcccugagcuagcccccucccucuagagucaugccuagaacugaccugugggaggacuuaacuugcccugagcuagcccccucccucuagagucaugccuagaacugaccugugggaggacuuaacuugcccugagcuagccccucccucuagagucaugccuagaacugaccugugggaggacuuaacuugcccugagcuagcccccucccucuagagucaugccuagaacugaccugugggaggacuuaacuugcccugagcuagccccucccucuagagucaugccuagaacugaccugugggaggacuuaacuugcccugagcuagccccucccucuagagucaugccuagaacugaccugugggagggaggccagcuugucuucucucacuuaggaaagcaggcgggagucagagauggcucagcaguuacgaguaucaguggcucuugggaacucugguuugaaucgcagcaccagaauggcagcucacaacuguagucuagacccuagaguuucaacuguuuccucuagccucuugagggcaccagguacaaaugcauagaccaaagaauuccauauuuaaaaaaaaauuaaagaccaauuaaaaauaaaacaaaccaggugcggacaagucaccauuccuaauuaguuauaguuuccuaucugaaaacaauuccuauucucuggaauguugaugugagcacuccaguaggaacucuucauucuucaauugagaaucugcuuuua

SEQ ID NO: 3940 - RNA, 3291 nt, Mus musculus
aaggcaggcacuaggcuggcugugugcagcccuacaauagaaaaauuaguuggggguuuaagcaaaguuugaacaguuuuuuuuuccaucugugagacggaccuguuaggaauaugcugaaaauuagaugagauaaacugaaaauauguugcccagcaaacaggaaaaacucaaauauuagguuuuuguguuguuuguuuguuuguuuguuuucucuccucuuaguuaagaauaggccuuggcaguuggagcagugacaugugacuuuagucccagguacuugggaagcugaggugggagcuaaggcagcacaggagacuccaucucaagacuguaaggaaugauuugggucagucuguuacaaagaaaagaaguccauuucgaugaggguuccuuaaaaggaagugucugauucgauuugcuuuuacaugucagucaccuguuucuucccauacaccuugagagacauuuuugucucaauagacgauuccaggguugcaaacuccucguuaucaggaaacuuucucuuagaacugaaauaccucacagugcaauacaaaccucuuguugauuucauucuccaugggaagaaaauggcuugguuguuaucugucaggggucccacuugcugucuguuauugcccauugucagcuauuugaaaacaaagucguaacagugugugaagguggcggugauccuuauccuccuggugaacaucaggacaguuguugacuagcucuuaauuucuuacugggaucagauuuagauaauccuauuguugauuaguucuuuaauuauccaugcauuucucccuuuacuaauaauguauaguggauaucccagcaagacuaauucugguucugugacucuucuccaucuauagguagaaaugauaucauaaaucccaguuaugugaucugcuuuuagauuuaauucuacaucaacauuauuguaugaauguauuacuaauacuuuaaauguuuuuaucucccuuucuaugugugugcuacauuuugaaauaaaaauuaggguacuaacuuccuaauagagcaaaaauucaagugcaggguuaagaaaagaauuuguuugguuagaauaauucacuagcugaugaauggcacaucgcuuuuguuuaauauuacacaguuaugccuggauuaaauaauaauaauaaacuugauaaagcccucugaaaaacagcugcuaagcguacugcuucuggaauguaaucauuaggaguaaauauuuucauguucuauacaauuacagaauguuaguggaaguuuauuguagacuauuugacaaugaaugucaguugauuuauuaaaugaauuuuuuaaaguacuuuuauccuuuuuagggcugauugggacuuuuaggucccugacauaaaacauuucaaaugauuggaaugcuggcuucucacuucgcucauuggaguguccaucuagcucugccugauguuagcacuccuuugaugguguggaaacgagaugcacaaaucuuucucaaguagugcaugagcaaaguugcuguuuucagaaaagaaaaaaaauucuaaaaauugcaacuaauaaagaacaaagacaagacuuugaagaaagugugcccuguauguuauugcacacacuguaaugcaugacuuucagcauaaggauaacauacgaugcaaaauauuucauucuggaaaucuccacagcuaguuaaaauauuuguagaagcugcuuuguggagacuuagaaaaucccuuauuuuauucauuuucuuaucucuccauuaaagcacuaauauuuuauacaguuucagcaagcagguugaccaguauauuuuaugaacucaguuccuaauauauggcuacuggcuuuaugcauaggaucucaguaaacgccacacauauauaucacuauauaaauccuaaucaucugcuuuaauagaugcauaguucuugguuuaaaaugugauaugcagauauuaauuguacaauauauauuuuguguccauguauugaauuuacuuaacaaaaaggccauuauaaauauaagccauuuguaaccugaguauaauuaguucaaaacauugucuagaaagaugauuuguaaaaaauuuaguccaauuucaaaagggggacaaagaggaaccaggaacucaaaaaaagcauuuuuaaguaaaauuguaucuuuaaaaauuucagauaauuucacacacaguaacuugccccuuugaaguauaaaauucaguguuuuuaguauacucaauauauuguacauugucacugucuaacuucagaauaugucauuccccaaaggcucuguauccauuagcagccaaaccuucuccuuccacaguaucugggaacaaucuaucugcuuucugacuauggauuugccuuucauauaaauauaauuagacaauguggccucuugugccuggcuucuauuaagguuuucaagacucaucuguauuguagcaugagucaguauguucuuuuuauggcuaaguaauauugugugugugugugugugugugugugugugugugugugugugugagagagagagagagagagagagagagagauuuuauuugcaaguuaaucaaauauuggacauuuagauuuuuucuacuuucuggcuaguauaaguaaugcugcuagaacauuuauguaauuuuuguauguggucaugguuucuuucacaucucaaaaacagauuaacaaauuaaguaauuuguauuuauuuaaauagaaucuuuuuaaaguccugcuuggagaaugaaacuuaugaucuugauuaaaguggucaauugaacucuagaauaaugccugucagguaugucuguaagaauauuuuugugaggaugucauuuugauaugguuaucaauuucaugaguccuuguagaaauuacauugucugagaauuucaaaguucuccacauuccuugaaagacagcuaucaaucauacuggagcgggcacuccuuaaacuugguaggaccauucagucaaugaaggagcauuuuaaaggugugguuucuuacauucuaacuaucucaacauuugcaucuuggaaaaaagaucaucaaauugccaagccuccugaguguuguaguuuaaguuuuuauuauuaagaaguaauucauaacgagagcaaaagugucaagaauguauuuugugugcaaagaaugaauguauuuaacaaaaucuucuuauuuguaacaauuuuuuuaaaaguugaauggaaauugauuucucauguacuuguacauaaauaaacauuuccuguugcccccag

SEQ ID NO: 3941 - RNA, 16726 nt, Mus musculus
uauuuuggauuauaaagacuuuacuucuggaugucuauauuuuaacaaauacuuuuaaauacaaaaucaacauauuuauacagucaauguaaagagaagugcucaguuaucuuaaucacaguauucuggagaaaaaaagaaagccaugguggaaaccuugaaagauccaacagcauucaguacaguccacuccuauuaacgacuuccuguaagucuucaaaacauaaagacugcucucuguaucagugaaagcaaacauuuccaaacagaucugccaucacuuaaaauuucugggaacuggguucaugugacuuuauaugaaaauaccuucaguuacuaagugcuuuuuguaucagacacuaaaaguauuauucugaaaagccauccccaacugggcuuuuccuauuuucagccucaucauuuauagucaugcuuugagcacuuuugguuuugcaacuauagguauagucuuuaacuucuuaauuaaauguugguuuuaugugugacuuuuaucaguuucuuccuugguaacucuuuugggucaggggaauaauggagaucaaggcauuuucuuaaacccaugacucugaauccaagaauaucugaaauaaauacuuucuuggugguaggggggacccauucauccacaucauuuucaaggcucucagcagcagggcagugguugaaaacauuugcuugugucaaacuagacacaaaaggacuuucggguuucugccgaaaugcuuuuacauucuuugagcaggcugagguggcuucauacuggccaguuagaggagaauuuuuucuguuuuuauaauuagcauuaggauuugaauauauggaaggcaguauuuuggaagcaccauuuaagccaugaauucuuugguggaagccugcaacuggaguugacugugaacauggaacaaagucuuggcuuucuucaaaaucacauucugagucugacugagaccuuggucuugaauaccuugagggugauaugcuuugcaaggauaauuuuugugaaggcuggccacgguucucauuuauaggauaauuuucugugcaagguacuuccagugguaacaaguuauccugugguauuuugguaauuucuguuccaauguccuuaucguuagcaauauaaucaaaaagaucagcagaagcauuguaacuaccuucaugaucaccagaagaacuugguguuaaguuauuauugcuaggccugcaaggcaucucuuucgauguauuuauacuuucugggcuacugcaaagggucucuaaaggauaugugaguuuucugcauauugugaaauugucaucuuccuuuuuuggccaucuaugcuuauuuucuaauuugugaagaucagaagcaucgcuguauuuuuuagaacaguuuuguauugccaauuuuccuuuuguuccugaauguaauuuuuguccacauccaguaaaauaucugcuccugagaucagaacagucacuuauugagguacugggccugcaugaaauuucauucuuuuguugcaagaccccacuaguccucuuuuggguaaugaaggcuucccuaucuuuugaagauguaaacagugcugaugagcaaguaucugguagaaaauccucagagauaucacuucuacuaccggcuauggagacagccgcuucugucuugucugcuuucgauucuuucugaaugugaggacuugcauuagacuuacaguuggaaaagagggccucuuucccagagucuucuuucaucauugcuugugaugaucuuaagcugaaagaugauguauuuaagggucuaguauuuuuccauggagucagugauaaucugcuguaguuuuugugacauuuaucaaugcuuuuauccauacccuguuuucuguucuuagcaucuaucucaguuacagcaaccucacuuucaacaacugcuagaaacuuguucagacuuucagagagugguagaucaucccaaaucaaggagucagaguucugggaaggauucgcuguuucuucggguuucagugaugacaaugaaaaugcagaagaccucuguugaaggauggggguaguauuuacuucauaaugcugguaacaugcgauaucauacugggaauaaucaucuuuuccugcuuuacuauagcauucuaaauuauguuccucgaaggguucuugcauuugugaagggaaaaaaugagagucagacaaucuacuuucauggcaacuguugcaaacuggacucgguaagccuaauucuucacccaacuuuccuguuguauuauucuuguccauacaagaaugaaggcuccauaaacucugaagggaaucauggcaguucuuagaacuagugaccucggaaacggagaugcagugucuguuuugguuaggaguaccacuggccaugauuuguuuugaugcuggaaagucaucacuagauguuacuugugagucagaagaagucaguucaagagauggcucccagaaucugaaaaaauccucuccgacacuagacucugaaaaccaggauguauucccagagcccuguauguuguuaagaucacugucugagucaucugaagugagugacuggcugcuauguuccugggagccacagugagguuucuuguguaaaagcggaugcaaauaggcaaugacuguaaauccuuuaacaugugggcuaggcagaauaaucugggaagcuacaaguguccugacuucuccucugagcuuacagcaaggcugcugaaaguuacuggaaucugaaucauguccacauacaucuccaaaauucuauaaaagaagcaaaugaauuuaaaugaaaacaaaguaacuuucucuuagcucaaggaggaaaugggaauuuaaagauuaagaaagaguagcauauaucaaaacuaugaacuuaggcagagacuucaaauccuucuuucaaaguuacuaggaacauugggguccuagauauguuuccuaacuccuccauaccuuauuugucucauuuaugaaauaaagauuauuugauuaacaauaauacaaucacacaaaacuuagcaaacaguagucauucuguuauaaaugaugguacuaguauauuuguaaaagaaagcacagaaaaggggaacuaaauuauguaauauuucaacaaaguaaaguuccuuagcucuugguuuaucuuugucuuuggguuuuccuuagugcucauuugguagugcuauauuuacaccccguuuagaguauaaucuaauuuccacuugaacuuuuuaguuuagaucaguuuguuacuacuccuucagaguuaguacauuuuaaaacuuucuaauguuauguauuuaauuuaagaacauucuucugaauuuauucuuuuugacaggcccuuauuauguagccccgacuggccuagaauuugcucuguggauuaggcuggccuugaacuuagauccaaccagcuuugccuccggagugcugggaguaaaaaugugcaucaccacagcaggcuuuaaucuauuuuuaauguuuuuaaacaacuucagauauucaccuuuaagguuguuucuauccuuuuauagaagacacagauauuagauaauuuguauagaauuuagaguaaaauaaaguaauaaucuaaaaugaaauaucuaauaguuuuucuaauucauaauaaauucccccuuuuaaagcucugaaagcacugaauuaaacuucuuuggcuuuugaaauagggaguuauaaccuguaauguuuaaauagaucacauguaaacuauuuuuacaguuuuaagugcuucuauaggcuuuacucucuauguaacaucuaaaaacaacguaggaaauuacaaucauuucaguacauaggacauucaaaagaaagaugcuucaauuaccguuacuccaaauacaaagcuuuguccaacaaaacacuuuucuacugcuguggucaguaggcucugaguucuaccacuguccaggguuucuagguuuuuaauagaaucuucaagguaccuuugaaagaaaauaaagugguaagcuuugaaauuuuaccuugcaguaaaaucagaagacaccgcuauuuucaaauaugucaugaaccuuguuaguuacaugcagagaaaaaaaauaaaaguaugaccauugcaauuuguuccuaccagguuccugcagcacaaagggagaaaaauauuuaagccuccuaaacccagugcaucaaaugugaacagaugccugcaaagucuggggaggaagcuuaguguggacgagcacaugggaaguuugccuuuagucccccacgaccccccaaaguagaugcuuacuuauuuaaucuucagagcccacaauuauacuaagggaaaguaaaagcaacuguggugggaguggucuuugugguccuuccgcugucccuuuccugcaguuugcccuaauguccuaauguccaaugauaugagcgaacaguucuucuggaaaaugagcaggugaagagggaagaagguugacagugagaaacuauuucaguugucuggauucuucaagugucaaggcugugaugaggucacacuaagggaugaaucugcagugucccaccuggaugagaguguuucauguuugaauugcagaauaguuacuuccaacuuaaaacgugauuauauauuuuugauuaaacuuucuuucccaguagauaucuuuuaaggaaacugauggccugagauaaaggguuucuuuuuaguaaaugacaaauacccucaauacuuguauuuuacuauuagcaugauggacaagcagucagguuaaaaaaacacuuuuaaagauucuuaccuguguaaaccaguggccguaaguccaaaaaauguaucuaagcagcucccaaauacaguaaugaaaaauaguuugcuggauucugccacuuucaaggacaguuuguaucuguaauugguacuuccagugucaccagaagagccacauuugggacaaguaaaccuagacagugggagagaaagcauagaguuguccaaauuuacaacaguuuguaaaaauauuccuaguuaaguucaauucgucaauucuuuauaacuaacacucuucuuucucccuccugagauagggcguuguuugccaugcacgaaacccacuauuacggagccagggucagcuuggaacucuugagguccuucacccgcuccccccaggaggaugggguacagucacgcacuacuagaccuagguuaaugaacuuauuuacagacuuacguaauacccaacuggaagaaacauaccaaacugcuaagaagcgaugggaaacaguauaacagaagaauaaccuugaaauaguugaacaccaagaauugauuuauauuuuucuuaaagucgugaaaagaauuaaguuuugaaaagauuuauuuugcacuaugugcaugugccuguaccuguauugggcaugugaauacaggugccccuugaaagcagagguaucagauguccuggggccagaguuaugaccucuccaacucccaaaaguuacucuaauuaaucaggauauguuaagaauauuggaugauaaaaaacuagacuucaaaagcauauaauaaaacuuguuuucaagauaacauccaauuauagccaaaggguaguuuaaaauacacaucagguguaaaucuaauuuuuauacugcuuggucuuggaaucguuacuaaugucuaaaaucuugaggaccuugcauguaaaauccaauacagagguaagucaaaaauagacaaaaaauuaagugaacacuaauguguuugucucccucuuauugcuguaauuauuauaacuucuacuuauuuguaugcuaggcuucuucaccacugagcuauaggccuaggugguauuuuccuacuuuaguuugcaacaucuuauaauuguuaccuuuauuuuuuauguucuagaacacuggcccuuuaaacacaugguaauuggaguuaugagguguacccccagcucuauugucuggcccacagcucugccugccuucuugaggacugccaggccgcagaaacaucuuccuugccaauccuauggcuguggaugcuguccccugagcucuauccuccugccaucagcuuugccugccucccaggaguauugcuggcaagaggaacaucuagucaacaccagggacaaccagauggcuaaugaccauucgaaaaacacaagccagggcaauguggcaccaccagagcccagcuuucuuacuacaaacccuggauauccauacagagccaaaacacaagaaaaugacuuaaauccaaucuuauaaagaugauagaggccuuuaaagaggaaaugaauaaaucccuuaaagaaauacaagaaaauacaaucacacagguuaagcaaugaaugaaacuguccaagaccugaaaaugguaaugguagcaauaaagaaaacacaaacugagggaauccuagagauggaaaaccuagggaagagaacuacagacacaacccucaccaaucgaacacaagagaucgaagagaaucucaggcauagaauauucaauugaggaaauuaauacaucagccaaagaaaauguuaaaucuaaaaauuucaugacacaaaacauccaagaaaucugagauacuaggaaagaucacauguaaagagaacaggaccagaagaagacucgaguuccaaggcucagaaaauauuuguaacauaaucauauaauauucccaaccuaaagaaaaaugccuagaaucagacaagaagcuuacagaacaucaaauagauuggaccagagaaaacacuucuccugccacauagcaauucaaacacuaacuguacaaacaaagaaagauauuaaaagcugcaaggggaaaaagccaaguaauacauaaaggcagacccaucagaauuacaccugauuucccaacagagacucuaaaagccagagggcuugggcagaugucuucaagccucuaagagaccacagaugucagccuagauuacuauacccaaaaaaucuuuuaaacaauaucuauccacaaauccagccauacgaagauacuagaaggaaaucucuagccuaaugacaccuaagaaaacagaggaaauaaauaacucuauaccagcaaaaccacacaccaucauucugcugcauacaagaaacacaccucagauagacauuaccucagaguaaaaggcugggaaaagguuuuccaagcaaauggaccuaucaagcaaacuggagugaccauucuaauauguaauaaaauagucuuucaaccaaaauuaaucaaaagagauagaaaaagacacuucauacucaaaggaaaaacuucauacucauccaccaagaugaugucugaauuuugaacaucuauaacccaagggcaagggcauccacauuuguaaaagaaacauuacuaaagguuaaaucacacauggaaucucacaccuuaauagugaaagacuucaacauucuacuuuuaucaaugggcagguuauccagacagaaaauaaacagaaaaaugauacucuagcucacuuggaauauagcaagguuuaaagaauauuuuacaucugcauauuacaucuauguuacugauauuacacaaauguucuguguauguuauguauauuaaccucccugauccaaauaaaaauuccaagagguagauauuuuugguccaguuuuagguucaaauuauguaagugauuugggcaugcuuacauagcuauaccugagaugguuguggcuaugauggccaauguuuauauucucccuacuugagaugcuuagauagaaggacugcuacaagucugagguuaccuugggauauacggugucaggccaaccuaggucacugaguaagaccuuaucuuacuuaaucucucaccauccaaacaaaaggggucaggggucauaucaaacucaagcauucuggcuccacugaauaauguuacccaucaugacuuacuaaaagaggaaaaguauacuuuuaaaagauuuucagcaaaaaugggugccauuuuagaaguccucauauaugucauguauuguacuagauuucuguauguuuuuucuauauaguuauuccauacuguagauauuauuauucaaccuuacaaauauguaauuauacucacagaaucuauagcucuugcccagugucauaccauuaguagauguuagcaacuuaacuuuacucuuauacagcaugaacucaagacuuccauaguguuuuuaagaaaggcuccugacuacucccuaugccccauucaauucuaucuggacaaauaaaugacuagugaaaauuaauagcucacuacuuuuauuuaaauauuauuaggcauuacuaccaucuuaaucuuauguccagacacaaaguuaacaaagaacuccaaaccuaacuuuucacuuuuacucuacaaagauaggugguauauauauguuuuguguguguguguauuuggcucucaauuguauuuggcuacaaugauuuuaucacgguacaacagauuacuagaauuugaacauaucugauguaaaauucugaauuucagaguacuugcaaaaguuucaggagcacugacaugacuuaaaacgcuguaggcuuugaaaccaggguuaccauaccagagcugcaaauuccagaacagccugaaaugcagacaaccauucacuaaugaacaaacauacauucauucugcagcauuuuuauuucacguuuagaucugggauauucaauaaccaacaaagucuaugcaaauauucuuaaaucucaaaguucuggaguuugaaacaugucugguuccaagcauuuuguauauguacuaauaagcacggugacagugacuaaguuuauacacacacacacacacacacacacacacacacacacacaaauacucuuaaaacuuuccucuagaaauuaaauuacuccucaauucuauucuaagacuaacagaagacccaaccuugaaauuuuccaagagaaucugauauucuggucuggagaauuuagugugcauuugcucugagucacagaaagugucuacuuaaacaauuuguacuuuuaccuuuuggacucaaggauuaucuuagagaagcaccuuugacaugauggauauauaaaauuccaauucuggacagcaaguacugaggcaaaaaggaauuuccgucuuuuauucaugugucuauacuuuguccuacaagagaaaacaagcaugagguucaaugcaaauguuaaaucacacaugacuagcauucucccacgccuccuaguggacauuuuuaguguuuaaaagaucaucaacuucuccuaaccuacagcuggaaguucauauuucugaauauaauucuuaugaaaagcaaucagucaauauuaucuuuuguuuuguuaucagugaaggcagugucagaauacuggcuuuucuuuucuguacuggggauuaaaucaggacacacacaugguaaucaaguacugaaaaaccgaauguuuauuucugagcaaccagucuguucuaguaauuuaguagagaaaucacuuagcuuguucccauccuuuuacaaaagauacagaaguugugguuacaauuuuaaugggaaggauuuuccaugaaccaauuucuuucuuccuccccgcugugauuuugggaguucuccaaauuuuuuguccagguuggccuugaacucaugggauccugaggagcuuaaaguauuugggacaguaacugaaaacugcuuuaguagauuucacugaguagaguuuuacaguuugaagagagaaagaagacauuuagcaaauaagaacgcuaccuagucuaagaggucaggguguuuucuguuguuuuuguuuguuuuacaauccuuguuuauauaagcaugucaaagauauaaaagcaauacucuuuauaauuucauuuuuaauucuuuaaauuguacauugacuuaccauuuuccccucaacgauuaacuuauacacagcauaaaauaaaugcuuucaaaaagaaguuuauguuuuuucagagaguuauaucaauuuggaaaaaugucugaucuguuucugagacuggaaucaguaaauucggacagaguaaaauucaguuaggcauagcuuuucaaggaucauuaacagaaauguguuagcuguaaaagauuucuacaaaucccgugucaacacauacagcagaagccugccuggucaugucuuaguagagacaguugaggccccggggagugugaagggguggggacauccucuuggauugggggcugggguggguggugggggaguaggugggaaugggaugaggaacugugggaggguggaccaggaaggagguaacaacugaagugaaaaaaaaaauuccugugucaagacauaguauuuccacgaaaauaagauuuuucccaucgcuuuuucuagugaugucuggcuagguauauaagcuacacuuaaggguagaucccauacccagcaauagauaguuaacacaacaugaagucaguauuuuugucucauauugguuuguaaacccuacacuagaagucauaacauauaaacaaagggccucuguaccccuguauaugcuuucuuagccucugaguucacauguaccuugugacuugaccuuguugauuaguccuccauccccucugccucucacauucuuucugcuuccucuuccaccagguuccuugagcccugcggggagggauuugauggcaacaucuggcugaguauggcugaguguuccuagguuucucauucccugcauaccuaucuggcugugggguucucuucccaucagauacaggaggaagcuucucuggggauaguugaacaagguacugaucagacaguagcagaauggcaacaggagucauuuacuagcuguuguuauuaucauuauuuagaacaguaguauuugguuuuagccuaggccucugggcuuguuuguuuucuaaagagagaaaaagguauguuggauggguggagaacacggaaaaaucugggagauggaggaggggaaaccaugaucagacuacacuguaagaaaaaaaguuuucaauuaaaaaaaguucccaucaaggcuuaaaaaugaaaacuuguuaauagauauaaguuaaacauauagaccaccuaucuauauucagaaagggaguauagaaaacgcuaauccaaggcucacgccuuuaaucccaacacuugggaggcagaggcaggcgaauuucugaguucgaggccagcuugguuuaugcagagaaagccugucuuggaaaaaaaaaaagaaagaaagaaaacccuaauccuuuauuauuguuuugagaccuuagguauacaugauuaaguuacaaaguuuugccaaacacauccauauauucuuagacuugcuugccaccuaggaaaaugaaguaguuuaaaauauaauuuauaaggaaaagggguccaccaaaaacccaucauucgugcuaacagcucagauucaagucuugucuuggcaaccauguugaugagacuucauggaggaagccucugauaguucagccaugugggugcuaggaacugaacaugcauccucaggaaaagcagucagcgcucuaaaccacugagccauuucuccagaccccuuuucucauuugauugccuuuccuugguauuuauguccuaguaauuuacgggagcacaggaagggauugcuucuugcuucugccuuacuaaaugcuucacauuuguuugcuccuuuccaccgauuccauauuucuaauguauagcucagaacugucgaucccagcacuaggguugcacacacgcauacagccaugcccagauuuuacuuagcugcuguagcucugcagguccucaggccuauacaacaagcagugauacccacugagcugucucccacgcccacuagguuagguugaacauugucauuauauugugggccaauauuuaggggguucaauacagaauucuauauucuauguggacauccaaaauuacucuugaugcacuguggguuguaccaccucuuggcagguaggccucugcuguuuaagaaaaguagcugagcaccagggaaugcgggcacacagcuuuaauccaggcucuugggagguagaggcagguggaucucagugaguucaugaccagccuggucuacagagcaaguucuaugaauacuagggcuacaaagaaaaaccuugucuucaaaccagaggaaagaacacaauaccaccaccaccaccaccaccaccaccaccaccacacacacacacacacacacacacacacacacacaccccaaaauaaggaaaagagaaguaugagucugaagccaaauaguaagcaguguuccuccauagucucuauuuuaguuccugcuucuagguuccugccuuagccucccucuguaaugaacaagccaaauaaaccuuuuccucuccucaucaaaagauuauuuauaaauuuuauuacauagauacuuaagauggguugauuuauaauuuaacugagacgcuguguuguacauauguuuucccuucaaguacuagggacugaacccuggaccucauccuuacuaggcaagcauuuuaccacugagcuacaguuucaaccuuuugagaugucuucuaaguuucccaaggcugggcuggaauuugugacccuccuaacucagcuuccaaguagguggaauuacagaucugauuauauauauauauaucaccaauacaagaaaaacuuaauauaagcaugguauuuuggaauuaauuuuuaaauuaauaauagcaauaacgaauugcuacauuuuaagauugguuguugucuuuuauuuaaggguuuauugcccucuagugguucaagucuguauguuaaaaaacaaaacaaaacacuguaacuuacagguaaguuacuuaagaaccgaaaugaaagaggucaguuuauuauuuuuaauugguguuuuaccuggcuaaccuacaugguaaaaagacacuucguucauugaaugaaggacaauaauauaguaaucagucaggaguuuguucuucucugucuaaucaugcuuccuucaugauaaauguaauauauauacauacauacacacacacacacacacacacacauauauacacacacacacucacacauauauauauacacacacacauauacacacacucagauacauacacacauggaauggagugauuguguguuugacagcuaaaaguaccagaucugaguaaguacuaaaauugggaaaacauuauagaccugagaacaacuucacauuuggccugccuuguaauuuuugauucuuuuuguuuuguugggaaggaugaugguauaguauuauuggccaacaaaacguguuccaacuugauaagcucaauauaucuacauacuguaauauauuacagagcugcuaaauggcaacugucgcuguauaugagucaaugacaggaagacacaguucuguccuagucacuagauuuauguucuaguauaagagcugacguaacuguaaacagaaagguacuuagugaugggcuauagggucaaucaaugaauaaguagagcaucaucuucucucugucauugagggcauugaggcaggaaagaaaggaaaaacuguggggacaugagaaggugaagaagccccucaccuugggaucuaguuugccuuuuuuacugaguucagaaacuccaaagcaacugauaaaccuaaguugacuauguaaauauauguucuacagacuuacuucgagcuaggauuuuagaguuuuaucacgauugcaccuuuuuuacacccccaaaucuaagcagugcaccucauaagaccaccuuacaguuggaauuacaaaagccucauaaauuacuuccuugggcuaauguaaaucagccacagggucaugcagagcaagacgcuguaaacagaucucaacaucucacgaagcccacaccaugucuuggaauuguaguucuuuccuuuuccuagaugacucuaucuaaauacuuaguaaucaacuuugcucagucuuuucuugaggcauagucaaggaucagggcuaccugauggaggucccuaagaaagagcucucaggcugcugggggauaugcacgaaaggcagaaacaacauugacagcagaggggaaauauuguagaacacuccuguugaaacguuaacuaggaaagcguuggcacacacaacagcuuuuccauguuugguaucauuucugggguauuucugacagacauggagaagggagcauuugagguaaaacaauaacagacaagccaggaaguuaguugugguucaggcugauaacguguucuagucaucaauguguaucuaugaaacaaugcaaagacuuccauaaugucacuucuuacaggagagucaacuguauuuagaagucucacaaauucaaaguuuaauaaguaacaaaaauugaauccuguuaaguccuucuugucacaaaauccucucaauuuuaguaagucauacuauuucuaacuagccauauggccagauaccuaaaacucucccuccacacgccaugucauauccaacauuuuuauccccccauccccucccuuuuuugagauaucaucuuucuauauaaaguucugacuaucuuagaacucacuguaugggauggucuugaacucagagauccaccugccucugcuuccugcccagcuuacuccuuuuuaauauuuauucuucuagaauuucauacaauauauuuuauauuucccccuccccaucuuccuaugcacccaacuuccaguucuuucucaaaaauaaaaaaaaacaaagcuggaaauaguggucuaagccuuuaauuccacacucaggaggcagaggcaggaugaucucugugaguuugaggccagccaaggauacauaaagagacccugucucaaaaaccacaccaaagcaaccccaugguggcuagauaacugggacuccucccuccccucccucccuuuccuagccaagucacagucaccaauuuaguaucaacucuuuacagggcacuuuccugauccauggcgauuucuagacccaucuuuuuaaagguaagauuuuccucuguugcccuuaggucucuuugaaucucaggcuggcuucaaacuagagauucucaugacuuggccucccgagugcuaagcuuauucauacaggucuccauacucaacuuugcuauucgguuuaauccuauccaaaaaaaagggggugggggugggguacuuacccuaggacagcagucucuauuguuaguugaagucauccaaaaccuggcccuucuuggcauaauggaggcacuuaaaauuuuaucugaggagcgaauaaaaaaaugacagagugcucagugaucccauuuuuugcaaggucaagaagccagccuugacauaccuauaaaucuagcaauugggaaauagaggaugauagagggaguucaaggucaguuuuggguauagaauccuguuaucuuggagccgggugugguggcacucaccuuuaaucccagaacucaggaggcagaggcaggcagauuucugaguucgaggccagccuggucuacaaagugaguuccaagagagccagggcuauacagaaaaacccugucucaaaaaacaacaacaacaacaacaacaacaaaaaaccaaaacaaacaaaacaaaaaaacaacaaaaaaaaauccuguuaucuuaacucacacacauaaaacauaaagcaaaacaaaccagaacggcuuuacaaacuaagcaauuacuaacgagucagaacaugccuuagguguggugggauaaaaagaaguuugggagguugagaggguggugcuuuugaggaacacacaagguaaucugggguucgggauaauucaguaugucaugaacagagugugugugugauauccuggguuucaccucccacacugagaggguauaugugugugugugugugugugugugugggggguaugacagggucuagaacugaaguuagagaggcaagcaaggccaaagagcuuuuaaccuaaguuacagauuuugaacuuaaaaauaucgggacaaacagaagcuucuaaaacaaguggugaguaucuagguaaagaauuuuucacccaucugccuggucuuggaggcuacuacugucacugcaugcagcugucacagguuagauuaugguaguggcaguguucaguggggaguuggauuuggaucucagguguggguucgugagagcagggaaaauagaaaccuuucaauuucuggacugcguacauuacucaguaaaauacuuucucugggcagucaaagucaucugaaaaaaauaaaacaaaccaucuuugccagcaccuagcacaguaaccugcugacauaguuuuaugcccccguugaaagucgagcccuuuccuuucuggguuuuuggggauccgcagcaacaguaaagugcugauaaaccuucgccaaggaacaugaaaaguauugacuuucccguuuaaccucguagccggcguuuacggccagaaguccugaaaucaauccauacggagugcaagguuacagcgccucgucaggagucucuccaccuagagccccccaagaacuccuuuuuucagcgucucaccugaggcaaaggacacagacaagcccgggcaaccgcuccgcccuccggccgcucgguccgccgcucuccaaacgccagcaaucgaaucucccgcguccucuuccgccg

SEQ ID NO: 3942 - RNA, 3401 nt, Mus musculus
caucuguauuaguaacugaauucaagucccuugcucacuuggcaaacacucuacuaucuuucuuucaucuucccagacacccuuucacucuuuuacugccccuccccagucacguucacucuaggcuaagccaagacuuugagaaacauagcugcucucuccuuucugggguucagaaagggagauagcaauguucacugauuucuuaauucaucugcuguccaaaguggccugccaugcuagcucugccaguauugaaggaggaaauaguggagaucccagggaugauccaguuagaggauuuuuccgaugcagaacagagaagcgaaagcuucuuccaggauugaccaagucugcccggcucaguagcaaaaucagcugacguggcaugggcucaguuuauggcucuggcuucccugcucaggugaacucugacaggcauaguuucagguuuuccaccugggaaaugagaguaauaacagcaccugcuuccugagauucaaggaggaaaaccaagucuaaaaauaugaagacguuugaucaauuuuuuuuaacagagcuugauacauuuuggcugguguuuugacuuuaccaugcuggcgauucauaauuucucucaucugaaucggcuuuuuacaacacucgcugcuacccaagacuucuuaaaagagcccuacuagcaauguccucucaguuuucagcugaggagaaacgaaggaccagacuuuuggggcuacuuggucaagucagagcguaaagaaguuggagugcugggaaaccgaccaaggccucugcucuuucugccaucuucugccugaugcgagcuccaggccucccaaguacaccuguagcauuaaggagccaagacuucuuaaacaagaugaucaaaaaacauguuaagguaagccauuugucugucacaauaauaugggaaacucaagccaagucuuauaagaaaacugguguucccaugagaggaacugucuggguucugugcaaaggcccccuagugcacaaacaagggucuuucuggccucaucugguuuuccccuggcuuucuuagaagaucuuuaguaggugggcaucaagauggugguugacuaaacaauguccccuaaucuuucucuuccacuuaccaugauaaaaauaauuacccugacagacuguccagucugccauuucagauauuucuuaggagccaaguacuguccuucuagcauccuuccuguagggcagaggauaaucccagacuucagcuuauuagcauacaguaguaccuccaagacugucuucucugugugacccauauucucagccucaucuuucagccacaugguacauugauuuuccucaguucucagagacaucaaaacucauuauuccuccuagacuuauuucuuccucauuuuuuucauucccauaucucuuuucuccuucuucugucaugugacagucuuacaaugcagccuaccaaagcccugcauuguuugacuaugccuuuagcccugaguacuccuucuggccuaccuauauacucagaagcagagcauaggcacuugaagucacacauagaauucugagcucucuucucuguucccccuucucuauccaauauaaagucacacauacauguaaguaguucaaguuuaaugucuaaguaaggcaaaccagugugcacuugaguggcagccaugggccagguaccccuucuccuuauguuagcuucauggguaccuuagaaaaauccagaaagguaguccuacuacauugaaagaauuaccaagacccauaugaaauaauauggccaaacuugaagguuuaaaucagacuugggaucuugucuaaauacucagagccaugaauuuccacgguaaagugcucgucagcauccagaagcuuccggcuccuguucugcuccccaguaguuaagcauggcaauaggcucuucuuagucacuugugaccaggcugagaauuauucaguaguuauccugcgccaccaaacacaugcacccacaaauaaagcagagaacgaacucucacuuugccaaagacgauuuacaacuuauagucaaacaacacucacgaaaaauuccccuccaccuucaccaauuagguggccuugucauuuaucugaaugaacaucaaacagaccuucagcuauuauuuuaauuaauuaauucagcccuuuaucugcuacccccauggguccugggagacaccuggcuuauuuccacagcagucccugaugcucagcugucagacuccaucgugaguggcacccagaucuucaugcaaggccaagcacuuaaucucuuuaacggagaccugucaucgcuugcuuucacuccagagcagccacagucuaugcugagacauacuggcucaugcaccugucccccaccccccaccuccuuuuuuaacagucaccaucuggguucaggcacuucucagucccucucugagucacugucacugcauucaccaaguggcuucuuguugccacguggcaggcucucugccuccucuugcuuugauccuauucacaaaaugaucaggcaaaauggguuguuaguuucaucuucaaauggaaauugaguccagaaaaagcaaagugacuugaacaggauuccuccucugggaaguugcaaagccaggauuugaaccgccucugugauaccaaggucaaugacuacgagcuguccacuugccugcauccuccagcccggacuuuaaucugcuaauaaaagcccagaguuagcugggcuucagacuccauaaacgaguauacucggggggcagggaggguauguuccagagaaaacagcauaaucaaggccugccugagugagauaagaaacaucaagaaagcccuuugagaaggauggcgugucacguaaauucucaacacugucuuguggacuccucgguaaauucugccuugguggugacauuuauguacagcauguuuauuugguggugguggugguagagccagaggauaaagaagaaacaagagacauagaucauacccuguuuuagaauggaggcugauucuggaaaagccacacaugaaacaagauucaggguggaaguuucucaaucuuugaaugggaauagcaauagcacaaaucacacacauuuccuaaauacccacauguugggaggcuggucucuagguugcccuuguuaggagguugcgaagcuuaaaagacagggccuagcagggaauaugcccuugagcaggcuaggacggcgcuagucccuucagucucccuuugcuuccuagucaugagaugcuaaccuguauacauccuccuugugcuccugccuugacuugcugcccucgccacaggcccaaaggcaaaggacuccacugucaggaauggaagguacauguuc

SEQ ID NO: 3943 - RNA, 739852 nt, Mus musculus
aagagccccgaaucuggacuccuccacuugacaccgggccacuaagagacauucuuucucugugcuuccuuuucucuuccucagacucugaacuucagcaguuuugaaugacugacgcgucccuacucaccccugggacguaauuccugcaggauuguggcaaacuaguauuucagguucccuuggcaaccccggugcccugucuccugagaacugugcauccccaggaccugagaagaccugacuucuggguaagaaucuauacuuuucuguuucucugcuguucccgcccccugcagcaaccuggcugcgucuuggauggggaggggcuggcuggggaaaaggauaugguugaaguuagaaaccacaaaguggaaggaggaagacccuauguguuucagucccugggugagagggcacgggcacggcauguagauuccuggaaugaaaaacugcuugcuuccagucuucaaucuugucauugcuuguucuaugaugcaacuuuugaguaaucgcugccaccuaggacugggugcccauuuagccucgggcguuugucagucauugaauuaaucacucuacuuugacacaugcaggaaggcguuacucucccucauagcuguggggagcagguaggggauccugagcaggcccugcaguggcagaguuggggggcagagcuguguggauguguggcgacuuccuucacugugugcagaguaagcacucuucccaggcaucaggaagucuauaaagccggccaccaagcaucaaaagguuuugcuuuguuuggggaggggguggaagaggcagaaccuuggccuugaugacuaacucuaaacagcagccucugagaaagacagugaugugcaaauuacugauuuuuauuggacacuuuggggaauauagcuguuugucaggaaaugaaagagaauguuugugcuuauaaaauuauauggaaaaucaaugugguguuaaguauauuucucaguuguuugagucaaggacuguucucucgccaauucuagcaaacuccaaggggauggcaaggucccaaagugcagccaugggacuggauggaaaggucaaaccucuguuuccuaccgcccuccaucuuccuggugugugucuagugacagaaagggacaggguggugaaggcugggcugaguggccagcacugcaucucagcagcugcacuuagcugcacaugggagucuugaugcuccagucucuucugaguucuuuugcuccacuuuaauuuauggaucucuguaauaucaagcuucuguuacagaugggggugaccccgggggaagcauguagcaggaaaggagacuaaaguuauccaaaacuugagugaaacuggagucugcauaacuuccagguuucaggagccaccucccauggguagaaguguauuaugggacacuaguauuacccaguuugacacaggaauaaagugaggguguaggaauagacaggucuuuugcccucuucguagguacuugacguugcuuuaugacugagaaucuuugacugacuggggaugaugccaaagaaacuggacagagagcucucagaaggucagaguuugaaaccucacaagcuaccaacaagaguucuaccugugacuacaagucuuguaguuagaaaccacacuagauaaaaauauaaauauuuucaagauauuuaauugagacucacaccuucauuucuaacccauaugccaccucccugggcuugcgugccuuuguguggauacucugugugcaauuagaaggcucuuaguuuguuucaagcuagccuuauucccuuuauaccauuaggacccacuugagucuguugugauccuccugacucagcuucuugaggacaaggauaacagguauauuucaccaugcucagccaaagaaacuucuuuucuuuuuuuaaauuaauguuauuauuugcacugccccaugugccacugcacacaugugauguuacaguacagaggcuacacugaucagugaagauaaacagcugacuagaugaacuguaaaguuuuauuuucucuuacacauaugcauuuaguggggugagagugcugagccauggcacucccguggaggucugagaauaacuuaucaguauuuggcucuccccuuccaccauguagguccaggagaugaaaugucagguuaucaaacuuagcagcaagcuuaaucuccuggaccuacgugguggaaggggagagccaagcauuaauacguuguucucagaguccucucuccaucccuucaaauguucuuuaugucucuuacuugcuguagguuaggcagugcacuccccuuuuauugugccuugguuucaauuucaaacuagguuuuuacuugcuugcuugguugguuguuuuuauuucccccuuugauaaaauugugcagguaauuaaaugcaguaaugcaugucauauaaguugaucuugguauuucucacagcagacauacaauaguugcuguugcuacacaggaaggugaagaaaaaagguauguuuagcaaaguggccugcuguucauauucagggcaacuguugugaaguaaauaacaaauuucaagugauucuuuuucaaagaccaaaugaucuuugcaaguaucuaagcucaguccaaggacuacaugcaaaagauaucaacagcaaagcuaaacacagcgguagguucagaugguccccuauaucaggcaucugcuucagcaucuguacauuagguuaaagcccaggaacuauuugagaauuauaacaugcacacagcaagcuucaggcaccacauaaugguaucagcuuuuacacuagcaauuauuauuuggaauucauuauuugaaagcagaaauaucaaagacgcuacaaagcacacaucugguuuuagcaugacuuccuuacuacacggggacugauuuuucccaggcugcuuuuccuuaugugucuucuuuuauuuguauguaugcauuauguguauacauuuauaugauaguuccuuauuuucuaagcaaugagguggagauggcuagaaauaguaucuguauuuuacucaaguauuagaaguuucucaggcauucagcuguggugcagccacagcccaggcauuacagguuguguuaguaacagaauuuccuugcuguagagcuuuggaauuuaggagagaaauguauuugguugacaagacguuacuggccgugacuguggccaauuguagucauagacccaaagaauucuugcacaguauuuucaggcaugaaaggaaaaacacaugucccuuaaaaauagagacaugauucagggauagagaaugucauacuccuuuaaaaccagcacuugagccacagauguagguggaccucuguggguucaaggccagccugaucuauguagucagggcuacaccuuuagugagauccuaucuagaaaugaacaguaaguaaacaaacggucaaacauucucagcuucacucacguuucuauggguaggaaggagugucauaagaugccuguauucuuugcucugcccgggagccugagaaugaggauuuguuaguguaaaguuaagccucaguuucaaaaagagucuugaaaguuccuaagucucuuagaguauacagaacaaaguucagaaugaaaauauaagugugcuacauauuuuccaguguacacacagcugcauuugcuugccaaguuugcucugugacuuuauggcucuccaaaauggacccauuccucucugcauggccaggaauaacugcaaguuaucuaugaucuaucuaucuaucuaucuaucuaucuaucuaucuaucuaucuaucuaucuaucuaacuaccuaucuaucuaucuaucuaucuuucuauuuaucuauuuaccuuucuauguauauacauuuuaaauuguauuucuuguaugauuagauugucuucucugauaaggggagggagaagcaauaauuugaaaugaaagagaaaaauuuuuguuuuauuuuuaagaaaagaaacauaucaauuauaacaaaauccaagccaauuaaacaccaaaccaauuaaaauacacaauuguuacagguagaaauauaacacaaugugaacuguggcuauuuuugcacaguaaaacuaaaauuuccuuucuucucuguguuuuucauacuuucucaauuuuuugugauauauauaugcauuucauuuaaguaaaaguuuccauauuuuucaaauuauuauauuaagugauggugcucuuccagaaaaaaaaaaucuguuucuaacuauuaagaaacauaguuaccaaguacacgucaucuuucugagagcagauggcuccugugugugguggccuacuucuaagcaagugucaagugccacaaugucacgccacauuuugcaagggcucgggggugggguggggaggagaauacagcuuaaugguagaaagcuugccuagcgucuacaguccauaugagacucuagguccaauccccaacaacacacacaaaaacaauugugcucucagcaccugaccauuguguguugccaguagucagggaugcuccaauggucuugucuagcuucagcucuugguuaagaucuagguuaagaucuaggcuugcucccauugcugguucacuuaagaaagcuccccaacacacgcugccacauauucauauuuccauaauaccacauuuccuccaccaggcauuaccauuacacacuuuugaguucccuucacuuugguauaugcaauauuuaccggacauuuuugagcaaucaagauuauaugaugccuaugugcccuuucuaaugucaucccaaccguucacuacaauguuucugugcccguagagcaauacaccuguuguacuuuacucaaguaguucucuuuccaagaauuuagcuuccucugaaccaggucuuguugauagaaaugaugcugauaaacauaacucauacuucuauuuuuuaaauauuuuucuuaguauugaauugaaauuuuaaaauaauuuucuuaaaguauaggauugaaauuaauggcucagagaacaccaacacuuuaaaacuuuuuagagucaaagaaacacaaggcugaacugugugucugugaggcaggucuguauacaugaaccugagaaacgggacaccguagcccaaaugcuuacaaacacugacaaaacugagaaaugggacagcauagcccacaugcuuacaaacacugacauucaucuucuucaccuuugacacagccugcaaacauugcugcuuuccauauuauuuucauuuacauuucuuugauuguuucugagaugaaacucuuuuucauguuuauugcagauugucuauacucuuaauuuucugcccuuguccauuuuucugcugauuucuuuuuuuuuucaauucaugaaagauucaucccuauuaaagauaucaggccuuuguugggucuauuauaaacauuucuuuccugcuacuugccuuucauuuuuuaaugaauuuuggggcaugcagaaaucuguuuucugugauucaagcauggcucucucacgcugugaugcuuucuucccuuugugauccuuagaagugcgccugcguucagaaaugaggucccccccaucagcauuuuuaagucuuuuugucuuuuuaauauaaaaauuagagucugagccgcggccuaagaugagacacaugaauuucagcaagagguucuuucugccucuugcaucauaaggacccacagagcacuggcuucccagggugcuuaguggucuggagacacaaacacgggugaaagauccagauuggaccggcuaaaaauucccugcgauggggaauuuugaauauagguauggguguuugaguagcaagugugguuuuaaguguuaauaacugauaagguaaaaacagcagggccucuauaaaugcugauccugaaaagucagugggccagacugucugugagucuuccuccagugagccgggcugcuggagagcuacggcuguggucucagguggcagagaggaagcuaaaugauuuggaauuagaucuuugcuuugggucgcaugugacgaaguccauuuucccuugucguucuaaggcgguggcuuucagcucagagcauuacacacuguaaauucuauccuuggggguuagggguagaaagagaggugguccaggaaccccaagcaggaugcugccaagauaggcuacaaucagacggagacugcacaacaguuucuggcgaggugacuuugagccucaguucucuuaccuauaaaacagguauaagaggagucagcuugcauagaucuuguaaaucagugguucucaaccuuccuagugcugugacccuucaacagaguuccucauguuguggugacccucaacucuaaaauuacuuucguugcuacuucauaacuguaauuuugcuacugcugugaguuguaaagcaaacauuucuggagauagagguuugccagaugguugugaucuagagucucagagucacuauugcagagaguacacugcaccacacacagcaaacgcuccaauaaaugacuugcuucacagugucuuugggguucaaacagcugaagguuguaugacuccugcuccccugcaugcaucucuugugccacaaaaagcuuaauuucccccaaucaaaaugugaaguuucccuuuuaaucucaaaaaaaaaaaaaagacugguuuucuucaaguugaugauguaguagauuuuaaaggggggcuagggauguguuucauugaguaaaugcacuuguuauggaagccagaggagcugaacucaaauccccagcccccagauauuuucagagcugggcaggguugagugccugagacuguuagcucagcacugacaggcagcaauggguggaugccaggggcuccuggaccaucccaccuagcuaaguagcacauuuccguucagugagucaccuugucucagacacaagguggaaggcacuggagggggacgccaacguccuucuccagcuuucacauugagcuugcaugacugcaugcacacauaugcauaccccacaugcaccguucccaccacgcaugcacacaccacacauaaauaaauaaaauaaguagaugaaugaguacacaccuaugcauaccccacacgugccauucacaccacgcaugcacacaccacaaauaaauaaauaaaauaaauaaauaaauaaauaaauaaauaaauaaaugcaugaaugaauaaggcaugacaauguacucaugccuuacugcacauucagugacuucccuuauuuuaaaaaguaagacucuaagcacccucaaagucuuggaagaaucagguguaucuuuacacagugcccaguaccuuugcauugagaauguuucaaacuuuccuggaacuggcccccuaguucccugauuugcauaucacccaaguauugauugcccugugggaugauaccuguuuggcauuucacuauaaagaguuacuuuguuagggagggccugcauaauuauuaauuuuuaaccgauguuaaauaaaguuugacaugugauguaugagggagacauaaagaaugaaagaaugggaaagcaaaacuguaacucuuuacugaauaccuaagcgccaggcacugugccugucuccuuggcaggaaagaaggguugugggauggagcaggaggaggcaagaguaccaaagccaccaacauugcuauuccaguucaacugcauugggaggaagguauaaaaaugugggcuuuccaauggcaacaucagacauaaggaaucaucuaacccuccugccucucccuaaaugcauuaugcaaugguguuagaauucuuagguauuugugaaggggcugaccuagguggcacauuuaaaaaucaaaaacaaaaaauccugugggcucuugucuacauguacagagcugugauggcgcaggguccccaggguaccagagauggaaguggaggaagcaagugcuaauacuuccaaucccuaauugcaggaagagucccuggaugccuacacacuuucuucccucacucugagacccaagaaagcuuaaacucucuuccuccucuucuucuuccucaccuuccucuucuaccucuuccuccucuuccucccacgccucuuccucgaacucccccucccccucaucucugcucucuccucccuuucucgcuuuaauuuucuuacauaagaaagcaggucuaaugacacaucccaguggcucacugcuaggaauaggaggaggaagauguugaggacccuuugugaaucugagaaacaggaggugggcugccaccacugcuuuuucuucaaguuggggugaaaccucuguugugcauggaccccucuagcacagaauauuccugaguccuuccauacuacguggaugccccugauuucuuccagucuguacacauuaugaaauggccaaugagggccaguucaccugucuuuuuccaagauagaugagcagugccuucaagagaugccccauauaaggggaaaugcaauguguacaaagacaaacacuccuuagaaaaccggaagucugcaucauauugucugccaugcccuuggcaguugagcagcguuuuguucacuagagacuagaauaauguauuaugaauagguuugcucaggaaauuguuauguuaggcauacuaaguuuaaaugggcaauuaacauagaucaugcuuacauguuuagucacuuaauuuacuuaaaaaaaaucucuagugugaugggcuagggauagagcucaguuuuuaguuuguuuguugaguaugcaugaagcucugggucccaccccuaacccacauaagccagguaucacacaccuguagucacaacacugggaagggagaggcagggagaccaccucagcuacauagcaaguucaaggccagcccuaagcuauguaagacucuguucauaaaaaacaaauuaaauagaagguugaggagaugggucagugaguaaggugccugacacacaaguaugaggaugagugucuggauuccuaguucccauuuuuaaaagccaagcaggacugugucugucugcaaccccagcucugagggugagaguagggggacagaaacaaaaagaucccuggagcuagcuggccaguaaaucuagcugaaucagcgaucuccagguucgaugaagagaccauguuucagaaaaugaagguggagagugauggaguaagaaacuggguguaggucucugcacuccauacuuauguacauacaugugugcacuaccccccaacaugagcauguucacaggcauaaaauguaguguggccacagacucuggagggaagccuucaucuuuuggccuaugccugcacaggcccagugggcacacagcagagccaaccaaagcgaagcauaaagacccagcgucauccagagcuugugucuuggccaacguucaacagaguaagaaguacuuacuucaugaaugcuguacuggggggcaaaggagaauuuuuaaucaugcuuuauuggagacaacuuuugccauguggaacccugucuaaucaacaucacugggaaauauauauuucuucugacacagacuugcaaauuauaccuucacccucccacccuaacccucacccagaaaaaaaucuagcaguguagaaaugcuuccauaugcucaaagcugcuuuccccauucucauugaggggaaauaaagaaaaauggcgcugaggagccagcuugcauauaugaguaaacacuuggcugggccacacguagagggaggaaaagcaggccucagugcuggccauaaagaauacuccaagccuguaagacuuugcuaaugguguguugaagcuuugcuccagaauggccuauucacuggaauguaacuauaacuuacauagguuauggaaauaauuuaagaccauagggcucaaaguucccgaauucucaaacaucgaagcagggaguauggaugauauuacuugccaauguaucacacaagggaccaguaaccuagccucuacucuggccuauagaguuggguggucuugagcuugagcaggccaccaaaucucucuggguuucaauagcaucaaugaaaugcagggacaauaauuaauguguccauauugcaaaauugacaugcaauugaguaagcaaaauccuuugccccuaacucuaagcugagguuggcaaugcugguagagcagugagccggccuucgggaccauggaccaugcuccuugaguacugucugaagccaacuuucgcaugacucccccagaguugcuaguucuuagcuucagaugugucaucuguaguauagggucuucaagugcacugaauuccucucacuuggauggucuguauggaagaaucuugcaaaccacaacccccccccaaaaaaaaacccauaucuacauuugaucuccaggguauagucugggguuggcauagugguuugcacguuguaaauacaccauaaauauuuguggaaugaaaaaaaaaaaagcccagcaagagaacgauucucauguuucccauugccucagaccuuuggcagagcuugugaugggcucuuuucaaauggaagucuccguccgauucaguuaggcaaguuauuacuugugugguuguaucucuaaaggaacauguuggccauuucuucuccucucugguuuggaacugaugucagagggggcagggaaugugguuuccaucaagccuugugauuugcccagagacacaaagcugcuaagguguccagccaaaagcagaacuuaggucaggcugacacaaagcuugccauuucguguucugcuguguaaauccacuuaccaaccucaaguucaguggcugcccaaagacacucugaagcuugccaccuucucuuaggagcacagugcuuucuagagguccaaagcacacugcauguggacaucgugcucuccuuauacaggauuguaggccaaaagccauuagugcccccauacuuagaaauaauuccaugagguaaucauacauuuauaucaaacaucugaaccauauuuaauauaauuaccuaaucaaaaaguuuuauggguggagauacaaacuaccaugcccagcccccuuccuuucaacagcuagaagagccuucuaaaucuuucaaauugauauuuucaauugaaugugugcaaagauaucucaaaccagccauggcgguagguaaccagaaugccagcuacuugggaaacugaggcagggagaugacaaugggcuaccuaguaaguuuuaguccaaccuaaggaacuuaucaaggaauuuuccaucuccaaauaaaaauuuuaaaacaggcuggggauagaguguuugccuagcacagggaagauccugagaccaaagaauacaaauaacacuaauaauaacaauagcaauacucaaaucuccaaacuguucccagaucuauacuaaaguucuaggcagauaaucucucuccccccaccucacccccaccgcugaaucuuaaccccagcuuuagacaucucugcucaucugacuagcaaagccagaacauuucccuucucuggaaaggguugccugcuucaacagaaaggccugaccgccugagggcuucugcaauggcuguccgcaugguuuucuucugcaaaagaaaagaagaaaguucacuucuugucacacauggcuuugcacuuuaaaacacauugcaugcaacaguaacaucauuucaucuaauuaauggcuaucuuggguaaagugcagaauucaacuuagaauuccgagcacaaaguaauugcugcagaucuaugugcagaauguuaccgaaacauacaguaaugggaguuuugacaauaccgugcuuuuaaagccuuuuaagaauaccaugggcaugucugcaagagaacagugugaaaugagaguauuuaaaaugcaaauauggguauaaaauggaacugagccuuaaccuuuguccguggcagccacuauuggcuuaaucacuauccacucuucugccuugaccagauuucuucauuuauuucaaaauuuauccuuuaagcacaugcuagacauugggcauaugguagucaacagugcuggcacccugaggucucuggaacuacaggggagacuaauguugaauaaacaacuauuuguaaugcugucuagcuugaaaaugggcaaguauaggagugggguuugaaacauucuucuuggccuggcaagauggcugaguguuaaaggugucuaccaccuagccugauaacccaaguccaaugccugggacacacuugauggaaagggagagcagucuucugaucuccacauggacucugaacugugcacacauguacccugaacaugugcacacacccucuauaaauaaaacaauuuuuuaaaaaggaagugucauucucugggucuaguacagacucaucuuggcauagguaagguagacucacuucucuaugugaaauguccugcucacuuggccugcagagagaacuuaauuccccaccccaaacacaauagauacuuuucuauauucauuucucugaauacauuuuaagaccuuuagaguuuauucucugccuggccucaguuuccccauccguggagagccauauuaguacauagcuccuaggacuuccugagaggacuuaaaggauucaucauacaaaaagcauuuaaaauaacacccaaguuccuggugaacacuggcucuugcugcuguuguacaaauuuagucauuuaugcuugagugcuguguuuaauucauaugccuucuucucuaguucauaaauucuugaauuucaggacccuucauuuaugcauccguucacucuagcacuucacagagaauuugacccuauaguagauuucugccuccguucguuuccugcugcugugagaaaauacugugacaaaagcaacugcaggaaggaggggcuuauucugccucacuguucaagauacaguccauugugucugucuuaguuagggcuuuacugcugugaacagaaaccaugaccauggcaauuauuauaaggacaacauuuaauuggggcuggcuuacaaguucugaggcuccguccauuaucaucauggcagaagcauggcagcuuccaggcaggcaugguacaggagagaguucuacaucuucaucugaaggcugcuagcagaauacugaccccccagguagcuaggacuaggauaucaaagcccacgcccaagugacacaccuacuccaacaaggccacaccuccaaacagugccacugccugggccaaacauguauaaaccaacacaaugugcaagaagucaaggcugcuguaucgugaaguaguuggccacacuauguuuacagagagcagggaauguauguucaacuagcuuagcuuuucugauucuguccagcccagaauuuucucacccauguccugcccaugauuaaaaugguucuauuucagucaaugaucgaucgaucagaacaaagauaauccaccacagguauacccacagguccauuucccagauuauucuagauuuugccaaguacacuaugagcaugagccaucauaguaucuaagcaguguuuauuauaagaacauaagaguaaugaauccccacaagcugugugccuggaucaagaaaaguuaagucaaaguauucuaggaacagaguucaccccccucccauacaauuuuguuccccuuguugguaaauaaagagagaaaagaaagaagugcaugagucuaugggacgaucauuugauaugcucuuugucucuucuacguaaaugugugugcuccuuggguucugaggacgacauagaaacuaacugauauuccuuucgauacagccaucauagucuuugaauaggagaacaauguccugucucucuuacuuuaauuauacugagcugcaugcaugagucacauaacacgacgcaaucuucuuuuugucaagugccuuucaucuggagcuacacccacagcauucaaguuaaauaauaaauaaugcagcacaaacuguugggggaggggaagaggggaauuaaauaacuaaaacagaggaggagagccgugagcauaaagauccucucaucagauuucagagggccuccaacuccccauacugacuggauuguuugcuggugguagagacagaagaacgggaauggagaugcgauuuagcaaauggcugaaacaacgguuuugauuucaugguggugacauaguuacgccacacucgucaugcugucuuggcgcuccagauacaccacacagguuuucacucagaaggacgugucucaacagacaaacugcugcagccccaccuccccaccccguauuguuuggggauaaucugaaugucaguagggcucugaugggcacuguggcauccacccaugucuaaaagggagagagggagaggccuaauguugccguguggagaaggaaccuuugucaauacucaccagcugccaaguauuaucauaaggccuucauaggcucugguucaggcuugguaaacuuuggccagauccaaauuugucuguggccugucauuauacagccuaaaagccaauaauguauacuuuuuuaaaaaauaauuuuaaaaucaaggauaauaaauguaagaauaauuuguaacuaugggagguacuuuagcugguagaaugauuacccagcaugccugaagcccugagauggaucccuagaaagguagagggaggaggaucaggaguucagggcuauccuugucuacuuagggagcacaaggccuaccuagaauacacgaaacccuaucucagaagucgaggagaaagaggaagaaaaggaagaaauuaugcgugguuugcaagagggcugcuggaugcuacucuagcacauuaaugcagccugcacaauaacgugagcauuuacuauccucacugaauaauuuggacacugggucuuagaaaggcuaaguacuuaccugauacucaugcagcuccucccugugacugagagccagagaucagaaacacaaauccuugcaggacuuaagugggaaaacaaaacaaaacaccuaauguggacccaggaggacuaggccaaugcggagggcacacagcccauacaaaagauggcugcagucuccuugugcauaaacauaggaguguagaagccucuugaacauaauauaucuuuccuucagauauauuaaaaauaaaauaaauggggacugggaagacaguucaaucaauaaauugcuuuccauaugagccuuaagaccugaguaugguccuugagaacucaagugagaaacuuaagcacagagagccauggcagaggcucggccauagauacaucagagacuuggccauagauacaucagagacucggccauagauacauaccugcacauagcugcugagaucacagacaucaucugcuucacuugccugaaagucagcuugaguugaacuugcuuccagaauggugaauucuagaagaguugaucaaguggccaaagcaaaauaaagaugccagagaguaaguauuucauauuuuuaggucauaggcuauagguagcaacugacagagugaccccugugugggagggucuuuugcacauuucuauguagggaacacagcauagccuugcugagcacuacagggaaacaguuccaugcuuugagagauuuguuuuaaucauuacagugcacgugcacgcgugcgcuugacauagcacauguguggaagucagaagacaacuuguggaaguugguucuuucugucugccacaugugguccaggcauuaaacuuaggucaccagccuugacaacaagccccuuuauccacugaaccaucucuccagccuuaugccuggaagucuuguauacuccagcauaccugcuuagaaugccagaggguuguauucagagaaggcacuagaaucagugugcacagugaaugaugaggauacgcuuggcucagcaagcagugaaaaaccugcccuccgaacagugguaggagagugguagaaucgugccaaggacucccgagcaagggcauagugaaggcaggagugcccaccguccuguauaugcacacaggaaggaaacagugaauauaucaugguucuuaugaccucauuugugcccgagggaagcaagauugcaugcaauggggcauccauagagaucaauacuugaaaucugguccuugugguagcaucagagcaucacuugggagcuagcugacuaugcaaacuguagccccacaccaggccugcuaagccagaaucuguaccguaaccgugcaauacaagauccucgguggcuugugacagcauuaaaguuugagaagcucuggucuuggcuguaggaguacuuacucuggggagaacuagacacucugaccuugugaccugccacgucuuuauugugugauauugaccuaaaaucuuaacucuacacaucagccuguuccuuucuggaacaaaauaguaaaaauauacaugcacagaugccuggaugcucaauugagacaacauuagaagcuccuugacauauaauaaguuccugcuaaauaucaacuucugucauagccaucacuaucaccacuauuaccuuuuauaauucaugacuuuucauuaaaacauuuauaaaggaagauccucuccuuccauguaggccucaucaucuuuaucauugacccaguaagcuuuggcaccaaucuagccagaaauuguaauacugaaaauauaugugacuggcauuuauagauauucuucaaagaagcaggaacuaagauuacuggcaagacaucacccuggugguuuucacaacuauaagacagacaugcuuaucugcacugcaauguugagggcgcuacucaggacccccaacuccuucacaggugggauagucaaugacagagacacguggccacucagagaagggacucaagauucuggggauagcuuagugaaaucucugccguagucuccugcagcucauggagguuaaacacaucuuuaacucuuguuucuucuguaauaacuaccaacacuacuccacaagaaagaaauauuaaaagagacacacaaccacaaagggaaaaauagccaagaagggaauaguauuuuagaacuagagcuggugaaaaagaaccaacugacucagcagcccugccaauguggcuucuaagcucucuguagggagagccuguggguaucuggcugucacugcagagccccagggauccuuagaaaugggaagcuuggggcacuuuuaacagaacuggucugggaagaguugaaaguggacaggcugaugaacuaucuccagcuucaccucagucccacacgauccuggguaccuagcuguucgccacagugcucgggacacccuggaucccugggaaaucugucuaauaaaggaaguuagaaugugcugagaaaaggaacaaaaguaaaugaaaacuguuuacaguggucaggccagcucucuacuucuccccaugcuaggcauuuggaaaacuuuagcagucagcaucuuccgcccuuggaagagacugaaauaaacuuucuaaagaaaccaagaagccuguuauagagucaccaagaaaauuaccuugccagggcaucccaccagcagcaaauauuacucuagagcuuggacuguucaacugucuuuuguuguuucuguuguuguugauugcacauauacacaccuagaccaugcaaauaugagcauacucauuaaguggugaacagcuaaagacugcucucauucucucucucuuuacauagaucuguauuaaaacccuuuuuauuacuaaccucaaauauagugcaaggaaaaaaaacacauuuauacuauacaaauacauaugcaagcaacucuaauuaaaaaucaguggguuauugacagaagaaaaaaaaaaaacuaaaguaaaagcucccuuaggagauagggagaggguuccaaagugugugugugugggggggggggguaagauagaauugggguugaauguugucaucauacacuauauguguguaugaaauugucaaagaauagauaaaccucaaagaacacagagacaaggaugagaauagcaucaacaggaguguucauaagauacauuguuagcauccuuagagauguagccugcaugaaauaaggaggcuauuuaaagagaagcauucaagcaaccaaaacaggcuccugacaauuaaaaacauaacagcagacgugaaaaugucaacagaaggguuaguaggcaaaacugacaaaaauuucccaaaaguagagcagaaagacaagaauauugaaaauaagaaagagaaaauuuuaaaaugagaaaccgucuauaaguucuaguauuugguuauauuaaaauuugaauacaaacaaaaaaaauuaccaaagaaauaaucaaagcaaauuuuagauuuucuaaaggugaaaaaaaagaacaaaacaaaacaaacaaacaacaacaacaacaacaaaaagccagcaacaaccuagcacaguugaugaaauaaggcccacugaaauaaggacccagauauaguugucucuugugagacuaugccagggccuagcaaacacagaaguggaugcucacagucagcuauuggauggaucacagggaccccaauggaggagcuagagaaaguacccaaggagcuaaaggaaacugcaacccuauagguggaacaacaauaugaacuaaccaguacccaggagcucuugucucuagcuacauauauaucaaaagauggccuagucggccaucacuggaaagagaggcccauuggacuugcaaacuuuauaugccccaguacaggggaaugccagggccaaaaagugggaguggguggguaggggagggggggaggauaugggggacuuuugggauagcauuggaaauguaaaugaggaaaauaccuaauaaaaauauuaaaaaaaaaaaaaagaaauaaggcaagcauccugugacuucugaaauugaaauccaggaaauggggacaggagagauggcuccaagccuggcuaccugagaugaauuccugggaccuacaugguagaugaagagaauugaugccagcaggcuguacccuggucucacccagucaccauggauguacacacacagacacacagacacacacacacacacacacacacacacacacacacacacacacacacuuacucagagagaggaagggagagggagagagaacaaugaauaaugguaauauuauuuuuuuaaucugggaaacugaagugcuuuuaaaacauccagagauggaauaagguaagagagucacacucacaagacaaaauccggacaaagagacaaauacaccagacuccuugauagcacauagaagacaagaagccauaaacauccugagaaugacagaaaaauugucuccuuccagaguucuaggacaagucaaauuagauauacagguuuccauguccugcugcaugaagagcaaaacaaaggggaggauaugugaucacagaagucuaagugcaaccacuaacuagagagucaucacuaucuccaggaauaagguaaaggagauccuaaaagaguguccagcugcaggucagaacacaaccagcccacacuggggcagaggggaugauggaaaaugagagaaacacacacacacacacacacacacacacacacacacacacacaugagagaaagagagagagacagagacagagagagagagagaguugggggauagagaauaaagaaaggaaauuaauagauuaugaauuaauagauuauuuuauagaugggauauaucaggagguuuauagcuuggugaaaaguugggggaucaaagaguaucgauccccaaaauguugaacaaccaugaaaaaaaaagacacaacaggagagacacaaaacuuaauacaagaaaacuauauguacacuauagaagaugauauggcuuaacggagaauaauuuuaacaaaaucauagcaauaaaaacaaugacacaaaguauauuaguacuuucaaaaaucaaaagcaaucaagaaauugcaaaggagguggauuauugagaaauguagaaauaaaaaugguuagagacagcugaaacagaaacuauugcucuuagggagagaggacaucaagccaggugagauggugaauuacaaggcaagggauguccauuuugcaccagauccaugcaggauauuugacuuuauuuucuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggauacuuucucuagcuccuccauugggagcccugugauccauccauuagcugacugugagcauccacuucuguguuugcuaggccccggcaaagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauauuguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccaguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucagguaagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagauuuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggguaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuuuuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccugccgggugggcaccuguccuccgguccggaagguggccggcuguccccggcccacacagggugcugccucagcgccucugugcuucugccuguuccagaagcugucagguucucuggcgcacccucucaccuguucagacuaauuuccuaaguucggcgggucucggaccaagauggcgaccgcugcugcuguggcuuaggccgccuccccagccggacgggcaccuguccuccgguccggacgguggcuggcuguccccggcccacaaagggugcugccucagcgccucugugcuuccgccuguuccagaagcugucagguucucuggcgcacccucucaccuguucagacuaauucccuaaguucggcgggucccggaccaagauggcgaccgcugcugcuguggcuuaggucgccuccccagccgggcgggcaccuguccucugguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggucgccuccccagccgggcgggcaccuguccuccgguccggaagguggccggcuguccccggcccacacagggugcugccucagccccucugugcuucugccuguuccagaggcugucagguucucuggcgcacccucucaccuguucagacuaauuuccuaaguucggcgggucccggaccaagauggcgaccgcugcugcuguggcuuaggccgccuccccagccgggcgggcaccuguccuccgguccagacgguggcuggcuguccccggcccacaaagggugcugccucagugccucugugcuuccgccuguuccagaagcugucagguucucucgauauuugacuuuaaaaagcuaugcucaugaaucacuuugauaagaagaaaaguuuacaacuuugcuuuuggucuguguuugguuucuacuggucuuuacuagcuuagaucccuacauugcugugagguagcuagcagcaucuuccccauccccaacagccccagucccaacuucccaccccauugugugacaaaucugaguagagguauagugguuucauagccccguccacccacaagcagauucugugaacagcaacaccaaaucacuggcuguugggcugcucaggaaugcugggcagaaaaggagcagcuagagagggacagggcaggcaauuccucccuagccuuugcagcucaugggaggaguaacagaacucccaagucccucgugcugcacacacauacacugaaauugaauacuauuuauuuuaucaaauuucucuccaauguucagauauauguggaauccuaagggucauucacacacugcugaaaauagguuauuuaugcacuucuaaaaauauuggcauuuaugucuuugggucccaugcugaaggaaguucugggacagcaucauaauuaagggagagagaguaacaaagaucucucccuacugucaagccauacagugaugaccacugaaaauuaguuuuacgcaugggcuggggcacucgccaaccauugggcagcacugacuucuaccuugaguuugugaucugagcuaccuuuaaaccucuucuugcuugccuugaacccaugaagauccaacugucucugucuucaagcacugacauuaaagaaguguaccaugacaccugggcuaguuuucugacuuaugaaacaauauuccuauccucucucacaagaaugcugugaucaugaaagauaauaaauauuuuguaaauaguacagcacucagcggaugucauagauuaucauuauucuagccacguguaagauggguaguuuauaauauuguaauuuauaccaucugguuuauuuuggugauuucuuaguaauggguuuuuuuuucauaccaaaauuauaaaaugggcucauuguggacauuuuguaaauaauaaaaagcaaagaaaaauaauuuaaaauuuaugcuuaauuucacuaucaagaauauuacuacuaauccauaccuccucucucucucucucucucucuuucucucucucucucucucucucucucucucucucucucucacacacacacacacacacacacacacacacacacacaccuugccuacuuuuaggagacgcuaaaaagccaacuuggaaaucaggcaacugaaaggaaaaauaucagaaauguacccuaccuuuuuaagauaaccaaggaguucaugagaggucauuucucuuuauagaaguauucugcuagaaagugaagagggcaugauggacgaucaccucuucacaaccuccaguggaaugaugaaucuggucaaugagcaccaaaggcugcuaacaucacaaagacagauggaagcacacucuaccaucuauaaagugguccugccaaaaaaauuaacucuccaguggaccaagccucuagaaugaacugcaaguuuacaggaaagaaaaaaagaauauguuaaaacacccccaaaagaguauaaucaguaacuagauuauaggacacucucugggauaaaucaguaacaacucauuuacaagagaagagaaauagauggcaggaagccuguagauccaacggaacccaggagaccucucagucaguugcagccugugggauucacuuggauggcgccacaaacaaacagacuaggaaagaagacuugugaaaaugggugauguggauagccacuggauacuuugauucuauuaaugaauuccuguuguguuuuaauauaaaaccuauuauuguuaggcauuguuaaaauaucucauauuuauaguaauggcuacuaaaauauuugugggcuaaaggaaauaguuucuagaauuuucauucaaauaacaugggaggguguaaauugacaucaauaacgagacuggaugggagcugaugggagcuauuaauuacugcagcuaggugauggguauagucaacuuacccacuuugcuuggaaugcucaauaauucauuaaagaaaagucacaagaccaaucauagcaaguccuucacaaauucauuaaauauuguucucuggccucuacagguacaauaugguccauguuuguuuuuuccaaagugaccaaaaaucuuaccuucuucuggguugcuuaacaauuaacuaauaugaaaguaacaauauaauuuaccuacuuaacauuugggggcaaaugcugugugcuuuaccuuaugcuauuuaccugacauuuauuuaaaugaauauuaucacaguuucugugauccuuacggucaucuucacaaagugucacauauggauaugcugaaacagcauauaucugugaaaaauaaggguguguguguguguguguguguguucguguguguguucagauagucuguacauaguaaaguguuuggaauaguguuagguccuauuauuacacacacacacacacacacacacacacacacacacacacauucauguuguuaaagccagaaaauauuggaugauggugacuugggaguagcaacaggaucuucaagaaccuagugugugaacacuuguaaagugccuggucuguguaguguagugacucacaccauaauggcucugagacuugaguggaagccauucuuaaagcuuuaguguuugcuguugguucccuccuugguuaucucugccacagguccuggaccaauacaguucucauaaggccaccgaauucuggaaguaggggauggaacugauuuugcagaauaucagccccagcuccugacccaccucgaguauacaagucagaccuguguagguggcaaagaagccuguuaagccagugacaagaugcagcaagagggaaaguggcaggauggaggccuuggaggaacagcagccuuugugagaacauuacauggcaucaagcaggcugaagagauggaaaggcauuaggauuccuuugaggaaagcccugggaacgacaggcgaggucagcugaugcagaaccacugcacgguggggccguggggacguggggacggggagaagguggcuacucagaaggaaugcuuccuucugcuacaaaauuuugccagcucgucaccuuugaccacgacagaugcugcuauuuucugaccaguguuuucccugcuaucugggagcaaaugucaguggaagggcacaaucugacaucagaaucauuacgugcucaucugaagcucagccccacugcccgaacugcaugcccucaagggcagagaguauagcguuggcaugaaaauggagugaauuaauggaaaauccccagcuuucaccaguguacauguacugaggcuuucguaugcucugcugcgccagaacaccaggagcccaccuucauuuauucauuucacaaguauucacuuaacaccuacuuggugccaggcauugagcaccacaguagcuaagacauagcauggucauuucacucaugcaacuuaaacaucuuacagcucgaaaacaaaaggaauguacaaacaagcaauugcaacuccauugugagauuugcaaugaaggacauaagcaggguaguaucaugagaaucaauguguucgccuacccucaacaagcuuaaauaaaccauaaauggcacuucacucauuuccuacuaauaucaauaguuccauccaccuaaccaauacaguguguggucagguauagucucgccaaagccggaaacuaccuuuggcauuuaucagaacauucuuuuuuuuuuuccuaauaaaaaaaauuguauuuacuuagaagcauucagaaugucaacaaaacagccgcaauuuuuuuuugcaauuacagagugguauucaguuaacagaacaacaauuaucuucguauaagcugcaucggagacaacugaagaugaaaaaaauaaaacccaaaaagaaaaccaaaagaaaaaaaaacaaacaaaaaaccaaacuacuguccccauauauaacuaauuugugcugugcaccaacaagaaccugcuuuaaauuuccaugccaauuuacaacccccagacuguaccaggcaagguuaguggcuauuuaaaaugccaccaggacagggcuaucuaaagacacauucgguaguguguuaacuauacaaaaaaagacacuguacaguuuaaaaacaaaucuuacacagccuuacauuucaauuuuuuucuuuaaaaggagugaguuguguacagggggguuaaaugcuuuauagacaagaaaaaaaaacugcgcuagaaccaacuuauucaucaucaucaucuucuucuucaucuucgucuuccucuucuuccuccucuucuucauccucuucauccuccucaucaucuuccucuuccuucuuuuucuugcucuuuucagccuugaccacccccuuuuucgcugcaucagguuuuccuuuagcucuguaggcagcaauauccuucucauacuucuccuucagcuuggcagcuuucuucucauagggcugcuugucaucugcugcaguguuguuccacauuucuccuaguuucuuugcaacaucaccaauggauaagccaggaugcucgccuuugauuuuggggcgguacucagaacagaacaagaagaaggaggccucuuggguacauugggguccuugaacuucuuuuuggucuccccuuugggggggauguagguuuucauuucucuuucauaacgagccuugucagccuuugccauaucuucaaauuuccccuuuucuuuagcagacauggucuuccaccucucugagcacuucuuggagaacucugagaaguugacagaagcauccgggugcuucuucuugugcuccucccggcaaguuugcacaaagaaugcauaugaggacauuuugcuucucggcuucuuaggaucuccuuugcccauguuuaguugauuuuccuccgcgaggcacagagucgcccagugcccguccggcucgcgcuugccccggcgcugucucuauggagcucaauguacugcaauggcugucuuaucagaacauucuuagaauaggaccuucagcaacuugcuuaacuucucuguuucauuuuuaaauuacauguauuuauugccuauaugugcaucacacgcauaugcacgacgugccaggauacuaguguggacaucaaaggaugucuuagugagaguuauuauugcugugacaaacacgccaugaccaaaagcaccuuaaggagaaaagaguuuguuagacuuacacaucacugcgcaucacugaagaagucagggcagaaacucaaggcaggaaucuggaggccggagcuggugcagaggcuauggaggaaagcuacuuauuugaugguucccauggcuucuucagccugcuuucuuacagaauccagaaccaucagcccaaggcuggcgccacccacaaaggggcgggccccacccucccccaccaaucauucauuaagaaaaugcuuuacagccugccugcagccagaucuuauggaaguguuuucucaguugaggcuuccuucucucagaugacuauagcuuggaucaaguugacauagcacuagccagcacaaaugacaauguaugagaguuaguuugcuucuuuguggaacccagggcucagucucagguggccagauuuggcagcaaguuccuugacuugcugauagccuuuugcuaguucuugcuuaacguccccgugucucaguuuucucaccuauguuguggaaauagugacugugucgaucacauggccuggagcuacaacugaaaugagguaacccucuuugcuguuuuccagaaguguucaggccaugcagggucuauuaacauccguuucuuaauucagugaaggaauuuuugcuaaggauguguaaaagccagauaggccguaaggagcagaguggaggacaagauccaaccauuucccuaaaagaguauuugugaugauccuagggcgugcuccccuuacuugcagacaguuuaaguugucauuuauucccaaauaccagcuucucuuuccaucaggccgaaagacagcucacggguuagauaggcaggcagcacagaaauucacugagucagcuggccagagaguagucauggcuuccccucuugcuuuuuacaaaugugguugagcuagaaaaggccaggaaccggggguggggugggggcgggggugggggggugucuucugacaccgacuguccauacgcugcggagccagcaggggggaguggggguggguucaguacucucacgcccuuuccuuggauagcaagaggaucccacagaugauacauccgggaagcuccaggccacacccaaggacuuccaggaaccuucccgguucuccucagccuucacuacuguucagcauucagcucugaccauuucuaggcggugcccccuucuccuucacaggcucccccucagggugggugaggaauggaaagaauugcagauguagagguuggggaaagauggaaggagucggcuugcuuaggugcugugcuauuguuauucagguuaaggaacauccagucucuuaugcuaaauaucucaacagggugggcauucaauggggagcuuuucuagggagcuuucuacuuacauuuagcugccugaagccugggggcgugcccugacccuuuccuuacccucuaauugugaaagucugccggggccuaucaguggguaucuaaauccuaugaaaccagcuuggcauuugauaaaguaucagacagacagcaggcaugaagcauuggccgcucccccucugugaucccuugccuggaauucucacauccagcaacccuucuguaguaacugcuggucuccaaacagaaguuguuauuuuuucaaauaaauauguuuccuaauuaaaacuugcccuuuaaagacucacacguucuuggccccacuuuauguuuuccuuuccuuguaacauauuacagaaucaauaagggcaaugcaaauaucuuuaauauauacagcuccaacggcucuaauaacgcaucugccuccacacaaucgcccucuccccucaccagcccagcugauaauuucugcugauuuguuaaaugccuugguauuucacucuggaugauaaagccuggaaggcacuuagcucuucaggggauuggggagggcacauugaaaagggacaaaguggaugguggagauuuccagccaugucugugguuuuuaugacaguucuuauaaacaaggaacaauuaguauccgaggcagagaaaguacagaaagaaagaaaagaagaaagagagaaagaaagaaagaaagacagaaagaaagaaagaaagaaagaaagaaagaaagaaagaaaaugucuauuacucauaaccccaccauccucagucaaaaauuugacaauauuuuuauauuucuuuucuuuuguucccuaguuaauuuuugcuagaggauuucaaaaauauaauuaucaauuuugaauuguuuuaaauuuuguuuacaaaauagcaauauccuaacggacugaaaacuagaccaaaauauuauuugagaguauacacauaauacucuaacgaaggcuguuccaauauuacuuuucuuuuuuuuuucuuuuuuaaauauuuuuauuagguauuuuccucauuuacauuuccaauccuaucccaaaagucccccauacccucccccuccacuccccuacccacccacucccacuuuuugacccuggcauuccccuguacuggggcauauaaaguuugcaugaccaaugggccucucuuuccagugauggcggacuaggccaucuuuugauacauaugcagcuagagacaagagcuccuggguacugguuaauucauauuguuguuccaccuauaggguugcaguucccuuuagcuccuuggguacuuucucuagcuccuccauugggggcccugugauccauccaauagcugacugugagcauccacuucuguguuugcuaggccccggcauagucucccaauauuacuucucauacuugaucuuuuaugcugguuuuugaucuuuuuaucucugucuucauuauuauaaaugauguaaaucuuuuguauauuauaccgugucccaaccuuugguguaauacacauacacuaagaaggucuucucuucucuucucuucucuucucuucucuucucuucucuucucuucucuucucuucucuucccuucccuucccuucccuucccuucccuucccuucccuucccuucccuucccuucccuucccuucccccccuaugucucucucucucuaaugucauuuguuuucuguggccuuagagagccacacaggagcaugaacaaaugcacuuagcacacaguuggacuaucaucugaugacaauggaccucauuuccccucuacuuccuucugaacccguuccacacugcaaggaauucuuccaucauccaccaggauaaccaaacugaagaaagauuguuaccuuuaacuucuagcccaguccccucuggguggccacccaaaauguccaccucaccauacaaaccuacuugcucucaaaccucuucucuucuucaugacaaaugccuuaguuuacaugaaucgccuacuuguuucugucuuuugucuucucaaacuaccccauuccuucuuuuucccucccuccugcuuccaaaucaucuuguuucaacuguacucaagaucacaucccucuccagcuaugaaccaucaauagcuuucccccaugcuuucuucagaacccuuucucuuucaaccaugccuacugcucuaaccuugauccagucguggccuacagcuucccuugugcuugugcaggcgccugaugcauuuaccuguccuguucucuuccaggcugagaacacagccccucccacuucacaguccagccugcccugagaagcaccuccugcaggaagcuuucccuugcccccuaagccaggguggacagaucaggcucacacugcugcuuccaggcaucacaccuucuacacugugucucuuucuaaaggcaaggauuggcccuacuguuucuuucuuuuuugaacuucuaaacauuucaguggcauguuuauuuaaauaagggggaggagucuccucucuaaccacccaaacuagaaauuaacauggacguaucauuauauaauuuaaauuuucuuuaaccuaugccaaucccuccacuaaugcucuagucaggcucacaugucacauuuauugucauaacaacuaagcuguuucuuuaucugagacuacucuggagcccucugucaggacuuugcuguucuugaauagugcacagcacuuacauggaaugacccucaguuuggaguugucugacacaucucaaugguuagauucagguuccuuauuugcuguagagauaccacagagauggcauuauguccugugcaccacaccagggggcacaugguaccugucacuaucccugugguguggacucugauguuuugaugaaggaggaguaugacaaaauuuucuggucuaaagcuaucauugucuccuuugaagugaucugcauccuguuuggaaauacuuugagacuguuugaauagcacauuucucaucaacauccacugcuuucaaaugcaaguccguuuccuuaccaccucaagaaugugcagaagcugaaggcgauuuccaaaguuuucacucucaagcacccccuucuuacccccaccucagaccuguuguuuuuuaaagucuguaagugccacugacggaacucucucucucucucucucucucugugugugugugugugugugcguguguguucuuuuuuuucucauuauguuuuuaugagauaugucuaggacacugaaauccagaaggcaggaaugauuggcuucauacccaagcagccagagccccauuacacaccugccaaagacuaaauggucaacagauacucguugaaggacagaaugugacugcccuucaugaugguagccagcauuugaugucugcagugaggacacauaguugauaaaugccacccaaaggcuugacauuuuaguaagucucaaaggcuuugucgcuggucaguguucacucaucgugaggauuuuaaaaauagauugggcugauuauaaggcagucugcccacaucguccccauuuuugccuuuuugcaugcagaagcaaggauguacugagacaccuacuaccccaaguuuauauauaaacuuugugaucugcacagagucuccagaggcacaguacccucuuguuguuguuguuuguaacagccaaucuuuccuuccacguggccugggaaucaguacugaucaccuauccauccugaaacacuucuuauaaagguaguggaagaugggagauggaaacuaccucugaguacuuucuaugcaccucagugcuuucuguccauuguucacucuaaggagguggcuagaaccuguuuuguagguggaaaaugaagcuaggggaagggagcaugaagcaggcuuuaggagggaauuucuuuaguuucuccaaaaagccuccgaguucaagcggugucgccaucacagacaaauguucuuccuuugguaaugugcuggcaauuaagauccagacucaugaaggacagaaauuccuuggacuauauucacugucaucccuccucucccccaaugauugccaucacgacuccguagcgguuaccaugguuuuggggaagcugucccaggaaagaaggccuuucuuuaaggcaucuugcauucccaaggaaggaacuguuaauuacuucuggcgaaagcaacccaggaaaaguguuggagguguggaaaaguauuucaagggguuaggcaagaagcagggccaaggacuccaagagaggugugaugagagagaagagcccgggcuacacaauauacuaauacacaacucggaggugggcaagaaaacaaaaaacaagaggggaggaaguggagaaaaguaggggcagggaaggagaaaguuuucgaaagacugcgaggaaagcgagaaaggagggucaaagaggaauccgagaaaaauacugaagcacuugagagaauuccagaaagaaaaugagaugaggaaauggagaaagcagcucagagaaagggaggacggagauaagggaaggcauggcacacaacagagaugggugagcggaaaggaggccgagugggcacgggggaagggggcgcaucaccuguguggcgccccccggugccguggugaagcccuguuccaagcgccgcucggccggccucguaggauuggcucccgccucccauucauguaaccugcgugugugugcgugugugcgcgagugugucucgcucgcucacucgcucgcccuguguguaagagagcgagggagggggacgaaggcaggcaggcgagcaggcagggaggggaagaagaggagggaagcuauuaaacacacacacucacacacacccgcgcgcgcacccccgccccagcccccccccccccgaagccucgggauugcagcuguuacauguggggcagcagugcuggcaggaacgccggccgggagcggccgggagccggagcccggcgugcgcgcgcggcuggaggcucgcuggggcuccgcuccccgcgggagcuauuguuggucucaccggagcugagcucagaaccgggaccugcuccgucuugggugccucaauacaacucgcggagcggcggagccagcggcgcggugccucgccuccccgccguccucguccacgcuuccccggcgguggcagccugcagccacgguaaggcggcgugaucagcucuacggaaaaagcgccuuggggaccacggcggaggcucgccaguucugucgccccucucugcauucgcagguccgggcagcucaagcagcuugcugggggcuccgggagaugcuagccugcuucccugcuccgcacuggggagggagggaggaagagaaggagagcggggcguccagguugccgacaaggcaaggagccuggagcccagagccuccgccaccgcagccccgggaguccgccgcguacuggagccugggaaccaguguugggggagagcggagaggugggagccggccccagacucuggaccgcgggugggauggagguuagcucgauccagguucgugugcuacgccgggauccccuucccugccacggcccagucuccugcagccccucugcagacucgcccgccccagacucacggcgggcgcuggaggagcccacgaggcggcgccgggcucccgcucugcaaccugcccugcggggcgagagcuggcugcagcggccccggugcgcgcugcgguuagagccgguaacccggggacgcgacccccaagccgcacgcccucugccacccgcuuggcuccugcccaucuucgccggucgcgucguuucucguucgguuugucucggaacgaguugaggacugcaggcgccggguggacucucuaggggugcagggcugugagugugugacuacuugcaccuccagcuucgggaaauaugcuguguauugaaaugugaucucugagcuccuuagucauuuuccuagugauuuaaaaaugcagucuuugcaucggagaagcggaagaagguggugucgcggaguguguguguguguccacaccuaacccaggaauaucccaauaacuauugggggagggggguaaaggguguuaugaauggucaaugccucuuggcggguccguagguggguuucucuggccacugcccucuucuucuaugcccuacccgcccccuccccaucccccgccuaaaccagguuggaaaguacuggaaauucaauugcguggucucuaacuuuggaauuugguaucccuuucagcaggagacguuaagacgauuucugcacuugggucuguguggacgagaguuuugcucagguuagauguagaauccgccucagaccugcaccaguccccuacccagucgccaccucuccuccaccccccacgcacauacaacacaacccuggagagaagguuuguacacaugcaguuaaccguaagccaccaacgcagcuauaaggacgcagagucagcccggguuuugcgggcaucugagcgcacuauuggcguuugauuagcccuggagaucacccugcugcuuuguagaggcgcugguggggcaugcucgugauccccagcgccggggcuagagggugucccugugcugagcuguacggccgugcucggaggauguucgcugaacaguaucaugggcaauuauauaagcugccucagugaucucccagaucuguauugcaagcacccggcucuugaaagacaacccugaaaguuuuacugcuuggggacuguaaguaccugggagacccacuuggggaauggggagcuggguaccuugugccgaggugcccacuucugagaugugggcuuugggugcuaaagcucuguccccaaggaaccgguuaccgaagcagggacugaguggguggagauccaagauuaaccugugaagaagaacgggucaggacucagauuucuuugaguccguggagcccugagauucagguguuggagguguuguguggggggguguuggauggccuuccagggaacguaguuuucggaaaaucgguguucuaggcagccccaagacucuuuucuuggccccucccuggcuuuaaauccagcguccuucaccuguuuagaaaccugccuccagucccuuuuagaaaugcccagagacgccaggcauccaggcccagguuugggguguuugugguggguuaggaaguagaguacuggccucuauggggugcggggguggacagaaaaaauuauuauaccuaaugcggaugcuaugggaaugggugccugauauggcuucuguucccucgccucccuccaggacugaaaacaguuugguuucaacugcgcuccuuuccaccccccucccuccuaucucgcugccucccuucgcugccgcagccugucgcacguugaugggcuuugauagagaaccacaguaguggaguguuuuuaaaucuuguuuuucgccuguagagggaaaagcuaucccagcccuagcagaaagaacccugaggaacgcugaagucuggggcuugguggcccugaacucccucccccaagucagaugauagcgugcauggguggggaggguuuuguuuuugccacauuccgguguccugaaacuccgcauccccuccccccugaaaucccgggucugucugaguguguucggcgcuguaaaauaaauccucccccgcgcagaccuguggggcuguucggauuuccugccucugccaugauccuuaacaaugcgauugcaaagccagugcagggcuggggaaaaauccccaggugccgaccagccgcgucuugaccuugcugaaggcgccuuugccuggguugccguagcggcucuggcccagccgcuggggcuagggaaggagugcaccccggaggcgaccggguucgcuaccagggcacggcgggaaucgguucucagccgguuggcuugggggaggggaugggcuuggcggcaaccuguuucccagcucuuggggcccaacacuuagcuucccagcccugcugcuggcuccacgugacuaacucuccucuccaucaaccucuagaagccuccgggaugggguuuccaggauuggcugcggcccccuuuucgccaaccugggacugggcgcccucggccuuggggcuuuuuuuuuuuuuuuuuuauuuugguggcccgaacagagcuccgcucuagaggggugacggagugggcggggccuaaucaucgaaacccgagcuguggcggcccaguuccgaccaggagcgcuucacaguuggggugcacuuaccccucccuuucaaugccuggccacuuucuuuaagacccugggugagcuccuggaggccuguagcuauacuucccggcuuuucuaaauguuaaaguugagaagagacuguuuucacaggugguaguagcgggagcaagcgcuuucucucucucucucucucucucucucucucucucucucucucucucucucucucucucgugugugugcgugugugugugugugcgugagagagagagagagagaaagagagagagagagagagagagagagagagagagagagagagagagagagagcgagcaguggggugggggugggcgguuccgaccaggccagacucuagcaugaaagccggauuucgcucuuucuaggagcuguaggacuacuguaaagaaccuguuuucuuuggugggggugacaaggaaacccuuucuccuagugggacugggucugugccgcuuguccgcucuugugacuguuuagaguggggaugcaacuguaucugauucgguagcagcgaaaagcugcuggaauggguauuagagugagugggauuagaggcaggacaguuugugagauuacuguucugggguggagaaggugucagggauggugagauuccauucucuagagauuccucauguucuuggguugccaguccugcuuuuuuaaucaagucuucuccggguggaaguaggcuuugggcauuaagccaugaaaguacccuguggaggaaagagucagucuuugcuaaggguuggggguucacaaucagugcuuaguuuaaggaggaacccugagaguacagcaaauggaaugaccuggaauuguaggcagugagcagagguuuuaacagaaggguagguauuggguuagaggacucuuuccauuagaguuuaauucuuuuuaguauaaucccuucagccuuucgugggagcuuuuuaauggaggugggacuuacagauuugggggauugagacugugaggucuuaggcagguuuuguggggagggccacuucucuucugcaaaauaugauacugccaucuauucuaccguucuguaagaaagcaccggcacccauuaaacuucgagcaagugucaccggugaucauucuuaccggcuucuuucaacuuucuccaaugauguacauuuguugggugagguuaggcauggaaauaaaucaacagcgcccaaagaaccagcaacauugcauccaaagucuauuuaaaaccagcuucaagugcuugacacaaaaauaucuucucuuuucuuagaaaagucauuuccaguuuuguuagaauuugugcuucacugggucccuuucuccugacagaauuccauccuugugcagacugguguauuauauaaucugguauuuucagaucagaaguuacaacucugagaaaagaggugaucaggaauuuaagcaaaagauugcugggcaacacaaaugagggacuugauguaagaugcucauucacauucuaacugggauggagguugggggagaaggagauugggcaagcagucaugcaaaugcucagccaaguccucugcugccugcugcuccuauucugacagcugcuccacccaggcccagccuucagaugcucccaucccagaauauucucccacacccauccaucuaucuaaacagugacaaacaaagacacaaugggguuuaaaaucaaccccuuguggguuugauucgaaaagccucgcuggguaaaucaaagucaauuuuagguccaaggggccaauuuuuaccugacuccuuaaauaguuuaucacacaaguuuauuguaaucuaaucgagagccaaaucacuccauccacuuugcucugagagacaacuguaggagccacuuugaaaguagcaugcccuagaucccaggcagcuaagcaacacagauucccaaaccuaacaacuuucuacaggaaaguauuuaauaaaacuuguaaauacaaaugugcauauguguauaugcauguuugcacacauacauauaugguguguacuguauggguuuauggguuuauuacuuuaugguccuuuucuuuguuugcucagauuacccagguaaaauguuaucacugaagaaauucagacaauagagacaaagucaaaauaagcucaauugcuguugggguugcaucuugagacucuaugaguacagaaaaagugaggucauauaguauuuugaaugcuuguuuauauuuagugauaaagcauauagaucuacccuguacccuguuguaacuccccucccucacagcaacaguuccaguggccagauguuuuaauauagagcccagauguuuuaauauagcgcgcuuucauuaagccaguccacacuucuugauuucuuguuuacguuuaguauuuuauuguagcauaaccacagcagucaacuuuguacauuucacagaauuuuagcguuuccucaagacggauuccuagaaaguaggguuguagagucaaaggcaugugcuguacugaagcucugucacgcuugagaagcagaaggauaaacuguguugucuacaucuuuuuaaccagaaucuguuuacuuuccaguccccucuaagcuugggaacugaaguggugggggaggggagggagucacaugcaaaccucauaaaaagaauccgaauaacuuugcaauguuuuacucaacugauaggaaauuccuuuuuuuuuuuccccuccaagaauauuuuucuucccugguugucuuggaaugacuuucucugaggcuucagccagcaguggaguugaaauauguaaauauguuccucagccuuguaggugggguuggcuacaugauaaaugacaaacaguucccuggauaagugagcauguauuccagcacuugcugggaguggagaucuacucuuuccuucuucuccuuggcucagaggccuuccauugaccuaggaggucuuaggaagggacagugaagaaggaggguguugucaaagaagcaugguggccccaccugcuaaaugucuuugcauugaaaaucagcuccuuguucuuguuacuaucccaggacaagaguaaauaaaucacucacucacuguaccuucuugcuguuugagguucuuguccccucacgauccacuucaaucagagggugcauuugucaggcuugcuccuuccccaguugucuuucugugacccagaaaagguuuauucccugugguuacaugacuugucacgugacagagaauucuguggaaccaguaggagaaaccucccauuuccaagguguccuuauccccagcaggauaaaucagaaguucccuuagauccuguaaaaaggucaccuaagggcuauugagugucaagugucaccugacauggaguggcucuguuggucacugccucugacuucagacaagguugagaugcugccuuugaugccuaugacacucugguuucaccuagggaugugagagaaugugucuugucugaacaucaaaucccagcuuuccuucuguuuggaaaacagguagaaacaggccccaagugaagcagucugucuguagagcaguggccccuacccacuucuuuuccccguuuguccugugcuggcucuguggugugggagauggaauaucagaggguaucaagugccaucacuucaccauuagcauccucuggaagucaggcuucgaaaacaaaaacggagcuucuccugggucuggaggcauauauaccugcaaucccaguacuuagaugccaagaguucaaggcuagccugggcuacuuagugaauucaagguuggcuugggcuccauagagagauuuuuuuuuaaaaauauuuuuaaagguauuuucuucauuuacauuuccaaugcuaucccccaaaccccccauacccuccauccccuacuccccuacccacccacucccacuucuuggcccuggcguuccucuguacugaggcauauaaaguuuacaagaccaaugggccucucuuuccaaugauggccaaauaggccaucuuuccauagagcgaucuuaucucaaaacaacaaacagcaguuuuucccucucugaaaaagucuauuuuuucucuauuuuuuuuuucuugcugugaaaugacuguugguuucugaaacuuuggucuucaaacccuuuggaagacaaacaaaaggguuggagcuuuguauauaccccauucauuccucaguuuuccugucucugaacuugccuuuggagaggagaguaggcuugagguacuagaaccagcguguugcuuggaguugaguauguaucuauaccuaaaggacaauuguguuuggaagcauauucugauugagugggcuggaggacucaagaaccugaauuucucaccaguuugcugcuggauuuuaggcuuugaguccacagcccuuacggagggguucacuuccaagcaccuucucuucugauguucuuuuagaacaugacaauaaugauccauagacacagagaaauccuagcuguccuagauuugggggcuugcauuauaaagagugucucuccuuuuggaucuugaguagccucauuuccacagacauagcuagaaggguagggugaaccauucuacgcuaugaaggagggaaagacagggacaagaaccaagggaagaccuuucaagugcuauuggugucuguccugcgugagggaguuugggagggaggagcuguuugcccaacuucacaugccugggacuaacauuugauaguagcucucucuagcucuuaaccccucuauuccauagaacggcagccuuaaaucuuuauagaauaacacauaaucaaaauccaauacuuaacaaaguguuugucuuuagaagaguuucuccuuuuguuuuguuuuguuuuguuuuguuuuucuucugggccaacuuugggaguagaucaagacauuuacaaauuugcaucauuaucauguaagcaauuaaagugcuuaagagcuuaaaagcaauuuguucaaguugguuaaauauccacccuccccaaucuuguuuguauuauuaauuuacucaucaaacuugugauaucagcuccacagugaagcccauuucaguaucugcuuauugauagcaaggucccaaagaaagggguuuguuuugagaagguccacagugaaaggacccaguucgggaugagucagggaaaccagcauuuaacuaaauaaacccagcccuucguuggccucuggaugagaacggguuguuuaaacguuuuauuaaggugcaauuauucugagaaccaguucguaaugcaguucuuugcaaacauuaauuagcugaucccuacaucaccccacaugacugauaaguagcauuagcccuccauuugagagaaaaaauagacacaaagaguugaggggguaaaaggccaacucuugcccugauggaaauaugguaguagcagguggaguugggagacugaguucuucucucaguaauauguauugcagugcaaucgauagcacacuguaacucaguggucgcuagugacaccucaaguuaaauuuaacuaaaaugcaauauaacuaagacauucauuuccucaaucacugaaggcauuucucaaaguuucaaaagccacauguggagaguggcuaccaggguagauacuugcagucauaggaugcuuccauuguuguggaaaagacucagagggagcaccagguuggaucccagggauaaucaaagaauaacacgaaaguccuugccaucauagaacucaaauauaaaacuucuccaaacuggcugacauacgaggaacacugagcaacccaaucuguguccuguauacacuguaagauuagcauccuuugccucuuugaagacuugugcuaccauuuaucacuuuucuuauuagccaagauuaucuuuaagacaaugcuggauccuggagaggaugaugggagacagguacucuccuucccugcuggugaaaaugcaaauuaauauacccuuuuaggaaagcaauuuggcaguaacugucgguagucuuagaaacacuuacucccuuuaguccaguauuccaauucuaggaaucuagccaaagaaaauauucagagacaggcagagaaguuuuaagaauaaaaauguucacugcagugguauuuauuagcuuggcggggggggggggggggguuaggaauagacuggacagaguguccuggagccagacaguagaauaguauacaaagaugaaauauuguuuuuauuuuuuauucuguuuuauuuuccauucuccugcccuuccuuccuuucuuccuuuuguuuuguuuuguuuuuugagacagggucucucuguauagccccuggcuguccuggaacucacucuguagaccaggcuggccucgaacucagaaacuugccugccucugccucccaagugcugggauuaaaggcgugcaccaccauguccagcuuccauuuauuuuuauuuauguauuuugaaucaggguugcuguauagcuucagggauccuucugcuucuagcaacccagcacugggagagcaggcaaaucuacagcuagcuuuguacaugauugcugaggucccuaggcuggccuagcucuugcucuguaguucaggcuaguauuaaucuugccuuccugccucagccugcuaagugcuaggauuacaaacacacacacacagagagagagagagagagagagagagagagagagagagagagagagagagagagagagaagaaagagagagagagagaaagaaagaaagagagagagagaaagagaaagaaggagaaaaggagaaagaaagaaaaaagcaagaaagagaagaagggaaggaggaagauagagaaaggcuauggugacuuggaugaguaaaauaggguauugagaagaauaucaacuuuggagacuguguucagaggaagaacugcuucagacccugagccaccacuuuucuggcacagaaaccuuggaucaaccuucuguaccucucuguccucguauauaaauaaauaauagaaagugcagucaaucaagcucacauaucauggcagggaggagccagugcucaccuuacaaagaucuaguccaagcaugugaagaugcagaggacaaccucaggacccggugugugcacugucuagaauauagacaugcaugauguucccuggagauuuguaggaucuuuacucuccagaggaaaguagaagauggcuugugguucugugauucagaccggacaggcuugugauuggcagcgcugaaccugguacaaauguggcugauuguaguccccaucugucucuggugcaggcuaggaagcggucuucugccugccccauugugcuuaugagcuucccagcagugcauagcacugaaaugcuguguaagcuccuugcuggcucccacucuugcugcgccucucucucaaggaauaaauaaagcuggagugagugccuuguuuacaggguugacugauuaaaacccaaggcgccccuaccuaaagaguaguagucuuuagcugcuaagugacaguggcugugaggcucaguguggagccaccuuccaggaaguaccuaggacuguagaacaguguucuuacugcagccuugaacaaucucccaagcucucuccccugguaucugaaagcagcacugaguuuggcaccaccuacucugcccagcuucagugccuucucucugugggaccuugauaagcuacuuaaugucugcaugccuuaguuucccaguucaucaaaugggaauaauauugagaaguuggcaggguucuuagcaugguuauugggaaagaucguuuaugacaagcauaggaguccuuguuacugcugagucaacaugagaauucccagaaccugaaaagugauuuauugacuuuuagcucuguaguggauggacuugccuggcauugcaaggcucugaguucaauccucagcaccacaguaagcaagcaaacaaaaaaaaaaaaaaaaaaacaaagaagaaaggacaggaguuuauugagguauagcuaaguucuggcuucccuuuccuuucauugaugaugguuccccucugugcugugguuuugugaaguggcuuggagggccuggcaagacucgggaauugccaacacacgucacuugguagcucuaugcauucaaacacaguccuuagaaaucuguauucacccucuuuucaguaauaaaauggaaaaucgaagucucugucuccaaaagguuuguguggcacuuguauaguaucuuuuggucaguauccuuugugacaaugguggcuuuuggcacuggcauauuucuucuuauuccccaucugcucaacuucagguuuugugaccugcuucugaagcccauuagagcacaucaguagugggaacauguggggcuggggaggcucugagacuuaagaggguuugaagaugcucauuuugcaagguuauacaagcauagcuccaggaggaccuuggauaaugaugguaccuguagaaggugaaagccagggauauguggagaaaggugagcaguucacccugguucaguaucaauuguucuuuuacuccuuacacucacaaaauccuaaagacuuucucucugccucucugaguaccuacucagugcuagcuuuaguuucuaguaucacuauaggucucaacaggcauugcuaaugccaucccugcaguagacucaccugaaauguucuuaccaaagaccaguuucuucuuuccccauaaauguucucugucucucugucugucccugucucuaucuaucuaucuaucuaucuaucuaucuaucuaucuaucugucugucugucugucugucugucugucugucugucucucugucugucucucugucugucucuguguguguguguguguguaagagagagagaugggagccaguguguguguguguguguguguguguguguguguguguguauguguauguguguguguguguguguguguguguaagagagagagaugggagccagcaaagcuauacagcuaagggugagcaaugacacacaagaguagagcuucauuaaauguucauuccauccccuuuccaaagaagcagaaaggaucccauauuggguaauuuauguaugaggugagugaccuaauucacuaaauccaugggacuagaauaugauaaucaaggcuuuuugcuccacccuccgcccugccacuggcaaacuggggcaucucagugggaaagucagcauucucccuccuccuguucuguucccuccaacagcugcuuucugccugguggaaaaggccuugcuuugccuggagcugucaggauaagccuuugggcuacuucugcucuuuuuuuuuuuuuuuguucucuccugggcugugcccauuaaccaauccugcauaauccccucaaaugugcaaggucacuucuggauuccccagguagaagagaggaugucucauuucuuucagcaugucaaaugcacaucucaugguaguaaccuuccaaaguugugcugaagacuugucauuguggaagagucugaaggcucucaaguuugaaggguuugggauuuucuuguugacaguacaauuuguuaagaaguccuuggcaggcaagaugacuugccucaguaaaagugcuugcuacaaaagccugauaaccugauuaugaguuuuggaguauauguagaaggagguaacauguucuacaaguuguccccugaccuccacacaugugccauggcauauaugucucuauccagucaugugcacacagacaaguaaaugcuaauacuguuacuacuaaugauaaaagugaagacauuauucacuccuuuggauuaauuuuucuggagaucaucucaaaucuacgucaaacugggaaacugaauuguacuacagagaggcccuugacugucagaugcaagagugcuuuucuguaaucucagcaacuugguguucugaggcaggaagaucacacauuuaaggucagccuggacaacauaggaaggucugucccaaagaacagacaagacaaaauaacaaacaacacuuguuuguuacuucuugagacuuguuaaguuacagguccucgggaugguagagaugacucaguguacaaagugcaugucacacaagcaggacaaucagaguguggaucccuagcacuuauaugaaagcuggccacauuguuuugcuucuauaacacgagaacuggaagaggcagagauaggagaaucccagaggcucccuaaccagccuuaaccaaaauggugagucucagugucaaugcuagacugucucaaaaauaagaugucaggagauagauaaagacauccauugucaaucaacuucugggcuuuaaauauauauguagagacacauguccucauaugucugugcacacuagcauacacuacgcacaacccccuugccauaaacacaaacacagauucuuguccagugcauuggagaguugaccugagaguguguuucugacaaguuccccagacauacaaauccugaugauggaauccccuuccuugccgagcagggaucucaaacuugaucuuucucuuccucaucuccccaugucuguaaguaccagauguguaugcaucuggacaccaggauugcuguggugucugucgugacagcugccgugugccaggcaacauaauaaacaguggccaucaucagcauaccagggacaaacugcacuuacagccggaacagugugcucuucaggcucccuuaacauccuuaaaugcauucaacuuugugacauauuguggaggagggagcaauuuuauuauuaagguauuacuuuaaagauuuuacauauuuuuuucauguuugggagcaggaaauauaguugaaugauagaguguuugccuagcaugcaugagaccauggguuugauguucugcacuaccgaaauuuuaagaaaucauauucuuauucauguguuucuccuugugacagcaguaaccagaacauuaaggaggccuaagguaaucgcuaagggaauguaaacaacacacgacccuguagcuaagcaaacacacuuggucuuuucugauauuguucuucuuuacaacugcuuggaaaauguuuuuagauuuauuuauuuuuacuuuagguacuugagcacuuugcuugcacguaucuaugugugccacaugcauggggaucagcugagggcuucagacccuuuggaacuggaguuacaguuggcuguggcucaucucuguggccccuugccugaaauucuaaucuucaucuacuccuauucuccccugccacauagagcaacuuagauacauuacuuucugacuuuacuauuaagauaauuuuccaugcuguuacauuuuuuucuccagcaugccguuuagauuuguaauuuuccaucauaaggaugugccauuauuuaucuaaucacccacugcuguuuccaguucuccaccacaguaacuaacgcugaggugcacauaacugggggcuuuccguuuauuucuuucgccuauuuucuuuacuugaaauuucgaggucaaggaugguguagcacuugagagcauuugaugcaugcugcucaugggaccacagaagcaagaagccaacuuagguucccccuagacugaaaggagcuugauugaagguguugucaucaucucuguguuagauugggagcugcaccguggguaccagggaaucuugggacagugucacugcacucugccucuggacguguguuccaaacugugucgugcuaggugauccagcugaacacagacacauuuucguuccugaauuccuguguaagugagcaagcaaaauagagaagaaaguugcuuguggggucucccaaacucuagcuucaagugucuaaccaccucuuugauguuucucuugaacgucuuauggcuaacuugaacuuuaugcaucucaaacuugaauuuuaugugccuuuuuaucaaaucguuuucugucaguagucuuuggccuaucauggccaaugggaacuacauccucugcuucauaggacccaaacauuggaguugccuuuagugcaugguuuuuguuguuguuuguuuguuuguuuccaugucugcauacagagccaucgggauaucuuaagaugguucaccuucaaaauagacccagaaacugacauauuucauuauuaucuuugcugcuaccaucuggguccauguucaucuucucucauucagauagugguuucuucuugucuuggguuccuugucaguccuugaucccuugcaguuuccagucaucguagcagcuaaaaugauccucuuguuauaucuacauuagauccuguauuaaaauguaacucugaucugucccuucccugcucagagcucagcaagggacccuugcuugccucagggcaauggucaauauagcuccaaagccuccaaagcccucucaccaggcuucccacccaucuccugcucagaucacucucucccucacuguguaggacaucaggccuggguuuguuuguuguuguuguuguuguuuguuuguuuguuuguuugguuugauuuuuuuguuuuuuguuuguuuguuuguuuguuuuuucgagacaggguuucucuguauagcccuggcuguccuggaacucacuuuguagaccaggcuggccucgaacucagaaaucugccugccucugccucccgagugcugggauuaaaggcgugugccaccacacccggcucaucaggcccauucuugcuucaaggcugucccucugccugggaugcuuuccccuuuauauccccauggguaacugcccacuuccccgucucugcucuaauagcgucuucuugccaagccuuagucugacaauccuguugcaauaagaacccugcauccaugccugcucuacuguuccaugacucccuaacccuucuguauguuuucuucuuuccaccauguuaaauguuaugcucuaguauucuuaacaagaucacccuagcugcuauaagaauaaucugaaagaagggggugggucaagggcagagcaugcuauguaauuuacuuauuucuuacccuuauuggcugaaaaugaauaaagacuucccauauaggcacaggcagagacuguuuauucagaguuuguuauaacaacggagucagccaccaucaguugccuuugucagggccucaaaggcaggcaggggaguaggcagccucacagugagaguagggaaggcuucgggcuucucugauuggaggcugcuguaaacuagaagccagcauccuucaagacucgaguagaaagcagacuuuacuuuguuuaauuucaagcucggguaauagggagggaagcugaagggucaggguuguuggucaaucuggccaaugguuuuuguaucugaucuggcuguuccucguucuguucagcucauucucuuguggauacuauuaagucuccauggagguagagauuaaucuagauuaauccucacaacaaacccaguuaggucuuuuuaaaauuguauuuucauuuauuuauuauguguguauauauauuuauauauauauaguggguagguguguguguuccuccacacagaggacagucuuugugagccaggucucucuauauaucacguaggucucaaugaucaaacucaggucaugagacuuagcagccagugccuuuuccugcugagccaccucaauggccaucaauuuaauagaagauccuguaggcucagcagggacagcacaaugucuauagcagcaacccugcuucccacagugaagucuuccuguuccuuauuuccaaagguaguucagagaggucagacaucuugcccccaaaguccugacccauacuuagccagagaacuagguccauaaauaaaucuacuuggcccuaaagcaaaaugccccucacccccccccccccgaaauggagggggcagggaacuugcccaauggcagaagcaagguuccucucaucuccagaggucacuaaacuuucaggcaaagcuuugaguaggcuccuaccuucauugcugaagcaaaacuuauuuucaaaauuaauuugugcucuuggaaggccccuuuaaaacacuuuuuuaagauuccaaauacguguguguguguguguguguguguguguguguguguguguguguguguaguaugggaaaguucauaacagacuugaguuugggugauagccccauagcaucaaaauaggcguguguguacaugugugcauacacacgugcauauucaggccugccucuaauuuccagaacauccuuggaauucuucaaauuuaaagcauugccaugguaacucucacaguugucauuccuugaucuauuguucucaccccaucucaguuuuccaucucucuaaucauuacgaaaugaaguucauuuguucagaaacggacuccagagacaagccagcaggugucacaaggcucauaucagagucagggacugaaaggcagguccucugcugcagacucugcuaaugaagauaguuaggccuugugugugcugagccacagcacugcacccaguguggcagcucugccagcagcacuuauuaugcuccauugucugcugaauggagccaaguuugauuacaggccugccuggcuuucucuucacuacuuccacuacuccagaucucagcagcacauagucaggacuuuagggauaacuucucaugggaucauccucaguuuuuccucuggagcuucagaugccaagggaagcuaggcuggauggauaucugccuucaguucaguugcuagggccuuguucacuaaguaucaaacgacaguggcaggaaugaguuucacgucccuggaggagagcaaggagggccagacuccugaugacaaacuucuuguagagguuagaaaauuauguucaauguucuuuuccaagauccagggagagaggagggugggcuucuuuugguggggucccucagcagggaaccugggcaccauccuacaauaugacuacuuaagcaauaagagcuugcugagugagcucugccuuggacuauaugugcugugaggcaaaaggaguaggcgugucugcucagaauuugggguucuuaggaugcaaggaaguauuucaaaauacccaaguuugagucaggcugaccucuguuuaagugcuggcucagcccucucugccugaaguuuucuuaacuuuggcacccuuggcuggguaauucuugcuugcacuagucugucuuaaugcaucguaagauaauugauggugucucuggaucacuagaugcuggugccuucuccaccacuuguaacaggcaacauuuuccuaaggcauuguuaaaugucaucuaggaggagaauacaagauucucccagguugagaaccacugugcugucuugcaugaucuuggccaguaacuagagcucuucuauuugguguuuuccucuucacuaugugguaaggagaccagcucaaggacuaacugagagaaugccaauugagcuucuagcauagagccuggcucagggcagaugcacuugggaaagagcucucauucccacggugccuggcagaggcaggggaggcuucuagaagaaagaagugcuuguggucagacuggaaggaugagauaguaugccuuccguaaagacgugaacugcuguggucaggguuauacgugcucucucucucucucucucucucucucucucucucucucucucccucccucccucccuccccccucccuccccccucccucccucuccucacccccaccccucacccccacaagcauacucuucucacuuguucagcaccauuucuucccuccuaugaaguaggccugguagcccccuggcuuccagaagagguacauuugauucuggccuccauuuaaugcccccaggaccuucugcuccauaugcacauggccuugccccgugugccuaugcaggcccagagaagaggcuguuucuaccaucuuguuaagcauaaauuggagauuucuuucugugucacuccucugcuagagaaaaugccccaaguaagcuuucagauugggucuggaugaaacagacagaggcuaagaugguggcugaauauuucauggagacccuuucaaaccauacacucaccucucaaggagaguguugggaagagaauguggaguaggagucugucucagcucaggcgccaccuacgagauggaacuuugugggguaagucuuuucauuucccaaaccucagcuucccuaccuauaaaaacaaggagucuuauaucggcugucggggugguuggaagguucuagugggugauacagaggaccugguggaguccugaggacuuagucuaacugguuggaacugccuuuucauuucuagaauuugugguuugagggacagcacuagccuugugaaugacauagaccaaggacaugagacuccuugagggacuggguuuagagcggccuucccagucuucuccuuugaauuugcacuuugggguuagggcuggaauuuuuggaggguuuagcagaagaccagauguagagaaagcuuuucccguguuuccagcagcccagcugagcagacguuggauuuaaaaauaagccagccuaucaggaggcaguuuuaaaauauagcugugacaagcaaaugccugcccugugauugcacaaaaauuagucauuagaaaggucaaaugaagccuaggcagcuccagagucccagcccccaccccaggccaagcuccagcccagcccagccccucacuccuccuguuucuaccaaggagcugaggcuguuguaauaaaaacacgaagaguaugguguuuuguaacuauuuuuauaccgacaucagacuugauguuagugcuucugaauuauuuagcauuuuucuuucucagcuggccucugcagcgaauuucucuuccagggcggagggaguuguuuuauaggaaaccaaggaagcagacagacauugacugcaggcccucugcuuucccauugggagaaagacaggaucagguauccuguuauggaccaguggccuccuauuaaagggagguggcugcuacuugucuccauuuuccagagagguuguguagcuugugugagcgagcccagcaagaaggguuggggguugaggucuugcagauuccuggguguuucugacugcagagccuguguuguuuuuguuggaagagccugcguacacccugcuuuacgcuaucauaaguacauggaggcucacaucaccugguggcuuacagggugccaggucaaaucacccccugagaguguggaggugaacagaggugagaucagccucagaaggcugacaaggaggaagaggaguggccucgugguuccuguguauuguugucaccgucuccgggagauugcugguggcuguagugggaggcugguuagguacauucugcaguucucuagggcauuuuaacuugagucugucugcucugugggcguguacagagcagguagagccccucccucaccgucugcaucuugggccucuuugaagaggguggugauuggcagcuucaaaccaccccuaacaacgagaagcgaggaggagcugggcucuuaucugcugcuucucauaauugaaguucaucacagacuuuuaguggccauuugaaauagacaucuggacugaaaagaguccugcugcagauugggauggucucacugcugcugcugccccagcguuaucuauuucuuuauuucagagucagagauuagacauuuuucuuauucuguauugcuccagcuccuauuuaauuaucagugacccagagaugacucuauuuaaagcauguuaaaguccucauucuaccaugugugaaaccucagcuagaauugugauaugaagucucugggggagaggggccucuggaaauuagcuagggacaacuuacuucaaaaguguccaucauuaugguuucaauaacauucuccaggauaaaauagcuguugguaauguuaauaacagcuguauuuugauagggcugcacuuuaugacucuaucaagcgauaucacauucuguuaaauaaaguaauauuugacacaggcagauuccauguuauuaaauuuuagauagcuauaugaaauacuugguucuccuugcugacucucucucucucucucucucucucucucucucucucucucucucucucucauacacauacauacacacaugcacgcauaguaagacagcuaugcccucccccagaugacuuuauuucugaaaaugugcagacuaauggagugaccccuuuucuuucaagauggccucuuauaugaaugauuugguuuuaaguuuuacaagaaaaaaagagagagagagaaacugaucaguguguuuucaaacaucucugcuuaggauucugcaaagaguacagaggagagagagucacauuuucagaguaaaucccuuguggcagaugccuuggugugugcgucacagcuuaucuuaugugacauaggcaaugcugcaggagccuacugugucuucucuuacaggugaaguggcaucucuaaggacaucacugguggaauuaucauugauccuggguuuauaugacugccuugccccaaaaccccaucuuguguccagggauuuacuguaaggcauguuuuuccauguuuugugugugugugugugugugugugugugugugugugugucugugugucugugugucugugugugucugugugugguuggcugggcaugccuuuaauccuagaaccugggaggcagaagcaggcagauuacugaguucgaggccagccuggucuacagaguaaguuccaggacagucagggcuacacagagaaacccugucuucaaacaaacaaacaaacaaacaaacaaaaaaacgugucugugugguauguggaaaggaguaggaauuccucaacuggauggggcuauacuucaguggcagagugcuugcuuuguaugugugagggccuggguucaaguccgaguuuggagaggaaaaacauguucuuaauuaauugcaaaauaucucugagagaauaucucaagaguaggguaccucugaggacuguuucacugugagcccugugaauuauugagugcacagggcuagagcuguuguuccugucuuagugaugugcucacacuaagaacuugagauguccuucagagacccaugacaauuaccucacucaggaggccacaagccuaccuugcuuacugacaucuuagcugcucaauacacagaauccagguuuguuaugcccauucccagcuuaucuuauaggaaacauauauauauauacauauauauauaaagaauaaaggcuuaacuuuuuuuaauguuaucaggaaggagaaaaguuuuacuagguuuucgggaagauuugugcugguaaaggagcuaaaaggcaaagauaagcuuuuaaaauacacgugaaacaacgagaacauaauggauuaguauaaaaauacugaaauucuauucgauuaaggggauuuaaaaacucccuuccuccacccauuccuucuccuucccucucuucuucucuuaguuacacauauacaaguacaaagcgcaguauugaaagucucacccuugaacccucuaucuuguaucuagggggaccucagggauaauucucuuauccacauugcuggggacacugugguccagagaaagaacguauuuuaaaccaucaagcaagucucuuaagggaaaaugaggccaagacuuggauagaacauugaaaucuagugucuaaacucugacuguauggccaaccuuaaccuguauggccuuacaagccaacccaagagauggguucagagaggcugagcaguuuuaaguaacaugacccaggcuaguaacuauucacaugguggaacuuuaacugacaacaagggcgauguuaacaggaucagauguggaauacaaguuuuuuugauugcuggucccauuuucucccagcauucacuaccuaucccugacacagaggaaagaacaaugggccgucccaguugucuccuagagagcuaggguugagccagggccccucauccuggagcugggguugcugugggugcccaugggaacagggggaggagcagaaccugugggagugagccuuggcuuccccuucucagcugaucagguggaugggaagccuuggagugagucacacagagcagacaaaggccccuuaacucagugcagaccuuccuuuucaaugccauaucaccauggaguacaggagcugcuuugaauucuuuccuauguaguuuugaaaagccguguguguguguguguguguguguguguguguguauauacauacauaucucugacaacuuuaguugugaauuuguacuggaggcaaggauaucucucaguuauuguacugaugggcuucauucuguccuauguucgaaacauuucuggacuaugauccagagcauaaacaauccaaugaaguugcuuccugcaugggaguaccagagggagaccgccaacuuauccaggugaugcagcuauggcuaaauacaagguugaagucaucucuggauauuuagucguucagucauucacuuacucagccuuucaaguaguauuuauagagaacaucagauuuuccaggcauaguaguagacagagucaggggaagauacaaugccugccuccaagguuguagcuuauuggaagacaacggcaugagggaggagcugcagaggguguaaguguuccuagagucacacaucagcugccccugccuagcagcagccagcaauggucuuauggggaaggagaagcuucauagggauacugcucagugugcaaagcuuguuuucuauaagcacgaggacuagaauuuggauacccagagcacuuagauacauucuggauggauguagcaucuagucugcaauccuaggaugugguaggcagagacaagggauccgcaaguggagacaggggaguccccagagcaagcuggacagcuggacuagacaaauuggugagcucuagccucaguucagagacaucuccuuaauagcugaaguagagagugaucaaagaagcuauccagcugccuaccacaggcuaggacuacaaguuuauaguagguuuccaguuauuucaagacaggguuucuugguguagcccugacugcuuauuuauugugcuuaaauuuuucuguuaagccauccuacucuaguagagggaaacacacaugcccauugcucauucgcacaccauuugagguacauggugggaaaagagcuuaccugggagugaacauccagcaguuuaggggugaccugaucugccuggaggucacuagggaagaccucagagaauagagaugacucuaaagagccuugaugguugaggauauucucaagugagugugugugggaggaguccccaggcaaaaggcagagcuuauagaagcuucagggaagccuguggagccaggaaaauaggggaagugguccuaggacuggggaagaccaacuuggacuugguccugaugaggcaaaggagcuaccuagcugcuguagaacucaguauuuggaaaaggugaaucuugaguagaugaugucacaguuucauuagaaaaaaaauguccauagccccgcucaaaaucauaggaggcaugcaggcaucuuuuucagaguaauauaacauuauagacguggaacaucaaccccacaguucaaagccaggguuuuugagucaaaaugcaaaguugaaauuuggaugcagcuuauccauugaguauagcuuccuuguuauacauuguguucacuauuucucucaaguuuguaguuucuugguaaaccuuuguuuuauuuuauguacauuggugauuugacuacauguauguuuaugugagggggucugauucucuggaacaggaguuacagacaguuguaagcugccaucugggugcuggguccucuggaaaagcagccaguacccuuaaccaguaagccaucucuccaaaccucuccuacaaaccuuuaaguucaaaaaaauacauccugccucaaggagggagaagagggagccaccugcaucccggagaagaagcuaaccuuagauagcauaauggguaggcucaaagcuacucagguuuuccacuaguuacacacuagaugcuugaacucagucucugggcuaagaaaacucuagauguguuucuagugcuuauguaaggaucaaacgcuugaggcagaagccuucaaagaguaaaaauauagaguucuuuuugagugauuucuucagcauugcagagaugugcuaaacauugaugucuuaugccaguccuuagauuugaggcucuuacuuaacugcuuuccagauaucugcucugccuuuaauguuauccaguauugauguauugaucaagaccucagccacaguguaucuuggcuaaccuguccuguguuccuagcaaacagggaaugaccgggugagcggcaagaaugggucgauguuacauuuaucugcaauguccaucugccuugucugguuggaaaccggugcucugccugcgcugagcuggaagaugcuagcucugcagaagagccguggcagaggucagcacagccuggauggcugggagcagggccugaaaggaggccaaggagccucugaccucccugaguuuccuuuucacaucuguaagcuuggaucguaauaccaucugcuuagaauguugugaggagcagaugacaugaugcaucuaaaauucuuaccauuguauccauuacaaaguuggguaagaguuuauuaaaugcugacuaacaauaucauuuugauuagauaaugaugucauagcuaaauaauuagcuuuggugaguaugucauaacuguucauauguguaugcaaaggccaaaaguugaugcuggugucuucuuaaacugcucuuucuacuuuauucuuuugagauaggauuucucacuaaacuuggggcccaccaguugggaagacuggcugggcaaugagcuucaaaaauccucuugucuuuacccuugagagcugagauuagauguguaccuccauaucugguuuuuaaaaugggugcugggggucugaacuuggguccucaaguuuguauugcaaacacuuuauugacuaagccuuuaguuuuguuguuguuguugcauuuguauauuuuuguauauucucuauuccuuccuuccuuccuuccuuccuuccuuccuuccuuccuuccuuccuuccuuccucucucucucucucucucucucucucucucucucucucucucuuucuuucaaaauccagauuuuauucccuuccugguccucccucugacuguuccacauccuauaccucuuccccacucccuuucuccacaaggauguccugcuccccaucccccacccuaccagaucuugaaacucccuggggccuccucugcaucuucucugacuaaacccaaauccagcaauacucugcuguauaugugucgggggccucuuaucaguugguguacacugccugguuggugguccugcauuugagagaucucagggguccagauuaauuuagacugcugguccuccuacagggucacccuccugcucagcuucuuccagcuuuccccuaauuuaaccacaugggucagcagcuucugucuauugguugagugcaaauaucugcaucugauucagcugcuuguuuuagugggcacuccauagccucuguaauagugucagguuuggggggccucccuuugagauggaucccacuuugggccugaggcuggaccuguuguuguuguuuuuaacucuugucuuaaauaaguaauuaaaugaauauuccucaauagagaaauuaaaauuaaagacacaaugagaugccacuacgagcucacuugagugucugaaauugaaaaggcuuauuacaccaagucuuggugaggaugugggagaacuuaaaugucaaauagagagugauucuaguuucgagaauacuuaaguagccucuuagaaacauaagccaggcuuaaggugcaugccuguuaucaggaguugaaagacugagacaggaggaucaccaugaguucaaggcuacccugggcugcauagucaguuauagaucuacuugggcucuaguaaaagccugucuuaaaacaaaggggagcaauaccuacuucaugacaagcccuuuuacuccuaggugcuuagcugagaaugaaaguaucuugacacaaagaccccccccccccccacacacacacaaggauguuuagaguggcuuugcuuguucuagcugagaaugaauccagcagcagaaauggcuauuaaccaguguaucaguaaucaaaggggaauggagccuuuauaaucccaauagaauggauuaggcucaaaacaauuacaaugaguagaagaaaugccagacaaaaggaauauauacugcguaguucauuuguucagaacucugcuuaugcagaguaauucugucccaguagagaguaggucaguguugaggagagcaaggagggauuacaaagagggcaggggagcagagagcaaugcguguguccucuccuggauuccauauuucacagugguacaucuauauugagacucaagcuaugcaguuuagauguagagugguuuguugucuuucaaauacagcuuugugauguuuuccaaaagcugaggcugaaaaugaaggucaaauaguguacuuaagcugaaguuuguuuacaagaugacagaccagcacagcucccacuugcagagaugauugacugcucacugguacccuggacaugguuuguaagcucucugagcugccaucuuuuuuauauaaaacagggaugaguccaagacaucccaaagaccuuggccuuugacuugcagacaaguccuuuagcauagaacucaacacguauuggauguccuccuaauggcugucuauaaugcuaguauuguuuauugguuucuauuaaggucuguagaugacuaaguaccugccaacagaugacuucccuaugaaucauccagacuggaaacugcagugaauguucuuccaugcggcauagucaugagaauauucaaacugcuaagccuguuuguucucuuuguaugguuaaaucugcuugauugucacagaugcccauucuagucaauaaauauuguucuucaguuuaggaggacuucuccaagaaggagacuaaucauagaaucuuagaacucaucagaacuggaacagccuuaaucuaaccuaucuucuuuuauuuguuuuaggagagucuuguuauguagcccaggcuagccuacaacuccucaucuuccugccucauccucccuagugauaagauuauaggcaaacccagacaacauaauaauuuuaugaagaugucaauuucugaggaagccaggugccuuguccaaaguuaucaagcaaaggaguccagagugaagcaaguuucuugccccuacccguguaugcaacccuguccccuaagccaggcugucccucacagauuggacagaggcaaggucagaugaggccuuggcuaaauguguucacaauuucuacauaaaugagguuuucuacuccugucacaaagcacucaggagacuuccagccauaagcuuggcauucccuacucaugacccaggccugguuguaugguuggguuccaugucucuuugcagccccucugcuacaugucagauccauuccuauaagaugacuuuacauauucuuccuuaaaauaacugaaagcacgcagucuuauugccauggccauacaggcggaggccagaacucugugucuagcagcagguagcucugcauggcucauucuuggaguccaguuucagaagauggacaccacaggaaccuuuagucaaagaaaagagacucauccaagcuacuacauuugaguguuaguuuucaggcuuguuuuuauugcuuuuuuuuuuuuuuaaacaggguuauuuguuuuguuuuguuaagucauugucucacuguguagcuacaccuagccugaaacuuacuauguagaaccaggcuugcuuuguauuuauagagaucugccuaccucugccuccaaguucugggauuaaaggcaugcaccauccagcggucaugcccacuguaaucucagguagugauagggaauguugacauaacuugacagccuuucuuucuccugguguuuguaucaacuuuguggaacuuagaaucagaacacuuauauuccuuaugagacugaaggaagugacacauggccucugaaaaacauccacacuaaggcuggagugaugauggcucagaggcugccccugcagaggacucggguucaguuccgagggcuuacaguaugauucacaaccuuuauaacuccuguuccaggagccuucuucuggucuccucaggcauaagagaagcacaugguguacauacauacaugcaggucaaacaccauacacaucaaaaaaagagaaaagaacacacacacacacacacacacacacacacacacgucaaguuuuaaccaaguccuccagcacagagccugacccagucugucauuuuucuauaacagcucuucugaauuuucucuuagggcuuucaucuugaagaaagugccuucugguaccaaaaacucauguguguuugcuugccagcauauauguguaugugcacaagaagaauugcagacaagaacuggagcucuuuugccuuugagaaaaaggcaaguugaauuuugaauuguggagauaaauguguccuacaguucaguucuccauauaagggaugcacaaauaaacucugugcagagccacaaggaauuaaucuuccuuuuucuuaaaauaucuuccguguaugcuuuacccguguguauguguaacauauguggauauauaaguauccucugcacucuggacaugggucucuuuaugcacccagagagaaaagauugucuuuuuauuuuguuuacauccucacgauaugguaguuacaccucaaaacagaaacuaaacaacaacaaaaaaaaaguaacaucauaaauaaccaucugauuucgagcucccauuacuuugcccugauuguccaaacaugucuucaugacuucuauuucuccccucccuaaacuaguauccaaacaggauuuaugcauuacauuugguugguauguugaaccaacauuccuaauaagcaguuuucacgagcuaaaaucaucuccaaauuggagugagccagcccuuuccagcugaagcagcugcuaggggcuggccagcaaggucucaugggaacaugugugccuuccuucugaugugcacauaccaaucagcaggagggacuggagacccugugccaagauagagaggcucauagagcaggcagaggcagaacuauuuagguggguuuuguuguuguuguuguuguuguuguuuuguuuugcuuuuugccugaaagguuguggauuccaagagacugcaaaccagagaccuggagucugugaccaguuucuaaagagaaugagagcugccgccggaggacuugggaagagccuggagugugagcuuagggucaccuuggcaauaggagacauugcuagaagguuugagggccacuaugugcaauagaaucagagcuaggaccaccuccuuggguuccaaagugcucaagcugugugcuuucacuuggaccucuuuuuugauguuucucauuccauguuuuuuuagugguagcuuuuugagaauggacuugcucuucagauggauauuuaaaguuguccccucaucaucugauuacacagccccuggcaguuagaaaucauuaagaugcucggcaggacguggugccuguucucugcccuggccuuuguuauguguuauaucuccucugcugcuuccuucccugauggaccauguguugucuaugugcagccucaguggggaugcagugacagccacacugcagugaagaugcucuugggauauguuucagugauccagaguucucagcucugugaucaggcaguauacugugggggugcagggaagagggagagggggagagaggggaagggggaaggagagggagagggagggagagagagugcgaagauaugaugauguguuuucuaagagguuagcgcuaggaagcuacuggaagguagaguauuuacuuaguaaauagucccugguguuuaugaugccgcugugcuuuuuaaaucccuuuguaaauaauucaccuuacuuucuuauaaaccaaguggagaaagucuccuuuucuuacuuaccucacauuugaagaaaccgaggauuagacugaugaagugacuugucccaagucauaugggaugaauacaucagguaauuuggcuuaaguccacugccagacaucucacuuuagcugaagaagggcuagaugggcacccuaugaucagggaagucacugauaacugcugaacucagagccucuuccugggaacauugcuaaggcuguacaggauucacagacaauagagggcuugucccuuaguugcucugagggaggcagacaucuuugucauucuuaggguugcaguuucucacccuguuaguuaaccuuuuccccugacaauccucuaaaauguuccagggcucaacugagcuaccaagguacugaaagaacugagaaggcucuuggaggaugcccugaggcuaccauucuuuuucauaacuugacuccugaaggucucagcccaaaaggaaggcugagcuaguggugggcucagcagugugguugccugagccacauuagggucugcugggcucuucugcaaaguuggaacugagcuaucagcuccuaccguuguggacuucucucuugacagggagcauuuggugguguuuaacaguguuguuuggugguuugaacuguugcccagggcuugucuuuacacguuaacagagcugaaacagggccaugaucggagcagccuuccagaguugagagcuaacucaguggagcauuccuucuacagagcaagucuuccccaagcucuaacacuaccugcaagugagauggguaagcaaagugaaacuggaaggugcucuuccccuucaccccuuggugaaagagaagccugggggagagaagagcugcugugggagauccaaagaguauggaccaaugccaagccaaaagagacagagaacaggaggcagagccaggaggugccaaggagccaaagaacaguuuaugcucuggagaaucucaaguguaaaacagacuagugguaccuacucagaaguaccuggguggugcauaaauuaucauuaaacaagccagagugaagccauucaacacagugggguacuucugugaccuucagccagcuguugggguguuacagcauuagcaccaccucaggcuuugaacuucacugggaguccagcagaggcagugggugugcaaacaaucagacuccuuagaccaugugaccucuuagcacaggggagucagccucuccuacuagcuauggacauuaaagggcuuaaagcguggcaagagaaauugagaguggaagggacuugcucuuguuaacugaaugccauguaccagaaacucuguaucucucuguauucauugcacgcccacuaugcauguuagacuauuaccaccuaguucaaggagguucagagaaggcaaagacuucucucaaaucugaucacgucuagccuuagaaacacauuccucagaccugguggaucccugggccaggcagugguaucccauaccuuuauuccuagcacuugugagacagaggcugguggauucagaccucuaugaguucaaggccagccugguguauagagcaagcuucaggauugucaaggcuucacagagaaacccugucucaaaaaaaaaaaguaacaaggaaaaaagaaagagagagggagggagggagggagggaggagaggaagggagggaggagggagggagggaggggaggaaggaaggaaggaaggaaggaaggaaggaaggaaggaaggaaggaaggaaggaaggaaggaaggaagauagggggaaggagggagggagaauggaaggaagaaaggaaagaaagaggaaauacaucccucauugauuuaauccccacccauacacaccugaguccuccuuuaaauuuucuaaacacucuuagaaaacucuaugacgugugcaggugccacuacuacaguaccauucaucuauguuuauuccuaauaccaaguuccagccuuuuuauauuuucugcuuuuuuaggaugagagccucacaaaagacuugccucuguggcuuguuuaaaaaaauaacaucaccacauacaugcuugugagucaugugugcaugugcgccuguauacacacaaacauacacacacacacauuaucccccauagacaacacuuugcaaauuaggcaaagaaagaccaaagggauugcuuaauacuucccauuuauucuguucaacaacaaaguacuuuaaaaaccccacgcaauuacacuguuauuuuaugauugugcuguagugagcuucaaacaaaucagaucccaucaagcaccucuguuuugccuguaagucauuucccaguaggcaaugcugccucgaaaaugcugagugcuggaaagcacagcccuuucuaauccacuggccuuugcuccaaugggccucucucucucaucacccuguguuuuucuuuuuaccagccacuauuucucauaucuuuuugcauagaaaaaguagaggcaggccgaggcuguaacucaguugguagacugccugcuuaaugggcacaaacccccaaggucaguccccaacauuucuucaggugggcuuguugguacaugccugaaaauccaacacuuggagcuagagacaggaagaucagaaguccaaggccaucccagauugagaagagccugugauagcuuccugggggagggaguggggggaaaggaagaagggaaggagggagaagauaacaauauuauauuggaugaaacgccacuaccaaagagggccaaaguaauccuuuucaaugagauagucaguaacaaagaucacacauuuucucuguggaucacuacuugguguuauuagaagcccuguuuugaauacaguagguaauugacagguuauauacauagccucauacaguauaaucuuuaccugacuuuagcuaacagcaguuuucuccuuuaaaaugagaucagauccuguggcuggcugaaagucacacacaaaagcauaaaaagcagguggccaaacaagacugugauggggucugucgccuauuacagcacuuguguccauaaccugguauuucucaacauguggucucaagcaggcagcucuccugccugggcucugccuggaaaugcuaguccugaggccccacccuagaccugcugagugagaacaaggggcuggucuucccaguuucuguccuaacaagccaucuaggugauuccaauacacaguaguauuuggggaacaugccacacccauuguacugauacaaggauaaaauauuaccugagcugauaggguuuuuaaaguugucccaccuucauaagaauauaauuggagcaaaauaaaaauaaagcaaaaccgcaaacgccccuuuucuguuccacucugauugaauaugccuuacaaaguuugaucgguuuuuagcuuguaccagcugucuggauugguaucgaggccucaagcccuuuuaccugugugaucuggaaaaaaaccgcuuaaccucagugccaaucuugguucuuagcucugucuaccgcagaugguaaugauccuuuauggaauucaugugaggauucggugagucagagucugcuaaggugcuuagcacagggccaagucuacgggaaguccccaauaaagagcagcuagaugcuaaccaugaaaugauuaauguggcuaugcuggcucugaugagagccuaaugagcgaaugguuugguuugcuuuuugggaagugcuggagaucaaacuuggagcuucacgucagcgaaaugaguuuucuuccacugcguuauaccugcagccuaaucaacacuuugaaauuuguccccuucugaaccucacuugcuuccuguugcugugacaaacacuaugaccaaaagccaguugaguaggaaagugguugcuuggcuuguuggugacaguuagucauugucaaaagccaaggcaggauuuaaggcaggagcuuaaggcaaagaccacugaggaagacuguuuauuagcuugcuucucaaacguacaugaagcuaucauuuuuauacaucccagcuacccagugauggcacccccccccacaucaauuaguaauuaagaaaaugacccacagauuugcccacaggccagguucugcugucaaaacacacuucgagaucuuauaaacaaauaucaaaacaaacuuccauuucucucccugcauaugucacugccuaacacugaaaaauaaaaucacaagaucucaaaugagauaggcaugcaggagucaucaggcagucuuggcuuagcuuuacugccaggcuuagacacagcaaaguauucucccuuaacuucuagggccauuuauucccauguaaauggagaaggucagguccacgaguauuuuccacaagggacugguaccaaauggcugugugugguaccuaagcaugguauuaaaugucguugaaucacauggugauaaagcugguuucgguuccucuucauucuuugugauuuagucgaggacggagccugauauuggggcugguagauauuuaauaccucagugacacucgcucagcucccuguuaacaaaggccugugucuggguaaggaagcaacaguauccacuugguuucccugaaauuuacucuucaacucuuucucacuguccacaugaggaugucucuuaaaugaccacaaugggauacauguugcuucuuaaaauaaauuaauucaagaaacagucaauugaauccaaacauuauuagauuaaucacaguauaggaagccuuuggguguggcuugagaucaagagaguggaaggagcuuccugugagaagcuagaagauugccugcaauacucagggucugaaggcuguacuuccuacagaccgccucuuccaucaagauagcucaucuguauagucaagccaggagaaggggccauuguaagucucaguacuggcuacugugauuagagccagagucaucaaagcauguaucaacaacccuacccccaccccaccccauuggggauucuggugcucacucugcagaggguugugugcauauucuagaaacucccauaggugaugaccuugcuaagucaggguucuagauaaggacauaaaauacagagcacaacuugaguucaaagcugccuaggaaguagugagagauugagagaaagugggugggcagaaaagaucaccucaacauuauauauacacacaggggcuggaaagcauccaucugcccaaugggaagaguuagcuaugacauccaaauacagaauauuauauagcuguucgauaaaguauguagggacaauuguaagauguggaaaacauucaaggugugaggccaagggaaaaagcaaucugccaacaucaucuauaauuuaaaagauuaauuaauuuuugugaguaugauuuuuuuugcuaauaugucugugcauguaguuauguaguaucuuuagaagccagaaggaauggaauucccugggucuggaguuacagauggcuguucggcaccauguggaugcuagggaucaagccuaggucuagcuauucuguuccuuucuuuuuuauugauacagggucuuacuaaguagcucuauuuggcauggaacucacuggguagaccaggcaguucucagauucaugcaucuaugacuuuauuucauccacauuggagaaacacaccaguauauuuguggauguuaacaguggucauuucucaugaaauaaugaugucuauuaaaaauguuugugguauuuuucuaagcuacuggucuacucccuagaagaggagauacagguuaaaucuuacucaaaaagcuggcacugaacaaaguucauucaaauuuuaauccugaugcuuacaagucacgcuccugugggauugugauggugcaugugugugcgugcagugcucagucacugucacuuccuaauguauggcuauggacagucuggauggccacuaguggcuguucuguggaccagggaagacaguuggggaugaggaagggggaaaguccaggggcugucucuuagacacuggcaacugcauggugauggaacggcuuuccaauccaguuuuacuuguaaaacgaacaggaagccuuguacugguggagggguugucuucaccugaucacuuccguagaguaagccucaguuucuguauuugcaaaauggagauaucaaccaauaccccacaggggugcuaugaagaaaaagugagauaaaaauauauguggaaauauuuuguaaacuguaaagugcuacauaaguguaccugauuauuucauugaaaaaacauugucaugcugaugucuuauccagcaacguuuagccucccaggugacaauuuugugucaaaaaugugcucuaggaaccgaugguuagcaggucuuuggcuuuauccaggugguccaugagcuggaaaagauggagaauucucucacuaaagggccauaucacuugacucuauugacagcaugucauguggaacucaaaauugccuucuugaaugcagauagauugcaucuauuaguugcuucuugcugucaugaccugccagacgggaaaauuaaaugugccuacaaauauuucaguaucugugcugugugaagguuuaauauucauuuggagcagugaguugagagagggaaaauaacccacacccuuuagguugggcucagaaauugcuaaguucaacagggguucuuugagcauucacccaaagcuagcaugugaagaauguguuaagccuucgaaagaaugacauucagcuguaauauugacaacuccaccauuauacauucuuuaagacgcugcaaagauucaaacucagguaggagucugucuauuccaaugggacuugaggaaacuugcccuaaaauaggugggcagcagagcagcggaagaacguguucaugagaugggaaaggugguagggguaucugucuaaccuuagcagucauccuguuaagauguggacauacacuuacauuacauugcaugugggaccaaaagauagacaucaauaggcugaagucauaaaagccauagguaucuaguaucgggcuaggaauguagaucaguggcuaaacauuuaccuaauacaugugagacccuagguucaauccucagcaccucagaaaacaaaauuaaagaugagaacaauaaaacaaaaugcauugaguaguuacaugggaaaccacacagaaaugacuuuuagaaguuauguuauacaaagaugauuucauauacaucuuguuaccgcuaugaaaagaagucuauuaaagaaaugaauagccaaugaaaaugacuuguaaaguggauguuguuauuauaugucgaucauuuuaagugucacaaauuuucaauguuuuuaggaugcugucauugucaauuuuauaucaauguacaaauaugauuucagaaguuaguuggugccuucguuccccuaacccuguuuuuuuuccauacuaagguccuaaauuccucaagccugacuucuccugccccagggguuaacagaaaccuaucccccuugguugccgagggacagcuguguuugaaauggggacugcccucaaggagcuuacaaucuagcuggggguagaugacuugcacuugaacacaacuagacugugagcuucuagagggcaggggccuuacccuagucaucucucugcucacucugcacacccucccugugggacauccuccauccccauggcgccaaccacugccuguuugcugagaacucuguaggccugaacugucuccugagcacugacuccagcucuacagugucuccuggcuccaucccugggugggaugcuccauaccacugcugcaaccgaaucagcaaugugcaacucaaugucaauuacuucuugaggccagcccuggcucuucaacuccugggcuuggucuucaaagcaaagguccagaguuauuguuuuggacugagcucaauguaaagugcuuguguuuaauguugauuaaauuggaacaucuuucucauuguauauagacuggcuaaauagguggguugaaaauuaacagagaaaugcucuuggaauguaucaguuauugucucuagugauaaaaaaaugguuaaugcuuuaauuuucugauaaugugcuuucucgauguccugugaugacuaugugugaauuuuauaaccagcaaaacuaacucauaaaaguggcugaaaagugcuucagauaagugucaucuucuuuggaaagugucuuuuacuucuuaauaucccacauggagucugaagcucuguuuuggccuuucucuguuaggggaacuuguguucuuuguauaaaucucuucccccuagaaugugagcuccuagagagcagaagaaccauugacuuauuuguucauuucccagugcuuagcacaaggccuacacaaguaacaccuuaaugagcgcuuagucuuuaaaggaagaggggcuguaauauaugacuucuaugagucacuugccuuuauuucuggauacuccuuuguuaugauuuuuagucugcuagucacugacuuuuaaaucaauauuuuaaauuguucuaaucuauauuaaagacuucauaaaugccuaucaaacucauucaaagugaggucuggcauguuagcagcucuuuuaaaucuaucuuggguaacgugcccccuaccugaaaccucaggcauaaaauucaggacugcagaguccaaaccugagugcauuucuuaaauugaaaaguggcaaaugacaguggcucaugggaagauauaugucgggguagauacaauaagagaaaaaugacaguaaccaacuuuaauucuguguuacucuguaccaggcacugugcuacacagcagcaugcaccauccuuguccccuuucccuuaugauauaaauaugguuaucaucuccauuuugcucaugaggaaaaugaggcuugaggaugcacuugauggggagacuaguauuugaacuuuggaccauuuuauuucaucuucaaagugcacugugauguaaguagucuuaacuuuuccagcuuacgauggugaaaucaaagcccagggaacaaguaagguaggccagcccauguaucucuuuugaaaugauggaaggagucgggaagagggaugcuuggagagaguagcccuguucuaauguuuguuagauaauguuuguuagauaugcucugcccugaauacacaaaggucuccucccagguucacagugcucccgaaguuggaagggauuuguuccaugguuaggcaguguuauuuaaaggagucuuaugugguuuuuaaaaaauagcuaaggacacaucgcaaggacuggugaggacccgugcauggucugucuccauggugggaauuuaaccauuuaauaucagcuagcguagagaauuguguucuggagagugugugcacgcauguuugucuucugggucuguagccaacuaauuacaaaaucagccaacaaauauuuauucaagaagugaccugauaguucucucauuugcugucugcuuaaggaaggguuacugccuuggguagaguuugggcuaaugagauaauaauaauuaccacucauugagugcagguugcaugucaggaacuuuucugggcacuuucuuauacacaauuccaauuaaucuucacaaccucaaggaggaagguuuuaucaccuacucuugacagaggaaggaacuuacagaguuugaauggcuccuuuaaagucucaguaauucaauccaagcaaguagagagagcccgauuugacucccaucugucuccucagauccucuuucccuauccauucuguuuggugugcagggugccuguggcuuacguuuaucacauuagcaaacauccuugguggaacggagucaguauuuuuaaaaucuugacaauuuuuuuuccuaacucuccaccaugcuaacuccacuugacagcagcuaagauugauuugaugguuauaugcaaauccuauaaggggaaauuaaaaaaaaaaguuauaaaauugcccaaguuuuucuagucauuuagccgcuagcucucccugacacagacaagaaugugguccuugggaggagcccagugauaccccagacacaugcccuuagcauauuuuacuuccuagcuucuauagaggccaacugcuuguacucucuagugacccuuagcauucucuggggucaccaggauguccuucuuuguuguccaugaguggcagcaacuguuggucaggaaaggaauuaacuuuggacaucaaauacugaagauaauggcuuagcucaggaaaguguauaaaggagccuaagguuggcacaucuauacgguuccccaguagccauguggcauggagucaccuggaugggugaggaucuugaugcucuucugacuagcucucugaccauuuuuaugucuccaagcccccugggguugugccccuugugcuauauguaaaauacaaauguaaugaaaagaauuugaaaacaagauaaagucacaacaaaaacaaaacagugaacgaacacauuuacugccugguauguguaaggcuuccaugaguuugauguccuuauccauagacuuagccuuuaucauuuuagcucagcuuuuccucagcccuugggcugucccuuuucaaugccucaagccaaauccuguaacuuaguguaaccagagucuguccuuugaacuggaaagcuccuuauaaggcucccauguucuuggcuaggcuaauaagcccucaaaagcaguauucaggaaaaaauacauugagagaaagaccuggggaugcaggugagugauagaguacuuguccugcaugugcaagguccuuggcuccauccccaacucugcagaaagcaaaaggaaaggaaggcaagguugaagaaaggaaaucaagaaaagaaaggagggaagaagggaggggaagggaagaaaagucaagguuacuuuaucaguggggauggcucaaguucccccaagcauugcaucauaaagaacagcuuucucugucugucuguccgucugucugucugucugucugucugucugucugucuguaucuccugguaauuuaguuacugaagccaucuugguuugagaucuuucccuaagccaugcauuggcacuaagggauagagagcagaaagggcuguggagccccagcaacccuaccuguagguuuuagaagagggcaccaugagguccuuuucugggagacacucagaggaaggaggcagacauuuaagcuuggccaccaugggguuuugugccaucaccuugcuccaaucagaguggucauuuggcagcuauuucuucuaccuggaauggaagguccuuggcagcaguauaaggaacuggcugcuuugggagccagaaagcuacaaauggugaguccauuuagcucuggagacuauagagcuucugucgaggguuccucugcuucaacuguuagagagacuggcucuugaguagccucaaucuauaagagacuuuguaugacaucuguuucuucucucuuaaggggcaaagcaguaggauacuucuagaacaagaacuagauacauaaaguauaauaaugcaaagaucaugagagguaaggagcuaaggugaggugagacacagauuaaggaagcaauguugaaucuaaccaccacacaguugggggaaggccucaagguucaugaaacugaaaaauguuagaaagcuaaugaggaaacacuucagaaaagcaguccaugaaucuuccagaugugucagccauggaaaaguagagaugaagggcaaagauguggucaagguggggaggucaguucugagcaaacauaugggaaaaaccuuaaauccuuaggcuaacuguaaaguacaaccaguacuuuuggucugcaguuuauagaugagcaagucaaggccaaguauuucucauuagcucuucuucugcuugagggcauagagaaagguguguguguguguguguguguguguguguguguguguguguguguccagaaugggccucagauauugaaagugaaggaugaaaaucugaaucugucuuuaacucaguuccccaaggcccauguuacuuguucauuuguggaauagacagaguaguagauggugagagagagagagaugagaggaauuuuggaaaagcucaaaaugggcuuuuggaccugaugcuauagccacuugaagucacuguaaagacccugagaugugagugauguguugcccguggccuuuucuaucuuaugugaggcugucaaagcggagcuggugacagauuuagugggucgucuuucaucuuccuacuguacuaccuccgagcccauauaugccuggcccugccuagucaugcaucucccaggugcaagaccuuguucaaaguuccauccuugugcaucuuuuaccucauugucuuccaugccugcccuggaacagaauggcuguucaggcuugcuuugaucuaucaguuuuacaaaauguggucaggaccuauaggguugcauuucaggaauaucuugcuaucaaguggucagaauugauugauuugggacuaauaagauggauggccagagguacaaacauucaggaguuguggguauaaguugccccuuccucuucaguuugggcucagauccucuguuaugguacuucuuguaaggcauuuugguugguaaauuuguuaggacuucuauuucaaggacucacaaacugggcauauuaagaacacuuggagugacucugcgguuugucccuauuugcauagcaaauccacaacagagaucagaacaccuguuuuccagcccaucugcccaggcuaugccauagggaaaggaagagaggaugagggacaaggccuggacagaugccggaaaggaagagaggaugagggacaaggccuggacagaugccuuuaggauucaaggacaccaaacauuaugguccagaggacauacggaaacaucauauguauucauucuccuugagacucuccuucacugagggagcuaaugcuaacaagcaaacagccauccaggcuacugaugucaccugucacuuaauuacccaucaguggucagcaaugaccacgauuacuaaauuagccauugaagccauuacuucauuugccuugcacccucugcuccuaaguucacaauauauucuguccgacccgaugucagcacccauuuucugugacccagcaggacaccucugugagccaccaccacaaggagagaaugaaugacuauggacacaggauaguaaaugaggccauagaaucccugcuucaucucugcauccaucaucucuguauccaucaucucuguauccaucaucacugcgucccuuaucucugcauccacccugcaguguuccugggccuaaggcgugguagauguuggacggcuuuaacuucaaaccuggcucuuucuguuugagaacagucuauagaaaucugggcugccuauaaguaaauguuugaaauauuaacuccauaaaaaagaggaaagcugauuuuauugcuuggaucucaacaauauauugaauuuuuucaaagagaaauaaaaagucauucaguuaugggcaaacaccaauuuucuguaucuuuugguugaagggaacaauaggagugauuacagcugucccauggaaauaauaaaugcauguccucaauccaucauccagugccuuggggucagauauguuugggaaucugugucuuuggauguuugaagggaaauggguugcauauacuguauauucuauaauaccccugguggagucuggggcaguguucuauaaucaagccuauuaauuuuucugcaggaaaaugucugacugucacacuaagugggaaaaauaaagacaauaaauagccucacaucacugcaggucagguuuugccaucaacugaguuauuaaaaaagagagagagagaaggaaagaaagaauccaagcaaccuuuugguuucagaauuuuuggagugucaggauugauaagggccuguggcucucaaugauuaauacuggcuacuuuacuauauaaacccauacagagaagaugauugccugugugcugcuguauaaaucaauuuucaguaguucaucaaguugugaagaccucagacgcggggcugggugggggacuuacuacauguggcaucgccaaggacugaauagaucaggcauagaaagggugcugauaaacccuggauggauacaucccuuggcaggcuccuggcacugcuccuugaccccacuuuggguugauuuacuuagaucugaguaacugggcuagugggaaagaaaauaugaacagggaauaaacagaacuauaaaacaauggcaagagcuuacacugcccuggcuggaucuuuacgacagcuugguccugugacugacauccuacauacaugccacucgcugaauucuuaagacugcagaaccacugugcaucuguuuuuguaaaugacucccugaggguagcacagcuaguuaguugcagaaccaguuuugggacuccaacauuuugcuuccugagucuauauuugcaacuccacugcauccuuguauauguacacugaagccaggcuccacugagaauauggacuaaugaggaagaagcaacuaaguagguaguagugugcaucauugagacugaagagagcacuccacauugccuuaugcacuucucucagcaauucuagaaagcgcaauccaccccgauuuuucaaauggaagaacugugcugcaggacaugcagggcuggaauucaaacccaggaccucagggauuuggccccaggagcauaaaugaagguuuggggcccauaucacagauaccaggagguguucugacaacaguuaggagccacacagcaaucuuggugacuccucaaaacagugagaggggaaucgauacuaaaucuuuuccugacuauguauugucagccaaguuccagcucuuuucuauaucacugcuccuuucuguaaaauggggacuguagagacuacuugacuacagggguuggcaccaaggaugauuugggggaagcaaaugguauuaaaguacaaucgcucuuuuaugccaauaugucuacccauagaauuaccaggaagugaaccaagggcuauuuggaagagcacauagggccuuuuggaagguaaauaaauauauaaggaaaagaggaaggaggacucuuguuucugacugaacaugcuggaucaaguucaccaguauaaaccugccaauagauaggcuaugccagagcuucucuggauccuucuguaccugguuuguacaagucuuugggauagcaacuauaauaaccccugucuuccuaucaggugcuugaggccuucacaucuuuauaaacuaccaugauggugcuaguggcucugucugauauuaguagcccuagcaaggucucuuggacacccucuuacccuuuucuccaaagucugcuggccaucgcccugaagguuuuugcugcaucucaaaccucugaggacuggcuccuucaccugcuucauccccacuguucccagagagccccucccuaagccagggcaaaaugguaacgguauuguuuuccuauucauuucucucuugauucgccucaagucugucccagaugguuguuuagagcaaauccuuaccauguuucuuugucuccugcugaaaauaauucagucacuuccuaucaacuucagcaggagucagcaacuguugcugugaagggcuauaucuggcccuucacauauuuuagguuucuaguccaauggagaagugaguauacauugagcgucacuaacccccaauucugaaaugcuccugaacgugaaaccauuugagugacaaccugacacaccacgucauauaauucacuggaaacagauuuugucuuauaaaaauaguuauuuaaaauagcauguuaaauucccuccaugcuguguguauaugguguauuugaaauauaaauguugccuuuagaugugcuauuucaaagguauuuuauauauacaaauacuuccaaauaagaagaaaggucaaaaucugaaauaccuauuuuuguaugugcguguggucuuuguauucauguccacacguguguguaugugaguacacaggccugugagagucacaauguuaagauagguuaucuucuucaauuaucccccaucuuaaucuuugaggcacggucucuuuguugaagucagagcucacugauguagacaauagguuagucuagcaaccuugcuuguuccagagguccccugucuccaccuucagagcacugaaacucggagcacuggguugacagacucaucagucauuuacauagauucugggcaucagaaucuggucuucaugcuuacugcuuggauggcaagcacuuuaccugcugagucgucuccucggacucggaaauacuuucaggcucgaaaauuuuauauuagaggugaucgaucuauaguuacuuacuaauacaguaagagggaagauacauuuuuacaagucuuuuauugaugaaauucaguguguaaggagcacugaauacauuuuguuuucaaaguuuuaauuuuaagcuaaaauauaaaaaguuacauguauuagugguguaccaugugacauauauucauauauaugauuacguagaugagaaaggaauuuaauucagauuagacauguaccucauauacauagcauuucuuuaagaugaaaguauucagaauuacuuuucuagcuuuuugagauggaaacuacuuagccggauguaacuccauaccccuggaccaggcucuccccauccuucucugccaccuguccacaguccagcaaccgccauauguggguucugcuucaugcuuuacaucugccgaugagaagaauugagcuucuuggguauaaaaucagaguuuguuuaauugguguucauguccccuaauauuaaauucauugcaaauauuuuaccagugaaaaccauucugagucccacaggccacacagaaacaggcuugggcccagggcuacaguuuucuagaauaaucuggaugauucucaaacacacugaugaugguaccugcacugaggcccacauaacaagcagccuggguaucaggauuguuugaaaguuuccuugcauugccaggacugaagacuauaagcccacaggacagagucugugggauaccugcccugaucucacagugacaaccucauuucucuuggcuccguucugucaacacaagcuaauccuuucuuacuuggaggucuugccuauccuuuuguacaucuagcucuccauucauccuuucauaucucccccaaaggauaaagaauguuuucuuuuuuuuaauucuuuuuuuaaaaagauuuauuuauuguuauacauaaguacacuguaggugucuucagacacucgagaagagggagucagaucucauuacagaugguugugagccaccaugugguugcugggauuugaacucaggaccuccggaagagcagucagugcucuuaaccgcugagccaucucuccagcccccgaagaauguuuucuuggcagacggaaacacaagcuaaguuggggaagggacuguucauaugcacgccggcagcccacccccgucaaggaagcccaucuaguaucauggcggugaggagccauaggcaguaguagguuucaagucccugguaaucagggguuuauuuucugggaagcucauguuuucugugucuuaggccuucucucaucagaaccuuggcacuuguuuuaagaaaacaaaguucguuuuuccuugguuucuuuuuggucuucaaagaauuucgcucuugaaaacaagccaugugugguuaaaaggaaagaaagugugacuccacauuggcaugcaguggccacggcauucuuccugcagucccggugcaauccccaacaacagugcuucggaacugagcccagcugaggcccacccucagccucaacucaaaccugcaaugcugugccugcugcuugcuucuguccucucuggaaguggaaucgucccuuccauugguaaugcugaagcucccaagaaugcugucacagacccaugccaucuuucacccucaugauggugauuuaugacaaaauuauuuugguuuguguuuguaccuuuuaaaaugugaguaagagaaaaaaagacuaaguguccaagaacccagaucaucaaaagauacuaugauuuccaacaggaaggggaagagggaggaagcagaggaagaggaaaggaaggcaaugucugcagcauguaggccuaggaaucuguaaauauaugucacggggguuuucuguuuuaaccuguacaucccagcaaauuaagggaagaaagagacauauuaaaugucuugccuaacuguccaagguugguugguugguuuguguuggugcugggaguguguguguauguuuguguacagacuuuucauguauuuguacuaaacaugaaggaugcucagcccaguguaaagugaaccagaacauuaaccacuaaauggacauuaccaccuccugagaucuaucuuucuucuacccugacccaggcucuggcuuucuaacuuccugguagguuaacuucuauccagauguagaacgccauaguuuagccaguuuugugaugauguaauggaaucauagagcaucaguucugcuugucuauuuccaugccuugcccugugguuguuccuucauuaucaacacuguguagcauuggcucuggcuuuauacaagguugcuuuccacuuagagacauaugcaaauggugcuucaagaagaguuagugugugagccuuuaggugcuacuuugauuuuagaauuagaguuucugggauacauucaugccucuaugcaugcuugcaugcaugcauacauacauauauacauucagacacaugcacauguguauuguuuacuaguuuugucucagguacagacccaaacccaacuguccaguaguguggucugauugccuugcccacuccaaggacacacauucccuagcauccauuacuuccacuuuugcuauucuagggaucacacuauugugucucauugugguuuaggguucccuaguaaguuucugauggcugggagcaccuuuuacaggcuuacugacccuugagauccucuuuugucaagugcuuguuuaugacuuccuuuuugaacaaugaaccacacagucugcuucuggcuucuuauuuguuuauuucugggaauuccuggugcauuucaguauaaaucccuuaucagacaugcuugucuucuucaaguuggugccuuguuugagucuuuuuccaguugcuauaaugaaauacacagacagaggcaacaagagggagaccaaguuuauuuuaucucagagcucauggugagggcgucauggcaacauaagcuugaagcagcugagcauuuuguauucacagucaagaaacggggagcagagaauguuugggcuuaacucaucucuuuuuauacagcccagaaucucaauccagggaaugguguaguacaaguaguacuauguaguacauaguacaugagucuuccuaccucaaucaauacaaccaagauaaucuccuacaggcagaggcauaaggccuaccaauucuagagcucaucuaggugacaacugagauuagccacaacuggguuuuugacaggguuucucuauguagcacuggcugcccugaaacuuacucuauagaucagguuggcuuugaacucagagaucuaccuaccucugccuccugagugcugggauuaaagaaguguauuaccaucaucugguugacaccucucucucucucucucucucucucucucucucucucucucucucucuccauuaauuuauuuauugacuuuacauccaaucacagugcccucuccuccccucaaauagccccugucccauucuccccuccucuucuccuccuagaagggggaggcccccuggguaucaccccacccuaguuaagucacugaaggacuggguacauccucuucacugaggccagacaaguuagaagaaugagauccacaggcaggcaacaaauucaggacaggccuuauugcaauuguugggagcccucaugaggaccaagcugcacaucugcuacauauaagcacagguugcagugggggcuagguccagcaaacauguucucuuugguugguaguucaguaucuaggaguaugaggauccaaguuaguugaaucuguugguuuucugguggaguucauauccccuuccgauccuucaauccuucucccaacuuuucuacaagacucccugaacuccaucuuauguuugacugugggucuuuacaucuauuuccaucaacuguuggguggagccucucagaagacagcauacuccugucuucaaguauaacagagaaucauuaauagugucagggagaaucauuaauaguguuggugcuugcccaugggaugggucucaaggccagccagucauugguuggccauucccucagucucugcugcauucuugucccuacacaucuuguaggcagggcacauuuugggucaaagguuuuguggguauguugguguccuuaugccuccacugggagucuugucugacuacaggagguggccacuucagguucccuaucucccacuggagauacccugcuggagucacccccauagacuuccugcuguucuuuucccggaugcucucuuaaugguaccauuugguaaauagaaauuuccauuuuggugaaguugaguugauaaaauuuucuuuaugcuuaacauauuacagcaugauuaagaaaacucugccuauuuugagcccauaaagaaguuauuuuuucucuauaaaauuuaccuuucugccauuucuauuuggaucuaugguccaucuguaauugguuuuccuuuagagugagagauggaggucaaagugcagugucuuuugcauauggauagcuaacagaguuagaaacagcuucugggaagagccucuccuccccugcucagcagaguccucucggucacacacagggaaacugcaucugugggucugauaccagcuccuacagccgaacauuuugguagagugaucugauuccugaguguagcuucguuucauuguucuauaauagaauuagagucaucaacucaagaacauguuaaggauggaaggaccucacacacgucacuggaguaggauuauucugugucaucugauagggacacuuucaaaguaaaaaguggcaaaugaggguuggcggguggaagcauagggagguuuagauagaggaagacaggaaguccuuggcccuaagagggagguguagcgaaaaguucuggccaugggcuguaaccuucgaaaaguuguaaccccagaggauggggggaaacacauuuucauuuucuacagcuguaaaauaaagcaagccaucagacaaggaaguauuuguugaauaaauggaguuuauaacaguuugauuuuaaugagcgugcauaauuuguacuuagggauuauuagcucuucaaaaucguguuguaacuggguuauuaauuacauuuuuugauuacaggaguuaauccauauaugcucuuuucuuaauaggggauuacauuuuuguaaaugagguacauaaauagagcaguuagcagcccagcuucuuuugcuuuucuauaauggaaaucucagucuacuguucugaguggacaugauuaaccaucugcuguaaguuacccaaaaugcugacagagaacuuagucuuggcugaacauuuguaucaugaacaaaagcuucagccauagauucuuguuuaaucagcccugagaguaaccugggcuuugagacugaagagaguucuucaacaaacucuaauaauugaccaaggugaaaaucauaggacaaggucaaguucauucacuggugggacuugucuccauucccuacaguaccaaaguggaccccagaucuguccccugaagcccacagcauugcucaaugacaaguagcuguggaccgggcagggaauucccacaaauggcuuucccuuacauacacauacuccaaggcccaguuccaggagaggaacugggagguauaggaagaggguuccuaguguguacugauguaguaguauauuagugacagacuuauacugaaacacugggcucaggaacaguagcaaggugagggaaacaagaagacagggaugcaaguguccccggauaaaggacacugaaaaaggaucuguagccuaacucaaugcaagguugaugccaaauagaaauuucugugguuguugagugaauucaagaagcaucagggugacuuacgguucauagaagaaacccugacuaggaggauuugaacucaggcuccugaaagcucaugccugugcacaucauauuuggaguucaauugucccgguccuacgcaguguagucaggagucccauggauuccugaguccccaucucaaguguauggcugauaggguucuaccagauaaaucaguaggaugagaaaauguuaucuuuauucugguagagaagguuuucuuggucgcacagcacauacugaagacucaguauucugcaagcuccaagguggguaugcagcucaggcuccaaggcggguaugcagcucaugaucucaagaugcuucuccucuuaucuaaucuaauucccuccccuccccuccccuccccuccccuccccuccccuccccuccccuccccuccccuccccuccccuccccuccccuccccucuucucuucucuucucuucucuucucuucucuucucuucucuucucuauuucuuccuuccuuccuuccuuccuuccuuccuuucuuucuuuccuucuuccacuuauucauucauucauucauucauucauucacuuuacaucccaauuguuaccccccucccuauuucaccccucacacaguuccuccugcuauccccauccccuucucuucugaaaagauauacaccuccgccccccagcuaucccccuacugugguauaucaagucuuugcaggacuaggcauaucauuucccacugaggccagacaaagaagcucaguuagggcaacaggaucuacaggcaggcaacagauuuggggaaacuaccccauuccaguuguugggggggggucugcaugaagacuaagcugagcaucugcuauuuaugugcauguuggggggggugcuaugucuagcuuguguaugcucuuuuguuggugguucagucucugagagcccacaaggauccagguagguugauucuguuggucuuccgaugguguuccuaucccugcuggaucccucaaacccccccccccgccccaauucuuccauaacagucccugagcucuguuuacugguugucuaugggucucugcaucuguuucaguuagcugcuggguggagccucucagagaacaguuauguuagacuccuaucugcaagcauaacagagaaucauuaauacugucagggauuggugcuugcccaugagacaggucucacguugagccaguaggauacucuuuucuuaggguugacaacuugaucagaguuuggcauaaagaauggucuaaaggccuuuuggauaagugaaugaauuauuggaaaacaauuucuauuauuuguucucauauuuuguuuaucagggauguagucagcauagauguaguuguugaaggcuaagguagaagaugaacaccccuccuucccacaaacacacugugcuagaagggagaccgcaggaacaguuguaauccugagucccugccucucucuaaugccuucuacuggccaagaccaacuaaguguugccagcuaggggaccagagugguguaucuaucuacuaggucgaccagucucugugauaggagccaaaacaugaagguagaguauggcagggucaugguggccacuguaauagcaauacaugcaugaagugucugcagugacagagggaaaguuaagagacccaguggcugcauguccucacuccccaacccugaauauuacaagcugcauggaaguaauuaauaccacauccaggaauugaaucccuggacccauaauuacauguacaagaauuuuuaaagaugugauggcagugguuuuaaugucucauaaauauuccuccaaggauccuuggcacagagaggagugguuuugcuucucaggcagggagccagaacagccuguccuggagaaagagcgggaguuccuccuucccucuuacuuuggccagagcuuuaagcuucacugagaacuuagccuguggguucuucucuacagagccucuguaccuuggagucccuuguaaccugucucuccagacugcugccacaacaggcacaggggcucccagucaguuguggagaguuaugcuggggagaguuucccaggaaacucaauuugugugccuacauucuggucugagcauagcaugcgcacaagguagagguuuuuauucccucaucugcagagggcagaggaaggaacuagaagguagaagguaugcaguaguaggccuguggagaugauuuggugguuaaaguccuugcuauacaaauaggcagacccgguucagcucuccagaaaccacacggaagccaggcauggcagugugcugaaacagugagcuucagguucuaugacauauccugucucaagagggaaggaaggaaggaaggaaggaagagaaggagggaggaaggcagggagggaggcagggagggagggagggagggagggagggagggagggagggagggagggaaggagggagggagggagggaggugaacagagaaagauaccugaugucaaccucugacuuccacaugcaugggcaaacacuuguaugcacacacauguaugcacacagaaaccccacaacauagacacaaaagcauguguaccuagagccccagaauaaaagugguauugaacaggcccucugacaugggcacaguucgcuuggugaaacuggcccagaagugguacaggcuuaaguuugaaucuuuuuguuuguuuguuuguuuguuuuuguuuuuucaagacaggguuucucuguauagcccuggcuguccuagaacucacucuguagaccgggcuggccucgaacucagaaaucugccugccucugccucccaagugcugggauuugcccggcuuuaaguuugaaucuugacccuaccucaugagcucuuuagauuugagaaccgccuauaucggccugauucuucaucuuuccuuuauaaaaaaaauaucaucauaacugugcccggauagaaauaauuugaauaaacauuucuaucccagaaucugccucacaccaguugcuaccuacauguaagccaauuucaaagccacuuuuaggaugagccaaugccucuuccuuccuguggucacaggacuguuuguaacuuugucucuguguuaacugacucccuugcccuccccucuccagcagacuggcagcucuuuugcaccuuaaugccuggcugcaaagucugucuagagaggcgaucagccaagauguguugaaugaaugauggagugccgagcagaugcugggggcuguugaaauuccgagucguguccuguguuugagccacugcagaagccgugguuaaggagacagggaguugggaagaguccagaaaccugaugcauuuagaaggcaauucacacugguucuuucugaguuuuucaggccguuuaacuuuggggaugugauuacaucuuuggcugcagucaccaugugcugggggugggggugggguggggguggggugggguggggugggugggugagugggguggguaggugaguggggugggguggggugggugaguggggugggugggugaguggggugggugggugaguggggugggguggggugggagagugcuuauucugauguuccagauuguucuuggcuccccuuugucugacuacuuaagagcucaugaaagcaaggaauugguauaccguggaaggacuuuggcaaaggacaggugaagcugguggaacaaaggacuaugauuuacacagauacacagaccauguauccaaaauccaggaaugccuacugugugcugcuguccugcauucgugccuuccuagagguuaucucuauuaauccuuguggguuguucucauucuugcucucuugaaguugaggaaacaugauucaggauggguccucuaauggcuguauucacacaggcauucaaccccaauucugaccacagagccucuaccacuccaucccccaaggcucugguuucccuuucugaugcgcucacacaggagagacuccauguuugaguaaugaggcuguugacuuucuuuuaagaaaaagacacaggaccagucugcuuccuuaaucaguucccuggaacucuugaacugggagaucccucgcugugauggcuugccuuggggauucucaaacucuucccuggagggucauaguaugcuuuccugaguucuacagaguccuguucuuaggaagcuuccagaagccagccaagccugcaucuuuguuccaucugcaucuuuuauuagcauccuaaagaguuuugauucuucagugaaccccuagacccccaaaucagacuguucccaaggccugacccaucaaggguaacucauagaacagagauucucccaugauuccacuaggaucccggaaauagcacugaauucugccucuaggaucuggaaauucuguacagcuccauauuggcauucuuucuuucucuuaagcuuuuucuaucugucuuaacuuggacgcaaaauauaaacagacaacugcccauguuugagcaguucuuugcuuugcucauucaguguuuacugcauuucugagcaugccugugauccugcagagacagacagguagcaguucuuuuggguccccugacccauaagcucugcccccacgcaguuccuuccauuuacuccugucaaguagaugugaaggacugaggaacccuugaacauggcuagaccccagugcacccaaggcagagcucucccccaaaaccccaggauuccccuacugacuugcaaucuucauagccaccucaacauuugagcuacaaagaaaacacucacagaucucacuaugggacuacaugagggagacaagaggcgagacugggugucaugcccccauagaggacacgcuugcccucccaauagugagacagguaguuggcagggugucacucuugccuuagaggagaaaauacacauuagcuagguucuaacaugcuuuaaaacuuggauuuuggaaucauauuuauuuauuuauuuguuaauuaagcuaaagggaagaaauuaauauaugcacuguggcaggugcuagacuauagugauaggaagaauauucucaaccuaccauggggaaacuuucaggaaaaggcaaaccuuagacuaagccugugggaaaggcugugggauaaggacgagccagcuagguccaccugagaaggggggaagcauuucagcagagugcccuuaaggaagcuauggaaucacaaccuggcaaggcgugguggcaagucccugccauccuaauucuugagagguugaggcaggaggaucaugaguuuggggccaaacugagucacacagaaagacugcccuagcuaaagcuaaaaagaucccuaccugcagaugucacccaguggucaucugaggaucgagacaaaucucagaugaggacauuuuacaccaaauacugcauuuuguuguuugaaguccacccuguagcuuuccauauaggugaaauguaccaaaggaagaagauucugcaugucuuugugaggugacagggcucaucuucuguuggauggaugcccuguuguccuguacaugugguccacggugugcagacaggcagacuggccagccgugaaaucugaaugcaaacuggcugcuaauuagaggcuugucagguuugaagaauccaggcccacuguguucuucagcguuaacacaccuucccuucaaaacguuaaaaugcaccuugcauuuaucacagugugaacggcuuuucaauguguuuaggcuagagugaccuggagcaguccucaucccugcucacugcaaaguccaaccauaaaagaagccaugugcaaucugcccaacuagcucuuguccaggcguguuugcaaaugcauuuuccucugccaucugacuccuucugcccauucugaccucaccaucuccuccagcuuucagcugucagcugaggggccccuuaguuuauugcacauacauagcuuugauuaaguauauguacauacaaucugcuucaaaucuuucuuccugagagagaggagauaauuucauugacccagguccuuaauacaugagcagguaauaacaaacaccaaaggaaauuucauaugucaacucuuaauauccaugauagagccauuaugaaaaauauucuuuagccaauaaauauguuuugaaagaauaaaccuaaaaugcugaaugggagacacaggagaaaauguugcaugcagucuaaccucaacuuuauaagguucauacaaauucauuuuaaaaucuaucaaaauauuaguucuggguaguagugcuguagaauaacugcuuuuguuuuuguucucccaugccccuucaugcucuucaguuuucucugauaaaaaguacgugacauuaauaacuuaaaaaaauuuaaacuauuacuggggauacuucaagccaucuggugucuugguccuuucucaaacucagccuuaaucuucuccauacacaucacaggcacgcccggaugaauuggcagccccuacuagaaugauuuaaccaauuaacuuacucauuaacugccaugguaucuuauaaaugcuggacaaaagaucuagaauaauccuuauuaagggauagacaaaggggauauuugaaaucccccuccaucauuccuuuucugcuuuucucauggaauucccacagggacuaauacccgugaggauaaaggauaaaauggcauuagagucuuugaaaggaaaaugaguucaagacgugcccauuguugaugccagagcagaauucccaugaaguguguguguguguguguguguguguguguguguauuacuaauuauucuaggcuuucggcugcacuuaccuuucucguggugaauucuugagcucuguuaaaacauuacuguaguacauaugacaccauucucuaauguagagcaguuuuagauaaccaggcaucaugcuucccauucuaugaccaagaggaaaaaauaaauagugagucuguggcaaaauuagcaucauaucuaucauuuacuggcaaagcugugauccagugaugucauuuuugaaaacuccccuuaaggauacgauauucaagagaaaaaaacaaaggaaguuuuaucucuaaagguaguucuucugcugucguccauagcagaaagaacuugaaagcaagguagaaauaaauuucagccugucagggagugggcuuuccaauaacucaguagccuggaagaggcccuuugaaagaacagccuuauacaagagggggcacuguguauaauguugauaguuuuagguucgguuucuaacuuugguguaccaggaggugcaaauucauggagaaagacuuaugugcaauggcuuugccacacugagauacaaaugucaucucccagguccaccugaaucccggcaaacaucgcugggcuccuaguuacuuaccuguuaauaagcacaugcuuuagagggcccguguguucacucaucaggcauucaucuuagaagaaucuccauccucaacauccacuauuucucugaauuucauuuuggaaauuugucacacaaccuuuggcucucacaccagauucacagaaacugucaucucauuucccauuugcagaguuugggagugcuagcuccuucugucucccugucuuagucuguuuuacaugacucuucuugggccuggaaaauuuuuaaaaaucauguuuuauugcucucaaccaguguuccucaaccuguagguuguaaccaucugaaaacauauaugccccauggucuuagaaacugaaacaccacucaguaguaaaauuacauuuaugaaguagcaacaacaacaaaaaguuauuguugggagucaucauaacaggaggagcugucuuaaagggucacaacuucaggaaggucgagaaucacugcucuaaaggcugguuccccaucagcauaggacaggcaccugacaagggccuuccugcugugacacucaacagcagaaggccaaagggcaggagagaguaagggugagacgggagaaaacucuccuuuguaacaaacaguggcuugugguaacuugacauuguucaaucuccgugaccuccauagcuccuggcaggcccaagccccaaugcuguuacaucuggaugauguuucaacacagaaacuaugaagcacacucagacucuaacaccccccccccccacacacacacacuugcccaugugccucugcucucccaccuuuuccccuccagccugaggcaguaaguccuagguucuccuuuggaauccaggaacacucacuuuccugugcuggaggaagggugggauguaaauugauugauagaaauuagccuggacacaguaucuuugccuuuaacguaauaacuuaaaggggacucucuuagcugcaugauguguuaugccaggccuugaaauaaaacaacuauuucuuuaaaaaucagcauguccaucauauuuuacauuuaagauaaacaaaaacauacuugaaaggaugcuucguacuagugaagaaagugcagaauguaucaguaguauaggaccugccugccuagucccuuuccccuucucuguuuccuguucucuacucuucccuccauccagcccauguuugugucuaugcccauuucauccucuagccacagaugugcuuaccacauacuuauuaacuaucugguacuuagaaauuguucuaaccuugacuauacagcugugaacuugacagacaaaucuauaugucuucaaugccauccuguuuggcgugugguuuuaaugagguuaaaaacccucugcucuaaagaacaaaaccagcgaggcuucuugucccgagcagugugacccuccuuuuguacuuuuaaugugccugcaugaagauacuuuauugucuccauggaugaguuuccaccaacccauggaugcagccuguguuugcaaugcuggggugugccaucugucucccuuauacaguguuggagacuuugucaaaaaggaguaauuuggagccaagauguauugagcaacuacugcaccccaugucaugcccuguaacuccaagagcuccugugucuuuccacaggaacaagcauuuuguugcuauuuuacaggucaacaugauucuuaaauaagucaaauuacuucugcaaguuuuuuuuuaaggauuuauuuuuaauuauuuugguauguguacaggugcaugugugcgugcgcauuuguaugugcauguguguauguguguguggggguguguguguguauguaugugucuguguccauguaguuaugugcagaagaacacaagggcucaugggaccuagaagguggcguaugaucaccuggagcuggcguuacagauaguugugagucucuuaauauagaagcugaaaacagaucucagguccucugcaaaaggagcaaguacucuuaacuacugagccaucccuucaaguccucuuaacugaaaaagaaaaaaaaguauacugguguuuugcuuuccuguaugucuggguaccaugcguaugcuggcaccugaagaggcccaaagaggacauuguauccccuggaacuggagugugagaguugugaggcaccaugugggaaucaaacaaacccaggacuucuguuagagcagccaguacuguaagccaccaaaccaucuuuccagagcccccuuugguguuugcaggucaggauucacaccuggcuccuugauucuauugcaguucuuucugcuuacaccauuggcugugagagguucaguguugaguuucagaugggggcaguuaacagcugugggauaggccucaugucccuccccuuguugauugaauguagggacuuuguccagauagaacucuucuucuaccaaggagagaaaaauuaggaagcuuugccaccgaaagacaggccauucacuaucuucaacauauaauuuuaaccuccccuccuugcagauuuucuuauuacauuuuacugcaaaagaaaaugguucugcucuucagaucccaucacaccccgggauguccaucuaguagguauuggauugaccuuuagaggcugaguuuggaaaaaauaaaaauaaaaucaccacucaaaauauauuucacaagcugaaagaaugauacaaacguucaucuaucugugccaaacuuucagugacccuggcggaaguaagugacauucggcugcccaacaaagggagauacaggacaggagcccuaagcuaagcaacagagaaagccucuuuuucugaaaguuacugggugagggguggugagggcugaucacauuuccuguguguaguccccaggaggucucuugucuugucaguaacagccauugucguucacagcaacucuuuuuuccuuuggugccuuuccucaagugcuuacgggacuuggaagccauaguacccaggcuugugucaaagcacacucuacuggagguucuagggaaggaaagccaagagcucaggcuccugggggcagggcacauggguuuucuccuuugggaauuuuguaagcaagggagcuuucaggacuggaaggauuagggauaaucucagcaguguggcuguauucuaugaugacagguguuuucagugugccugagccaguggacccagcccauaauauucccagccaaugguuagguaaaauccuggcuuccauccaguuuccagucuaaguuguucuuauuacuuuuuauuuuuaauuuuuauuuuuuaauauucaaugaaguuguacuauaagagcaccuugaaauuaacagucuaccaggcaacaugacucuuauuaacauucuuauucuuucugccaagggaccugcuaaccacuccaggucucaggcagugugguuugguggcacaggcgacugaggcucaggucugaagauaagccuauuaguucuguuucugaggcucaguugcugggugaccuugggcaaaagucccuugucuugaaucugcuucugcaucaguaaauggaggcuaagucucacucuuguggcuuuggugagaucagauuagaagaucugauuugcaacuuagagagacuuaugucuuccugaaauggacugcuccaggcauuucacagcccccaccuuccuaucacaucaagucacccuuugguugggaaguuuagaucuuccuuugucuuuucccucacuguguuguccugacuggucuggagcuccugacuucaauggccuucccacuucagcuucccgaguagggacuacacgugugcaccacugcaucuagccuuagauccuuccgaacaagaugauuugcucaggcugagacugaccuucauaugaugcagaaaacaggcacuugagagguggcuuucauaaacuaccacugaaagaguacuuaauguggacaaagcuugguuggugacuaggggcuuccugcauaucccacuaaaaucuccgugguugcucaaagagaggugguacuucacuucaacucugagugcccacacacgcacacacaugcacacacacuggaacugagucugagagaaguucaguagcuuagucaaacacacacaaaucaagugacagaacaugacacugugucagcugacuucucaauccauuacauuucccaaggucuuaggugccucccauauccugucagaaccuugaaaacuaaggcagagcuuucaauuuuuaucagucugaugguuguggccacaucuuguuggauuuuuauauuuucuuguuuugaguacaagaucaauuugccuguuagcuuuuagggccucuguuauugacuucuaguuucuuugucuaucuguuaaugggggcucucaaguuuucuuauauuuuggaaggaacuucuaguaaauucuaaauauuaauuuuuguuagugguagacaaguaucuucucuaaaaauguaucuaugcauguaaauuccauaaucuuugaagucuggaauuacuacacccaccccuuuuuuaaucuuaaaauuuauguuucugcagguuuaaguuuuguuaucccccacaaaugaaacuuucuucuuugcuuucuuuuaguaacuuuggaaagcaaaggaagguuagacaugggccuuuaguagaaggcccagaccuuaugaaucucaaacugaccucauaauuuuugguuccuucacaggacccuauacaccaacaggaaagcaaguagaugagggaggggcucuaauuaaaauuuuccacuuuuuaauuuuucugaacuucaaggguacucaccucucacaucacagaagcaauaguuaaugaguagaggguccccgggagcucuguacuguaacagaucagucuccaucaccacuguagucuguuggucuaugaaguuaggccuagaggcacccaguagacagaagaaaggagacaagacugagggguggguaacaacaguguaguugacccaggccuccaacucacugaccccuucucaaugcagaggcacccagaaaagcaagaaaagcaagcaggaggcaggcucagggcccgaggagagcucugcuuucuugcugguuaucccucuuugggggaacuuaaacacaugagucugauuuaacaacaauuucuacaaaaagcaaacuagguuaggauuccagucucacacucugugauauaugguucccuuacuaaaggagaaacacacacacacacacacacacacacacacacacacacacacacacacacacacagagagagagagagagagagagagagagagagagagagcagguaaggaaguccagagcagcuuaugaguuggagacccggggucaguuuuaacugcuuccuggagaaagacucaagucuuggagguaggcaacccagggugcaggcugagcucuaccagauauggauuaguaaucacacaaacaagcagagcguguuuuuguuuuuuuguuuuuuuuaugguggcuaguguuguacaucguaggggaguuuuuugaucuacuauucaaagguacuagaaggaaauuggcacagguccacagauaaauccaaguuaaccugguaaaaugggagagguuauuggauauacagaaggauggaauggaaagaaagaaagaagggagggagggagggagggaggaagggagggagggagagaggaaggaaggaaggacugugaguuuggguuucugaagcucucuguuucuacgcaccaguucucuucccuccuggcccagggauccugauaguaaauugcuaaaucuggcaggagagcaugaggaaaauaucuuuuucccugcccaucaauugucuaagaguuucacuuaaagccaagcacaugcucuacugaagcgcucaccucuggccuccucagcuucuuugaacccuaucacugguccuuggaaaaggaaaaugaaaaaggggggggggcgagaggcccugagcguaagagacgugaaucaugcugaaccgcaaugcuccucucugaaccuugcuagaugagaauuauacaugcugauuucacccgcuacuuaacucagggggugacaggcugcaauugaagaggcuucagccaguuaagugccgcaaacccuugcacggguucugaagcggcuuucagagcccugugauucggguugguaauuuggugguggccuugcuagugagucuuggcucuuccuuaaagaaaaaaaaaaagguuucauccccugcuaggauguagccugcucuuuuguugucuagagacuagagacaguuacaagcagagaggguggggaagagauuuuauaaggaaagaaaagaaaacgagaauagacuuacaugaccagaaauagccuguccauagagcugucuucuuacuggaauugggaaggcaaaggaaggggaggcuaauauuugucuguuguucacuggguugcagauuccuaucacucuugacuuuugaacuccacauaucuccacaagacagguguuguuacuccuauuuuuuagguuggaaauuaagguuaaucagcuugcccaacacaaugacaacauggugguguggaugcugacagugacgguaaagcugacauuucuguggcaaucaaucucugcucucaguucuuuguagggacugugcucacugacugccuccucaccguacaggggcgguuagccuaaguguuuuuccuaagaaagccuguguugcuagagaacggaaggauugacgaaagacguccagucugagcaaggcuugcacucugacuccuaggaugaaagugggaaagaagauccgaagggcugcaaauacacaugaucgccacacugcgcccugcgccugcuucugggaggggacagugcuagguacaguggucuuggggucacccgagugcuggcugccuguacuuguugcuucagcuuuuccuguauugacugcucacugucucccguccaggcauguggaaacugacgcucaggaggucaagugauuuacccaaaaucauaccacuaauuggggcucugggcuacuuuuaagcuagaugauuuccuuugcuggcucaucucauuaaauuuaaagaacuauuccugcaggccugauccguugaacaaacaguggcucaacaaaagcugcacagcugcccuuagcagcucuugcugggggccugaggugaggcuggcuaggccugccucagaggacucuugaguuuugggguucacugugaacuuguuccuucuugcucccucccuaaggagccacagagagccagaaauggcaggacuuggcuucuaccccuuaaguaaaaccacagcagccuccacuugccuuagucagaucuaguuacagccagauagacaucaauuuuuauugcuguuaauuccacacaaugaggguuuagacucuugauccugagaaacaaaauauggcccccaaagggaagaucaagaccuauccaaauugucuuuuuuuuuuuuuuuuuuuuuugcugcuuuaagaaagaagcaccugccgcccccccccccaauaccaggacauuggaauuucacauuuguuuccuuucucucauuauuccacauauuugaaucaaaaugaugauaaauugcuccauuguagaugguuucagccggacauugauauauuggauuaauuggauuaagaccaaugagguuuuccaaauccccaauccauauagccaauaaaauaauaacaaaauauguauguucacacacacacacauauauauauauacauauauauauauauauguauacaauauguuuauuauacacacacauucauugaacauagaugaguauacaaauguauguauucacaaguaccuguagaaaauaauagcaguucuuccaugguaccuaaucaauaacagauguguaccaggcaaggcuugccaugugcuaucuccugguagaaaaaaauagaaguucuaaggaacuauuuucuuagacuuuucuggagagggugagugaggaggcaggauagggauggggugagaaugaaaaugaucaggcaccagagccaugcgccaugcuguguuaguacccucuucauggcuguuucauagggaaggauucagguagcccuugacuagaacauccuccauguucauguggagguaagaagggaagagaacacaucccugcaugcacagggaugccuuuauauguacacacacagaucccccuuggcuucccaaucuuaccaugugauuuccaaaugggacugucagaaauuuuaaaugauggguauggcucucauaaaauuucucucagacaaccugucuugguagagucugagcucagcaaacuucagucuagugaccaaauccaggccagccccacaucuauuuuuauaugacccaugcauguacuaaggauagcuccuauguuucaaauguuaugaggaaauaaaaucacaagaagaauauuuuguggccggugaaagcugugugaaauucaaauuuuaguguccauaaauaaaugucuuuuggaagacagccacacacguuuguuuccauguugucgguggcuauuugggggcugaagugguaacacugcguugugacagagaccguaagcugugggcugggaguccugugccuccuuacuuccuuucuuugcuccugcuggguucucugcucuugugugggcaccccaaccccauuucucacaauccagcucuccaggcugauaucgaggccacuaauucugggaggugaaaccuuuucccacauauccccuaaugccagugggaauuuggaacugguuacucaaucugucuaaaguuaaauuuaaccaucuauaaaacaggacugauaacaccuauccuuugggcacgucucucagcaagcauguucuuaguugguguuacuagcccugauugaaugcaugcuacagaauuuagugugccccgaaaguuggccuauccuaccaggguaccaugaccuagagucauuuuacauggcuuuucucuccuugaggacauguagaauaucuuuauguaucuucagccuggucaugggaaggaguccaggaaauagucucagcacauaugagucauaaucucccuuuguagucacaaaugucauaaaagcacccccuuaccucuuuuuuguucaccuccucggagagcuguucuguuaccauccccugccuggauucaggucccacacuguucuaauuuauuuuauugaccuuucuaguugcugccaugcuggcagaaauuuaacagccagcuuuccgaaaggaaaagaagaguggucuguguaguguuugccaauuucucugauguucucacaguagccaaucugugccuccugacauaaggccucuguguguggggcugcaaauugggacacacaaauuggucucuaagcauguauacgaugucacacacaaccugcuacucuacguucagugacuuagcugcuuccuguugaucucagcaaaaaagcuccaaguccuuaauacuuaauacacuuacagaccucacaaauuagcucugcuaccuaccccccaggcuuguccccuccccgggucugucugucugucuauuucucucucucucucucucucucucucucucucucucucucucucuagucauucuucugagcuccacacaccaugcuccuccaucgccucugucuucccaggucuuccaagaugcucuggaacagcuuccuuguucccaugcucuagguaccuucuauuggccuguacuuuuggcuauugcaguagauuacuaaucugcucaguuauccauugcuacugccuguuucccaucagaguauaagcuucaaaauacagcacccauaacucacauuccauccugggguccugggucucuggcaugggggaagcuuagagaauccuucucagaaggcugcagggcccagccuuccuggguauuugauuucugucuugggcauaauuucuaaauacuuggaucuuauuuacuuuaauaucuuauguuuuuagaacucaugauuugguggcuucugggagcacugaggcuaucuccuaccagaauaugacaagccucagauggagaaaaaguugacaagcuacauuuuuaagaugaugaagcacucugucucaguucuuuggaaggaaaguuauccaucagaaucguccuuccuucauguugaugggacaaauguuggugcuuaacauccuagcucaaaaccccuugggccugccauuuuuaguggcaaaaauugaaaaacaaucuguuauuccuguguugcuaauuccauguaauuuucuccaaagugagaguugcaauccaucccauauuuguccuacagucagaggaucguggauuauuggggaaaaaaacccucuuugggaggcuuuugaaauaugucucccaaagguuuuuguuuuccuuuuaaaaacaucuacaguuuuuuuuuaaagugugccuauugcaucaaaaauggugcuagugaauaacuuugaguaucucuauucaauucucuugggaaaggagaauuauaagaugacaaauuccaagugguuuuugagugaaggcauaggcuaacuaugagaacauuguagcuagaauugugcauguaugugagacugaaguaggguuaaguugccucccuggcauguucugauguaugguuuuggggcccauuauaaccccaacacuaugugauuauaauauuucaagggguugcuauugaaugaaacauaaugguguaacagguauuaguguaagaaccauugcuauuaauagcguaugacaauacauugccuacuagcaaauuggccuuacuuugauuuuacuauacuuuucuauaccuaugagaauuuuaguuaaaucuaugugaaaucugaaauugcuccuuacagagauaacugggggugggguggagauaucagacuuaaacaagaaagaagugauaagacuaugaagggagcaggagaaaagaugaugaugagaggaaucucaagcucucugucucaugucuugccuuccagacagaaccaugaagcuuguggaguauacugagauguaaggaagggugacagugaucugaugugcuugagaaagcacauguagccugggacccuagggaccagugcuguucccuccacuguuauaugucugugcccagcaauggcaggcucugacacacagcauuaacaaagcuugcauguguuuaacaagugguuucuguguccagaucuaagaauacucuuccuccuucuucauggauagcauuugaaaaauagcuccucagugaugucacuuggauaaaauaagggucacuccaagaauuugcugcuucaaucagcaaaauacccuuugcucuuggggaauaagauggauugggcaaguagaagguggcuccaacugaaaacagccaugucugugaauguuaagaugaaugguaagacucaucccuuuggacuaagaaucacuuaccacaaggcacacgaagucacggguaugucauuaagacaauggggaagaaagaucuccaaguguuucuagccaucuaagauuaguaucuaaagaggaaauauguaguccacugcuacuuaaaaccaucauagauguaauagcuucucuucuuaaaguauguagaagauauaucaucaccauuauuauuacuagcaguaguaguuucauuuaguaaaaacaugagaagauuuccuaaguuucuuuauaaucuugauccauuccccccaaauaauuaugaaaugcacagucuguguaggucugcugcuauggccacacacugaagucccucauaacgacuguaucauuuaaaccuuccccuaguugggcuagaugugugcuuucuuuccacugcucagaaauacauggacaugcauuucagggagagauucagagacagcugaauuccagagacagacuguaccacagaaucauaaguugcaggaccacaagucaaacugaggucagccaaacuccaaaauaaagccaacaucaaugcaucacaaauuuucugacauuguacacuuucaaguguaugucguuuugcuuuccgacuggggaaugaaagcucgaaucagaaagaaucuaaaaugauuuaagguaaacuaaaugggcuggguagggacaguagcaacagugaacccacagccaccguugucaagcagacagcccuugcucauuauaauaauuuuaaaaaguagguguucugacauuauucuguucauuguuccaagaaaaguuggaaccccaaauuuccaugugaaaauuuguguuccuaaucuguuaucaguuuauuugacuaaagcaaaauacgguacaaaguuacaguuuggaagaauaguuugaugucccuucaaaggugugaggugcuguguaugcuaaguccccagauaugguuauuacaagaugugugcacauugaaaugucacacaaugcuccauagacauguaccauuguuacauaacaauuacaaaacagaaacgaagcuagcuguggggguaugugucuguagucucagcucucaggagcccaaaaaaagagacugugaguuacagggaaaacaaggcuacauauacuauaacacacacauacacacacacacacacacacacacacacacacacacacacacacaaccaagggaaaaccuaaaacaaaaugagaaguggguuuuuuugagcaauugaaucucugugugcagaguguguacaugugugcauguucagaggagaagaucagacauucugcuguaucgccuucccaguaucagcuugacauagggucacugacccuggagcuaggccggcagcuagcaagauccagugauuuuccugucucugacaaccacuucagcccugggguuaaaugcacauguauagccagccauguacaacuuucuauauagaugcuugcaaucaagcucauguguccugcuugugcagccagaguucucacacacugccucaguccuauagacgaaacacauuuuaaaagagaagagaagauaauggagaagagggagaaagagaggugaggggaaggaagggaaacagaaaaaaaaagggcacaaagcaauagaauauauaggaguagucuaccccagggugaugucaguggcuaggccucuauuaucucuucaucugucuugugagaguggucagcagagaggcagugugcuuguuccaacuguacaacacgcauuugagaacacucaccugggaauauucuuuggaguaagaaaauggaccacaccaggaaaucaacuuagucuuaauuaaaguccauuggcuaccuauguuaauaccacuuaaucuuccaguccacugauggauauuguuguccuugucuuuugcugauaagagaacagguuuaaagaaauugaaagccugagccggggucauaagacuuugaacuagccaggucugccugacuucuaagucucuucuccuaaucuuugcacuguccugucuccucugggcucuauaagcauugaagaccuucuauggacauugcuuuauucagugcccuuuguucgccagggcaagaugucagagagugugggaacuuguucuagaaauaaacaccuugccuggaaaagcaucagucuuccaaguaaagugcuuuguguaucguaaaaccuucaauuuagcuccauuauauuuuagguccaugaggaauagauugcagcuccugcuuuccugcugauuagagcauccuauuuacguguauacaguaccuauuagacggugagcuuugcagaauuagcucccugaugaacagguauuauuucccccucggcugacacucagcagcugucugcagucauuguguucaaguucacccgagccuaguaugcugggacaaacagugcaaaacagcuugccuucuagcccagagaugggugaggccaaguccuauggaauauaccuuuuguuacuaggugaaucugggcagccuguguaaugacugggccucauuucuucaucuguuaaauaggaaugaucuuuuuccuaaccaguucaggaccuguucuugaacuucugaugguuccacgccuuugcuccagccccugcuacucuccgucacagaaucuguucuguggacuucugaguaagcaugugucggaugucuuacuuauuuuuguccagauccuguuucuggauagucuguuccuucuugacaucgaucagaaccgucacuuccacuguauaucaaauuacagccucucucucuucccuacugccuaagcacuuaccucucuaguauuccuacacuauggagaacagagcuugauaucgggcaggccaacuguuucuucuuucuucacgguagcucauuuguguugaucagggucucagcuaggaagagauggcccaucagaauggguugacugaagagaguuuugucagcugguuauguggagaaaugggagccaggacaugacaagccguggugaagaacucagaagcuagcaauggugaggcgucauggcuacccugugccuaagggaugaggaggauaugcaggacauggaauagcccagaaugauuugugaauggcaucugccugucuguguccccagcgcuggggcuauaugcaugcacaaucacggcuagcuuuuauaagggugcugagaauucaauccucuugcuuuuacaaguacucuaauccacugagucauuucuccaccaacccccgcccccaaucauuuuaaaaguagguccauucuacguaugguggcaugugucuauaauuccggcauucuggaggcuuuggcaggauuuaagggcagccuaaaccaaguagacagaccaccacacuaaauggaaaaacugauucacaguacuccaucuguuccacuuucccccaccuaccacuuccaguccaacccuucaugaucaagaacucaacccuucuucuccaacucauccuauuauuuuaaguugucucuuaaauagucuagauguuaguacaaaaauacucagacuuaagcgacuuauaaaauaauauaguaaccuccacauauucaccuucugaauucaggaauugucaguauccuauuugucagauuauuucauuuguaaauacuuuggugagugucuaaauaauucaagauuuccccugaaguuggaaaaaaaucaaacaugagauuaugcguucauuacuaccaaauacuuaguagugucaggugucuaggaaguguucauauuucucugauuggcuuacagaauuuuauaguuugcuauuccaaauacuauaauuguuccaugccauaaaauaaauauuccuuucacuuaaaaaaaaagacagcuuucaagauauacaaaaauauaaugaaagaaaagguggguuucugauaaccaaaccauuaggaagacccagcacaauaccugccccauuguuccuagacacagggccagcauauguucugaauggaacuuuucacaaaugugugcuuugacacgccuaugaucacagaguaaauacaaucuccauuugguaauaaguguuugucaucaggccuacugaugauugauguggcuuacugcuucuccuccagguccccagaguccccaaccuugaccacagccucuccucuuuuuagccuauagcuccugcagggagaucuucauucauaggcugcccuguaguuauggcuucucaggccuuagagcaaagugauguaacgcuggcauuuacucagcugacacugugcugaaggucacuuaaaaauauuuaucauuuaauuuccugaaauugucuaacauauauugacgggagaggagaguuuugcaaagaagaugaagaaauaauuguucuaaagacuuggaguuuauucaugcagcgggaugcucugauuauagaucguguauaacccagacccagaagcaaugagcagggagugccauaccagagcugugugucuggggauagcccaggucaaacagcccugaaaccaggcaaagauuuuacauuuuuaaaagcugaugucugagccaacucugaaaguggccucagaucagauguauuuacaccauaucugcuuauuucauuuggucaauuuuguguguauguauauaugugcacacgaguguguuuguguccauguauacacagaugugcauacaggaguguguguagaaucccaaggacaacuuugggcaucgcuacuccucaggcucaauccaccucagguuuugagauagggucucuuuuugugaccgggagcuugccuucuguaacugucucucuggugacauaauuguaagugcacuuucccacguccagcuuuuaauguggugcuaaaaacugaacccuuaaauguguguuacuuucugagcugucucuccagccccccagaaccucaucuaaaucaugagccucguugacaacacagagacuaugcgggauuugagagugugcuuuuuuuuuuuuuaauuuccaaauaaaacagcccucagucaaaggucagguuauguuuauugcuuaauuugguggcagauuuuaugaggaacugucuacaauggccgcaugaagaauguagguggaauucgccuaccauguagcacgaggaaacaauucuuccugcuuucugcuucugugcuugcugaaguggggguuggaggagagggggggagaaaggucucugacucacacccaggcagcuucugauuucuauaaaguagaugcaacaccccauaauucuacucuuuagguagcacauucauauucccaaaggaaacguccaugacuauaguagaccauggugaggaggggcugaucucauuaaacuaugauauccauuauccauuauggauauguaguauaggaacaauuucuaagagcaagcacccagucaugaaacuaaguuuaaaaaaaaaagagugcauuguucugucagacauaaaaaugaauggcaguggcucugcccgauaacuccuuuccuacaauaacacuuccaucacucaggacugacagagguaaugacgauaauaaugaccuugacucauuugugagcagcacuuugcuguuuacaaagcccuagcgugucuauuaccucacuugauccuccuaauggcuuuacuagacagauagauggggcuuauuguuuccauuugcuaggggaggggacugaagcuuagggggccugugugcauuaacuuugguucuauggugaagacagucaaaguagaagugugagcauccccaaugucuaggacuggauguccugcagagcaauguagcacugauacagaaggcacucuguucuaggcauagggacagcauuucacgggaaugucuuuauuuggugccuacaguccauccugaugccucuuuaggugagagacuuggaaauggagaaaguuaucacuugccuaaguuuacccaacuggauguguagacuugaaccuugagacccuaaaucccuaguaacuuccucuagcccucacucuggcagaaaagacuauggucaagagauggucaaggaggcagguauugguuauuuccuuggagcuauucccaaacagauagaagggacucacuggugagcacccauauuguuuguuguccagauuuugccgagcacaggaaaagauccgugaguuaagccaccauugccuagcguaaccauggcgucugaaguugaagguauaaagaccacaagagaggggcugccucaggccucucaagccucugagaaaaugcgcuuccgucuuaaguuuuagauccuggcugcuaaaagcaucagaguaauuuucauuucucaucuugacaaacacucaauuguaugaauuuguuccacugaggucccaugauucaucacacuggucucauaugucaaugugagcugcagcucagcuuauauucagcuagcugggacuuuagcugaggcacuucauuuuguaggucuguuuuucuuuuucuauaaaaggggagguugugacacaagccucaucuuuacaugguuucucugaccaucaaaaucaguuggaugaggaaaauucuccauaagcuaacaguacuaggaaugggacauugcagaucauuuauucuguucauggcagcauuucuuuagggcugacuugcaccuuauggaauucaaauucuguuucauggagggauuucuucacaugcaucagaaggagcaauaucgugaauccuugaaaccuuaauuuuccagugcacauaaccagccaagaagcuauggagugaugguuccaguuuuguccuuggaugugucugucagucacaucuguccaugggagcccuucaggauuuggaagggagcuguuauaucaacauugauucucagucuuuccaaauaaaauaucaucagugcuuccaacaacauuauuuuaaggcagaaaaaaaaaaucacuguggacuuaagguaugaaugaaagagccaugaguuugcccuccuugcucuuugggauuuuuuuaacuuucauuuuuuucauggaauuaucauguuggggcagaagucagucuugguuguuguucaucaagagacauucaccuuguuuauugaggcagaaucucucacuuagaccuacggcuuguugauaggcuacacuguguggucauaaacucucagggauccacugucucugucuucccaggacuaggguuacaaguagcacacacaacuauaucaggauuuuuuuaagugaguucugagaguugaacucagacccucauggguacaagucaagcuuuguguacuaguugagcuaucucuucagccccuucauguuuuuccaauguaguucuuagucugguagacagcaauuauacaucuguuuuuuaaaugucguaagggaacacacaaagagagcaaaauuuagccucugggaacaaaagacuuuguugaguauggcuugcaagucagagauugucaaacuucuuuaaagaugcugcuaguaacucucuucaauagugcaaguuguacagcuucugucacaagcauucaacugugcauugucauggaaagcagccaucuaugacaggcaagcagauggguggggcugugugccaguaaaacuuuauuuacaaaaauuggcucgcuggguggauuuggccuguagcccugagcaugccggucucugcuauaaaccaucuuuuuuucucauucuuuuauuugaauucuccaucucugguugauugaucacaagcauacccuguguagcuuugcuuggcaguaguuauguaagcaaaaacaauuucugcagcuuuucugauuugcuugauugguuguaaguguuucucaugaaccaggcagcacgucagagucauuuaugagccacaauacauuaaagauugucacagccccaggaugccaccuuuauuagauaauagaagcuugggaagucauagcuguucagaaucugguuugaugguuuccaagcaaaauacauuuucucaucaaugaaaaacagauucagagcuggggagaugacucaguagauaagagcacuugucaugcaagugugaggaccuguuugaauuuucaggacccagcuaauagaugggcaugcagcauagcacaaacaucuguaaccucauugguccuauggguagaugagagacagacaagaauauccucagaagcuugcagggcagagagcaggcauacacagcagaaaggaacaguaaaaagaucaugucucaaauagaugguugacauuugagauccuucucugacuucuauaugcauguuauaucucgcauaugcgcacauucauacacauggauacccauguauacacacauaaauuaauauaaaaaacacauguuuaaaaugcggcuaacaguggagcucugugagaucauaaagccuuugugaacuugaccaucagaauuuggggugccucaacagaagcuagaccuccccuaggaaaacugguuuauaauuuucaagucaaggauuacccucuaagaaaaauaagguuaagcccaauuauucuggaacauucugucauggguacuagagaugauccuugucuaagagguugaugugggcccaucgcacccauacuuccauccccagcccccaggagacaccauauacuguauuuucccucaagcuaagccacacauaauguuccauaaggcaaaaguacucagaacuguccaucuccugucccuaguuucuaacuggaaggcagauucauuccccauauaugagacuaagucuuagucugacauugcuaucucccuaugcuucuguccuuuuucugccucugcaucucucuaacccaccuuucuuucccucacacugcaucuuauuuuaccaccucaugagaaaaauugugaacacagaaaaugccucaaaauuauuuguuggguguccguguccucucuuauuccucucuucuuucuuuucuugucuucuugccaaucaaacuccagaggccacuguggaagcuacugcagguuggccagcugaccaacaaugaacugagcugcccuuuugcucacagucauugcuucagaacauccugccccuaguuuucuucucgggucaugcaugucccucugacuacaaugcccacaaaucaauuagcugcaggcagucaugcuuuguggcuucucucuguucucacagauggcagcucacugaucauaagaggugccugccuaaagaggguaggucaauuggguaugaucauggcggaggaggaagcugcagcuuucuuugggaacucaucagcaccagaaggucuuggcuucccuucauguaaauggcuggugucugggucaagcauucagcugaaaccaagaccaguaguacucaaggucuccuaugaacacauaccucuccucucaucccucaagauccucucucuacuccucuaagcacugcucauuugagcucccaaaguccucuaguauauggauaggugacauguuugggagagauucaugaacauggcucuccagagaccagggccagcaaaaauuuuucuuucuuauucauccauuaugccacagacauaucuggacucuauauauguaaucucaucucauuuuaugaaauagguauuauuaucuuuguuuuacugagcagaacacugagacuuuuggguuugagagagagugaaaaacaaacaaacaaacuaacaaaaaccaagaccuagaccauacccuccauuuuucacuuuguuaccauggcaccuaaaacuggcccaucaccuccuuggcuacaagguaaacuugucagauauuggcaccaaagccaugggcugugagaaauaaagaaucuugccuugaaccagaaaaaggagggucaaaggaaaaacaggcuuguuucaagccuggcacugugaaccauaaaacaaucuccaaaaacaagaauguuacaucauguugagggaaaccagacaguaaacaagucaguaugauacacaugagaagacucauaggaaaggacauaugaagggaauaaggaauucuggggagggauggaguagagguugcaaauaaaaauaagaugaaguuugugaaaucuugaaaauaucaccaagaaggccauucuggggucauguagguggcauccaugauguagucccaguucugaugcauggggagagagacccaaggugcuagaacaggggguagaacagaguuggcaaggaaaguaauaggaagaggagaauucuggaagcaaagggaacacauugcauagggucacauggguuaaggacacucuugaagggauguggcaguuugggugcugagccuucuggaugagagacgauaucagcauccacaagguaugaaugguagaaauggcuagaugguggguuugagugaugugagugguaacugugguacacagagugaucuuccuggaucaguaacuaaucucugaaugcuccucagaaagcaagacccucagaaagucagaaguuuuuuuauauagcuuagaaggacccucauuuggaagaaccagagauaguugugugcuuccugccaugaggcacaguuuuguauacauuugucccugaagucggacccuugucugcuguauuuccccagccagugucuaucucaggucccagcauacuguaggugaugguggguugguaacaugagcgcauaggaucuaggagcuuuaucugacuuuauaugcuuagcuuugagauauggcuucaccacagauugggauggagaggacaugaguuggauuccugacccuccugugugccugccacauguaucugaguucuauuuacauacuuauaaagucaacauuugguuuuggccgucuuugucaaaaaucaaaugaccauagguaugcggguuuauuucuggucuuugauucaauuccauugaucaaccugucuguuucuauaccaauaccaugcaguuuauuauuauuauugaucuguaguacaauuugaagucagggauggugauaccuacagaaguacaggauuuuauuguacaagauuauuuuagcuauccuggguuuuuuguuuuuccauaugaaguugagaauuguucuuucaaggucuguaaagaauuguguuggacaauuuaugggaauugcauugaaucuguagauuguguuugauaagaugacuauuuuuacuauguuaauccuaccuauccaugaguauuggaaaucuuuccaucuucugaucucuucuucaauuucuuuguucagaaacuugaagaucuugccuuauaggucuuucacuugcuugauuauaguuacaccaagauauuuuauauuauuugugacuauuuaaaaggguguuguuucccuaauuucuuucucaggcaauuuauuauuuauauaaaggagggcuacugauucccaguggaaggauaaggucaccaaacuacccacaaagccuuccauccaaaauguguccugcuuacaacauguacagggacaaagauaaagcagaaacugagugcauggccaaccaaugaccgccccaacuugagacucaucccauggucaagaaccaaucccugacacuauuaagagacuagcauaacuguccucugagaggcuccacccagcaggugaugaaaacagaugcagagacccacagccaaacuuuaggcagaaccugaggagucuuguagaagaguuauagggaagaguaaggaaaccauacaggauaggaacuccacaagaagacugauagagucaacuaaccuggacccuugggagcccgaaagacugaaccaccaaucaaagagcauacauagaguggaccuagccaccacaccccuucccacacauaugcagcagauuugcagcuugguuuucaugcagguccuccuacagcuagagcagcaguugucccugacucuguugccugcccguggaucauguuccccucacugcacugccuugucuagccucagugagagauaaugugccuaauccugcagugacuugaugugccugggugguuugguacucagggaagaccuccuccuucucagaggagaggaggaggagugggcugugugaggggugugugagggggaguacuggaaagggggugugauuggaauguaaaguuaauuaguuaaucaauuaauuaauggaaaaauucaacauucgaacauuuacauaauaauuugguaauccuugcucagagaaagcuuccuggcuacuccaagucauccccuccccacuccauuacucccaccuuaguucaccauaacaccugccaguaccugaaagcacuuuacuucuauauuaugaugucauuucacuacagcugaagcccaugcaggcagaggcaugugcauugccuugucuaccauuuuaagcccaggaucuuguucugccuagcacuuggggaaguccugagcauguguucaugcgucagugagaacugggacuugaccauucacacacagacaagaaaggaaaacgauuggucuaggauaauugucccaugugcaggcucagugcuaacuccucccgcaguauuucucaaagcaaacucugcuuauuacagguuuuguuauguuuuaauugggaucuucuucaaagggacaaaucuuaacaacuuaauuuaagauaguuccaggugugcuauuccagcuguaaacuuuaccuguggcugucugucugucuccuagcaacuucauugggagaccgguaguacagaagagaggugauggugccagugggcaaaccaaaugacagagauaggaaagaggaugggcauuggggcuuuuuuuuuuuuuuuuuuuuuuuuuuuuuagugugugguggauaauuaaacacccaaguuuagacauucucuagguagaauauccucugugagccuuauuucuacaacucaggagccucaggggccucauccagcccaucacccucugaaggacauuucugugcccuuugugaagccacgcccuucguuaaguuuuugacacauaucacuuccucuucuccccauuuaggcucugagguaggguuggagucauuuucaguuuguauguaaggaagcugaggcauguagaggguaaguaauauuacgucauuagucauccugugacuacuauaguacagccccaugcacgcguacucuagguggcuuagaccaaggcaauguaaggaaccugagaaguugaucaguguguagcucacucugcuucugguaaccucuuccugcacucuggguggcuaucuucucagucuuucuugugacuuuuucuuccccccuuucuuauaaauccacuacucccaccauaagaguucaacccacaagaccucaucuaacucugccuccaaaguccaucaucucucaagccaucauauuggguauugauggaauuugggaauaugugggcugggggggggggcaugcacauucagucucucucaguccuacuccuagcaaguaacaaagccaaggcuuaacucccaucaucagugugcuccguguucugggugcuuggaaucuuguucaagcccuagauuugauaaccuacaccaaugaaggggauucuacgagggcuggaagagcuauccaggugcagcacuuggugucagagugcaacugccaugaacucagacaccaggauaguauugcucaccacuguauccucaacaaaaacuggaccagagauauuucauaaauacaaacucuacaaaugaauagaugaaucugauaaagacugaugacuguauuuggauaugaaaagguuuagaugguggcuauguucacguguauugggucccuugaugucugucaaggcaggugagcauaaggguagccauuaaugauauauagcuugccaugguggcaccuguucauaaucccagcacuuggggaggcugaggcaaagagggcuggaagcucaaggccagccugagaccuaauguccuuggucuauauaguaagaccuugucacaaaacccaaauaaaaaccuuuuugcaucuuugaguccauuacaaccucacaagaaugcauuuuucuucucauacgugauggggacugagcuacucguaugagacucaccucugaaucaguacacgcugcucguguucauuguguguaaugauagcuguugucaggagagcaaagcguuuuccagaaguuuacagucacuucaacaaugcaggaauccaaagagauuuugacuuuuucuuggggaaugucucuuugugacuucucuugcguccuuaagaccgagaccagcugaugcuaugagggaguaaucugcuucucucucaaauucaugaugucauguuauaaccgccacacauuccugccccacuagaaaaaaaagccaagaaacuacaucccaucacauuucuggaugacagaggugggauuccgccacacugacuagcacagguuucuuguauaagucucuaccaauucagcccauugcgaagucacaggcagacuccauuaaaauccaguuugugcuuacuuggaauggcuguugagaugugauugucacaaagaugucuuauuaaguuccugcuauuugcaaggaacucaacaacaugugacaugggugcuaauuuugcccuuuuacauggaaggcagcaugguuuagagggaugggcuaaccugaacucacagcuuauaaguccuaaaaccacauaagugaaggucaaaggaaaacaucucagauuuugguccucaaucuaucuuguuugagauuggguaucuuguuuuuuucuaccgugugugccaggcugacuggccaucaaauuucuaaggauucucuaguguuccuauaagaacguaugcauaggcuacaguguucagguuugugugcgcccuugagauucaaccacaguccucauauuggagcagaagugcuuugcccacuaagccaccuccccagcacuaaaagauagagagucacaauacaucagaccauuguuuuucuucugauuauagaaauagcacaaagaaaaauguguuuuccaaauugccagggcuucgaggaugugaauuuuuauuaauaaccagauagcgauaguauggaauuuaaugacacuaauacuaugaaaaugguugagaggagguaggaauguaaaugaacgugagagcaaagcauaacauuuguuguacugcauguaaacacagagaagcgaagccugggaacaauggauauccauugagaaaaaaacccauggcauuagagaagaaugaaacaaagaaaacagcaucccuguuucuuggcugugcucccuccccuuuggguucagaaaauaaaauugagacacaccaaaggggauggguaaagccuuggaacaaugaauacucguuaccagcaucagcuggguaucuuguuaguguuaaccugaugcauugcuagcgagcugcaguuagagcaguaauuacaguaaauagaacccauuuggaauccucaagcaaauaugagcaggcaagaaagaugagcugaaaaaaauccauuacccuuuggaaguuguggaagcuucgaauggcagcgauuucuacaguggauugcguccgacuaggaagcugcagugugaaugaaucuaucucccgcucucaaguguguuuauaugguaaauaaaauaaauuacuacccauuccagccaugugcaguuuccuggaauauuugucuugguaauuuagguagaaaauguagguagaauugagaaaaucucucucucucucucucucucucucucucucucucucucucucucucucucucucaccuguguuguuuggguucuuaguaacacgaaauauugucauucugaaaaaguaaauaaaaaggcugagggaggaugugagaagguagguuucacaggcaguggggcugcacuuguauauuuuguguauggaaacuaggggccaaccucuagugugguucuuccaaugccuuccuccuuguuuuugagacagaggcucucauuggcuugaacuucaacauauaggcugugcuggcuggccugauaguaaaucccagggacccaccugucccugacucccaagagcugggauuacaagcauuugucaccaugcuuagcuuccuaugcaguuucugaggauccaacuuacaucaucaugcuugcguagugagcacuuucccaauggacacaccuccgcaacccagggauagguucuauuuguaaagacugcuacaccaggccaccaugucuggauacucacagucuuuugggaggauguccauucccucugcuuaagaguugcagacacuuucccaacucagccagagcagcagaaggacuaaggagaccuuccucccugucuucagcuuaggccuguugcuguucaggcccagaccagacaucccucucuggcuuccuuuauucauccccccacuccagugaaaagaugucuccuccucccccagcuucuagugucuuggccucaugcccugagcaauccccuguuaccaccauguggauaaugacugaaacuuaagaguguggaaauugaaagacuuagcaagaguauaaacacacacacacagacacacacccauccaacaauaguuauuaaguggaagcucugggccagacaugauccucagccugguugaagacccguuuaauuccucgugggagcugagaugucccacaacagaaaaguaaaaacacuaaaaacagcaugucugugagcauagcugagagcuaugugagaugcucaaggugucaccuggugauuugugccacugagugacccaacccuauagacccggccauggcaccaaaggguaccagccuuggggagcugccuugcuuuacuuuucaccuucaccaaauggccccaguugacuggccuucagcaucuuuuucuugccuggguaccaggacaaaaguucauuagugaugguaauaauacuagcaguuuuucagauagugugggaacuaaucaaagcagacaugggacauaugacguucuguuuguuuuuuuguuuuguuuuguuuuguuuuguuuuuuccugucagaguaacuaugcaaccucuucaagccaaaugcauuuuaguaugcacccguuuuguuuuguuuuguuuuguuuuguuuuguuuuguuuuguuuuguuuugagacaggguuucuuuguguaacccuggcuguccuggaacucacuuuguagaccaggcuggccucaaacucagaaauccccugccucugccucccaagugcugggauuaaaggugugcaccaccaccgcccggcuuaugcauccuuuccaaaagagaaaucaagggccuuugaaucaagugcuuacaucuaaguacccagcuaccuacuucacaucgauagguaaacaugguguguuuugguguuucuaaggaacuaucugauuaaaaaaaaccaauauccucauuuuacaggugagaaacuuagacucugacugcaugucaaagcucaaccucuggagucagcagacaugggugugggacuaaguucuaacuucuauuuaugaaaccccaggcugugugcccuuucucuucccugugccuauguaugcucaucuguagaacaggaugccugauucagcuagcugcuacagaaacugacuaucaugauugcauaguguccaaagccagacagagaagaaagacuaagucaacugauccucuacaucuggggccaguagcaaaaauccaugauucccuuguccguaggcauucacacuaaagacgggucacggugaagcaagcuuuaguuaugcucaugugaggagcuagaagggccaaggccucaugaguccgagaguaaagccaccaaaccacugagacacacucugaauggcaaggacaaugaagcagguggagccuaauccucagacacugcacaaacaaccccaaaagcccaggucagaccaaggacaggaagggaaggaucacuuuguacagugcuucagggcuagaggggggaggcagggagagaaguguuguagcaggaugggaagggcugaggauaaucccgagguggaauucauaugacucuaaacuggcauucuggcccuggagaugggucccagagcacagcuguucagcuguuuagggauuugcaauuucccagagaucugugacuaaccucgcuccgagagagacuggguucggugacuuggagugcagccugcacacuggaaucuaaguguucuucaagugguucuuguuauggagugagggcucagaguccccagccuugaugcuugucuuggggccccaaagcuugcaacuaccagucaugcaagggucuuagagaaaggucagacaucuguggauucccauuuccauugcuuuccagccacccacagccacucccuauucccucucucuguaucucuuccuauccuuccaauccugcucccaaauccuacaucauccugugccuuuggccaggaggccuugacuccauauuccuccaguuuccuccuccaugagguauucuguccuuuauaucauugcucagccucuacaaaaugucucaaagcuccucucaccaugggauauuaaagcugcaugcuccuuugaugaucacagguuaacccaaagguucugagcuuucccaucuguaaauggaaggacuggaucugccuagcaacacuguaguaagaugaaguguguguguguguguguguguguguguguguguguguguguguagugaaggcuuuaggcacuccugguauccagaaggaccuugagaacaucagcugugccaggacacagaaggaaagugggugugaccaggugagaaugucaugaugaggggaccguggcuguaaguggugggauaaugagugucaaggcuuuaauguggugacagaagaagcaacuguguaugcugugacagcugcaaagggaguccacugugccgugugacauuccauuuaaggaaugcugacauuccacccuggcucagucuagccauccucaagaguaucauguucuacuggguagggugugugaguguguaugugugugugugugugugugugugugugugugugugugucuggccaacaggaccugggggucccugacgcucucaguugucuuuauugcuuucuccagaccagccccucagacucuaacagaagagugccccccacccaccaguacccucauccccugacucuacuuccgggagcuccugagccucagagcagaggaucaaggcuggugauggagaacagagcccgaugcccauuuauuggaagccauuuuccuccucaauaucuucaggagagguggaccggcaaagcgacauucccgcagaaauaauuuuucaauuucuuauaauaggacauaaaagucggcccggggaaauugauuccguucggugcucccuuuguaggacacuuuaucuuccauugcggccucugaauuucagcaauuucuaaagccugaggaagucucgcuuaauauuuuuuuucuuuuuugccacccuggcagaaggcuuuuguagcucagcugaaugucucugcugaccugucacuuccucacacuguggccugugggccugccucaggucugaagaggucaccccaccuccaucccacacccccacccgcccccccaaccugguagcagauugcugccuccccaaaguuuuccuccaauguaauuuagucucagccuuugcuccucccucccaucucuugccccucccuuuuucuuccucuuuugauauugacuuagccuagguuuugccuuugcccacgcuuucauuucucuuucuugucuugugacucugucccuagguugcaguuacuauuuaauaacugugggaccuagcagcugaccuaaucuuucuguaucucagcuucuuagucuauaagaugggaauuaauaacacauacgucaaugaugugaggguuccacauuacauauucaaugagcccuaggaagggaggaguguacucaagggggagggaagaguguacucagcgggggggggggggagggaggaguguacucagguggggagggaagaguguacuggggagagggaggaguauacucaggggcugagaacaagugcuuggccugugguccuagacaggagucccugaacuuggcccuggccccuggaaggagccaugcuguuuucaguauacuagggugauucacaaaggcauagugcucaucauuuugaaggauuuuuucuuccugauguauuaucgaguuugggcucuaugacagugcuuggcugaagaaggaauaggcuccuguccuguuuauagaugagcggcugaagccuuggccacacuuaggccagggaggcauguacacagacaccugcgucaagugggcacugagccugaucuuccuuauccccugcaucuggagaauaauaucaucaauaguuaggccuacccaccucucuccuacauacucugggaaaaaauagaauaagaucuuucuccgcucuguugccaugcuggggggugggggugagacuugagagagggucuagagccuuaggucuguggagagauccucuucagagucccugacuuguacaccagcuuugcucuacagcuaacuuaaguguuccgacaugcacagucagaugugacucagccggcuaguguucuucugcagagcuccaggaggaagcuacauggcaaguguuacuucccgagguccagcugggacucgaacccaggucugggcuaagauuucaggcaucuuggauguagggaagcuaagugugccaagccaaauuucauugagcaaguuuagaauucaccaggccacauuccaggauuuuuuuuuuaaggcugcaugcuuuauuugagauaguuuagauugcuuccaugugaauuuaaggcuagggccagagacuuuggaaaaagaagucaguagguagaaguugccuuucuaccagugcagcugccucugaggagagggaagggcuggcugcaaaucccuucggguuuuuggucaggcaaccaaaucucuugcuggggaugcuaugaagggaauuccaccuccugccaucuggguggcagucagaggccaucccauuccaaggauuagauaacccucuuauaugcaggcacugaccgggagcugaacucaagcugauagcagcuguuguucacaaguaaaaauuucccucaaaagaaccuggacucucaaauguaguggcuauuuuuuuuucucuuuagucugugguugagggugugggaacuucuauuaaucuuauuauggucagaaaguccugcaucugauaaauggauucagucauucauuccacacacaucuuuaagcaucugcucugggcaagcccuguuuuguacuauaggaaugcagaagaaaacacaagauggcacccccuagcccaacccccacuccagcccccgagacacacacacacacacacacacacacacacacacacacacacacacuucgcuuccaucagaauccuagucuauggaagggacauuugggaggcagguuaucacaguuuaucugucauaucauaucauuuccuuccgagacucaguggguccuuagcaauuacucagagucagacaagcaaggaggaggagagaagauccuucauguuggguuggcuacagauggagcugugagagccuguugguucuugugcuuaucaccucuggaaugaggguaacaguuaucuacucugaucuuguccugcacaggaucuugggugucacagaacacucaccuaccuacucaagcuacaguagaaagaggaaggccuguagugccacagugggggaauccaaagacaagaacccuauugcagcagagcuuaacagagagccuggaaagggcuguagggcacugagguaucugugggucuuucucuuuguguggcuacucuguucuacccucugcucaccuaccuccaaaaagcucacaggcccacagagcuuuaaauuguauucucugaucuucucaauacccuaccaacccuugguaccccucuguuacaaaccauugccucuagcccccaaauuaaggucccacgcaucagaggaggagccuaaucaagacaaaccaaggcuccugaacaguuaaggcgucgcccccccuccaagcacaaguaccaaaucuguuuuaaucagcccugauuacagugggauaugaucacaugauacaaauaucccugggcucuacaugccauagucuccaguaggaugugauauugacauauccaccauagacuugcuccuccuggacugccuugaccaguucaaugaguuuuuuauuugcuuuguuuugguucucuuuucucuuauuucuaagaaccaagcaggcugauuucccgugcacagcaagauuaacuaaaugacuacuguuuccaggaugcugugaacuggaagguacucuguagaugugagguaugugagaaugucaggcaaguacugaugaacguaaacauugcaagggcuggcugggcuggcuuuaagccaguggcuuuaaucaggaaugauuuagcuugguaacuuaccucguucccucagcuguugccuuucccaggggccgaggagacugugccuugaaugugaauccuucaaaguagcuccuugcugugucccugaguggggccaggucucagccuuagaaaguauaguuuguuucaaucuucugggcaacauggacucggugcacacuggucuaucucaauaccuaggagagagcaggcagccagcagcaggagugacagccagggagcugugucuuuggagaucacaaacagggugcagcccuacugggucugaauuuucacauauauuacaucauugugucuucauagcaaugucauaauaaaugggauauuuuaauccguaucuuacaggugggaguaauaaggcucagaaugauuaaguaauugauccaaagcaauaaacaauaaaugggaagucucuuggcucccacugcauuguaguaagaacuuauaaacauacaauuagcaauucuuucugacuacuuagagcucucuccuuuggugugcaaaugagacuuuugccagcuaagucuccaccugacucuacuuacacagacacacagacugaagggagcuggcgucauaaaugaaaucugcccuccucugacuuuggugcucauagaggcccauuagaaaugcuuuacagaggaucuacagucuucaauccugauuucaagcuuugccuuuccacuggggcuggaugggagguagccugccaauucuuggcuugaacagggugaaaagauggcuuggacagggugaaaagauggaguuguuucuugguuucuaucuuccuugcaacacuaaucaaccugccuuguagcaaaccagcgguuuccuagcaacauccaaugauguagcagaguggcaucuauuuugaaucuucccaaagugaccuguugacucucuuugagcaugagugcuauugccuuagacaaguggccuugcuggcaggguucugcugcagggcuacccugaauaguaccuccauucugaaaauggacuccuuccuuuucccauuccugcccuucacauauucuccagacacuaucuguugcucacugugccagaacugguaccuucuaugggcaucuugcagagaagaaucaggcccaguucauuggguaggaaagaacauuuuauaccaagucuugugauauauaaagaagaaaaucaaaauugaaguuuucagaaauauuguucugaaaaguccuacguugaaccagacuuugacacaucaauaggaguuaucuauggcgagaaagaauacacuugucagaggggauagcauguguuaauacgcuaaaggcagaaaacccacagaggaaaguggcuaacaucacugaguaacccaaaauauuucuccuugagcugcuuuuggguguuuuucagacaagggauuuuugucucaaaauaaaaacuuaggcuccaagugaaauucccucaaagcugucugugacaugcuaacuuucauacaguucuccaggaucaugaaauguucuauggcguucucuagguugccucauguccuaggacauuaagaccaacccuaggcuauccaauaaaguuauuuccuggagaugcuucuacauuggaaggccuaggcugaggguggaguuugcccugagauggugagaacuaugggcacauguaaacagguacagagagcugguagcccaggagcuggauguaguaugggccacuguuuagagucuuugucauggauuugaguaugagcaccucuuauuaccugagacagcucaggggacucagcaccaacacacaccaaucacaaagacccuguugggugacagccuggugucaguggcucaugcccuugggaagcaaaaggaggugggucucugaguuugaggucagccuggucuacagagugagucucagaacagucaggacuacacagaaaaacccugucucaaacaaacaaacaaaugaacaaacaaacaaauaaacucuguuggauguccauauaggcucucacuggccuagacuaguuuccugaaugugacaccacaguagaauuagaaguucuuugcuuuuaaaauguccagguuauauucucugauuuuggcaacuggauugguugggguuguuuuucuguccacccucugcuucucugccuagcccagcuacauauucacugcuauuugucugcacaacuuugauguguccaggacugcagaaaccagagacagaucauucucuaugcugagaagaaagugucaccagauaucagaucaaacacaguauucuaagcaaugguccuuuucaaagaaaaaggaaacuuaacagauacaaaugagaaagcccaggaggcaaaagaaaacuccagagccaaagggcuaagaucuuacacaccagccuuccugcucacaggccagauggacacagacaagcccacuggaugcucugagucuuaacuuuucuuggaggaaaaugcaagaugugaaagagauuuuugaaaugugcccuuuuuuuuugucucauaaaaucagcaccaccgauacuaggaaugguuucuuuuucucuuuuucuugcuuaguucuuaaacccaacacucaagaacaggcauaguuuaguaccaacagcugugaaaacaauuuucacgguuuuaguugaaaaguuguuugcggggccagaagugcugcugggagcagaagcucuauaagaggagugaucgccacaucaaagcgggaucccucccagccgcaggcuuguccaggcucuuuucaaagaucaucccccauucagagucauggccauacugcucugugcucauuuuagacaacaguggucuggaaaccaagaacuugaaggacagaugaaaaagccuuggaaauuuugccugcaaaagaugacggacagugauaugguagccaagaaacgugugcccuuuaguaacuacagcuucgucuagugcacgguauuuucuguguaagcaguuguuuggauagauggaugauggauaggcaggccuuuuguggaaucacaucucuaucacaugccaacauugacuuuagggacaguugucuagccuuccugcuguaagcugcaguugggaagagggaagccucgggugugcgugcaggguguacgugcagugugcgagugcacucccugaagagucaguggaauaagaaguaugcaaugcugaccacugagcuuccuaccccgggagauacuugggaaauucucagcuauauucuuuugucacccuuggcugugaccucuguccucaucauuaaguucuaggaucuccuagaacccaaauacaccauccuuauccacugggggaacacaaaaggcagcccagcauguugacuccuugugcuucugguauuggguuaacugggggcaugcuccauuucugcaaauuucuagcuuaccaguuucucaacuuuucugaucuugguuuuuacuauaaaacuaggcuaguugucaaaacauuugagggugugucuggcacugagaaaacaugguuuguggucagcuaugccugcugugucaggguuucuauugcugugauaaaauaucaugacaaaaagcagccuggggguagggcaugcacaaaggagacuguugcagcauagucaguguaguccuucaugaagggaagucaggacaggaacuuaaggcaggaacugaagcagagaccgugaagagggcuacuugcugguauaugccuuaugcuuugcuuucuuauauaaugcagggccgugugcccaguggugacacugccccaaugggcuccaucaauccuuuaucaagaaaaugaacuacaauuagcaaagaaaacacacaacagacuuaccuacagggaauuugauggagguauuuucucaacugaggugucucuucauggauaacucuagcuuauauccaggugacaaaacaaaacaaaaacaaacaaacaaaaaaucuagacacuugcuucacagacagagaauugggcuugccucugaaguuacagagugggacaggaaggcaaaagcucagcucacuuucucaagacuagggccauugaauuugaucuguccuagaaaucagcucuccaguccaaggagcauaucuggagggacacacugugagaugcuuaacuaggacaguauaucacacaaagauccgucauuucuuuuuuuuaauauuuuuuauuauuacguauuuuccucaauuacauuuagaaugcuaucccaaaagucccccauccgucauuucuaaugaucacccuugauauagaaaucuacuggggcuauuggucucaguguguccaucugucacucggagacagcaguauccuagcaaaagaaagaaaugcguaugaagaaugcuuauaagucacaaagcacugggaugucccucacccuuagaaagauuuuggagaauugguauaaugaacauugcauuggucuucgguggaaagcugguuuccguguaaaaagcucaggucguuuggcuugcuuugaagaaggaauggaauaaggugacggguacaugucaucaccuggcacaggggacugaacuuuggcaaguuuccauauuucucacauucucuuacacaagucucuugaaaccccaaggcuagacuugacuuucuggccucuguagccacuuggcuaugaccucuguccucacuguuaaguucuauaacaugaauauaccacccuuauccacugagagaacacaaaaaucugcccaaggagguaguggacaucuuggcuucuaguauuggguuaccuuagggcacgccccacuucagcuccuuucuagcuuacuaauucuuugaccuuucuggucucaguuuuuacuauaaaaugaggcuaguagucaauccugcuuuauaguuuacauggugacuugaaggcacaucuggaacugggcaccugucauuuacaaagcaaagggcucucuugucaugagaaucagugucaucucaggcugccuggacuucugcugugaaccugggcacaaaacuugacagauuuuugacaacacugauuucaaaacaggugcccuuucugcaugaguaacuacgaagugccaaagcuggaccuggaaccagcuacauggcaaagaagagauuggaccuguagccccugccaaagcaguccaauccaugaggcuccccgcucuacaguuccaggaagcacugugauuuuuccagggccauuuggcugccuuuggccccaggaugugaaggaacuaaugugucaccuccauuucuauaacaucuagaugagaccugaugggaugucucccccuucaacaccaucccccuccugcucagccuacugauacuguauacaguauaugucugagaacaaaccaucuaucccuaggaaagaaagagagaugcugggauuagcccuugacuuauucucaacuccacgauccccucauugcucccugcagcucuuugaggggaggauucuccugaacucucacucuccagguaagaagagagaggcguugucuguuccaaugagcugcuggcugcaggccauauagcuccugaguagucagaauggauccuaagcugguacucaaaggacugaguucauccuauaccucugucagccuggaaaaaaaauguguuggccaugcagaugaguuuuuuaaaaaaaucacuuaucugucagggacaggucagucugucuucagcagggagucacuggcuauugugcugaccacauacguaggcuauucccaggagggccaccaugccaccauugcuuuccccaaauaguguguguagaucaucauugguccugggagacaucgcuugaccagcuucaaagggaagaucuguaauuugcucagugggcuugguaagacacuggccacuacuauguccuucauacccauauggcccugcugccccuguugccccugcugggaacugaccuacccuuggcugggguugaaucagcuaaugagcaaucaguguaacugcuuggacugguuugaauccuggcucuggcacauaugaggugauguguuuaucacagggcucagcauccaugacaugagaagggcuaaugugaggaugcagaagcaggggugcaaagagccucaggucuucacucuggaagauguuagguuauuucccaggagauucucaugguucccuugaaagagaguucacaccaccguuccauuuugcagaugaaggcaaucaagcaugcauuuguucucacaccuacccccucacuaaauucugucugugugucaaaccaaguccuggggcaacagagggacuaaagcgugggucaacucuagggacucugagccucaagacacuuuucuuucuccguagccuccugcuuuucuggaguccagaagccagaagcaacugcaggccagggaggaauucaggaaguggcucuuuuauccuuccugucacucuagcccaaaccucugagguuaucuuugguuucccuucccuacccacauacucagugccuuuacaagcacuguuaagacugcuccugaacuacugcugugcuggggugggcucccaccaccuaguagaaguuugcuaugcacaguucuucccaguucagcacucagugucacacugacagcuuagcauuggccucagugggauauuuacuaugaaaaguagcaaucacagaugcucccagauguucccugucucuccauuucccuuucuuuccccuucuaccaucucagucuaagccacuguuacaccauacccagaagguuccuccuggcuucuaaacuaccuacugucaauuccaucaccaggaggaaaacuacaaacuagugucugcuacccaucuccuuuuagaaacaguuaugguucccagauugcuauggcugaaaaccaguccuuguuggggccugccugguaugcuccaucugcccugucacacugaccucagcagcaucacuacucacccugcauucuuaccaugguuggaagaacugacaccauaggcaagacaucugugcuucugcugacagagcucugccccugaaucuuugcauggcugucuccauuuacucucuggguugugugcuaucuccucauaaugcccgaacacaggcaaguccuccugucugcuuacccuuccugcccaaagcaccuucuuuuacuauuuaauuaccugucuguugaugacaggccuuuggugccuggggguggaaauggugggauugacuagauuguagugaguaugugguaaaugaauauaaaacuccugcaugagcagaugauccugaaaagguguccguccccccccccacccccccgcugcugaugacuagggcucuaccucaguuucuuuaaacucuuaaagcaacuaggcuugguccaaggaagcauuccuguccugacucuuguaugcaugguggagguuguccuaaauuuagauaacuugaaaggaaaucucuaugcuucaagggcaagagagugucgagggggagaaacagaagugcuucucuaggagcugaggauguagcucuguugaguaccuagugccuagcauuucugaagccaugggccaauccccagcacugcaaaagccugacauaacacuuacaauccaaguacuagcauucagauagagauagaggcaagaagauaagaaauucuagaccacuuuuagccauauacugaauuugauaccaguugagaccagccugggcuacaugagaccuugccucuagauagaaagaaagaaagaaagauagauagauagauagauagauagauagauagauagauagauagaugauagguagauagaugauagauagauagauagauagauagauagauagauagauagauagauagauagauagauagauuccucuggcugcauaugcuucagacucuccaggcuuuggaagaacuuagcugcuccugaauggugaccaagaggccaggucuagucagauggugaauuuccauugggccagguacugucuugucuaggaaacaguuuuguagacacaaugacuugucauaggaaacuuuccugugacauuauagacagucccuggggcuauggauagaacuucaugggagaacacugaucuagcacacaugaggacuugguuucaauccccaguaucacagaaagaaaaacagacaaucucuagaguccaucuagccuugaccucucguucuuuaaaacuggaaaaacuuugaacgcuuaggaaccucgguguuguccaugaaacaagguucaaauggcuuacuuugcgacgacaugcuguuguaaugacuaaaugugacauacuauaugaaaaugcuuacuuagcagggugcauaguacacaggauucaaucauugcuaguuuucuuucauguuucuccaaauguguacccgcacaagucuguucaaaccauugggaaaaugggcauauucuugaaaaugcuauguguacagacuuuucuuccacucgcucccuauagcuccauucuguauccuuagugcauccaacugggcauccuugagagaaucccauagguaagguagcuggggaguuuuucagcauaagauucauugacuuugcuggggucauccagacagucgcaggcacccccuggagagccaggcucugucugccuuuacacuggucaugguuccaagcucuaguugaaaacauccuucaccuagccugagaaggaagaguggggguaauagaguguggcagcccugagcuggcauucagagcuugccacccucucuuuaacuguagguaacucaauggccuuucugcaccgacugaugggaacacagagccacuuugcagagccucagcaagagaagggauuggguacacagaacaggaaggcgauaagcaucuguuugucuucuugccagguucuggacuauagcagaauuuguggcuagauuuuaggaugugcauggcaggucagugcucaaguucuagaaagcaucuuguugaucuuguuguggggacggacaucuuguugagaaaccuuuucaggcugcuucauuccuuuaguccccagaggcacaugaaccuuuguggguuugaggccagcuuggucuacagagcaaagggagggagagggagggggagggggagggagagggagccugucaggcaaucucagcaugcuuagggacccaggugccucuuggccugguggagaggcuagguguccggugagacugucauuccuugaaacauuuacucugaauuaugcccuggaaauacuuuccuccaccauucacaggacagaaucuaaagccccagugcagagcauugccauuuuagucuccuaugccagacaguggugugucuuugagaacaggcagaggcauugggugcuaggacugagguggcugggcuuugauccauuuccccaggcugguuuuugguuugguuugguuuugguuuuuuuuuuuuguuuguuuuguuuuuuuuuuuguuuuuuuuuuuuuuuuuuuuuuuuuuuuuuuuuuuuuuuuuuuuuuuuugguugguugguugguugguugguugguugguuuuugccauuaacauucucuugguuucuuuaguuggucugcuuauaugcaaaggucacaaaacuggguaguuucguuuuaauuuuuuaaucugauuucuaauucuagucuggcucugacuagaugguugagugagcuuggggaaaacuggacaauuaacucacuacgauucaguuuucuuaacuguaaaauggggacuuugacacuuuuaacagacuacacuaggcacucuggacuuuacauugaaauugacuuaaauucaauaagauaaauaaauauggauaagugucauaguguauuuuguacugauggugaugacaagggaauuguuaaaucauaaaacauucuuuuagaauguacuuuugccacuggccuuaaacuuucauuuagugggaaguagcauacugaaagguaacuggcuucuaugccuuccucauugauucaaauuaaaccucacugucaucuggcaguggaagccucagucucugucucaaucagaggauuuuauaucuguagaaauauaggacccauuaaaauuaucuauuuccuuggcacuuaaagcugucgacauagucuuguugcuuuauguccuggcugacuuauacaaccucacuuuccuaagacuuggggagcaugccggaguguuugugaagauuaauguuuuguuuuaagaaccaggacuuacgugugauucaguucugaguaguucauaugaacuauuaaauauuugcuuugauggagcauucgacaggucaagaaaacugaacaaggcagggcugguggccuucuguaauauauggcccaggguuuuccucuuucuuucuaauuuagugguagguuuauacuaacacauacaauauuccuaguccugggacaucggaacagauaugaaaugaagagaccugguucccucccaagaggagaguggacugaggagaugcagcugaaguagauggagacuggugugagucugaagccccauaguacuuagauaggaugcugugcuucugcugagagagggcuugucucauuauggucuuuggcugcugcuacagaagcagaccuggaccaaccagugaacagucagaauauggggucucacaguaggcaagaaugugaagguuucaugguggacuuagggagccagguagccuuuggcaaagccuugagaacuggcuggauacuccuggcauaaagauacagacccugggacauugguuagugcuggcugugggcagagucaccguaaugaagagguugugaguuaagcuugaauggccugguuaagcaagguccugguuuggccuagucugagagagguggagacugaggagaaaggggaucuucagugucuagugggagcuucuacuucagucuauaggcaagggaggacaaggcagguuuggagccagguucuacuuuagagcagugggacuucugaagaacuugcugauggcacucacuauauuaggaagucucuuuccccacacuauguuccugggauaggacacacguuuucuuucugagagcguugguuaauaauagguacccaggcgaaaguagaaguaagaaaaacacacugagaugcacacaggcacauguuuaaugaguucacaaagugauuuggcuuccugauuuuucacaaugcaccucuccacccucccaccugugugaaaaucuuuaguggagcuggagccuugggcuuccuggaggcuggcaggagcuggaguguguauguagaggugguugcucucagagauucaggagcaauucagagccucucuauaccuuugacccagugaacuggaaagugaggaccauaauaucuccacaaaaaaacagggcaggaaccuggaggcaggagcggaugcagaaucuauggaggcaugcugcuugcuggcuuacuccuuaguagcuuguucagccugcuuuucuuauagaacccaggacuaccacacagggauggcaccacucacaaugggauguccccucaccccacucccaccaaugacuaauuaagaaaaugcccuauagccagaucuuauggaacauuuucucaacugaaguucccuccuuucagaugacucuagcuugcaucaagcugacauaaaaccagcaaccacagagcaaagaggagucaagugugcccuuucauucaaauggcugucagcuaugauucaaaagggaaaacuucccuucugagguuccacaaaguggcacagucacuucuucuccagagugucuuugagaggaaauggugauaggcuucucauuaggugauagcuaugucuggaaaggucauuauggguuuggagguugaaacccccaccccauucuuaguuuggguaccacucccuucucagugaugagucagagucagguuaaagugaccauagccaucuugccccuuugaaauuccacuccucuccuguuauuagacgcguucucacgaccggccaggaagaacacggcaaaccagaaucuucugcggcaaaacuuuauugcuuacaucuucaggagccagagugcaagaagcaagagagagagaaaacgaaaccccgucccuuuuuuaggagaguuauauuucgccuaggacgugucacucccugauuggcugcagcccaucggccgaguugacgucacggggaaggcagagcacauggaguggagaaccacccucggcauaugcgcagauuauuuguuuaccacuuagaacacagcugucagcgccaucuuguaacggcgaaugugggcgcggcucccaacaucucccccuuuccuuuuaauaagagcaaauaggccacccauauuaaugagaguggagauagaggucaaauccccaguguguagguaaaggagccauguacaggauuagcucuuaggcucacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccgugcaacucucucgggcugcugaagcacacucacucuaucccgugcaaugagucuagccucgugagauguaagagcugaguggccagcgaccuauugccuaagcauagauaaccauauaucagggggagcuccauguucuaguccugcaagcgccugggcaauaaccaccuugucucuccuaguuugggccuuaagcuuacagaccaaucaaagaagcaacacuaauccacagcaaaguguaucuccaaauaauauuaaucccacccauuuuuuaaagaaagaaaaugcugaggagauccaauuggguaauccuuuggucagggacagguccaagcgcguggaguugaccugaagucucaauucccgaaggaucuguucaaauucagccauccaauucuguaacauauacugaaaaagacuuuuugacaaauuagcugcccuaguaaacuuaacauacugaauggaaguaacacacaaucccggaaacuuuuguucacaucccagcugaguuauuugucauaauacaucuaguuguaucuggacaagaucuaugaguugauuaaccagcaugagaccucccuguaucuugacauuagcugaggccuguucaucuaugacuguagucacugaggcugacaaaguguuaauggugucaguugucuggaccuguccagacagagccaaggcugucugaauuaaggccaaacccaguucccaguuagugguaaaaaagcaggagaauacuugagcauuauacaucaccgucauugggaguggaaaugucgacauuaucccccaacgcugcucucucuuuauuauugacgcccuggacaucaccaagacgagggacaucaguauucccuuggucagucuggauuuuucgggugagucuuucugguauccaaaauggguugucuucauucugugggaaaacacagauagcuccccuggaucuuaucaaaauaggauccgggccauaccauuuauuaucaaggacauuuuuccauuuaaccaucucauugggccuaucuggcucuguacaaugacguucagccgcaguauggucaugagcaucaauauuuaaaaaauugaguguaaagagugccaaagacacagacacucuuggugcucgggguacagucuccucaaaaguuccccucuucuguuuuauaagauaggcuuugagggugcgaugcgcacgcucaacaauacccuguccuugaggguuguauggaaguccagucagguggguuacguccaucugacggcagaacuguuggaauuuuugagacguauaagcugguccauuaucagucuuaaggagucuggguuucccccaagcacuccaugccucaagacaauguugaaucacaugugaggcuuuuucuccaguuaacggagaagcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauaaacaggaaaucuucuagauaacaaaacuaauuguaucugcugaaaaauauuggcaacucuacuggaaggcuuaaucacuccagccacuucuaaaagauuuacugcauuaaccacauaacaggaaucugacacaauauuaagggguucuaaaaagguuuuuaaaacuucuaagaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaagauuggauguuuuggauaaugguuaucuauuuuuccugaaaaggagguaacuaaaacugcccaaucauuagauguggcugccaagguuugaaccugugcagcgguauaagguacaauuaaaagauauggacuuugcccaaagugggugauugcugcuuuuaggccuuuaagggcaagcugugcaauugcaucaggauaccaaucuauuauuuuagcuggggauacguuuggauggauccacaacaauggcccauucugccacaaaacugcaguuggcaauugugcugucuuaaagacacacaaacugaaagguugcgaauccucaauacguuguaauugugcauucuguaaggcuuuuuccaccuuuuguaaggccugguuagcagcuagaguaagagcccuaggggaggagauaugaggaucuccuucuaaaauacuaaacaaaggccuuaacucagcagaaggaaucuuuaaaaaaggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguaaaccccacugacuuaaaguuuuaaguagaaaaggauaugccuuuuguagcaugguaaggucuuuauggcacaggaggaugucauccauguaaaggagcaaaauuaaagaggggaauuguucccucacuggcaaaagagcuucuugcacauaaaguugacacauaguaggacuauugaacauucccugugguaagaccuuccauugauaccucuuaucagguuccaugugauuaauagaggggaugguaaaggcaaaucugggccuaucccuuggacacaaagguauagaaaagaaacaaucuuuaauaucuauaauaauuaaauuccagccacgugguaaggcggaaaguacagggagaccccucuguacugggccaaauaaguucauuugcucauuaauggcucugaggucauggagcagucuccacuuuccugacuuuuucuuaauuacaaaaauuggaguauuccaaggugagguagaggguucaauauggccuaguuuuaauuguuccucuaccaguugaaucacagcuucuaguuuuucagaggauaggugccauugaggaacccacacuggguccccuguuuuccaugguaugggccgugcugccccaauggccgcuaaggaaaaacccagacccugucugucuugguuuccauuaggugagaugggcucuauccuucccuguucuugauguccuaacccuuuuccuucuuuauaacccaucuuugccaugauauuuuuugcuuuagcugaauacccucccgauggggcguuuucauuggacaaaauaaggcccaaaugcugcauaauaucccuuccccagagguuaaccgggagugggagcacauaagguaugaauuucccuugcugcccuucagaggauucccacgucaaggcaacggagcuuauagugggacaugauugauauccuaggcccuguaaugaaugagaugacucuguggugggccaugcuuugggccaccaauguguagaaauuauacuuuuaucugcuccgguaucaaggaugccuucaaacucuuuuccguugaucuuaaggcagagcuuaggucuauuauucaaagauacaaccaaauaggcagaaucauuuccugaggagcccauuuucuuuaucucagguccugcagauuucucccugguauuaucagggaggagcagcagcugagcuauccuaucuccuuuacuaauagaaaaaacgcccuuagggcuugagcacaggaccuguauuucaggggaauguugacaauccauaacuccaggguggacuacuaagcccugcaaggugagugaaccccggccgagaauaaggcccaugguucccgggggcaaggaugguauaggcuccacuggcaccggcugaauacucauuugaggcauuaauaggaagucggaggcggcacgcagguccacccuugugggucuuccugggucgccucucugacugcuuccuggguccugacaaaccgguucccauaucuuugagggcccugggaccgagggcccgaugacccguuuuuuggcacaucaguugauugacuaucaggugggggaaggacucugcccuuuauaucccucacagagcgacacuggucagcucuaugauaacccuugccacacuuagagcaaagagugagagucccucccuguuuaucuggagcucugcaaucuuucuuaaaaugcccaggcuuuccgcaauuaaaacauguccucugaucauuucugcucauggagcgguucugagauuggaggauggcggccgcuaagccugcauuggugagaggucccccaagcucucgacagacccugagccagucuuguaagccuuuguucuuucuuggggcuauggccgcucggcacuccuuuguggcuugcucauagauuagcuguucuaucagaggcgcagcuugcucugacucuccaaaaauacgcucugcugccucugucauucuggccacaaaaucugagaaggauuccugaggucccuggauuaucuuuguuaacugcccagugguuucaccugcucgagagagcgccuuccaggcccuaauagccguggaagaaaucugggcauaagcuccccaaugguaguuugucugaucagcagaauaagcucccugacccguuaacaagucaaaaguccaaucucucugcucuggagucaaagcagcugcguuugcucgggccugcgcuugugcagcuucgugccaaagcgcucuccauuccauauauuugcccauacuagggagagcggcuuuuacaaccguuugccagucggcaggaguuagugccaugccggcaagccugucuaacugcaccaagguaaaauuagcauugguuccguauuuacggaccgacucggcaauuucuuuaauuuguaaguauucuaccggagcguggacacgcccacccucggcuccuucaaagaccggaaaugccuguuguauuuuccuuuguuccucucugggaaugaaugagucugcgcacugccucucugcgcacugccucucugcgaagggcugacgcacuacgcagggcggggacuccgcauagggcggaccuugaagccgacugcccugaggccaaucagcaaacuggccuucgccagccgcuuuuggcuuccuuaacugauuagcuagcacuuuaccuggcugguacccuuuuuucucauaaugagcugcuucuuccucccagucuguuucuucagaggagaauucuucaucugcuucagagcuacuaagagcuggcuccccgagcccauccagcgaugagcacaggcuccuuuuccuagagaccuccgcuaauugaucuuucuucuuuucccuuuuuccucuuuuucuucuaaucucucuccagguauuccuaccuaaccuuaacuuuuccucagguucaagacccguggaaaggccuguacgcuuauuuuguguaccauauuuucucuuugcuccuacucucucuccccgcuuuacuucugauagcuuguccugaauuuccucuagaauuuucagcccuaucuuaaucacuugauaacaugugaaaaggaacaaaagggcuccuaacaccagaaaaaauucaaggccaaacauauuccacuuuacuucugauagacugucuugaauuuccuuagaaaguucaagaucagacuuaccucguaaagcuguacucacugguacucucguuccccagcugaaaaguucugaauucauacaguugaauccuucuuaacagucugcuuuacgggaaccuuuauuaccgcgacccgcaguucugguucuggaaugagggaucuuccuugugccggugaugguaaacucucgucccgaguuuuuucucgucccggaauucggcaccaauuguuauuagacgcguucucacgaccggccaggaagaacacggcaaaccagaaucuucugcggcaaaacuuuauugcuuacaucuucaggagccagagugcaagaagcaagagagagagaaaacgaaaccccgucccuuuuuuaggagaguuauauuucgccuaggacgugucacucccugauuggcugcagcccaucggccgaguugacgucacggggaaggcagagcacauggaguggagaaccacccucggcauaugcgcagauuauuuguuuaccacuuagaacacagcugucagcgccaucuuguaacggcgaaugugggcgcggcucccaacacucucccucacacucuagccagcauuggagcaucucaaccauugauuuguaugcuaaggauggcaguggaacaugagcgcacacaccagcccugugcugguuuaugucugucaggauucccugaagcaauggaaggcacagagguuucuuaugagaaugcccgcuucugaaccccacuuuaucugcagaaagccaagcagaugauugcucacacucacauugcuucuggagaauccauuucagguacccaaugugcucaacuguguguacuuaccaugagcauggccucuggggagagcaguacugucacuuaggguacuucagagugcucaggcucuguguagggucccuguaggaacgaaaucacaagggguaucugucuaucuaucuguuucuauggauauauaagccuguaguguaacugucuguagagcuaauaugcauaugaauuuacucgcauaaaugcacagauuuacaucugugcaauacacguuuugaaggaaaagaguuuguggaggaauuguuccaugugacuuaacccgaacuuuuguccccgcuggcaagaacacacucaggacaacuggaaucuucugcggcaaagcuuuuauugcuuacuuaucaggagggaagaccccgaaccgggaaaauggcgcugcuuauagagcucgcagcgugacguuucagcaccugauguggcgugacagcuccugauucguugcucgcccaucaccauuacuacgccgcuagaugggcagugacuaggccugaguucacucuugcacuugcgcauaaggcuuauuuacuaguuaggcgcaguggaagccagcgccaucuuauaauggcaauugcucacggcaugcacgcgauugcucgaggcacggcucuccacagugacuguugggacugacaaguccaguaucuacaggacagacuaagcagccuggaaauucaggcaucguuucuacauuaagucuggagacagggcaacaccucuauaccuuucuugggaaaaaguggucuuuuccuucauaguagucuguggauugaaugagggaucacugcaugaggucuguccacacuggggagaauaaucuguuuugagccaacauguuauacgugucagugguauccacaaauacuuucacugcaacuccagacuagauccaggugugcccacaggaacuccuagaccuuagaagggucuggcuuugcugaugagcccccagacccaggcaguucucaccagaucuguaacuagaaaggaggccaguguuucugaagaacagcuccaucuccagccagguggaaaucaagccagaugaacugcuagaaguuuggaucauggauucauuuguccauucaugcagcugucugaccuuguguuaggccuucuaggacaggagauaagacaguaaagggguugagaagagcuucggggauguauaaucccaucaugguaggcucuccauaccuugguguauaagacagaacuuuauggguauuccauuagcccugguuauuugucaugaugggaaagugaacacuuucacuagagcccagugcaucucaaaccuuugugggucuuguguccacuggagaauucagcaugagccaugaaguacuuuguagugcucacaccguaacaauaugaauggaggagauugaggaaacacagagaccagauugaagucguucaagguuuacaagacccauuggauaaggauucucaaggagaaaucuacuucuuuuuuuuuuccuuuuaaggaaguuaagagaguacagggaaaggguucuguguacaagccuucugugcaagucugauaccugaauccaaguccugcagcccacaaaagcaaugggccaugcaucuguaaucccagagcuccugccacacaaugagaggcagagacaacagaauuucccacaagcucaugaaccagcuagucuggaaugcuaagcaacacacaugacaagagagaccaugucuuaggaacaauguagaaagguuuucaaacauuguccucugacuuacacaugugcaucuguucuuacacaucucucucucucucucucucucucucucucucucucucucucucucucuccuucucuaucucucucuuaacacacacacaaacaugcacacacacacucauacauacauguacauuauucaugugcacaugcacacacucacauguauuaagaauacauaucuugggggcuagagagaugucucacucaaguggcaccucacaacugucuguaacuccaguuccaggaaaucugauucucucacacagacugaaaauucagguaaaacaccaaugcacacacaaauaaauaaaucuuaaaacagaauucaugucuugcuacagaggguaguuucaccuuguaagcauggaguugugagagaagugacaucgagcuccaauggucuccuaggacauacugagcuacaacugaagucugacugcugagagaaauaagcuaauucauaacucaaguuuggugacuaucccauccuuuucuuucuuaucuacaugugaucauagaguguugggaauaguuuuacauccauuuucucuguuuaaauacucucuguuuuuggaaauuaggcagaguuaaagaaucaaacagcagaagcacugaaagguguacaguacaggaaccuguaagguauaaggacagagcaaaggagugggaacaaggccaaaaacauacuuggugggacccaaugcaaagugcuuacacagaagcccucauucaaacauuugggcauuaaaaacaucaacaauaagguauuaggcugagccuaggcuagcccaaacuucaucuaugcacucagaacagacacauagaggaacccagcccugagggaagaagauacuucccagucaggcagcacugggaaaaucugagaggaaggacuuugucucccaaagcaucauagggcuaucugggcagagaaucagcaggugcuaagaucuaaggaugugggagaggagucaugagacaagcuuagccugagaugguuugaagaaggaaagaugaagugaaacugaccugccaagaaccaguaaccuauggguuuuuguuuuuguuuuuuaucaauucccccacaagaaagaacaugugccccuaaccgcacauggacuucaggcccauggagucccauuugagacacaacccagaauauccuuaauugccagcucaucugcccuuugcccuuacucccauugccugaucuucccacagcacauagggggaaggccaaacuguagcucacgugaagucugcacaaccaccuccuagcuacgauggagauaguccgaggcacagggaacucaaaccucacaggccuuugagccuccgagagaacaggcuuuguggguuucuucugacuccuucaauauguaccaaauuguccaucuuaucauucccuguuuguggagaaaguugucacaggagcuuggugacaaguuguuugaacucugacagauugccuauuuccucucugcuauggcugucuugguucuuguuggcugaaauugggugguuaauucccuuucuccucucugguggcuuucuguuccuuuacagcacuuucuuugauaaaucauuugggacaucaaaccaucaacagcauugccguaaacccuuucuacagauucauaaaugagaucacacugagaagaugcauuaagcagugacuugggaagcguuugggacuguuuauuugccuggagacacaacaagcagggcuguaggaauaacggguuguggaguugaaggcagcauuugcugagcagagagagagagagggagagagagagagagagagagagagagagagagagagagagagagagagagagagagagagagagagcgccuuaccguucuuagaggcagccaggcuccuaugcagcaaagcugggauagggcuucuguuagaguccugcucuguucuccagaguaaugcaaggugcagagaauaagggacuuaaguuaacugauguugugcagagagcaggugacaugcuuccucccaaguuaguucuauucuugaaacaugagaaucacuagacaaugcaucaucuaccaugcaucucugaagaagcccauugacuuccaggaaccucaguuuccccaucugagaauagaaaccacuuucuauuaucacuccaaaauugguaagaaguagcugagagcagcauccauguggaguaagcuaaguuccuuaaccccacagcuuugggguaggucacacaagcucucugagccccaggcuucucaccucggaaguaaaaagguuuagcaggauuuggaacucaaguuuuaucacuaccucgcauauacaaaaaugucagcuauuuucaucuuugccauuaucuucaucauuauuauugguaccaaauaagcgcuuaguaaugauuauuuuuuuccauucuguuauaggcaagagcuguaguguagcuggaaucagcauucucagcauaagcagacagggcuuuaaaucacgaaugugcaauuuauuggcagugcaagcuucccaaaugucugaggcuuguuuagcauccaagaaguggaguugcaauagacaccuugaacugcggcuuauaaugacugggagaggaaaaaaaaccaaaaaacaaacaaaaaaaaaaaaaaaaaaacccuggccugccaugucauucaugcugaaaacauuacucuccuuucgcuuucaaccauuauuuugagugauuuuaaagugagacacaacccuccucccagccaagauccagaaaguccucccuguguuuguugcaacagaagcauugccugcaauuuaggcaguuugcaucaugcaucuguuuccagccugucuaugcuacggagguaugaugaaaaagccaccaauccaauccacauggcccagggaucaugcugaaguugguaacaaagacuuucgcagguaaacacugagugcaaacgcuuguauuugguuguggucuuggcuggcucuccuccuggacacugcagaagugggcuguguccuuccugugugcuuuggacuuucuuuaccugcugugcugugauugugaucugccugccaugcaggacccuccacuguagaagguagguggugaaccauauagggcaggaguuagacagcagguccaccauccauggauggagcauuuagcauauugguaaaaacaucugccaaaacacaaggcaagcucaauggcaugaucaccugcuguauauacuaggagacucuggacaaagauucaggacagcaagaacuuuaccauggggaugauuagaacuccguuggcuuugcagaggguuauuguagggucuggaggaaugacacgggaauggagaagcugugauaaguuccuugugucugugugaugcaggaauuugucaucgacccaucuuagcuguuuaccauagagauguagcucucccccuaugcucucuccccgauaaagcaacggacaaugaugucagucagcaggauacucaaaccuucacaccagguugugcguugcuggacaucuuauugguguguuccacauugccugcuagugaaggaagaaggugaaguugugcacaauucauugcuuuucccccuccagugauaauuauuuuuuguagaaaaaccugaguuaagucuuaauaauuuaauugcuuuuauuguugauuaccaaaccaaaagaauaaaauggagugugcuguucauuucaaaacuuucuuuaucugcuccaggcuguuuaauuucuagaucgcagcagagacugaacagcacugcucaaaucuucaacugugaacaaacuuuugguuuguuuuuuuuuuuccaguuuuccagaugaguuugucuugaagggaaauggaauaggagaaauaguguuuggcuuauuauguuagagcgauaugcuuguuuaaggaaggaggauuggaaguuaaacauuuccacaaacccauuuuuuuuucucugauucuaggcaaguugcuugauguuucuaagccuuaguugcucagucuguaaaauggaaaugguauaccacuuucaguugggucaagauacugagucaauaaagauacagcucuuaacccaacuauagacacgugggagacugggacaagucacucagcuucuuuaggacaguaagacuacagccauagccguggcugcugcuuugaccguauggguccagagacuuaugugauaaucucugugcuaagcagccauccagcaucagcuaguauaccuccaucccuaggguacuaaaggccccaugaaggucugcacccuccaugcuggcugacgagaaugcaugaaugcaucguuaauuauuaagggauuugugugagcuaguuauuaaacacaguuaugauuaaaaauuaaaggacaugagcuuacuuguaaauaaauuauguuuaaaacaaagagaaagcacuugacaaucaccacuucccauuuccuuuauuccauuaccuuguucuccugaagucacaagucuguuuuaucauggugauacacacagcaagauggcugcuccugucuucccagcuccccuguguugacucuguuugccugaagcuagcuauggugggaguauuuacaccacaggaaugagcaaacucugcaaaucagugcuguuuauuuauugacuuauuugcuucucucgggggugggcagggacacuaguuaaauauuuacuagcaugacuuuggguaaagcuuacuaacuaacaagcagagacacuuuauuguagggcaagaucugacagugagccaaaaggaaucuccuuccagcugauguucuuguuaggauuuacagagcauuuguguuuuugcugggaaauaaaauacaugguuugagauaauggcuuaguacaguuuuguaaccccuuauucacaaugugugggacaccaaagguccggaggaaaguauuauuguguaaaaucaacugucuuuguauucagaucaggguuuuuuaacugucauuucucagaaaagacgauuucccucuaagcauuaaccaguuucagaaugcuuaaacgaugcuacugaggaaauucaaccucauagaugaaucuuacccacugugggaacaguguaguuuggguugguuaauuguuugguuuuuggauuuuguuuuuuggguuuuuguuguucuuguggauuuuuguuuuguuuuguuuuguuuguuuuccagagugcuugauugaauggggugggggugggggcgagcagguaucaucugggccagcaugaaaagcuuucagaagacgccauucugugacugagcauccacacacacaagacagcaccaaggagaaauaucaggcagcuucggugcagaaggacccaaauaaauaaaagcaggagggaaagagaauagcaagaagccacaggaaagaccacugugacacacuaggacucuuagaauuugagauugaaagaacauuagcagguugacccauggacagcuugauugacauuucauggucacacauguugcuguuuagguucuucugguaucauuuugaugagcugugugcucugagguaggccacuagacuucucugggcuucuuuucuuauccccucccccaucucagaaaauagaaacuauaguaauuaucacauuguuuguuguuucuauuaaaugacauaaagguaugaagguccuggaucauggaguuucuggaaagagguaaccacucccccugccauauuaagacaugcuaaucaucuuaaaguuaugagaaacucaagaugauuuuagaaaugagguacuauguauaagaaaauguauuuuuauaaguuggccuuugaucauuuaauuauuuaaaauauaaagugaaacugucuaaguggacuuuguaagaacuuauuuuuggaggagaugcuggucugauuuuguaagacagacccaagaccagcuacaagaaguuguguugaaauaugagcuaaccaguaccccuagagcucgugucucuagcugcauauguagcagaggauggccuagucagccaucauugggaagagaggccccuuggucuugcaaacuuuauaucccccaguacaggggaacaccagggccaagaaguagaaguggguggguaggggagcagggcagggagaggguauaggggacuuucgagauagcauuugaaauguaaaugaagaaaauaucuaauuaaaaaauugaaaaaaaaaaagaaguuguguugagccagacaugguguccuacaccuuuaaucccagcacuuagaacacagaggcagacagauuguuucaaguucaaggcuagcauauucuacccagugaguuucaggacugcuggggccauguggaaagauccugucucaaaucucucucccucuccacaagaaaagaauuaauguauucauugauucugacucucucccucccccaccaaucucaaucucucucucucucucucucucucucucucucucucucucucucugugugugugugugugugugugugugugugugugcaugcgcauguguccgcguguguucugucccacuccuuccaugcagaauuuaccaaagugcggauaguaagcucaguguuuuacaaacucugcuagucugcaagaaaauuauuuugagucauuuuugucaucucccauuagacaucaauuuccuaggcaaaauggaauguaggacacuguugugugagugaaaaagcagacauguggccagagguuaauaacucccauugcccagucaugaaagaaagaaaaaucacagugucacuucuacucuugacauuugguucugucauccuucgaagucgaacaaagcaucuuugugcauuauaaagaggccuccauuuaugucuuuccaaaguucuuuggagaugugccucuccauuuugcauggaaagguagauaguaaguggagagaaaccuuagaagcagugcagagcaaagcacccagaguauuaaccauaaaccacauugccccaaauuccuccuggacaaguggcaacaagccaucagaaacaacagagucccuccaguacagaaaaccacugcccacagugagaaauauaaucacugccauaucuguucucagggugggguaaaaugcuacagaaugccauugaacuagaaagaaaauccaagagcacuuucaaauugcucuauggacaaugagagaugagguccccucugccucagcaagcaugcuugcuuguccuugucacuguuguccacuguuggcuauugcuucucuugcaauagcuguugaaugacaucaaaagcaggccuugugaauuguucuguucugcagggcuuucagcugugugccucuccaggagccccggggucauucuuccauucuugcuguguugugcuguaaacuucuuuucucaggcuaucuguuuuccuaccuggucagauccugggagauacuggauaagaaucaccaguaccuggucuuaagaaaaauaguagauucaggcauuguuuaaacugcagcucacaguaaugacuaccuuaaguccugcuuaugaccuccauguaagaauaaagcuuucuguugccaccugggaugaacuaugacauuuuuaauccuuuucaaacccauuucauuuuuugaacccuucaaaaugauuuuucugaugcauuagguucauuucauggcucaugaaagggacacagcuuccugcugcaaaccccugcauuucaggcuuuaaugggcacacagaucaucgaggugcuggaaaauggcagguucugacucaucaggucugagauggggucccugauucuucauuuuuaacaagcucccaugggauguggauggaugaugcuuaaauucuggcaguaccuugagcacuaggguucuccagggcaggcuuuguucagcaccacggacagagaaaacccaugcuuccuuccccuugccccaauaccugagcaaucaaaccuaugaggcaccacacaugucuggcuucucugccagaacugugucaccaacugucugggaagcaaaagaaccuucuagaggcuaccucgugauacaaacuaugaucacucuuccacaaaggaggccucuugaucuucaaggauaaacaccuuggaauagagacccugcugaggaguaggaagagaagggcagggcuugacaaaacagaggaaaagccuucugggaaucggcucagcuccuuucagcauccuaucucuccgguacacuacaguucuuaccuacuuacugugucuuugucuucaucuggggucaugcaauaaaggugcagaaugucucucacagauuugcucuagugagcuguagucucacucuaguauacagcugcagugacaaaaccauuacauuagucugauaccaugacucacauuaaauaugcuuggaucccagagcacauguuuauacuaggagcagcuguguauuuauaccaaucuacaauuagauuaguccuucuuggugcuuaccauguuaggaccaccugauagauuugcaaaaaugcugauagaagggccucaccuaacagcaguuccaucagaaucucugaguaggagguuuccaguguuguuagaagcucucuaaauggcuagauuauguggccaagaguaaagaucaugguaugcaccauauucucugugacaauauagaucaaguucuagguacucuuuuucuccuccuuuuguucuucaaaauucuucccagaucuuguccaaugggauggauucccaccuacauaucuaaugauuaagaacugaugugaccaacugaccuguaccuguucuacaugcacaaugaaagcuacuaacauuugccuccauuucugcccaacucuacaaacuugggaguagaucucacuuaugucacucugaaguggaagaaucugagacuuagacaaguuggcugggccugaugaggucaugcagggaaugccagagccagaaucuccauuugauucaggguguacuggagcuguuuggaacaggcaccagcagguuucugagguuaagggagacccaacaccacagacaaaacuuuguuuuucuuuacuacuaucaauuuuacagcuuuauggaaaauacagagucuuuauuaauauuuuauagaauucauuucaaaacaauaguagcccuuauuaaguauguuuuguuugccaagaacuaugcuuggugauuagagcugucaaucagcgcuaggagauuggcuucagaucgaucuccuugaggaugucaaaggucauggacacucaagucuccuaaguacaaugcuguaguauuuacacauaaucuguguuaaucuuuguacuuaauuaaaaucaucuauggauaacuuccaauacccaaauguaaauucuggguaaacagguguuagauggacuguuuaggagauagcaagaauuaaaauuggccuacacauguuuaguauagacaugauuuuuuuuccccucaaauguuuucagaucugauuguuugaguuccaagaugcagaacccagacagccaacaguuguauccauuuccucuuuacccagcugaguuccaugaugccauugcaaggcagguguugcuccuacaacuaggauagaaagagaaccaagucuuggguuggguuaauaagccuaccuauaagguuaaagucagaaaguagcaaaggcagauuugaacccaggccuuccugacaugaguccagccacuccuuaagcacucugcccauuucuuguuugcagugcaaugauggugaaauuaucucauuagagccuugagcucagaagggagauggaugacagggugggagccagguucagggagcaggugccagauggaugcaaguggggauugaccaucuggcagaagacuaaacaaacagcauccacaggcuagaagggcuucuuguaaaaguaaaaugucucucccucugcucccugcuccagcaauuccagcauucuuuguaucccucccaggacaugaggaggcagguuccaggcaaugccacccuucuuccugcuugcagaggaacacaggguaccucuguuguugcaguuugagguccuugaugauagauggcaggucauuugcagagccuggagcuaucauucaugaaggacaauggccuacugggaucuaacacauuuggagaagagcaugaaauggacaaaagggggauuauaugaaacaaagucaaaggaaaacuguuaggagucuuauuucaugagccuugauuccagcagagaugaaacacucugaaagagcugucagcaaaugcacagagagcccagaauuguucucuagcuuccugguguccaucacuagccagcauuguuagggacuauauagaauuuagcagaggauuacccuuuugggaagugugggcuauacucuaguguggagaggagucugguguuugugaggaacuuuacuuuguaugaggaacugggucaguaacuugagaaguaucagugggaucuuucuuugucuggagcacuggucccugugcauggaucugggaauguaaacagaugaaugacuuuguuuggcuuggcuugggaaccacuuucuaaaauguuagaagccccacuguguaauaggagggaaguuaaugcuguauguaugagcgugggguuaaggauaauaaaaacauucaaagucagagaaguagucucaagccugcuucuuugucuuuuggcuuuagaucagcaaguaucacuggccauauagucugaugcuuuccaacaccugcuaaggguguggcuucuggaaguagguggagagccaggcuugaugguaacaaagcacacagcucccuaccaugaaggugcuguggcuuggaaacugggcauaucauuaagugaaggggagcagcccacuuaaggucaugcuuaggucaggguugucaggacuggggcacauuccgccaagcacucauuguaucuugggucuccccaugaugggugguagccuucuguggaagggauguuggaaacacauuuuaauggguagugaguguuuggugcuuggugcuuaccugguugcauucagaggugcuauuuauuggccaaugccaagaaaacccauuucagaacaguauggccuagauugaaccauaagcccugcaguugcuccaucuugauuggguauauuccuuggccucucuauaacuuguuuguguguguguguguguguguguguguguguguguguguguguguguguuuucaucauaaaauacugaggcuauugggauauagagauggcagagcaguuaaagaugccaagcccgagggccugaauuugauuccaggacccacaugccaaaaggagagaacuaacuccuguuaguuguucucugacccccacauaugugcuuuauuaguguguauccacuccaucccacacaaucacacacacacacacacacacacacacacacacacacacucaaauaaaugaacagaaaaggaauguaauaggccauauuucauagggagguuauacauauuaaauuugcaaaauauauuaauacuuguagagcauuaaauaagauaauauauuuaagguauuaauuaaacuaauauaugaaguauuagauaaucuaacauacagcaguugcaauaauaucaggcacauaguauuuuauaccuguuuuuaguuauuguuauuguguacauaugugagcaggugcacauauauauguggaaacaugaacacgugugcauauguauguggaggccaaacaacaaacuuuggugucauuucucaggagcugucuauaaccuuauuguuugagacauggucucccauugggaccugggacuaaucuguuggacuagacugguuaguuuuggauccccaguuauccuacuggcuccaccuccccacugcugggauuacaagugcgugccagcacauucaggguuuuuacccgggugcuggggaaugaacucagggccuugcacuugcaaggcuagaacuauacuaagucaucauccuagcccuguaaaacugauuauagugaaagcgugcccaaugcccaacuuugcgcugaugacagggauguaucagugaacaucauauggcccuuccuucauucacgcacauuguugagaaccagccacauacaugaccuuuccccaugaccggaagucauacauccucugaaaaugauucggggaagugcaacagggagucaucaaugggagggauggagaccaaucugcugagacaaggaaaaccuagagaaaagagugcuaauuaugaaguuaaggacaggaaauucugaccuggugaaugcagaugagagcuuguaccugcccugccucacuugugagaguauagagacacucuguagcuaaugaaacagaauaaaaacuagaagccacuucucaaagcacugggggacucugagggacaagggaacagagacuuaaaugacaggaaugcugcccacaugugggcaagggugagggagacacacggaagcauucagauuauuccaggagagaaacugucugcaaaggugcagaggcaagccuggcagugugugugugugugugugugugugugugugugugagagagagagagagagagagagagagagagagagagagagagagagagagagagagagauuugcaugaagacuacagggcucauggaggggauuuggcccaggggcuuagaggauaagcuggaggggauguaguccucaaaccagagaguagcaggugaauuugauuccacuccgaagauuuuuauggacucauaaaacuguauauugugagcuuguaaagcaucaauucaacccacagcguaggauuaacaagguacaacagaagcaaggucccaggaaauaaauagugcauccacuguauuuguccuucuccguucaucuuucuguuacuugucucucacacucaggccccaagaucucugagaugagaguggcagagagcccaggaaaccagcauuuaacauguugggcacacuucugaacagcugaccuguaucccgggaccaccgcagaccugucagcuugagcagagaaguagaaagagaggguuuugguggacucaggacuuugguuucucugacucccuagcccuugccuaaccuguguaggaaguaugggaauucaguguacuaaucaaugugagaugcagagucugcgcccacuaucgguuucaaaugcccugugugcacagagcaaccagaauggcuucuauuguguggacucccaggcagugucuguccuggaggcugugaguggggaaaugauuuauucaaagcucacuccugccucuccaugccuaggguaagcaugaguguggagaaugcaagaaggaacccccgcagacaggugcccugcuuccagccugccuucuacucugugguccucacccuuugcucuuccaauccccauaaggcaggugcuucccacauucuucaaagcucacggagaugcagugugugaggugcccagguggaaccuggcacuucucagaucgacagccaccacuuagcuucucuccuucauuuguuccuaagagugacuuucaaagaaaccauggauccugcucaccggaguccuggcuguucuuugaaguucgaaacccaagucuuucuuauaucucagacccggggccaguuuugcauguuagcuugacaucaagguggaguugcugaacucucuccuagcagagaguuucuuugcagcuuccuuacucugaugcagguggggauugacaggcugaguuccucaccacagagauguauagcgcaccccugugugcaggccagaucugggcacaggguaaggauugauggacgaggcagagcccuuucuuagcucucaggcugacugcagggcagacgaaccaucaguggccgaccugcugggugugugcugcaguugauggggacacaggaacugugguuuccagaaguuucacaacugcuucugcacggaggagucaggaccaggcucucgcugucugacucacagggaucuuucaggucaagucugagauagucaguucugcaaggcaaggauaucgggugggaaagaauagaacacuuucaaaacaaaacaaaacaaaauaaaaaccacuguuacugucacuuuaagaguucucagaugaggaaacagaugccaugagaauucaugaauaccaaaugaucaacaggaccccgacaagucuuuucuuuuucucugggugucuccccauccuccacaugagcaucccuuccaguuccacaagccuugaugcacaguguguugcucacagccugcaagccagugugaagccagcuuggcucucagucuauuuaucuuaucuccuauuuauauuuggaagccuguuucuucaucuguuagaacugccugcaucgcacgcccuggaaaugucucuguuuaccuugaugugccgugagcacgauccaggguuauuaauaaaacagaggagcuucccagcugcuagggcuaaacuacugcuauaaaaucgagggccacaguugaggguucuaguugcccuagagagaacucccauacgcuccacaggcccauuugaccuuagggaccaggguggggcaagggacauugaaccaaccugccuggcaaacaaugcccuguuuuaccuucuccugccucagaugguagaacucacauuucugaacaucccauagacagcaaacagacaagguuuugguugcucacucugucuuaccacaaacagaacaaaacagcaaccaauaucucaucaaaacuguuuccacuaucuccuagaaagcccaauuugcccaugacaggccugucuucccauguggcacccccaccauuuugcaccuugucaaaugagagcuaccccuuugucuaaguuugccaugauaaauugcaaucaaaugcaacuuggggaaacuggguuuauuuggcuuccaauaacgggagagaaggagagcaauuugcugagucagggaaaaccuggagcagagagugccagugaugagguuaaggacagggaggaaacccugaccugugaaagcagaugagagcuuguaccugcccuguuucacagguucuccucuugugagagcauagagacacucuauauaucccugaucaugguccaucgcugaggacaaccaaggcaggcucacaagcagagcaggaacucggaggcaggaacuggaguagggacugugggaaaaggcugguuacugccaugcuccccacggcucgcucagcuuucaguuauuucuuuuaccuuugacaucauaaugcaucacccagggccaccugcucagagguaacacagugaacuggacccuugugcuucaaucucuaaucaagacaaugcccuauagacuugcccacccaggucaaccugauggagauauuuucucaauugaggagccucuucccagaugacucuagccucugucaagaugacaaaaaccaguauccccugucacaggggugugaggauuuuuuuuugccagucucuaccccuccccucugcuucuauauacucuguaugggacaccucccaaguaagcuugccucccuagacuugcaugugauuuggucuucugugauacuguagcuauguauaacuauugauacacaguccccagcuacaguuauucaaaguaagaauuuggggauagcauacgaguaacacaaucaguggaaaacauucuuggaaugaugcggauucauuucuugacagccuagggauaaaccaugauacuuuuuccaugaugcucggcagugaagcaaggagcugucagucacacaaucaaagggggaagcaaccaaucccccacagugcacuguuucuaagcuagaguggucaguaggaucagguguacugagugcauuuguguguguguguguguguguguguguguguguguagaugaggagugucuucaggugucuucuucauuuguucuccauuucguuuuuucaagacaggcucuucccugagccuagaacuccuugauuuggcuagccuggcuggcaaugaauucugggaauccguagucucugccucuccucccccaagugcugggcuuacagaugcacaccacuguguccggcuuuauguagguguggaggaucagagcuuuagggcuuuauaucucacaccuggcacuuuaacaacauggccacuuccccaaccccuuaagugcauuuugacucaguagcauuuuuaacuuacaacaaguuugugaguuuugaccccauuaugcagaaacgagagucuauacacacugcgaaaccuuuccagccaucaagauccccauuccuaugcauacccucauucugaucucacugcagccugccaaggagggaguggcuauucccuuuucucggcuccagaaaccaagcggaagaaauaaaugacuguccuguguuauggguucagagagucucacucggguauggcucugcacagugggcagaguguggcuaaagaggcagcaggcacccaugucugguaagucauacuugcuguggagcccugugcagagaccugccccuccccuugggagcucaguuucuucccacuauaaagugagguuacugcccuaaaucagagcuucuuaaugugaguguauggccgggaagaaaauaacugaaaguuagcauuuucucccauugcgaauauaggcaauaaaccacaauagcauuagcaguuucugggacuuuguuaccaggaagaaucagauauuuuuguaucccauuauaguuauuggagaugccucaaaauaucauuugcacucaucacuaccucaagguuaugauaguuauuagacaagcuguuagaucuuguuaugacuuagaaaagaaauaaaaauauaacaaucacaaauuucucauuuuaacauuuugauaacuauuucaauauaauugguuuccuuuguaauccgauuaguuuuuauuuugugcuuuuaaaagguuuuuucuuucuuuucugggaagagggucuacauguuucaaggaucugccaaagggguuuguggggcuccagagguuaagaccuugcugugucaccgcaggagcccaggucccaccagacccagguucucauucaucagccuucccccgccccucacucuagcacacucagccccaucugcuuccacaccugaggcagcugcagaggugcucccuugggcuccaugcagcucagauggcauucaauuucaucagaccagugccuucuggucuauaaucuaagggaggcugaugcugucacagucauauggguugaguggaaggagggagauggaggcucaagacucaaacaugucuuuugagauaggcagcauuuagugcucaaauaccuugguuuuaucccucccagaugacauccuccucaccccuauucuucuacaagguccucauggggguaccacagauccagagaguauggguguuuguuuguguuuuauaggaaagggcacagggaaggccagaguccagagccacaaaggacaagauguaggaagaaaguaaggauggugaagcaaucaaacacacacacacacacacacacacacacacacagagagagagagagacagacagacagacagacagacagacagacagacagacacacaccagaaaacagagcugaggacaggcuggcaggggcaguuuguucuaagggcacaaggcacagaagaacuugugaugggaccauaccagaagaugaggugagagaugacuauggcuucauauagggucacaagugcaggcagaaguggagagaaguggacagaagcugagagagccugaaaagacagaaccaggcgggcuaaaggauagauagcuaguggauggagauagagcucaaggauuuagggcaaccuaggugcuccacuugcugacauggggaccaaccaagggaggcucucuaggaggagacuguaagguaccaccauguggguaauaggugguuccuagcaucaagacaauuguuucucuuuuaugcugauuacauugcaguugagaaaacacaucaccaucccaugcuuccauggcaacuauuaaacuaggagcauaacuucuacuuuagggguuuucugugaugguuauuucaaauaugaaguagaagcauccgaugcauuaugagcuguccauggccccagguggucucuagcagugcuccaguccccaggagucucagggaaucccauuacaaagaggcacgucuggaacguuucucacuuaggggaugaaauuuggaguccauaacaagucuggccauggugaugcugagucuguuuucuugccuguugggcgggaauacacacuuuugucucuagcccuugagauugugucacacaauggcaucguuggguggaauucacauagucagucuccaggauugucucuguggcuccuggucaguccuguaaggucucuagcucauuaggaccauuaaaguugaagcucaaugaauuaauauaaaguucaugcaauaauucaccuaggcuagagugcugagcugaaugagcugugacucuggacccgucugcuucaaccucccuccauccuaaccucaccauucaggauaucuuccucacagccaucaaggggcucaagaucaaacugggcccugugcauccaucggacugggcuggagagaugacucggagguuaagagcagcggcugcucuuccagagguccugaguucaauucccagcaaccacaugguggcucaaaaccaucuauaaacguaauuuaugcccucuucuggcaugcagguguacaugaagauagagcacucauauucguugaauaaauaaaucuuuaaaagacagaagcaaaacaaaaccccugacugccucucacagauagaaucagaggccugaaccucauccuuccuuuuuuuuuaauuuauuuuuuauuagauauuuucuucauuuacauuucaaaugcuauccccaaagcccccuauacccucccccugcccugcucccuaacccaccuuccucccacuuccuggcccuggcauuccccuguacuggggcauaugaucuucgcaauaccaagggccucuccucccacugauggcugacuaggccauccucugcuacauaugcaacuagagacacagcucugggggguacugguuaguucauaucguuguuccuccuauaggguugcagaccccuuuagcuccuuggguacuuucucuagcuccuucauugggggcccugugauccauccaauagaugacugugagcaucaucuucuguguuugccaggcauuggcauagccucacaagagacagcuaugucaggguccugucagcaaaaucuuucuggcauaugcaauagugccuggguuuggugguuguauaugggauggaucccuggguggggcagucucuggaugguuuuuuucuuccaucuuagcucugaacuuuguguuuguaacaccuuccaugcguauuuuguuccccauucuaagaaggaaugaaguauccauacuuuggucucccuucuucuugaguuucauguguuuuacaaauuguaucuuggauauucuaaguuucugggcuaauauccacuuaucauugagugcaucagugagugcauuuuuguaauuggguuaccuugagaauugacaaaugggaccucauaaaauugcaaaguuucuguaaggcaaaagacacugucaauaagacaaaaagaccacuaacagauugggaaaggaucuuuaccuauccuaaaccagauaggggacuaauauccaauauauauaaagaacucaagaagguggacuccagaaaaucaaauaaccccauuaaaaauggggcucagagcuaaacaaagaauucucaccugaggaauaccgaauggcugagaagcaccugaaaaaauguucaacauccuuaaucaucagggaaaugcaaaucaaaacaacccugagauuccaucucacaccagucagaauggcuaagaccaaauauucaggagacaguagaugcuggcgaggauguggagaaagagaaacacuccuccauuguugguuggauugcaagcugguacaaccacuccggaaaucagucuggugguuccucagaaaauuggacauaguacuaccgaaagauccagcaauuccucuccugggcauauacacagaagacguuccaacuuuuaauaaggacacaugcuccacuauguucauagcagccuuauuuauaauaaccagaagcuggaaagaacccagaugccccucaacagaggaauggauacagaaaaugugguacauuuacacaauggagcacuacucagcuauuaagaacaaucaguucaugaaauuccuaggcaaauggauggaucuggaggauaucaaccucauccuaauccagguguuuugcugcugucucagaugcucugugucuucuugccugucugccugcaucaucauggguccacccacauuccacaccuccugccuggaacuucuguuggcaaagacuguucccaacuucuuuuucucauucauuagaacagagccuucacuggguuccacuauugagcacaggaccccuuucuuccauuuucugcucuagacacguuuuauggccaaaaugagcagcugaaaggucaaaguggagcuggagagauggcugucauauauaaaucccauaaucuacaucgacauugugauaaagagacccacuuuauagauagaaaauaaggcugagaggugcuaaguaacuuucucaguguuacaugauagcuuugguacaaucuaggauuugacacuguugauaagauaaaugaccaucaggaccuacccucuuacuuuaagagcuauuagcaucucagaggugcuggggggggguggagaaucauucuuuuuugaggagcucuccuuuacuccaguggauggucacauauccguggauguauggucaguacuacuugaacuuagugggcuaugaggguagguuggaguugggagggguguguugagggcauauggggagagucggaggggaaauuagggggugguugugaucauauuucauuguauaccuguauuaaaaucugaaaaauaaguaauuuuuuaaaguugugauuuggaugcugaugaggcccacgauuguaacauuucucccaaucaccaguuucuucccaugugcaguccagagaagggggcuggcaacuguaugucaaauggaaggguaagcaugaaauugcuggguggagaaguugcucuuccaagcaaggcucacuugcuugaguuguuaaaauuagaaaggcucucaccuguuguucugugggucuaguugaaaauauuggcagcauccuacagcaucuuggaugauuaguagaccucccauguuuuaagauaaauaauaaaagccauuauuucuguagcaaacuccccccugaaaguaauguaaugcauagcauccaaacaggagugccugcagcuggggcagcugucuggaggaccucacuagucccuggaaagcugguuaauguucuaggguuucauuacuggcucugccagaccuuggggaguuguuuggugcugaggguugagaccucaugucuaccguaucuuuuuuuuucguccuaaauugcuuccaucacccugaccacacagacaagaugagaucuaagugagaaggagugagaaaggacaggaccuuugauucugaaaugcccaggagaaagcucaagugagcauguuuugauacccuaaucagcaacagaaguccagggguugaaaauccaugccccagcaaugaugaccugggaaaucacugcccaucauuuucaggaagagcuuccucacucacucagacaucugguggcaaggcuuagcuuagaucaacagaguuuccacaaagcaccuacaucugaagaguggacacucaaagcucacacagcaugccugagccuuggggucccuggagccuccuagauggaagcuucuagaaggcucaguuuaugcuauuuucagccuuacuaugcugucaccagggauguaaccacucaggucuggcaucuaccuugauagaaggcugacccagagaaugucucuguccuccugguagguggcuagguucgggugcuuuaucuucagcaguuagagugaugacuguggcccuccaccuuccauuccauucccagcccucacaaauuggcacagcacagcucugggauccagcuaugauuuccccuucacauucuugcuucucacuggaacuggaaggcuucugggagcuaaggaguuccugacacucagccuaacccuauaacaaucaccccaccaucuggauuugcauucugaugcugguuugccuaggcuccaaauccuggucuuagagggguaugguuguauacucuuucagucucagcauucaggaggcugggggaggacaaucccagguucucaggcuauagacuugacccugucugaaagaaacaaagacgcuagccaggcgugguggcgcaagccuuuaaucccagcacuuaggaggcagaggcagguggauuucugaguuugaggccagccuagucuacuacaaagugaguuccaggacagccagggcuauacagagaaacacugucucagaaaaaaaaaaaaaagaagcuaaugaacaggagcaaaaucuuggcucuauuacucauuguaugcuuuuaggcaauuuuguaggccuuucaguauucuuguuucaucuauaaaauaaggaaaugacagcaucuaacucucaaaauuguaaaugaagauuaaauggagugauauuuauagagcauuuaggacagugcauggcccacuugggcugcucugaccaugcaacuagaacaaguugccuguaguaucauagacaagcuuaagaaaggaaacccagagcuuuuaccuggugccugacaccaugaaagacagauccauggcaagcaacucacagggcuuuggaaaguuucaggcagauaggagcugguagaaaaggaacuaugcugcccuggaaauauaguggcaggaucuuaagggaucccgaggagagaggcaccaggggaagagggugagcuaugcuguuggcaacucaggcuaccagacugcacucaucaugauguuuaccagcuuuguuagaugugucauuguuucaauaucccuuuaucacaucucuguuagaugugacgcauacaaagaccaaggcaacccugagguucugugcucuuagugucuauccaucucaggugaaaacaugggggcuuacugauaucacaaauguugucuacagucaauaagcuugggagggaaugagaggcaggggucaaccccagggucucacuaaggacuaaagagcaccaugcaugguccccauuacucuuccuuagauauugagaagcagaagagaacuauuuagagcugugggagguggcucacaaaaaggauauugaaacaaugacuagaguguuugaagauggggcggagacaaacaugauacugguaguaucuugaucuuaguuucucaguggaaacuugacuuugaucaggacaucagacaaacuuugaucuaucuugguaccuccuucagggcccagagaauccugauuuguugaccuuccacuuccauaugccaguggccuucaggggcuaaagcaaguugucaacauguuacuggcaacuggaguagauuaauuugagacgauucuaaacugagcugaagagguggcaccacaccuauuagcauuucuuuuccuauugcugugauaaaagggaacuuaagggaagagguauucauuucagcucauaguucaagguacaguccaucuuggcaagggccuuaaggucgugggaguuugaagcaaccagucauaucauacccacacucugagaauggugaaggcaagguaaaacucagcucacuuucucugucuuauccaguccaaaggccacucucagggaauggacucgcccuccauuaagaugggugcuccccacuggugugcucgggggcccauaucccaggugauucuaggucugccaagguaaucaauuguccaccugacuuuuuauuuccaccucugcgaccuuguuaggagaguggguguggagugaguuggguuucaguaauuuuggugacugaauguugaacugaagacagguagcuacagggagcagaguagugaugugagaugcagccagaggagagcugagccucuuuucccuauaucugcuucucccgaguuaacucagaaaaacaaccuaagagcaaauguucauaaauaugugucucacucuauagaaagaaaaacucaucaaaucaauaauugcagucaaguaaauuuauuuuugaauaugggagggaagaggguaaauuugguauaauuacuauauaauuugacuuaaaaugaaguccauugaacauuuauugaaugugggcacagaggauagagaaacacuggaacugccaaagagcuugugaugcagacagaucuagccuuucuggcacccccaguucuggaacucuuguucccaaggcccaggcuaugaauuguaugugugagaaaagaugugauagucccucaugguugcuguaagucagagccugguauuccauacaaacccauuucaucccuugucuuuuuuggucauuauuaaaaucuggaaguaccagguaugguggcauauggugcuagggggaugacagacagacaaacagacagacagucaggacacccaacauuuuccaguuucuagaaagaaauuggaugcccuauggccuucagauuuuaguuucaauagaacaagaaguuuuggggguacuccuucguaaaaaaaauuccucaaacuuguggggagagaauugcaguacacuguaugaacauaguggguaggagggucauguagaaauccacaugagagacaaugguggcucaguggaauugaggaacuccuugggaaggagaaaaugaacugacuuaagcuauauuugaagguagaauugauacacuguggcgaauaauuguccaggaccagugugacauauaaggugguaucaaaacagcugcugggacucugguggaaaccaucaguagacagcgcugugacuaagcacacugguggagagcuaacaacagcagcagcugcagcaguaacaguaaaggaaaagacaaauggcgaauccuuuuguaccaguacggagauucucgcgccuacucagagauggguaaaggaagggcagagagcauguugauuccuuaacaauguuaauugcuaaggcaugugggaaaacauguuuacacugaagacacaaagauuaaaaugccauggcaucgugugccuaccucagugacagagauaaaccaggauccugagguuuacuauugaggagagcaagaggagcuagcucgcucauggagugcugguagagaugaaagacgaugcgcucuuuugugggaggcauuuacacauuuuccaacuguuuggcaauguagcuuaaguacauaaucaaacugccacgugagaaauauguaugaaauauuaauuagugaaaaauuguauacaucugucagugagggauuaauuaccuaccuacauaaccauuauagagaaugcuuucuuaguaaguuaaaaagacauuaaagucagcauccaugguugggacccuucuuuguaaaccaucagaaauacauggcaugugugcaucuguuucuccauacucucauagagcggcuaacggggccuguauccaaauugauagcaccagggugguaguacauuuuaaaaauauuuaguguauucugguaaaaauucuggcuuuuuacaagagaaagcaaucuauggguguaauaauuauaaugucgaugacuguaauaauugacuaaugcggacugguuggcaaaugauuccagagagagggguuugcuggauugggggggacuaaucaagccaaaucuucuugagggagcgaggcucugcaccaaggcaggcuaagccacuucuacaggcccuuucaccuauuuacucucuccucauaaaaaauuuacagcaauuaauuuuaacgaaugacaggaagugggaacuuaaaguucuaacaaggccaugccacagccacauuggccagaauccagcacagccucuucuugguggcugcaguuucguccucauuucccgugacaguggaguccuagguauuaugugacuggcccuuucuauucccuugguuacuaucuuggaucuuugaauaaagaaucacuuucagucacauuuucugaaaccuggacgcuucuuccuaaagugcccuuuucgggaacuuaaauagcuauugauaggaucucgucacuuuauggaaucgcugaugauguuacagaaugggcugaaccugccuugauuugcaaauagaacuuaauuaguggccaaaugccaaggaguuauagauuggagcucugaggacagguugcaggagagggagugacuguauucacagagugcuggguuggggauagccaaguccuggcuccuuggugaccuugggaaaccuuugugacagauaacaaagaguaaagcaguucuucuugcuuucccuuugaaaugugauaucucuaaguucugaggcugcagaguagccagggaccaaaugccugcauuccucaaguauaguuaaagaaacugauaagagguagcaugguugcggaugagcauuuuagacuucaaaagugccauauucuaaugagauacgggcagauagguuacacagacaacaccuggacccugggaguucguagacauuugugugcagaauggccauggugauggacucuugauauuguuagcaaccuguuugcaauaaucgacuccaucuucaucacaagguugcuuuuaaaugguccacggagagaagggcaagaaguaaaaagcugcagguacuucuuuuaaaacucccuuaaaagugaaguuaagcgccagggagauggcucaguaaguaaagucaccugucacuaaugucgcuacacgaugucuugagcuugauucccaaacguacaggaugaaaggagagaaccaauacccacaagcugucgucugacuuucaccaacacacuguaacauacucugccccacucccaccccuuccacaagcacauaaaauaagugccuaaaauguaauuuaaugagaugcuuggauaugagguaaaacaaacaaacaaaaaggaaagcaaaugacugacccagugauggcuaaacugugcggcggccaccagugacugcaguggccuuaggauggauggccgccaggcugagcuagucuucuuggcugugaaacuuucccagagugguuacgaggaccugagugaacaucuguagguagugccgccuugacagcugugacuggaggggcucagggagaugaugggguuccuuuucuuucccuuggacucuuguuccuaauucaaaaggaauaucugggaguggcuacuagcugucccuuauuuuccagacguagucaacugaaggcugggguaaguccaguggcagaagucgccacccccugcacuccacuggacugagugcagacaaugcuacugccagagaccagaacacaggccugcaaagugcuuggagaaaaugacaaugagaaagagacaauaugggaagggcagcaguccuggucauaaugugagggacaagaaagggaggccugugauccaaccaguccacuagguuuuauguaccauuguccugcucugaaggaagauagaguguguguguguguguguaugccugggagagaaaugauuggaacaaugcucaaauggaacuggagagacagcucagcuauuagaagcucucucugcccauccucuuguagcagacccauuucaguuaucagugccugugcugcauauccuacaaccaccuguuaagucccucuccaagggaccugaugacuacuucugaccuccaaggcacuucacacacacacacacacacacacacacacacacacacacacacaguaugcacucauacaaaaaacacacacaaauacauaucaauauaauuaauuuuuaaaauuuaaagauaauuauuuauuuuauauuuuauuuauaugaguacacuguagcuaucuuuagcuacaucagaagugggcaucagaucccauuacaaugguuaugagcuacaaugugguugcugggaauugaacuugcgaccucuggaagagcagccagugcccuuaaccacugagccaucucuccacaacccuuaauuuuuuuuuuuaaacugagaguguaugagagccaugacucuucucuuuauacucuuucuucuaaugucccuaaaaaucuagguugacaucuaugaaaaccaaaaguguguacccagaugucuggaaggcugauguuucuauacggagauagaaguacugcugguguccagguuugacacagaacugucauugagcagugugugugugugugugugugugugugugugugugugugugugugcccugaccaucaggaacauucucuguuccaugggcuggugaguaguggcaggcaauauuaggugucaaaguugugcugccugugagcacagaggacacucaggguucauugugguugucuucuuguuuuucagauggacagucugaggcugagagagggcuagugauuucucggacacuugggcaguagguaaguuaugacgaugaauugggccugaaauaaagcauauauccgaucaucagggcuucuccucugcagcuacaugcaccccaguucucgacuugucuguuuugugcaauuuaaguaaggaaaugaacagagccaguuugaagcaucuggguacuaaauggguugugauuucuguuuuauugucaugaucugcuugaaucauugcgaagaucucuuagccccauguuaguguuagaccuuuccuuaggaugguaggacucuuuagaaccugguaagguagaccugaguguuuguauaaucaggagucagaggaucucugugugugugcucagauccugcaacaacacauucuaugacuuccagauaugaacucagauauguucacgaugaucacuauuuccucuaaauugucuuucaucagaauauuaagcucggugcugggcacggagagugacgaguuaauauggaguuugcugugccucugguauauaagcacuuccugugaucauuauugcuucauggaaacuucuaacaccugccuuggaguucgugguuguaguauucaugguuguaauguuuuccccgauugauuugcauuguauaacagaacaccauuggcuaguguuaugugauauaagcggugaaccuauaaacaagaaaguaucaugggugcgugcuugagauguggacuaaugccuaggccuuuuuggucucaauaagcuucccuccaggaguuucaucucauagaugggaauccuuuaaaaagucuuuaaaauggacauuuuuaaccaauuccaucaguaaggauggugcuggggaaaacggaaaucaagauagguuuauacccagguagggauauuuuuuguauagguuuuuguuuguuugcuugcuugcuuguuuguuggcagaaagcagugccuuccuuuccuaggagugaagacugaugugagcucugggcaagccaguaacaagaggauaaaccuauccagggccagagacaagacccuguuuccaagugauugagaguuagcauaucagagcaacucugcccagggcuguggggacaguccccuuguugugcagugacccugcugaaggcugcugcuuccuaaagcucaaugguucuggacacuaaagcaagugcuuagcuccugccuuuacagaacuuugccucgggcacugcauggagagcgggagggauuagaggcugggcuguuuguuuauauggaagacacuucuuggaguugaagcucuugggcucuuucaaagucugggauuucaaagggugcaugaauaaccucaggccuaaccugguguuucuauuugagugugcauugaggcuggcuggugggucuauuuaauugaggagacacgcuuugugaauuaugaugagggagggagggagggaggaagggagggagggagggagggagggagggagggagggagggagggagggagggagaaagaggggagaggggcugagagaaagacaacaccugugucuguguguguguguguguguguauacaauguuuagaaagcaauucuuacaaggaaauuucuuuaucuccagacuuacauuuuuagcaggacccagaaauggacuuuuaaaagcuacccuuuaacuuuucauucaugugucuguauuagcuuaugccacaugcacaugggugcuggccuccauuggauucccugacaguugguaugacaggcguuuguggucuuccaguguggguguuuggcuccucuggaaaagcaguaagcacuauuaccacugacccaucccucuaaccuccagaauggcucuuaacaagacuuuuggaccucucugaugacaaugggaggccagcugucccuucauccuggcuagaauuaccaagaucccucuuacguucuucagagucaacuacagacucuugcuucuuguauugaucucucuguggcaggcacccucccagccuuugcaguacccccucccuucagggcugugcucuuucccuccaccugucucacucagcacuaacaacgcaggugaccaccuggccugacagaugauagcugccauacucuuggaaccucauccccugugacugacguugucccagcaagaaucuuuggcgucuuuguucagcaguuacucugagcuuagaauccaggaacaucuuucuuucucugcaggucacuuucagcugcagacagccagcagggcaaagcuuuuuccuugccagguaggguuucccuucaucccacacaggacaaggggaaggcuuguugaaaggcagccuuggcucuccauagcaagcacucugccaggucuccggaguggagccuguucccagagcgauuaucuuuccugcgugagaagcaggugcuuggugacaggaagcaaggcgggcuuagcaacagacuuaucaggcucucuacaagaaugucguuccuguaaacaggucugagucuguguuguuuuguuccucucaccugcucaguuguggggcuggcggcucuaauuuucacagcucugcugcagaaguaaucagucccuguaauguaaaguucugucugcaguacuccuguuuauccccuacaguacuccgaaaagggccaggccagacaagcuguggucuccagagaagacuauggccucuggcucccucuugaaagcccuauggagugugugugugugugugugugugugugugugugugugugugugucuguguuccugcacuuagugcuacuucaucucuuugcacaugcuguuguugcauagugguuuugaaagugaacauugucuauggcugccuaagcaaggggacagagauguguuuggaucagauaaagaugccuauuccuuauauugauccuuccaaggaggaggcagcuuccccucacauacuguacaaccccguagcucuccguccaaggcugugaucucuccugucuugcucacaauggacaaagcuggugucugaauugacaggaugacugcugugugccuggaucccuagcuccugcugucccauguccucacaggaaacuuugcagucuuuauucacauggugggucuacuucuuucagccucaguuuccucucucucucucucucucucucucucucucucucucucuuuaaugaaggguggauuggagagcagauugccaauaauccugaagguacaccugacagauauguaauagcuguaauuaguacuugccauuggagaaguaauaggggugucaguauugauaacggaucauuuuuauagaacuuuauauucucuuacauuugauucagcaaacccacaaaagaaauaagacuaggaucauuguacugccgggagauaaggagagagagauagagagagagagagagagagagagagagagagagagagagagagauuuguuuccaacugcugaaggccuggauagagcugccaagggcccuguagucauaaugugggaguggagaauaggaaccugaggugcuugggagagccuaaagacccagcuuuuccuagagcccugaucacuucuucucucucuuuccaucuuaaucauuuucuuccuucuggaggucuauccuauuuacaugaagcauucugccugauuccuguaaacugcuucaucugugggucuagccucucauuccugggcugacaucuuugacuuacaauggucuccacaccagcaaugccacgcacccugguagccuguugccugccuucagaauuucccagacacacaguccagggcugggagagcacagucauucggcaucagcuuucuguacaccccugaauguuccugcuuuuaaggcuuauucugcccucuagccaacugacauuuauuaauauauacaagaccuucugguccaugagauaaauuaguuucaaaaaguuggugaacauggccaacuuucacaaucuugcaguaaugcuggaauuuguguucaggaauucagacuagaagcuacaagcauuugccuuauaggaagucuguagcauagaguaauaccuaguccaaauggggugacccugacuagugcuagugcuuuuagaaacaaugcagcauccuagccauuggcuuucuguggucuucuuccauuggcugguaagguucccugagguagcaaccagaagccccagccccagccccagccccagccccagccccagccccagccccagcagggcauaggucuauagcagcugagggauacaggauguaaugauaaacaguauuaguaauaaguuauugacuguacguuaacaguacauagcacuaagggcuuucaugugcugcuuaaugaugagaugagcccagagaacuaugagaugaggugauuucauugugcagccaucaaagugcagauucuucuaaaugacacaggguuccgucacuccauaugaccucuuaaucagacauauaauuagcauaaauaugugagccuugugcugacauaacauggcaaaccuacuuaaguauuuguaguaaguagagguacucuaaaugaaugauuuagaaaauaugcuaaaucaaugaacuuaaagcaguuugcuaucacuaccaaguagugcuuacuguaggcaacguacaagcuacacuuucuuaccucuggcagugcaauaaauuguuuacauuaucaucacuguaaucauaugaauaacacauugaacuccaccauggcaaugauguuaccacaaagcaauacgagcucuaucagcucaguuauaaucucaagaggcugcuauugcauguguggucucuuauugaccaaaacaucccugggugacauaugacuguauuauuuuuugcuuaauuucugcagcaaccacuacauugaaugcuguaguuauaaaggcaauggcucaaacacauugaaucacuuucccagguugcacaacugaacaguaacagacuccaggaggaaucugagcuaagggacacaagagcuggcauucaguggaugucuugcccuacugagauguacuggcuuucuuaaguaaucuuccucauagacacagcugguagccauggcugcaucugugaacuccuaugaaacugucacucaaaucuagugccugauaaucuaaagcaguguuuucagacagccaaggcaaaacuggaaaaggcugagaugccaugucauguauaaagauuauaugaagagucacuaauaaaaucaauguacagugguuguuccuggggguaaaccucauuuguaacguucgaguaggacaagguagcaucaagagaugcaaucuaaguucauggagaauaguggggaaaugugcagccacaguguguguguguguguguguguguguguguguguguguguguguauuucauuuuagaaucuggcaauuucucaacagccaagccauugguggaugaggccaaaagaagggaggcaggcaaaucuugaugcauugcucucaagggaccaccuucccuuuccuguaccuucccacaagaccccaugggucugugauguguuucaucauauggaguuucaucuuaugcaagccggcgaaaugguccuccagccucauugcagcaagauaauugaccccuugugacuuuguccaaaagguaguaggagcauguacucauguaaagucaagcagcggggaaacugaucuaagucagggaggaggggcuuggagagacucaaggggcuacuggaaugugaccagguuucugauggaauucauuaagcugccaagguucccucuuguggccugacucuggucuauguucagucuuggagacagcaauggcaaaagugccuugcuauguaagugccagagcaggggcacuuguuccgugaauggaaaggugaugaucaaugagcuauaguauugcagucuugccuuuggauagcauuguucuccggguggcugugccugugcacugaaggaagagaccauuccugcacugcauccacgcucugcagagcaugauuaggggucaggaauccucuguggaacuuccauauaagauaagcagaaaauucucuuuuaacaucuaggccccaggucuggauucucuucucuuuguguauauguuaugucuccaugaugcuggagcagauguuuagcugggacacccaaacacccauggcacugcuguucugcagccuauacccuuucucacggucaguucuaauuguccaauacccacauacaacagcugguaaauacuuuucauuugacuucuguuugagagauguucuuuguguggagccaaagggaccgccucaugccaguugcuccucacauagguucaacaggacaauggcuagucaucaagccuuugcugugcauaacuaacuaugcagcugugcugacaagugccuuucugcuuaccagcauaccccaggguuacagaaucaccagaaagucaccaauucccauggguacauggggcuggcggauuugucuguagcccaaucuuccccuuagaucaaaaaugcaagugucaucgcaguggcagaccagggagccggcucugucuuugcugucucuccagugaacagguggcaucacgcugcaauacaugacugugacacucauccugcagagcaggugagagcgucucucucaagagagcaaaccgugaagcuucucagacagaagccccccugagugucccuuauucauucuguucuaaaaagucaaaaaguaaaaggagugacagaauaaauguuccauagagguaaauaugugcacugaggaucuggguaguccaguguuucuaugccgguucugcuccuuauuuagaggucugaucuuaaggaaaggggugaaucuccuguuucaauuuccuggucuauagaacaggaacgaugauugaaacggcuuuuaauacguaccaugugcacccagcagaauuuaaaccuguagauggcaaucuugcugugauagauagcaugagucucucuuccuccuacagauggggaaacugaggcacagaugacugggcaacuucuguaaagucacaugagcaaauggcagagccagaugcuugguggcagaagccauagcuaaucugugugcuucucuggcucuaugagggacuauguggagauuauagagaacuuuccuggguaaaggacuagaccuagacuccauauaagcugguuaugucuacuuguucugugucuaucagaaacaggaagcauuucuacuuguacccauugcauucucagcacuguauucuaagucccgugucucucaucuccuucuaauaucacagucuuccuucuugguccugauuaagucacacaggugagggaacaauagguuccucagccuucucaguagugaaauccccauugacugaggaguccaagcaggagcaauaugacccuuguccuaagcauguagcagguacuuagaguuugaacuguuacacugucuuccaucugaauuauguuauucaauacucagagcaggaugugaacacaaccaaaacucuggggucucaugauagcauaaagagagccaguacgaagaauccccugaguuaaugcccauguccuucaggacacgcuccuaaaaggugucagaagcaagaaacucagaguucagccuaggcuuugcaauaaaagugcuguaugaugugggaauuguuuaaccugucugugccauuuguccaaaggaguucacgcuaaccuuguuacacugugccuauuauaaguugauguugaccaaaucaugcugagagucagagaaauauauucuuaaggccuccaguggcaucauugaccuaugaugauccucaaaacuaaacugugcaugagagcuaucucauagucagaggcuaggcaaaggaaugucugaaaugagaggaaaauagccaagccagcaaaauuuuaccucugauaucagcaaaggagaagaaagaauggcaaacuuaucuuuaagccuccucaacaccucgggaaaaagaaagcugauguguuguucucauugacuagcccugagugccuguugaggaauaagcaaauacagaugacaagcuauuaacuaacuaggcacagagacaucgugcuuaugcagggauggcaguucaugauggauugaguguggcuagccugacugggucugggacagauuuccuuguggaaaguugauagggguguuccuguacccaaccucugagagugagacuaggagccaggacaagguggagggagggguggugguggugaacugcacuacagucauagcgguucuucaguugacuccacugccaaucaugagccugagaugcucccucugauaucccccccaucgcaucuagugcaguuuaacuucuuuacggccacaguagugacagcugcagcugccugcagguggccacucucuugagcugaaggccauuucuagaacagagcucaacugaggagccaacaguagcugucccugcagcuggaaaagcaaaucuugguuccguguacacagcaggcagcugccauucuugccugccagcccucgguaggcaccucugguuaacacuacggucuuuacuacuguguuucagugaagucucagaacuuucccaaauacugugcucuagguaaaugcucucaaucgcuggaauucacucaugagaagaaacuuauuuguuccuuucgcccucuccaucuauaggggacauuuauugaugauauaauaauaagucuucaguguuaugauugagcuggcaagaucgaauacuuggcagaccuuggaccauuuccucgacaugucugcuggaaaaugugguuuucuuguguuuuuccuuauuauccucccugaccacauuacauuugagugcagacuuguuuccucuugccucacucagugcccuuuccccaacccaaauucauuuccuuccccuugccuuucugagaucacacucucauuucagcuacuguuaaucuugcgugagugaugagggucaaacucagguucuuguguuuacauaguaaaccguugaggcaucucgcaagccccugaggugauuucuuaguggugcucccucuugaguguggccugccuuugguuguuacuccaaaguguugguuguugaccuaucaagucauuggaaaucacauuagaguugcagggcuauccaccuagccgucaccaccaaauagaauggauuucucaagaaccuucuauuuguuucaccagcacacaucaagcugaacagaguagagcucuguauuccauucuauucauuucaacuucaagggaccuuugggaaucacagacuugcugucggagccagugaacuggggcagacaccuaagccaaggcaggguugguaaugacucuugauaaaugacacuguucuuuguccagcuguccaggugccacaagcuuggcagugccccuccaggguugcuugggucucugaaguaaauaccuccacucugcuacugaccuugcuuuugugcaaguugcuuucaguaaagguaggacuuuggaacugaaagcagacgcuaccagaaccuaagagagauuagagcaucucagagaggauucuuugaggcccaggucugugccaaguguuaaacuauguucuuaggaacacaggcauaaaaccagugucccagaguuuaaauuacaagcaugguuccucagccccuugacacuggguuuucuguguuguuuguggacuguggccuugguccuugagacgaugacuucucuauauaaaaaauggaauuugaaaucagcgugagagaacaaagagcacaauucaagucuucacuccuuucucugcuagagauuuucugugcaaucaggcauaagucacuugaccucucugaucuucaagguuaccuuggugucuauauauccuggguccacuguauugcucaagccccaaaucuuggggaagcaagaguauaaugcuggcauucugggaauguccaaugugugggauuccugccauggacaaacuuuucuuacagaacuauaaaaacacuugauucaccccagucugucaccaacagauggauaaacaauucuauacaaguccaacuuggugaaccaaugaauuuacugaaauuauuuauggaaguuugagggguuucuaaugcaagcaugggugacucaaaaguggcacaucacgaaauaguaccaauuccugcucaaccuuccauguccucuauucucuagcauccauacauccuguuccagcccucauugaacugugacugccucaucaccguuacuguaggccuagcaaugacuggguucuucugcucauuucuuugucauguuugugcccaaacucuccuguaggucaccccaggugcucugcugcaugaugguugauggucaugccccacugagaggaaauagauuguuuaaagcaccugccuccacucaugacuuagugacacuagugggaaaguacuuacuagacccugacaauguacagaucaggacuauuuccuggaagauaccauuaacucuccauuggaugaucuaagacuuauaaguccuaggguuucuaucugacaugguagucacugggcccuaagggagggaaaggcaaacccaguuaucccuacaccaggacuuggggaaaucccuguuccuuaugugagucaucacuuuccccacaauccuucuuccuggugcucgaggaagcugagauuccugagaagugauagccauagccaagugggauggauuucaccccuugugguggcugcaugaaaccaaaugcucgaguucuuuaagacuagcuugucaucuucaaagugggcugucauccuuuccuuguugccauuuucugggaagugcaugagauugcacaggugagagcagagcacacacagagugagcauggggccuggagugaggauguguggcuguggcuuuuucuucuuuugaucugaguuucuucaucugugccuucaccaguaagucccaacaggaguguagaaacgucuuuccucugugcacagagcuauccaacaagcucuugugugaauagaauuguugucacccuuucccagugaacuccauggagcaauuucuaugucugucuuccacuuuuaguccuaacauguuuaagaauaagaccucaucacuauacaucuguauccccgguagguaguugauacucuaggacugagugaauaaaggaagaaaaacaagcauccugagaaccgggcacacacugcucuuaagccuggaaggcuucaugcaauccucaugguggcucuagaggguuggcauuauccugcaucugagaaaaggguacuggggcccggagaggucaucaacuagcagcaugagggauuaaaaccucaguauccuaacuccaaaccuggggcccguuuucuacaguaagcccccucccugucucuuuccuuuucauauuauuguuccauaaacaacaauaaugggaaaagaaauaaaaucaccuuccaucuuagcacuuccagcaagucagcuguuuccauuauuuuccacauucccuacagucucuuucuugcauauuuuuuauaauagcauuauugagauauaauucacaugccguaaaauccacccuuuuaaagcacacaguucccugguuuuuuuuuuuuacaauacucacagaguugugcaaccaucaucacuaucuaauuuuagaacauuucaucaccccccaaagaaacacucauuagcagucauucaccaucuccugcaucccccaucccuggcaaccacuaaucuacuuuaucucucuauggaccugucuauucugaagauuuuguauaaauggaaucauacaagaugcugccuuucugucugauuucuuucacuuagcauaauguuugcaauguuuacccauguuguaguaugaauuaguguuucacuacacacacacacuuuaauguugcuuacgaauuuauacuugauaagcauuuaaauugcuucuacuuuuugacuguuacgugcagauuuuuuguggauguauauuuucaugguuuuuugcauauauucagagaaugacauuauugggucauauauuccuuggauauauccuuaaggccauauuucuggguacuacauucuuuaaguuuauucugagugugauauuacuggauccuauaucuuugggguagagccugagugugauauuucuauauguuauauucuuuggguauauccugagugugauauauuucgguccaguauuuugggguauauccuggagaugauauugaugaacuuuacauucuuauaaauguauucugaggguucuuuugcuagguccuauacuuuuuauugguuuauccagagggugcuauugcuaggcucuacauucuuuugauauauccugagagugauauugcuaucucaugagugauauuuuaaguuccgcauucuuuagggcuauacugaggaugcuauuucuagguccuacauucuuuagguauauccuuggggugauaauuucuggguccuacauuaugguaauuccaagguuaauauuuucaaaaacuggcaaccaguuuucaagagcaucuauaccauuuguuaucucucuagauaugcauggaguuucuaauuuuucauauccuuucuacucacugcuuuuuauuauauaucuuuuuuuagacauucuggagguuucaaugugaugucuugugauuuuuauuuggauuuuguaaugacuaauaguguuaucuuuacgugugccuauggcaguuuaaaaaaacucucuugaaaaaauguuuauucuaguucuuugcccacuuguuaauaggcuugucugucuuucuguaguuguaagauuuuauauauucuugauuuaagucauuuguccaugauuugaggguauguucucuccuucuaugagcugucauuucccuuuucuuucuugagaguaugcucugaaaagcacguuuuuaaauuuuuuaaugaaguccaauuuagaucccauuucucuuuuguugccugugauuuuugugucacaucaaggaagugaccgcuuaucccaaaucaugcagcuuuagucuuuuguuuuccucuaauacuuuuagcucuuacaucuaggccuguuauccacugugaguuaaacuuuuuaucuugaaugaugucugagcccaccuucacucauuugcaugaagauguccaauuaucucugaaacauugauuggaaagacuuuccuuucccauucauauguccugcugcuucugucagaaaucaauugagcauaaaugugagacuucauuccugaucucuccauuuuacuccacucaucugcauccuugcaaugaccccgucuucauacuugucccugcagagcaguuguaaaguugagaaguguggguaccucaauuuuucuuuuuuuccccaagauucagacuuuuguguugugugcauuuacacauauauucuaggagauauuuguugguuuauaaaaauaaaacaaaauaaaaaauuuuaauuccaauauaagauuauucaguuuaugaacauaaggaaucauuccaauuaauaaaaacuuugaauuuuucuguaauuuuaaaaaauuauucaauaugcagguuuuguccuuauuuuauuaccuuuggauaauauuacaaauaaaguuauuuucuucauugcauuuuuggauugaucacagaguauuucuuucuauacucuauacauucauuuuugucucuugauccuacagacugucaucuugaucagcuuguuuuauuaguucuauagugugucuguguguuugugugugugugugugugagugagagagagagagagagagagagagagagagagagagggagggagggagggagggggagagaggcagacagacagagacagagacagguagacauacagagagagauccuuaguauuuucuauacccauaacaucuugccaucuaugaauagaggcaguuucuccuuuucugccaaucugaaugccuuugcuuauuuuucuugauuaauuuaucuuauagccuuuacuccaguauuuaugagaaauauuaagagugaaucauuugcauuguuuuuaaucuuaaggggaaacuuuacauuguucaccagagucugauguuagcuaugaaugcuucauagauggucugaaucaugagccgauuacuauuguucauagucuauuguguccuuugccauggaagaguaaugucaaaugcuuucccugugucuccuggccugaguaugggguauuguccuuuguuguguuaauaugguauggaaacauugauuggguuuugcaugagaaaccauucuggcaucccuagagaaauacaacuuggccaagauucacaauccauucuguauguuuuaugccaacucaauaguauuguauugagaauuuuuuguaucuggauuuauggaguggauugacuuguaaaaauugucuuccuuuguguugucugugagcauuggcaucaggaucauaaaauagcuuggaaaggguucuuccuucuucuacuucuugcaagaauuugcgaaguauuuguauacaccugcuucuuucuugaaaacuuucaaaaguugggacgagcauaaagguuuugacagcucacgguuacauccuuucauaugcuuguaucagaaagaaauagaagucaaugaaaacaaaaaccugauguugaauugaaucuugaacauuucuccaugugcagaacuguaaaucucuugccguuaugccaggcccuuaacugcagaccaggguguguagaacagaugggauuccugcuuuuaaagaauaaauaacugcaacuauuucagugcagaugucuaaauagauucuaugcugaagcagacuuuccccccaucacagauaagagacaggccucuccaagagacucagaacagaccaaugccuggaugaauccaucagggucauccaagaaaaucaaaacaucguauuaauagcuuaguguuuaaggguugaccaaagauccggguuugguuuuuguuacuguuuaacaugugaaauaaagaaaggaauauucuugucuugaauggcuuguugcagaaaauagacaucuuagauuauguucauaagugcagcaauuucacuauaauacaggugauuauaucaaucccaaacauuuguaacgcagaggcucagaaauguggccuuuggcucacucauucaaucagucucuucauuaguuaaugcagcaauuauucaucaagcucuuuuccugugccagucccucuaccagagugucugaacggauucuauuugagucccuguuccagaggagcagcuggucugauguggugagguauagcacuuuauauaaauaauagaucccaggcauggacaagguugccaccuagucaugaugagagaccauagacauauaagcagagagacuucagaaccgaacaguguccagagaaacccauuccacauggaguccugaaggauacauaggaguuuucccagacauccuaugcuacauagcugaagucuaagcagaacaagguguauacgaucugagucuguccuagaauucaaagucauucucaaggauucaaaggaagagcuuuaaagugauuugaacaaacucaagaggcagauccuaaagggucuguguguuuuuuaaccugauagagccaaaguuuuaaggauuugggaauuuuuguccaaauggcaguccaauagugcccgagugucaggaaugaaauaagauaucacaaaaauuauguucagauguugagacaucucuggaugcagguuuccuggagccuucccauagacuucuaccuccauaggcccugucuuaucuguugugacuuaauaggccaucucacauaacuaggagguuagacuaaaaaagguguucaaaucugacccugacuguuacucaagcgcguucuuaaccccagcuuuucuugccuguaaaacagggccacugauucaacuuccccaguuguugggacaaugaaaugagaagggggcgucucacaagcuggauacgguggcacacgccuguaaucccggcacuaggaauguagagucgggaagaucaagaguuuaaggucauccucaaugacaacagugagcacuaagccgacaugggcuucaugugacccugucuuacaaacaaacacguaagcaaaaaaaaacaaaaacaaaaacaaaacaaaacaaaaaaaacauacacaaaagaaaaggaacaaagaucccaagggcuuaggaaucuaucgacagcuggaucuaagauguguccacaccugugacgagaguaccaguguugagaacuggagcgaccagucccacucacccacugucagucugauccuugaccauucaucucguucugagccuuagauucucccuccacaaaacagaaaugacugugauguccccucaugauguugccaaggagcgucagugugaagaucaugguaccauccggcauauugguugucauguugcuuuugagacugaaugugagcacaagguuuuugggguuuuguuuuguuuuguuuuuuaucccaccacgcagucucugaguccaaggcugcacuuguauuucucagagccaaacgccaugcuugauucacaaggacagucaaauguuucuguaguugcauuuacuucuggccuuccacacuuuacucauucgagguuuuugucuaauuguaaaaagaauugaccguccuuuuagaaaucuaaacaaaccaaccaggagaaaagagucuaaaucaucccauuuuauguauuuauuuugcugagugguccaacuugguauuaauccauugggggcucucccaaggaagcagacaagaccuucaguuccuguuugacuaacccaaccugacugucccaguuucucaagccaaacgacagggcugcgacuucuaugcauuagggcauuaggcaguguaaccugggagggauguguuugauaaagcuucaucucccuggccccaccaagagaagaaccuuuaaaagguaaagggagacagcgguggcaggagccacagggguacaagcaaggaugcaggagggugagagccguucccuuggcauguguccagggguucagggagggcauauguuuugcagaaaccuuaagggauuauauuuagugcaguguauacccuuagcuugccccccccccaaucuuguucccaugcaugauaucuaaugauucucuuuccaccuaaaggcaaaagaucaagcuaagggguccucaggacccgagacaggcucuagaguuacagccccugcccacagggacugcccacuccuagccuggcucugaauaaaugaacucugacuuuccucuggagcugcuaacagagaggagacaacuacagaaagcguuagaagggucuuugggggguggcucuuggaggcuguagucaacugugccuuugggaagaaagaaaggaagcucaugaauagaaauauccugccugguuaaacacuugagagugggagaauuuccaaaaacauagaaauaucaaagggucagcagguuugaugucugcugaaggcuacucuuugccuccaacgugauguccuuugaugguguccuuaugcucuguccuccagaggggaugaucccauguccauguggcaggagaagggauguagggcucaacuggaucccuguuuuuauaagacacuaauccacucacgaggacagagcccucaugcccuacucaccuuccagaagcuccacuacuuaaggcuguggcauuggggaauuggcuuucaauauuaauuccaaaggacacgacuuccaaacaccuuggcaagaauacacucgggguacaucuugaaggguaauuaagaguucaccagucaaagaagaaagcaaaggacauuccagagagagaaagagagggagggaaagggucugggcugauccaguaggccuuguauaucuuguuacaagggacgucauucacucaaucuugaggggugaggagaccagaucccagcuggaaagacuuaauaagauccaccugaauacaccuuaauuuauucauugaauaaugauguagagaaucaugaccagguaugccuaccuugcuacauguggaagaagguuguacuugaccccaagcaggcuaagucucuguuguucuucauucuugccuccuacugagcaucuuccuagcugguguccucucccaaggugccagugucucaagggcuguuacucaguuucugccuggcacacuugccccauuuccuucuagcaagaagagauuaggaaacauguuaaagaggugucucuuaacagaugggagaguucucugagcucaucagguuggaucuacuacagagcagguucucagcugcagaguuucuaauacacuggacuucuagauugagaacacucucccuugcugcaggcuacagucuuuuuuggaugcauagaaggcugagucguauguguguguguuucugugugugugucugucugucugucugucugucugucuguuugacauuucauggucaugcaaggaucugcaaugucagaguauguacuuccuguuccaugcacaugugagucuggucucaggugugcauauuacauaugucugcaucccugagcucccaagugucccuuugguaugcugcagcaggaugugccggugagauuucucuucaggcucuauugguucucagagaugcagaagcccugccucaccuugaaaacuauccuguuguuugugguuuccugauagugacagaaucgcugcgcgugccugucacuuguacacauguacacacagccucaguaccacuugggagcugugaaugcaaagaauuccccagagacugccacaggccacuugagugacucacuaaugggccuguuuccuuccucagagaaauagcacaggcaagguucuagaaaugcaauuuuaguaucagcucaacuucagcaaacuacaucaaguggcuagagucucaagguuuccuccucagaggcugcucugaugggaaaaccccucagaugucugcagccugggaagggaauccuucccaaaggcucuugggaauucccucuaguuucccagcugcaagcaggcccuggugguuaguucccacucucgaauccagauguuagugaugaggcaggcugcccugcuggguguguuucugcagcugccagagaaaaagcucaugggacauucaucagucacuguacccagagaugcucauuuuaggggcagaagguggggcugaguuagaacuucuguuuucacggacuuuacaccuuuuuuuggaauaugacaucacuguccuggaacaaggugggacagaagcacaccacgauuaguccagcuguuuugucacacauugccuucugcucccugucucuccuggugcucucuccucugcugugaguggcucuggggcaugagaaggcgcucauuugcccucugcugcguugacagagucagucaucaugucuguuuuguucuugccuacuuagugggaagggcuugcaagcuguugagcugaucuucuggucagucugugcuccaaucugggccaucaagauguaaaagaaccgcagcaccagguauggugguuuguaccuagacucucagcacucaagaggccaaggagggaggauugaaaacccaaggccaccucauuuauacauagagacccuuuuucuauguggggaaaaagaggaaagaaggagagagaggaugaugaagagaaaggacuugguaaacaaaagagcagucucugagggugaggaccauaagaauguuuggguuuccuuuuugugugugugugugugugaaucccaggucaaguucagacaaguucaauugaucaccccaacuggccuggcagcaggcaacugaagaguucaagucuaggcauccaaagucagcccucugcuucugugagcauaauuaugcccggcaaaguagcacauuccauaucauucuaaccuugaccuuggugagcuucacuucuauaagccucaguggccucaccuguaaaacaggacaacaaccuucuccuccuagaguacugcuggaaaaaugcaaggagaccaugugugugaaaauugauacuaucagaucuggcucagagaaaauuaucaacaaauguuacuguccccuccaucuggaagcugacaaauucaauuaacuagagccacccauucccaccccuacccuccacccccauucccaagccuauccacagaaucauaaauuuccugucugaaaaaacagcuccauaaaucaccuggcauggucugagcgggggaauucuggcgggaguugguuccguguguuccucagucuugcuggcucagccugccagccuuccuauaaguagaaggauucccaccagcacagccaaaaagagggaaagaugcugucgguggauuccacagaagggcuaauauuagcggggcauaggauggcuaugggucuauauuuagaaucugugucuucagcccuuuuggaugcagcagaguggagggcagaacggggugguauuuacaagaggcaggcagagccgcuagaccaggccuuccuucuucucucuccaggaagugggcaagccaacacaaaccagggcugcuggggaggaggcagauaguagaggguacccccauaguggaacaaaguaagguagugauagaagucuugggagaaccccaggauugcugaauuuggcuaaugggaaggcagaggaauaagcucuguggccuucugguuuggguugguaaccaaagaaggaugucccuggcuuuauccugcagaugcuuuggauggacgugccacagggcaauggaccuaggucagaagagagacguguaucuuucacagacgucuuuuaccauccucccucucacagguggccuccuccuuucucuguuugcuuugugcuuuucacccagaaccugccucgcugaggugcuucuagcccuucuauauggacuaaaccaaaauauauacuucugcuacauacauguuauccuauaucaaacgaggcccaaggaagagaggauggagguauuugggguuucaguuacuccauagugugggauauacucugaacagccacacacagaggccuucauauuucucuacaaguaccacauccacagaugcucuccagcaccccuggccauaccuccuuaggagacuucaagacugaauagaauguccuguuaccugaugucugcccuggguucucuuccagcaguuaggugguuuccuaagggggagagacaguguuaggaggagaaggggagggcaaagggcuuuccuggugcaucagguuuucuacccuucggugagggaggugaauuggaugcuuaccaggccucucugccuugcagucuauuuaucugcugaguuuuucguugguauaaugagaauauaaucagaacagcauguguucuccacccugucccuacuccaauaaaauccaugugaccccaaggaaaauggagaugacuuaggcuuuuucacauucugguguucucguucacuccccuuucuggagucuuagacaagcucagaggccugucuacacaggguggcaaggauagcccacaagccgggauaaucuacucucuacccuuaggcccugucugaaucuguaauuauggcgugggccugggugggcagguugcccccaugagaggcuggagacuaucaugggccuucugcauguacuuuccaccauuauggaacugucuguuaugguuccuggagcgagcuuucucucuucccuucucaucuuagagcacuguucucucaguugguuugcuuguuugcagucugugggcacaguguugucuccccugcagacuccagagcacauggcugaguuggcguggacgcaggcucaccccacuuagccuacaggcauuuuugacacauaaauaaauagcucugagagcagcugauguuuccagguaaaauguuugcacaugguauguaucugggaagcagaggcacgcucgcacgcauacacacauagacguuggagaauuaaaaacauaacaugcacaacucuacuacucacacaugccuggccccuggagauuucacugggagcuguuucuuccugcagauggauuaggaguuugugauuuuuagaaucauagaaugucagggagggaggaacacagcagauuauucaguuaggggauuucaaacauacugaccuccaucacccaucuucaaagagaauuuuauagagaccuucgagauacaaaacagaagaacagauguguucuggauaaagugaagaagaggaaggaggggaggccuggauuccacugaaugcagugugaaaggcagaauacucagcacccuccaggaaacuggggccagaggaagaaagccucucgcuuggcgucccaugacaacugaaggaugaauucaaaaauggaaccagaagccauaccauggggaaugacaaaucacagcugaaauaagauggaaauauaacugaccuuuggcaucuguggaagaucaguuccaggaaggcaagccaugaauagcaagggcuaaggacacacaaguaccucauauagaauggcaugguauuugccuauaaccuaggcacaucuuuuaggauacuuagaaucaucuguugguugcugagaauauccaguccaguguaagaacaaagggaugauguuguuuaggagauaaugauagaaauagucuacacaucucagaauagauacaaugcugccugaauaauucauauucucucucucucucucucucucucucucucucucucucucucucugugugugugugugugugugugucugugucugugugugucugugugucugugucugugugucugugucuguguguguguguuuacacacuuuacuauggcauguacaucaaggccagagcacagcuuuguggaguugguuccuacuucccacuauguccuggauaucaaacuggacuucaaccuucagccacugaucuuucuccccugacccuccuuggcuguuugaacaguaguucuucuuuccacugaguaucaaaccagccaucuuucugcuaugaugguugcuaugguuuuguauguaaauagcucccccucacacacacacacacacacacacacacacacacacacacacacacaucaauuuucagcagaaucacccagcaucauagacaggagugucaauguaucuguuuuacaucacugcugcucagggcuggggucuucucagaggagggguagacauggaagccccaaccacucucuguucaguuagcuaggcuccuugcuuaccuguuugaccaagauuucauuggacaaaacagaaacagaaacagggggagcuacuuuaaacaaaagaacaucagaaagucccaugauauagguaccuucaaaggagugaaucugaacccccauuuaccugacucuuuggaaagauauugaccuuacuaugacaacggacugaaagagcaaaccuucuucagucaugcaggacuaaaguuuguccuuuuggccucaguaaaucugagagaauuucaagcuuggcaccaccuacaguuccucauggaacuugaaaacaaacauggucccagaucuaaacagaggaacccuccugccaauuguucuaaacccccaaugccuaucuaauuguucaccuuugaccuacuuaaacauuuaguaccuaaggugauucuaucaacucccucugccugcaguugccagcuuggccaucucaaccgucuaacccaauugaugcuugacacccuucagcugaauacuccagaggaguucuugguuugcuggcaccgaugggugauuuggagaucccagagcuguguagauccccacccugcagagagcaaggcauuacaccaccuucacaucuuugcaggagucucucuaauccacuaguuguaguuuguugcugacguuaaauccaauaaauucaugucuggcaguuugauucuccacauguuugagaaguuugaagcuuuaaggugaauuaaggagacaucacugauggacuuugggagucaaccuauggggauaaggucucucuggguagacucauggguccaggucccaucucagcucugucacaugcucgagggggagggucaaccucagacuggcuacuucuuucucucaaaaaugaggaauauucaggaggauucagggaggcagaugaugagauguagaugagguuggccuacagugcaagcuuuagggcuguguaggaagauccugccucaaacaagcaaggaaaaugacaaacaggaauccuuuugauaaguauuuauacuacaaaaagaauagcugguccauaguggggacccaguaaacagccauucuuuccaucugguuccuggaauaucugugaagccuuagaccccugacuccauguagugugacccagauccaagcuagacacuucuacuaaagaguacugcccaauaacacucgagggugaagcuccaguagauggaggaugugugcuaaccagaugucuuugauuuugagagcaguaacuuacugguuuccaaauacuauaauacucucacauugcaggguuuccuauggcuagaggcugccauggcuuauacggccuuguaggaauuuucugccuuuaaagaaugucucauaagauacugaugcuuucuauaguucaggaaguugucauugaucccacuucaacuucaugaaauugauguucagagguccuuguggcccagguccuauuccggaccacauugcaucacuuauuguucaaucuguggaaccauuauggguggcagggauagugagucucacucauuagaugguaaaccgagucucuaccaaguuaaggcacuuggcuacauagauuuauuagaggauagaauuggacuaaugucuaugugauucuugcuauuguggguagauguauguguuaggagggggcagcuugcuucuuuucacuuuuuuagagccagcccugagcagaucuaugugcaaggccugaaggcaucuucauuuuaauuaguaaaauaaucuccauugacuguuaucugcugugcacuaaacacauccuugacauuaaagcuucacuuauaaacaagauauaguuaaagcugaagaaauccaaacaauagcaauucauuuaaugaguguuuuuaagagcuguaaaaaugguacaggcauauaugagagagguccuggacccgggagaaacuucuaggaggauauacccugugaucugaaaguuugagcagcugaguaaguugggguggugagguucuggucuggaggaccagcauguuagaagucagagaaaaagcacccacccggauaaucugagguuagcggaggguuccaugauagccaggaauaugguuaguccucauugauaugcacuauagacacaaaauacacguggaguuaagaaaccacaugggaaaaagugucaagcaucacauugaugguuuuuucuauuuugaucauuuauuagaauaauaauuuaaauaagccauguuuguaaauaaaauuaaagccgucuuauuaaaacugacauuuucuuuucucuuguaaaaucuaccagcauuacauuugugacccacaguguauuaagacuuaauccaucagggcauaggaagugucucaaggguugagaacuuggaaauauaaguuagggagauugggauuagaaagugugugauucugauacauuuccuuuaaacucauuuacuccccaaagcagcucgagaggaaaagauuguucaguucauguguguggcucagacacagggaugauguaccaagugguccucuguuggucuaucuacacaucagugcucacagcaugccacuacuaagguacaaucugagcucauagccuuucuauucucuacacuccaucccuggcugccagccaguuccuugguuugauuuucauuugagggucugucacuagaaagucaucaugcuaaagauuggcuuuuucaugcuucuuguuucucucccauuacuagacagcaucugaaagaccagcuaccucucucuuaguucuaugagacggcucucaaaguaaaaggcugucccaucuaaggguggugugccuaagggcauugguagacugcgcugguuuagguuugccguggcagcuucaguauauauagugucuucagcugcacucacgucagugaugucugcaggucucucaguggccugggcugcaggagcugugggauugcacugauagccaaaauacaaccugcuuagguagguagguagauagguagguagguagguagguagguaggucucuggaggcuuuuggucuaguucgucugacuccagguacaggaugugaggucacucuugugggcccagguaggugaggcccaaugugacuggcagugggggcaggggcccugauaauuuuugagugcuauacugaaguuaagccauaccaugagucccuuuagugucugugagcugggcaggugaccucauagggccuuugggggacuaacauguccaaggaagacuaucugguacuuugugaggcugaaaaugagcaagugaacguaggcauugauuuccugggcuucugcagagaaaugagcacucaagguuggugauaagagaguucccugaaguccucaucaugucguauauuguagggagauauauggggaucaacaucugaaguucuaccuugugggagaggcucauugcugguguuguaaggaucuguguacauguggaaccauuggguuaacucugggauacaucgcaagagacacauggcugcauuugagaaagcucacccaccuucccuguugagaaaucccugcccuagagccucagggucuuacaucaggacuuuggguguaaccaaaauguuucucuucucugaagaaaggaaaaauacagggaacauaaccaacaagaguguaggcagaacccucccaaaguggaaaaggaaggagcuagauuuuaucacauaauuaagccacagacccagacuuuaaagucaagucacagaagcugagaaggaaacucauaggaacuuagaauuaacuucuacugauaccagaacuucacugugguagaauauuuaaauagucuuuucuucugggaaugggcaugaguaugguuuuauauagauguauugggguuaaaaucauugguacuaagugaauuguuagcaaaauauuugccugaauuuuuggaaaauuuagggaaaaaaauuguguuaguuaccuaagguauauagacaacauuuaacuuaauguuuagaauacaggaauauuacaaauauuaauuggauacaauuuuagaaagccacuacuauaugccaaauccugucauacccaaguugcagggacucuucccccucacccugcgaagaccaccgaggagccaauuccaaugcaaacacacacacacaagggucuuuauuaugaacuuacaagcaaggacucucaccaucaccaucccagcaggucagaagugagagccucaagucuagggguacagaguauuuauuguggguacagcaagcuugggggauuuccauuuauugugggucagcaaacuaguauuuuaaaaacugcauuucugguguaaucuucaggaaccaaucgggggcaaaaccucuuugggaggaaagacaaacaauauggcuagguuaucuauuuucuucaggaugucauagguugucuauguguaccuucauccugcuguuauagccugacuggcuguugcuaagggugggggguuaguugccauaggauguuugcuuaaguggacuaugugguuuuccuucuggaauuggaguuuagccccuggcacuucuucucaaaaaacacagaguagguugggcuuuacaaugcaagccaagaaacacagauaggccacccaaaacaggagaaauuacaguaggcuuccuggagaagcuaccuaacaaauccuuggaggauuaguggguacgugucagggaauauaaauggaagguauucuaggcagaugaaucaugaacagcuggugucacuguaauagaaguaaggauuauacuggagcaaagcuuaaaccauggucagugagaugaauggagaagagauaacugaagagaugggaugcagaauucagggaaaaugugccaugggucacacuuagauuucauacaauguagacgguaucaagccacuuaagaggaaggaaauauaggaauuggauuuagauggauggauggauggauggauggauggauggauggauagguagguagauagaugauagaaauuuacuuagguacaaugcacacaccacauuaagugguguuuggauuaugggacuaggagcuaaauugcuuuggcugcaaaaugacaauuaaaaaaaaaaggaaacugcuggggaaucauuguggaugcugcacugcaguugugcacgugcugagccccaguacacucccugguuaacaaggcaacucagcccucccuacucaccucaaccuuuugggaggaaagaccacucccagagccaggagcagccuuucuggaagaggagacuguggggccaggcugaaggugaagagggcaccaggaaacuuggccauugguagcagccacaaaggagccuuagcccacaggaaacccuggaaggugugggaaggaaccugcuggggguagagggaggcgaggcuggcaggacacccacagagcagccuggagaggaggcagcccagaagcaguuaauccugcugguuggauuguuuuuauaaacgacacucuaaaaucaaauagaugcaauaaaaacacaguggccuuuucauuaaacaugccacagaggccccuuguucagcagccguugucaaucagaucugggccauugucucuuuucccaacccccuauaauuggcaucugucugggaacaaacaaauaaauaccaggcuggcauuuuaacuagggcagcagggagugagggcccuguguuucagagucugcuaggccaucaaggcaagugagggcccccagaagacugguucucacccaagguagagcccagcaucaaggcacaauuagauacagcucccuggcgcugccgcugcucugguaggaucaggaggauccuuugucucgggccucuggcugaagaagccccucggagacgauuuuuggaaggccuuauuuuuguuucccuucauaaaaaguuauggacauaaaaaagaaguggacauguucucuggcugacuucagauacaaccacuuaauaacgguaaugcaacagaguugccaaauuauaaaagcgggaacaaaacuaucacgcuuaauuagugauagcauuaaagcauugugacuaaccaguaauaauagccugucauagcacuauuauuaacuacgaguuuuagaauagauugcuggcuuccaccuuggaccacauauucaugcaggugauucucauuauucacggcagcucuguucuacaaaguggaucugaacucugaauuagcaaauuucaacccuuugcuguuauaggaaguuccggcaggccuccgaccaccauccgcccaucaaccuucaaugcacaaucucuucaaugcauaauaguauguguguuacuauuuaaacacacccgguuuaacauuuacuuuugugucauggguuuugaacucaggggugaagggaggucacuuaacaccaagcaacauccuugcagguaggaccacuagacacuaaccuugcaagcauuuuacuaaggagagucaucaacagaauuagaaacaugaacaaugugguacuaaguagacucugaccaagaggcaaaguguugcuguaucccacgagagcacggugaccgcauggagcgccuuuaguuuuccaucucucugggcacacugcagacauucugcuagugcucagggugggguugcaagcacauuuacugaauaugcaaauucacaacccuguuugagcagcaggguaagcagagucucugaaccacuagcucugacugguucauuucauuugguucucacucuggcaauaccucccgcauuaggguucaggaaggaagauuugaagagcauaagugauauacccuaacauacauuauagucuuccagggucaggugggacagcccauggaccugcagacuaauuuaugaaaauaguuuuacuggaguacuauuaguuugcauauuuuguuagaucuugucuuuuguguugaaguggaaacagagcaauugccacagagaucagacugcaaagccuacaguuuacaggccgggccuuuaagauccagguauaaucacgaauauguccucucucuccuuucuuucuccagccucccgggucaggucggaggagguuuucuuugauucuuaugccaaagccguuuguuugcuauucacagaaguaauuuuuuuuuuucuugaacguuuauaacguuggaaaguuuauaacuauauuuuugucauugcauuaacauuaauaagcuuaaagcccaaacagacugcaauucuucacgcggacaugacaggaacagaugugauaccggaagagaguuagguaacgccagcacagucaaaagugggaucaauuuguaaguuguacaggcgucuggaacuuuccaguaaugaaguguuacaucugggacaaggacuggguucugcaggaaucacaguugucccuaaggagacaaugaccuacuuucuaugaauaaccuuuauucucuucagacgacuauucuuugcugagaacuuacauggcaguuugccugguaccauuuuuugucucugugguauauggcugugaaucuggaaugccuacaccaugggaucagauacgauuaucccauuugaugggaugggaagugaaagauuggauaccugaagucagugaggucugacucggagacacaagcccugcaggcugcucccucacccugccgugugaccugaauguggaauguccccaaggguucaagcaucccucuccagcuucucgcaauggcuuuggugauuuuggaaucucagggguggaacuuagcugauggaaauaaaucauuagggcugguccuuuaacuauauaccuauuucugguucaggucugaacacuuugcuuccuguuaagccaccgcaaugugacuagacuucucccagugaccugggcuaacucauucuccucgugucaugcuuucucccuaugaugaagugagauguuccggaaauaaugauauggguuaaaucccuucuccauguuuuguggcagcaaugaggaaguaaguaguaagucagacaugccuggcacuaaaaguugaucccaugacccucuauaacuuacccagaauuucccucaccacuucccuaacucuugagacuggagcugggaauugaacaaugagacagcuuccauauucuccucauauugggacacuuuucuuuggguuggaguaaagggggaagcacccacagaacacuuggguggaucaaggguagaaacccuacuaagaugagaccuuuagauacugacaaggguaguauccaaggugugcaagauguaugguguugugucugcauagaugugauagguuacagagcugacagggacauagaacuggagaugaugauagaauggccuccacuccaggcugggaauaguagaugagggagauucaauuggaguuuggucucacuagucucaggaauagaucccugaaggagucccaaagcaacccuugugugaucagccuucuucucaacccccuuugugucucuuaaccuguaagcaugccucuaucccccacaaaacuugaguuaccaagggcagggagccuucagauguauggcccuuuguuuaaagacuacaaugacuucaauucauguuaagaagcuagggagauagcucaguggauaaaguguuugcugugcaagcauccaaaugaaauacggccauggcagcaugugugcuugcaaaccagugaaggggagcagagacuaggggaucccugaggcucacgggucaguugguccagcugagaugaugagcccccagguuggggaagagacccugauuucaauaaaacaauaagguagauaguaguagaggaaacacccgaugugaaucuccaacccugugaaccugcacagacaaauccacacaaauguaugccuuccucucaaugguuccuccaucuauaugaaucugacaaucuuggcaauuuccuuggucacuuguacugugacuguaagaaaagugaaagucuugccuaggccaauugagggcuuccuucaucuccaucagcaccaauaaauugugguugucacccuguuauugcacauccuaaaugcuuuagugcacaguguaugcagaggguuguaaagacucuauuacgaaaugucuccaagggaacagaagccaagaguaggaccugacgaaugggcugggauccccuugcacuucauucuugcagggauauuguacagaucuacugaacccugugcaucagcuguguccuggagaauuuccccagggccugggaauucccaguaagcagauguuuagucggcuucacucauuccuuucccuagacugagcuugccguagacacaauacuucccuuggaggagagagaggcuuccauuaauucaauauucacugagcauaacaucagauuucagucaggucuucggaggcagagaggaccaccccugcauucaagaagucaugaaaugguuugaaagauggcuacaugguugcaguauaagcaagaaggcuggaguugggauucucagaauucccauaaaugcuagauggguauagcaggucgccuauuguucuggcucacaaaggcugaggcaggauccuccagagcaagcugacugccucgacuuggcuuauuggugggcacuggguuuauuuaagagaccaugccucauuggacaccaugaaagaaugaucauggaauauuucagacaucaccuuugggccuccacaggcacauacacacauaugcauauguacccccacauacaugugaacacauauacauggaacaccacacaaacacacgaaucauaaaaggucaugugaacucuugggaggggcaaucauuugagcucagugucugaaaaggcucaugggagaaugacacgagagauuaagggaaggaguuugaucugggucuugaaggaugaguaggaaaugaggaguuuuccaagcagaacaugggaaggucaucagaaagagaacaacuuugggugagagaguagacaccauucuuguuuauaaggacagagggagaugccuucuccuagucccaaagaaaauccaguuuuguccugaauccccauuccuuccuuaccuucuaugguacuguaucaucauccuacuugaagacuggaagauagagauuauuggugggcaaaaauguugaaaagauaaccacacaauagagauauguuugaguaaaagaagcggaagaaaaauacucuagggcuguacuuucuaauagaacuaaaaagaaaagaaauugauaagaucaguuuuaauaauacuuaacacaucauauucaaaauauuauuucaagguguaguuagcauaaauguuuauuaauaaaaauuuaagcucuuguucauaguuucaguauaugaaauaaaguguguguuuuuauacuuaacaccauagaucagcuuuaaucucuacacuucucagugguuauagaaucgggcuguacaagccugggaccuaaacuucuuuguuauucagcauaacacuaaagaacuaugacugucugggaucuaccuacucgcccauccauucagcuaccuauggacccagccacccauuuaccaaaccacucaucuauuauccauccauccuucuuuccucccucccucccuuccucccuuccucccccccucccuucuuuccuuccuuccuuccuuccuuccuuccuuccuuccuuccuuccuuccuuccugccugccugccugccugccugccuuccugccuuccugccuuccugccuuccugccuuccugccuuccuuccuuccuuccccuacccacuuaucuaccauccaccugucuaccucucuacccaaugacccaaucauuuuccaccaaccauccacucagcugccuagcagcuuuaccaucuauccacccauucuuccacauaugcacccaucuacccuuuucauccaugcauauauccacucaucuacccaaccauccauuugcccauucagucagcauucaaugacaaccuaccaugugcuuaaagcuuccaauggaaagaucaaaugagacauggcccugugucaccagaaauuaacuacaagauaaugagcuagucaccugauguguacugggaccuuucacuugugaucagacccucucaagcuggggcuccaagccauggggaaucaguugguuuuuccugucccuugucucaaacagaagaauaaccuaacaggcauaauacucaccucucuguucagaguuuggcucccuuuaccaaugagccuccuuguggguuccauguggacacauguauuugaaaauccugcaucagacaucucuuagacaagcucaaagccugggcaaccccagcccauagaggcucuuuuagcuaaagucacacaguaggucauuucuaacuucccaccccugacauuuacuccaaauagcacuacuuacagaggggcccucugaaaguucuugcauauucauuagucuccaccacacaccaggagcuuggagcaagaagacagaagucugcaagggcuauguugccucuucaagaacaaagccuuugucgguuuaccacucugggaagauugccaagcuccaguauuaauaauaaucccuuuguauuuuaaaugcuuuauaauugcauaaauaaagcauacuuucucuucuucaaugguaaugagccuuauuugacugauugguugauuaauaacacucuaauuccuccaaugacaaaacacaaaagccaaaagauggaugcagaguuucagugguuugagauggcagagaaccuuccuggccacuuucugcagcugcccgggaaacucaguacgaaggaaugagcagugggcucgcuucacaguuacuuguuaauaagcuaggaacgcagucagcaucaggaaaacaguuccugcuuuuccagcugcgauuucauggacacuuuuaacuccacauucuguuaggugaauucuccaaaggccuauggaagagguuucuguggcuuuguugauggcagcacuugcccuggauugcuagggcuacuuuuaaacaucugggaucauaaagccgguccaaguaaaucauguuuacugcuucacguucaucucugagaaacgcagagucaacccuaagucugcccugcaacaaguguuaagaaguuuuuguaccgaaagucacucacauuugagcugucuacauggcucuugguacuucuuugugagcaacaugguccuguaagcauucuccuuaauggagugauguacuguaugauaauagagacgcucauuucaacccuacguuccugaacacggacccccuugcucuuuaucauugcugguuuuuuuucgauccauagagaugaacugagcccagggguggcuugugauguggcugugaacuuggcuuuccuuuccugagcucaucaaaggcccuguuuucacaaugagucagaaaucacaagguuaggccaaagcuccagugagggagauggcauuaacagcuuucacugucuugcaccagcccaagacaaaagcauccaggaggcuuuugucaaucaccugccuccuugcagcaggcuucagacagacagacagacagacagacaguaggcagagggauagaaagugagugagauagguauccuagccuuccauccuccuuuuccaacaagucuauugugcuaggcagauggucaggacaaaucgggguuguaguggaggcagaacgaagcuugccuugucagcaggaaguccucaguugaauuccuggcaccucauaagcuaaaugguaugguccauaguuguuaucccaguacucuggagacagagggagaagaaugagaaauccaaggauauccuuagcuacaaagugaauuccaaaagccauggaggaauggugcuuacuagguugcuccucauagguaccgcagcacacgcgcgcucgcgcgcgcgcacacacacacacacacacacacacacacacacacauauauauauauacauauauauguguguguguauguauauauauguauauuuuuguguauguauauauauauguauauguauguauguauguauguguguacauacauacauacauacauacauaauguuccaagauaccugcacaggguggcaccaccaauaaugaacugggcccuccuaaaucaguuauucaauuaagaaaauggccaccccguaaacuggccuacagacaaucugauggaggauuuucucaacugaggauccuucuuucuguaugacucuaguuuguaucaaguugucagaaaccuagccagcacacucaucuacuguaguccagcauuugagagucagggcacgccuggcaggcucggcgggacuccauaucaggcagcauggcugcagacuacugugugcacauauucuuucuuggugcuucucugucucuagaaacaauccauucauaaugcuguuuggggggggggguuguugcuauuguuguuguuugguuuuuuuguuuuguuuuuuuuuuuuuuuuuaguaucagacauccaugaagggcucugaucacaugucagccccagcggucucugaaucccuguagacccugcucaggccuugcuuucauccaucccaggguugugggacgcuguguguugaaaguauaagccuuucuucugagggauuugaaggccagcuccagcuuuugucucugggucaaggaagaaauuugagaggcuguggaggaaggaggcagcuggcuuuguuuuguugagaucagugcuguguuuuaaacaguuucagcuucaacuggauacauacucccaccaaagaaaaaacaacucccccaagaaaaaccccaaaacaaacgaaucaaaacaaaaacugcaggccucucugaccuacagcuauaggacaagugcauuuucuuguucuucaccuccuucucugucucuucauccccagcccagucccucacauccaguagagaguaaaaagaacuguuuuccaguggucacuaaucagaagaaacagggaccuauuuucuuaguacuucaggggggucauagugaagacucacaaagggaacaauaacagaggugccuaauucaucugcauucuguaacccuugacccuggccucugagcacagagucaaauacugccagcuuucccugcccaggauaguaaaggcagugggcuagggcagcccaccacaguccgguguucagcaguggcgcaugaugugagcagcuucuaauuucccaggucuggguugcuugccucacugagaaauaacccaccaguuggcuucugccuccaccugcuaguucagggcaagcagggacacugucccucaugucaaauugcugacaugugguuauauauccaccuuugaacacagguuuccaaauaaauuccauugcuuucucugaccagccacauauucuccacauuucuucuuucucugauucuaagaagaaggaagagccaggcugaggaaacucuauagcccaccugaugaaggaacuuugggaaggggacaggaguggccuagggaggucugggcaugaucugcuuugaauccugagcagagccucagaucuaccuauguaaggguaaagugaggguaucugggaaggugugaggugugccuuaaggcaaauggcauuuuugauaacgggacaguugaguagggcuccuaaaggcauccggggaagcauggagcagcucuuggauuuccuaauucugcgaucugaggauauguacauucuuuaguuuugguuuauucuuuucaaaagaauauguaaaaagcauccacaguacauuuacaggaauaaaagcauuguauacuggagggcuacugcuauuuuauuacugaugagcuugagguauaaaugagacacccagagugaaauuuaagcaggcacucacaguuggugucauaccgcugcugcagcggcacacuggagaaugagugacaccuuaaagugcccuugguuugcccuucauucacuucauacugguccaagcuaugagauuacauaaugauuaagaucacuguugucuuuaaaggaaauuuuuguacuauuacaauaguagcuaccuuuacacgauaaacagauguauguaagguacuauguucagucuaagaaaaaucgcaacuuucuguagaaagccacagcccuccaaucaccuacuguugaagaaugaguaaugcuugcccauuguauaaccuuagucuuaacuguuccuuacauuguagagagcuauuuaaccagugggucugagaagaagccauaaacagaucucaucccauggaucuguucugaaaacaguuucaugcugaccuacagguuggaguuaccucaaguacauuaaugcacagcugcauagaacauccuaauuguuuauuuugaaauuauuuucuccuggacaguggugauacaugccucuaaccccaguacuugggagucagagguagguggaucucuaugaguuugaggccagccuggucuacagaguaauuuccagaacaaccaaggcuaccucccccccaaaaaaagagaaaaagaaaaaagaaagagagaaagagagagagagagagagagagagagagagagagagagcaaaaaagaagaaaauacuuuccauugacuagcagugguuauuuaaugaauacuugauacaguuuauugguauaaagguggaugacugugugcacucacacauagauggauggguagguuuacaauuagauggaaagguagguagauagacagaugggugagucaaugaauaaaggguuugauggacucacaaccugugaauggauggauuaacagguagaugaaugaauagauaguuaguuguguggauuuacaagcagaggcauggggguuucaaugaguagacaggugggcagauuaagaaauaguagacagguagguauguagaugaagggaucaacagguagagucacaaauacauggacaugagaagagauaaauggauggguauguuaauguauagauggaugaguagauuuaugaguagauauaaaaaaggaagauagauaaguggguggauaaauggguagauuuacaaauagauggacaguggauggguggauggaugaaugauggauggguagauuuacuaauauaaggacagguggguggacagauggcuaggugagcaaauggauagauggguggauuuaugaguagagaacagguggguagauagauuaauggguagcuaaaugacugggugaaugaauuaauggcaagcuggcuggcuggguuucaguuuuguaaguucccaagguacagugauuuugaauauuuuauugaauguuuauugauauuuaugcaacacccaugacuuaucuauaauagacacuaaauauuuguacauuuguuauugaguuaugugagaaugugaggaaaauguauagacuauguagguagaugggugaguagauaaccauucacuuauaaacaccauucuuuccauccuguaacuauauaugagccgugguagucuugggagcuacauaaguagguccaccaucuccuuccagaacuucaaacucauccaacacuaaacacaugaccuaacauacuguagacagucugcuggaccacuuaagacugaucaucacaaguuuugagugcuccaaagaaaugaagaaacagucacuggccacaugacuucucaguggaaaagccaaaacuaguacucacuuuaagacuguuuaucuuggacucacuucuuuccagauaauauggcuggccuaccagagaaguaaugccuugaaucaggcagacauagcauucuauggaucuggggagccaacaggagagcuuuugcuuagaagagacacacaacuuugccugagcgucacuguuugaaacaauugugucuacuuaagccccugacucugucagcaggcaaggacugugugccuggcuaagaaucuuggccauuaauggauucacugucaguaaaaauucccuggugcaggaggcugauggcauauagagauguaagcaguuuugcaagucacuuuugccuccuguaaauuugacucuccugaaauaaagucuuauucuggccuucuuucaugaaggaugggguuguguagaaugguuggcagggccagcccuugcauucacagacuuggauuauaguggagguaccacuucacaccaccuuagagaagcaggaaaaggaaagaaguucugucuuuuggacaucggccauaccaggucaccuguaguacuauggaguuauacuuauuaacacuccuucagauagaacucagaaguacacuuuacacauggaggaagcaaagggucagaaagguuaugcauccuauucaaugucugaucauuagucacugguaaccucauuccaaacuguguuacuuagacauguaccagcgcaugaaaccuaugcccuucucgccuccccuuuguaaggggaauaacuaaaacuccaguuacccagucugucccgguaaucaagugaacucucaccuuccagguguuggcaggaagaaggccugaauuuuugcacacgaggaagcuguuuugcacccaugauguggguggauucugaaaugacaagccuuuugaacauuugccaguaucucaacccuucuaauuaaaaccacauuauccaugaugauucuuaaugauagcauuuguggaguugggaugcucucugcucucgaguucagugugaauuuuucccaucugaacagcacaugucauggccuugauaauggguuggguggagauucuacaugaccugcuccaguacucuauauauuuuuucucauucuagaaaccucuauuuggggagacucagccugcuugguaaauuguuugguagccaugugucaaagacacaugugaacucuuucucauuuuuuuuuuaauugcguuggcuauggaucccuuucccuuccaaggugcaggugugaagaaauaaauagaucagugugugcuggucaggguuucuguuaggcuguccacuggcauguccuuucccacuaaugagacuugguaccuguaagguuuuugagcaacagcccauuguugaccugaaccuagaggagacaggaaagagcauccugaguaaugggucuaugaaaguucacugaauuauuuauucuucaauaagucugaaacuaaauagaaaauacauucuuuaagaaauuucauagcaucucuuuggagccugacauacagucugaaggcugcaauacugacuguuuaagaccaugagugucaguuucguaucacagaucucuuuacaaguucacuggccaaggguuacuaugacugguccuuucauaucuuuccaguccaucucccauuuagacaaauuccaugcucaaaacccuggacuucugauauccucuuuacucacuccuugcucagcaccuucugugcugacuagucuuaugucaacuugauauaagcuagaguuaucugaaaggagggauccucaauugagaaaaugccuccaucagaucuggcuguaagguauuuucuuuauuagugaaugaucagggagagcccagcccaguauggguggugccaucccuaggguagugguccuagguucuucuucuucuuuuuuuuuucaaagaagacugagcaagccaugaugaccaaccaguaaacagcaccccuccauggccucugaaucagcuccugccuucaguuuccuguccuauuuuaguuaguccugacuucuuccaauaaucaacaggaguguggaaguguaagccaaauaaacaauuucccccaaauuugcuuuuggauaugggguuucaucauaucaguaggaagcccauugaggacacuuauagccccaucaugagaacucccauggauccuuuaaaaugcagcuuuucuucaagaagcccuugccacugauucaggcuagacagagcaaccucuacagugcucacacugcagccagcacagauuucgcugcuuguuuugcauauuugguucucaauggccuagacagaccuguccuuugguaauuguucacuaacugcauggauggauggauggauggauggauggauggauggauggaugaguggauuagaguggaaaggccugggcaguuauuuauaugagcuucuacccuucugccaagaccuauaucuccacaguguccuagggcccauagccaugaaaucuaaagguagcccaugugaggcucagccuccaguauccaggccugggaugagagccaagcagcuagaauccaaaaggcaaggcaguggguaagaguuaggauuguuaucacaucugggaaagauggcauggccacugucaaugacccacuuucuguacacuuuuaacuaucuggggaacuucccagaagaucuuucacaguuggcagggucuuaccaauucuggcugacugguuugguuucacagcaacauaaugaagcugucagaugccaaacucuggcaguaggcagccuuugcuuggguuccagcucuggcaacuccuaccgugcaacuuaggcaagucagcuauccucuuugaggcucucuacuccccuggaaaaugaggccauugaauaauacaauaaaggguacauuuagaagcagauagcauauucaaauggguuggcugaaggguuuacugaaaggcagaguguccagacauggagagaggugcaguuauccaagaaagugccauagagcaagaucugagguagagaaaacaagcccuugcaagccuauagccgacuagcauguaugucugacagcauggcccacuccauguggccaaggauagcugaaaauggccuaacacacacacacacacacacacacacacacacacacacacacacacacacacacagcaaacuuuuaaaaaguauuacuuuuuaacuuuugacucagguacagaguucucaaggaggaauuguauagauaacaagguuguauaguaauauuguaagucuacuuuacucauccaaagauggagccuuccauuggcuaagccagaacagaagucaaagcaaaaggcaugugcauugcuggaagccacuagggcaggagggguagggaaaagagccagagggcagugggaacacacccgggcauaaucuaaggaagacucgcaggcaagccuccucucucccuuaucaaccccuccacucagacaggaaaagggaccaaagacaagaucggacgguucuuuuuagggcuucgccagagugugguaaggaugaaggugaaaugggaagaaagaauaaaggauuucuaauugugauuaucuguggauuucuuuuauccaccuuaucucucugugccaguagcugggaucauuagaaacccaugcuuccccuaacugcggcucuuaaaugugcugaauucuucuucaaagguacuuuuguaaggagcuguaugccgucguuuuuaauuaauuuuagcuuuauuuuuccauuugaucugauagaguuaaaugaacuuuuauugcccagauaucccuagccagugaacuaggucagccuuuccaggaguucuuugaaacuuuucacauguauaaauaacuucugccaacagacccugggcucugcaggagaccuagcugcccugcagagauacaugggagaugggcuccacccacuggcuacuuccaucagaaagcuuggcccacccacaggucuuucugagcaccagaagucuuucagcgcuuacugggugcugaauagagaaggggucuccuaggcuaccuguaucccacagggaaauaauguugaggaccuaagggguagaauuaacaggcaucuagcguuuuccuccuuaaaccugucuuacuguggaggacugcaauuugcccaucucucugucaugguuucuggagcuuuucugccaccuguagccacugaugagucuuaaaaccugugggccuuacuuacuaggcccuucccgccaacgacagagaaugccaagauaaugcaugucauggaagguaaugucucucuaggacugggagaacuuuucgagaucucuccaccucucucuuaucucuugccccaacccuguugcuucauagaguaaaaaaguagacuuguauuuauuuauacaacagagguaauuuuguccccugucuuucuuuaacgagguuggugagagcuugcuccccagagcucaggccuccuccucugagcugcaccaugcuuuuccauuguguaaaugcacccagagcucuucucagacaugugcauaguuccaaaugcagcucuuaaagacaacucuucaaugaccuccugauguauuuggugggaacuggcucugacuaucaacucaccuccuauuaacugaaugcauggaccaaaacacuuggcauuuuagugggaaaagccagauuggccugcaaaaaguuucgcugauggacaccucaucagcaguggaugagaaagccccuuugcaauaggcaaacccugggaauuaucaugccuuugaauguuugccaaccugauaaagauugaaaaauauaucaucucuuugauguuuugauuuauauuucuuuuauuaucaaauaucuuuucauauguuuauugagcccccugcauuuguucuucucugaauacguuuauuuccuuuguuuuguuuucacuggaaauaaguuuuaaauuauuuugugacaucaaaugcagcaucuuaaucacaaguauuuuagugucaucauugaauuuauuuuggcuuaguuggagaugccaaaccaaagagggugggaggagggucuagaugucucuaucuccugcugcugucgcagggaacccacucucugcaaccucucagcauggccugucacucccacaccgaguagaacaaggcgaugcauuauuuaggaugccgucgguuccaacgggaaacucuacccaucagaccacucucuggcagcugcuaaguaccaggcacgaaggcacgaaucagcugugggacuccaugucguccauuuagaugaggacucugucaacugcccauugagaaccucuaggggucacauccuugacaccgucugcuggaccaugaagaucagcagccugccaagaagucugacaggcugugauuauuuuccacuccagugcgguguguuuuucuuuccccuggcaugaaggggauucauuuucugagcgagcucucugggcugcagacaucucauaaagggaaaugguccucucaggggaccuugauauguugggccagacccugaaugugagcuugugugcaagcaggugauguuuuuggucuuguagauaaguuguuauucacuuaauccaucuauucuacgacaaaugugcugagaugcaguuuucuaauauauuaaauagucagguuuuagggguucaacaagauggccaaguagcuaagggcaguuucuaccaaaaguaagggccagaguucgaguccuagaacccacaugauggaaggagagaacuaaguauauacacacaaaccaaacaaguccagguuuuaauaauggucuaaaucuugauucuugaacuuaccaagugacauugaacaaucugcauuguugcuugguaccuaugaaguuugcuuaaaauauaaauggaaauaaauaaaauagggucagcagugucuauuucagaauuguaaaguuaguggagccaaucagcaauggucaaacuugaguaaauaaauacagguacuuaaaauaagcgucuagucguguacagaugccugagcauuggcugggaccugcugaccuaaaccuggcuugacuagguucacuucagucugcaagguacauucaagccugcccaggaaucucuuaucccucuuggaccagagggacaucugaggcauggagaguuuacugcagaagaaaggagagcaagccauagcacuaccucuguacuguacagauggacauuuuauuucuuaguucuuaacaugccgcuacccuuuaagagguuggucuggaagcaaugcucagauuucguggguuccagggaacacggucguggcauuugucaguuuauaugcuagcugucuuuacccugccccauuaccuugcuuugcacagcucugccaguuucugucugugucuguucuuuuguacugcauugugggaaauuuccuauaaaccuaguacauuuguaugcaccccucucucccccuccccccaugcaggagugugugcuuguaccuuuaucugguaagccaucucaccagcucuacagacauauuuuuugaguuuaccaaaucuuuaauuguaucuauucuucacuuucauuccgccucugaaguuuaauauaaauggcgguuuuuuguuuugggguuuuuuuuuuguuuuguuuuguuuuguuuuuugaaaaaaagugaagucuuccauuauguuccuccccagcaagucuuuuuauuaauuuaauuuaauuuaauuuaauuuauguaugugaguacacuacggcugucuucagacacaacagaagagggcaucagauucgaucacagaugguuaugagccaccaugagguuccugagaacuaaacucaggaccucuggaagaacagucagugcuccuaaccacugagucaucucuccagcccucaauggugauuuuaaaaagaaaaaaaauugaguuucacuuguuuauguuucaaaccugccuuuauguuuucauacuuacaagaacaucaugcuuuucgucucauguaaguuuaucauuucucuucccuucauacuccauuaguuaccucuauaauacaucagguuauuuaguauuccaaggauaugagcucugguugcugugccugcuaauaagaagugcuugggugagcuguaacuuuggaagcucauuuguagaugauguguuucuuguucuuuugguugguuuuguggcuguugcuguugcuguugcuguugcuguuguuguuguuguuuguuuguuuguuuguuuguuuuuacccuucucucugugggugucacuguagucaacguugucaaaaggccucugcagagucuauuaauuaccgcaugcuccuuaccugccuaccaccaccaagcacgugcuggcuucuggccaguuuucacacuaacuuuuuguuguagaaucccaggaacccauccgugguuggugugaaccgcaacuucauguuuauauguaacaguagguucauuuuucuaaauaugagauguuauuuuccucccccaaauccccaagcagacacaagcuucuuggucuccuguguagcuggccggccuaaguucucacgacuggaagaaaccccuccaggguuuaggcaaaagucagggacuccauucuaaugcuuggccucacauggccuggaacugugacuuauuuuugcuuguggaaguuuagcucccggcccucagcuauuaaggucucugucuucuacaauucugaaccaucauggcuccugcuuauauacuugauacucuagguaaauguucuuuauuugauuuuuuccccuuucuauuucauuuuguuucauguuuuuagaaggcuuaauagaaaaggaaacccaugaguucagucuucaguauuggccagagccacaaguccaacacuuaccgguccucacaaaaccacuguagguggcuuguauguuaagcuccuucccaagaucugccccccaccacauguuuucauuaaguaacugaguaguuacaugccuacuggauuuaaaaagaaauugagaauuuaagcugugcccagcaaguuacugucuugaguuaccuucuauugacucuuguaauaauuagaauuucaauuauucauuuucaauuagaaguguggcauaaucaucacggaugucauuaagaaauuuaauuguaucuaauguuggauugauagaagggauguuuccuaggaaaacagacauccuuaauuagaagaacaagaguuacagaagaacucugaaagaagcugaaagaagcagaggccagcaggcuggucuuuaguggguugaggaauauguggguuaaugcuccauucaugacaaacaucuccaagcuaaccacccccagauacagggaugaaaaucaccagaggucacuucaaauucuaguucuaccauguaccucaaugggcacaauggaugccauggugccugcucugugccugguacccugcuuaauucuaugcuuggauuguuucaucuagucacacuaccacagaucuaggaauuuucuuggaugaaaaauggugcaggacacuggaaaucauggugcagagugaguguuguguagcggaugacuagagacacagcuaccacagagaggagccaauuacugcacuccuaccuggugagagcugccucacacacauauccugguuucaucuucugaagcagcuccagagaguacucauguuacaguauugagacguuggcuuggagaacauagguuacaccauccaggacucccgguuaaggagugagagauccacaaucuaaaccuccauccuccaucuugggcuuacugaccuuguauauagagaaaugaaagaaacuguccauuucucaaauaaauaaugucugugaauucuuggguauguuuagguaacuugaggguuuuuugauuaaucccuuuuugguggggguagggggauucgccugaguuugauugaguuugcuggguagauggauguauaauagguauuguugacaaauaguagaggcuuaaaaauauuugaugaaucaaucaauacauuaaggauuugauggcuggcuuaagaggagucacuccuuuuaaaaauagacuaaaauugugguagaaauuucacaggccagcuuugggauuagaagaaccuauauucaaauuauacuuucuacucuaggccugugggaaaguggauccaaucucuccaugccuuaguuuccuaaucuguaaaaugguacacucagaauaggcuuuguacagaguaaauacuagauaaacggcguauuuuguaauaagcacucagaugacagcugucauuauuguuacagcauuauguuacaguugugguaaugaaggcucucuaagugggcaggaagucuucaucuguuccuguucuuggugccaccuuccuaaguaaugucuccugucccagagggcuuggaggacacugugucaggagugggauggggaagcagagccuugucaucccacaaaaggaauggaaacaguuggugguggggggggggacugcaaagaaaaaucuugaccauaucccacaaaagaugcuguaguuuccauggcaauuaaugguguuaagugcacuucauagcucaaaggucucuagugaggcaggagaaaggggugugugugugugugugugugugugugugugugugugugugugucuuuucuuuucuguuuuuuuuuucuuuaauaguguuuggagaaaaaaaguguuugcuugaaaacuccuuucauugacuauuaggcaaaaguuuaauuuuugaauucuugauaagauaugcaaaauaaucuuagugacagaaucauagguauaguuacaagaccccaaauagguucucugccaggugaagaggacccuccugaaggcaaugcucuguccucugccccuggugaggauucucuuacauaacagucccuggccacccagggaaguguggccuugcuauagugucuauggacucucagcaaggagagguugguaggaccucuaugguagccuaaucacagggacacugucucagcauguagcuaacugauaucucuuuauuaaauggcuacucuguaccuggugcuuuguuggggugacacauaggucucccagcuacuccuaaaaggggcgggaagaucuccacaugagaggacucagauuuuagagcaagccacggugagcugcaugaagccaugccauucuaggcuucucuguuuucccacagccaggagaucauccccauguuaggaggucaggcagcaugcuacacaguaaacgucacugcagggguccucagggaucagacucacguugcauacugacucugucacaccuuagccaggagcauugaaaacagccacauauuuccacaauuucagaauaaauuauccuuggcuaaucugcgguguuaguuguaagaauucuugaugaagaauguaaauaaccaaaguagauauggagcaguugggcccucaggacacagccgcuauauugauguggauuucugugcuuagaaaggguagaccaagccucuaggcugcucugcaaggccuucaucagccauuuuccucuuaggcuaccucccauaugcagugcaaauuugucauacuuucuacugguguuaaggauuuggguuguuucaguguuuaguguuagacauaaugaugcagaucuacugggguuuuguucuagguuaggccugggccuggcgucugcaagaucacaaaauaacaccauaguguuuuccagaaguuuccaguuuacuguccugauuacuaacuuauacuauaaauagaagguucauuuaggcucccgaauagaggucucugacuguuucgacuucaaaaucaaaccaguaaaagcuaucucccucaauucauccugguacuggggauguugaggcauggcacgaguuugaggcuagccuggacuacuaugugaaauccuucaagacagaaaaaaagucauuguauaaaguuguuagagugguagauugaaauuaacaagaggcaauauuucauaagcacucuauaaaucuggcccauuccucugcccccuuuuugcuuuuucuauggauuaugagauggaucuauaaaauacucaacccuggacagugagguacucagagggaaaagcacuugucacuugucugauggcaugaguugaauucguggaaaauggagauaacuggccucuaaauguuguccucugucucuccaugcaaugguugacacaugccugcagucucagaucuccugaacacacauaauaaugaacaaaugauuuuuaaaagccagucccaaucuuaucugcaucccuuuacccugcccccauccucucucggaugaugcacaucugucacacuauuuugacccauuucuuucuccuuccuccuuucacuuccuacgauaaaguucuucgugcuugucaugugcccucuggcuuauccuuuccaacagugccaccaccguggcaguuccagucuaggaaacugaggugcacagaagcaaaagccccugaccccagguccccuggggaggcaaugcuggagguggcuccagagaccuaaaccaaacaggacucugccuaaagggcauguguccauuagccaacuccaaagugcaggggccugaugacuccauucagagccuuacagcauaugaggugccuuccucggugagaagccuagaaagggaacugagaacucagguaagcaaaucaguguggucaugaaugccuggcucuccccagccuucagauucaguccgacaugaaggcaguagcagaaacuacagucugcacgggggcgggggggaggggugcuuucugugcucagguugaaguugagagugcaucuaccugguaaaauccaggaaggccuucuggaaguggugucucuugaggcccuguucccccccuagcuggaggagagugcaucccuguaaagcaucccccuccuccuccucccagggcagccaaggaucucaguccugcuuucuaauccccugcagagugcagacuucacccauaaggugagccuccuucccugcucucccuuccccaccucugucuaguucacuguggacacaagcuuccgaaagagacgaccguuuguuuuauaacaggagcuuaacacgauucauuucagauucccuaaggacuuuuguaaaguuuggacugagugauaauauauuuuuuuguuaagcucaagaccuaacaagcaggaagcgguguucaacaacauaauagagcugauauacugcagagcagguuuuuaucagagucuucggacuucuccuaccaccaccugucucaacagggagauuaaagggguuuuggagauuugcuauaccacacacaagguccuguccuaaugccauugacaaaggcugagagagucucaggacaagggcagcugagcuccagaccuucuaagaaugguggucuggcauccugugcagaaccaagucagugcucucuuagauggccuggcucccggucaccccaagagguuaagauuuggagacugcagagguucuucauuuggcaaauuacuuauccagcaagcacaugggcuagaguuugagcccucagauacugugaaaaaaaauugugaggugucauagcaugugcuuguaaugugagggcuggaaagacagagacagaauucuuagagauagcuggcaagguagccagccuaguuaauucagugaguucugagccaaugugaggcccucucucaaaacaaaaccaagguggaucucaaagaaauguggagcuuucucugugcucuagacauauggcugugacaccagagucaaaggugaacucugggugaagggaggggagacaacggagcagguuuuguguaaguacagaugagguugacuucuagccucuaugugaauggauacacacacacacacacacacacacacacacacacacacacccuggaccugcuaagucacaagccccaggagcuagacccagcauuuggacgugaagaggggccucugggugauuuguaaugcuugcuaaggccucuggguaauuuguaaugcuugcugaagcuugagaagcgcuugcuauucaaacuguggucccuggcccagcagcuuuagccuugccuugggacaacucagaaaagacaggcaccaaaucugacucugaauuuaacaauccugccaguuggcucuuacucucauggggcuagaggaacauuccuguagccaacacuggacacuggcggcaaagggucagguauuucaguuaggcaugggacuucuuuagaccccagcauuuugaugaggucaugaauuaugaggucaccucccacagccucugcugcaugggagucacucacccuccuugugacaggccccuguuccugcagccaccagccauguguuaagguuuucucguaauaaaaggccccugucggaguucucauucuauagaaaucuucauccagcuuccuuuugaaguauuucauugucuuguguaaguuccuuaauacccucuggucagagcaccucuggucuggucaccucuggugaccuuagaacacaaaucaagaguuucucuaaggccaacugaaccugaccccaaaaucuaccauguagaauacauuuaagacaacucucugacaugcacggguacuuuaugaaaggagaaaaaaggauccuacaaccugauauauggcugaaaaaaaaugcuagcugacuuuagaagcaugcaugcgcccugccccuuccuugcauccucuggaguugugauauguaaggugacaagcucguauggagccuucucugugcccuagacauaaggccaugacaccagaaucaaaaagggaacucaggacgaggagagaggagacuagggacgggaagacacauuuuaugucuccauggagacgagaaccauguccuuccaguucugggucaggaccccagacaaguagugcuuucccuucccccgccccaggaagacaguuuaaaaaugcaccuuuggggccagcuuguaagugcaccaaggggcccucagacucuacauggggagggagaucacagggugccugcgugacagugaaauucaagaggcucuaaaaagccuguauccuccgaccuacuaauucuauuucugggaaucugugcuaagaaaacacucugagauguaggcacaacugcauccauacuggcaaccacuguggcuuugguuaugaguaaaaacuggaaaccacuaaaugcuucacuaaaggaggcucguuaggugaauuauggcuuacucggggauggaguauuuuguagcuguuaaaaaugauguuugccgagcuuuuaauggcaaggcgccaugugucuugcaggccauuaaguaugaaagacaggaugcaaguucuccgaguuaaaaucugagcuuugugaaacaauuacagaaaaaaaugacagucagcacaugagcgggagaaaccggcucucacugguuuucucggcacugggauugugcugugauuuuguuccuucucaccuuguuggauuuccccccaucacacacccccacccccgaauuugaaaaccacugcucaucucuguuaggagauugucugagacuugcucgagauaaagcaaauagucacggcugguccgcagccaggcaugggauguaacagcugcuucuaucuucuaaacaugcauugcuuuugaaaugagaaaaaaaauucaauaaacauuauuuaccaaauuaaauucaaaucaaaauaaauaaauacaauaaagcauugguacacccuguggaggauggccucugcucccaaaagaagugacagccuguuucuggcuuaucguuuuggggggaucuucaaaaaccagccacugugaaauugacuucuaacggaucuuaauugagaugggcucuaaaugcaaggaucagaaaugacauuugggcugucuguccccaugcugcuuuguggaugaguccuguaccuuuucuaugugucagagaugucuggggcauguaaugggaacuguggugcaagucccauccuugccuuucaggaauaacuccagggccugguacacacuggcaguaguuuuugccaauuccgagcagacugcaaguugauuuuaaugugccuggaccugcauagaguugagcccuucauccucaacuauauacaccuugauagucuugucacaugugcucccuucucuuaacauaaaugggcuuaaugcuguaguggcagguugcaggacaugggcagggauugccuguaaaucccacacugaccuaugcacuaaguacuauuaagucucucucugccucugcuuuguauccaacgccacuaaauauuucuucuucugccugcugguauagcucacaugauuuccgggguggucuugcaccacauccucagaauuucuuccaccuguggagucaucaguuacuuaaguauaccuuaaagcagggugccagaagccuagagaaguuccaauucucucccuguauaucaucuugcagccuggucccuuucccugucuucccccagagccccucuuccagcauucuucuguccauacauccauggcuuucacagacagaacacuguaacucuuccuuccuaaacccucgaggccuucuuccccuuucauguccaaacuggcugauuaaagcauuuuacccacuccaacaaaaguagucucucucugauacauccugguuucuuuucaaaccaguggcuagcaucuugacaucacaucacuuggguauguuucuuuggccaguaaauguuaaccgagugcuggaaagcaucaagacuacaggaagaagagcugaugggaaaagggaagcagaccacugaugugacuuagcaauccaacaagacagccgggcgugguggcacacgccuuuaaucccagcacucuggaggcagcaacaggaaaauuucugaguuugaggccagccuugucuacaaagugaguuccaggacagccagagcuacacagagaaacccugucucagaaaaaaaaaagaaagaaagaaagaaaaagaaagaaagaaaagaacaagacaacacucugacuuugacaugucucauggccuuaagaugggagauuuucuuagaaauguaaacuaugcaaauugacucaagaaaaauuagaaagacucgaaaggagaaagguucuauauucacagggcacauugcucaacuuaccagggguucccugaguagaaauauugggaacccuuuugucucaacaaaaacuauguaaucaauaccauccuguucugugucuguggggaagcuggaagacuguaggccccgggggagugaugcauagaauuguaguuuucuccuauuucucuguauauacuggacucagagacugcacugugucuccauguaaauaugggcaguuaggauuuaugaauaugcaccagccuacuuucucuucuugaaugaaauuaagagacagacaaagggagagacagaaaagagaaacagaaugcaauauaaaggucagcaacaaauggauuugagaugcuuggauggauccaguagccaucuuuauaaugacuuguccuucccauguuuaauugugauauuuaauggacacccuugcauugcaagaugacacuuuuaaaguaaaauucucuccuaaugaugucuugagcccugccccucagugggaaaaucagcaaaaccuggaggacuuuaucuggaauugacauucucuucugugauuucauuuguuugcuuguuuguuuguuuguuuacucaguuuucacugaaaagaaaguaaagaugauguucaguuucaaacauguacaaauugcuuuauuucaauaaaauuaaaucugucucuguaucuuuuucuuucucugucucucugucucucuccuugucucugucucugucugucugucugucugucucucucucucucucucucucucucucucucucacacacacacacacacacacacacacacacacacacacaaugggauuacuuugaaaaagcuccagguuuagagaacucaacaacagaugagagaagcccaguaccgacucucgcuuguguggggacaaguuucccucugccccuuucuaguccuguauguaacccugggugcaugacguauucucucugaaucugaguucccauagaaauccaguccaggaaacaguuaucacaaaauggcagugcugggagcuuucuggcauggcugucuuagguggauuggucuaucagccaugcugccgacaacuauucugaagucuuauuagacuucucucucuugacuuuuaagugacuugcaacauuuggaugacauccauaacagggaaguguugagcaucccaaaaccccaugcuuauuucuugguuaucugugcaauauggcccauuugguccucaaagcaaccccaugagauguacuuuacucuuaccuccaucuuaaagauggagaaacuguacaaagauaguccagagugugccucagccaaagucuaccauggcagagacaggaauggaacugagcagucugcucucagaaaacuuggcuaccauggcuuucugcaucuggauacagccuuguaucugaccugccuuugacaauuguccuaugauagcauuuucacugcucacaugcucccugcacuaaucacaaacucuuacauuuacaaagucagaaauugagagccaugaagagacuuagucauagucaauaggauaccuuagcccagagccuaguccauucucuuuauuccucaggaacacugaggcucaguuucugcauucuugggaauugagauaaggaugcuuagcucagaagggacgcaaagcacuuagaaagggacccaggaacaguaccugcuaaguggaugucacuugcaaguuauugcauuugauacuaucaaaugacauuugcuuccuuugucugucuugaacacagagacucugagaugucugaguccuuccuaugcacccuuacagcaaaauuaauuggugccagaugugccggaaagcacaagggugaaagucacugcacccaggucuaucuacaucugugcaugacagcaucucccucaaaugauacuugguuacaugaaaugagccuguguauuuugaaagugucugauuuagaacuugcaacagcaaauaugauuuccuuccccuucucugguuguguuuuucauggaacagagccauauauuuuucuuucuuucuuuuuucuuuuuauggaaagcagacauugaaagacauucugcuguagcuuuucagugggacauuucaaggcaggucugcugaggaaguguuaacugagcacuuccuaugagcacaagguuguguggauugcacaagaaacacaaaacacgaccuuaugacucagugggaucagguccugauggagguauagcugccacacagacagacagaaggcuagaacccccacagaccaccggacagcuccuaacucuucaggucugcauuagacagggcucugcagagacucagaaccaagaggcuaguagauuaaaggaagagaaguauaaagagauuacucguguaauuaauggaagugaaaagucucaccagcugccagcaggcacagagaaaccaguaguguugacaccagccaagcccaaaggccuaugaacucacagcaugcacaucccagaagagauuaguggccagcagccaaaaagaugguucucccagcuuaagcuccuugcuuccccucuauucagacccucaaggacuggccaaugcccacucauaccaagugcuccaucuugacucagucuacagagucuccuccacaaaacaccuuugccuucauccccagaaccacuuagcuagacaucuaguagaucggucaaaucaauucauaaaaucaggcauucauauccaguuccaggccagggacagcuuucuaggaaguauuugcuugcaaguagguugaacaauccaauccagaugacacuccuaaacuguuagcugcauauuaaucugcagggacuaauaucauaacauaauuaguguagcaguguucccaacuuaauugaaaaugcugcauaugaggggcaguuaaugagaaaugcaagguuugaugauucagaacugcagagacuuggcgguguagcggguguagcugggaaguguuggauuuauuuccuuuugcuauucucuuuguacaucuggacaggaagggucugaaaggaguugcuaacaguauguauggugagcgagcuuugauuaucuggaugucccucagcuauuuggaacacagcagagagccagccaagcaggaagcaaaaaaaaaaaaaaagccucugcaccgacaaaacacauuuuaauuuguucauacaacagucuuuucacaauucugauaagaaauccucucagcccgccccaucaaaauuaauguuuacauuauccacaauguuaguacgccaggugaucugauuucugaguccuuagcagagcagcagcugcaccucccagcaggguggaggcaccuacagggaugcuuggcucugcaucuccauccagucucaggagggcuuuaaggcacaagguuauauuuuggguauagggaaaacaaagauguaagaaucuccgcucauaugucgucugugggaagggaagacaugauuuaaucucguucuggcuaguuuaaacagaaaaggauuuaaaggagacuauuggggaacuuacacauuuucuuaaaauaaaaacacuuaaaauguuuuuauuuguuaacguauuucuuuaacuauguauguacgaauguauguauguaugugggagggggcacuugugccaugguaugcauuuggagaccagagaaaaacuuguaggcgucaccucucuccaucugucuuguauauccugggaaucaaacucaggugaucagacuuggcagcaaaugucccugccuacugaaccaucucguugguuggcucuuuguggguugucuuguuuuauuuugcuuguuuuaacuugaccacuuucaaggaauggcagggccgaagauuggcuaccacaggacaggaagccccccgcauggcacaauaucccucuugcccuaagucuuugacauuuaaauuggagaacccaaaccgugaaguuucagaugagugguuaucucuaccagugugcuggagggaaggucccugagagcaauauccagcuauaaugacagcaucuauccugagcuaucuggugggaggaaucuguaguuucccauguccagacuguuuggaauacacaggaaguugagguggauguaaaaagaguaaguaaugucuacuacaaauguggucaugagaugagaguucaauggccaaguccuauugaaguuucauuccaggacugaccugcuguuggacaggaauacagugaaggggacacaaaauaacaucugagugcuaguagucagggaggaacucacagcaugagcagaguaaacagaaacaucaaagaugcaagaaggaggacgaguccauuuaagagugacuuauguuacagaggcaucacugucgaacgcaugaagggaagagcuggacaacagcuagaguggagauguacuuaggacacuugguggagggcagacagcuccacaaagcuguugaagauguucugagauuaccaugugaauuuccccuugcuuguagcuccagcacccagcuguacaagaguuuguugcuacagccuuuacucugccauguucucaggugauagaaggguugugggaguaccauagcccugauucauacuccuagaguagcaaccagggaucuggauaccaggaaccccaagcauucuucucacaagggcaaguuaccccaaagagaacugcagacacucucugaagauugccucuuggcuuagaacaacagcagcagccuccuccccaguguucagugacauacagagauggguguggaccuggggacauuggggaucauggcaguaaugugaacagguaaucaaguucagcuuugggauuuuucucuggggauggggaggaagaaacaaagucucccguuauaucccaggcuagccugaaccucacuguuagugcagaguggucuugaagucaagguccuuuuugccucuuucuccuaagugcuggggcuacauguaugugacaucacaaccugacucauccuuauaagaaguuuucauucuuaucuugaaauuuagacagaucucugcaagcuaaaugaaaguguggggaauagucuggaaggagguaauuggccagagggaaaggucauuuccaaagauccacaagcggauuauuuaacauaccauucuaauauguauuugcacauuugcauauucauuuauauuuacauguuuaugcaucuguaucuguguagaggcugccauuaagacugcuuucuccagccuccacucccagggcucuguucuguuuucuuugcccuuccauacuuugcugaccugagcuccccugggucagucauagccaugggcaaugucacggucacugaucuaggcuuccagcuucaucaccacagguccccaccucaagucagguaacaagaacggagagaaccacagcaggaaccugacugucuucagcuccucauacuucauguuauucacauuguccuuuauaggagggacacuuuggccucagguguuuagcaagaaugauuguggggaacauugucuagagcuuccagucuccucuugauauugugauaagcccaugacuucaaugagccuucuauaaguauguguaaaugugcuguguguuuguguauacauauuuguguguguauuccuucuccugugggugcacauucguugaguguguaggccagggaucaaugucaggugccuuccucuauugcucuccagcugauuuuccagcaucucucacugcaccuggaacucaucaauuuggcuaggcuggcuaguuaaugagccccaggauccagccugucuccaucaccgcucccagcaacgggguagcagacgugugugcgguauccagguuuuauaugacugcuggggauccaaacucagguccccacgcuugugcaggaggugcuuuauccagugaguuaucuccccaaucuuaucucuagaaaucucaaaguuacaucgagugcugcuaucuugccuagccaguccuccuggccagcugcccagaagagaucagggagagccaaccacaugcuccgccagcagggaggcaggaagcaggcccacuguuuccuaagggaagcacaagcuuugggaaauaagcaagccuccauucccacacagcaauuaugugcacaauuacauuuccagcaggugucacuuaagagggugaaacccauuaacuguucaaaugagaaagcagaaaggagucuccgagaacacccaggcaagguauacucugcaaccuagagaggggacacucucgggcuuccaccacguguucccccacucaaucugaauacuauacuguguaucgaaguacacgggccugaugcaaacuaguguagaaauaaaacuuggccagaaggacagccaugaugcuugggcaugugugcacaccaacuagggaaugaguauggauagcauuggaugccucccuucaagucccgagaggcauccaagucucuucauagcccgcauccuccuccuucuccucuucuuccuccuucuccuccucuuccuccuccuccuccucucuuuuugagggcaucaagcacacaggaaauaaccuauaaguccauggaagacauuuuuauagcaauuuucuccauauugcuuaaaugaugaacuagauguuuuguaggaacaucuaaggagagagagagacuuccaggccugcacgaacuugcuuaaguugacauuugcccuggaaagugacuaugauugcccucauuaacagaugaagagacagaagaaaggagaaggaucucaccccaguaugcuugcuuguuaaugaacugcagaccuuggauugaacccaggccugucugacuccaguguguucuuugcacuacacugagcagccuaaguugggacuucauuacagaagugaagcagaugcucccuggugacgucauacaggaggggaguucaaggaccagagcuucuucuguccuacucacuagacggccucagggccuagaugagacagaaggaacuuccauuuucucugcucaggucagccuagcuuugauggucaaggaacugaaagcuggaaaugggguaagaaaauguccugggcacagcuggcaggcuugcuuccuuucugacaaagcccaguucacaaccuccuuucuucagucauacugccauuaauaugaaguggcacaauugggucuaugccuugccaagcaacaguaguuucugcacugucuaaaaugaagagacugccuccuuguccaaucucucagccuuuuauaccaucacuuacagguucugacaaguccauguucuagugugacuauaacccuucuguauuagucaggguucuuuagaggaacagaagugauaaagugugugugugugugugugugugugugugucugucugucugucuuugaagggaauuuauuagagugguuuacaggcugugguccagcuaguccaagaguggcugucuaccaauggaaaauccaagaauccaguaguuguucaauccacaaggugggaugucucaacugguccucagucaguauauucucgggggcuggaauccugaagagguaggcucuccguccagcaaaggaaugauuuugccagccagaguaaggacaagcaggcaaagagcaaaagcauccuucuucuguguccuuuacauaguccaucaccagaagggauggcccagauuaaagguggaucuucccaccucaaaagaucuggaguaagaguggcucuucccacuucaaaugauuuaauuaugaaaacaguuccucacaggugugcccagcugcuuggcugcucggguuuuaguuaauuccagauguagucagguugacaccaaggacugccaucacugccccaagccccuuccucugcugucaucuauccuuugacacaagucucucuugggucauuuuuauugcuuccugugauacaguugagggugaacuuuguaaacauuucauuguauccauucagccagucauucaaccuuccauucacccaagacauaauuacagggugugaagauuuacuacgagguagaguucaugacugauuugagauggauacaaaauucauuaagaaguccggucuccauguuggagagcuagaucaccacaaaaggcuacaggugaagggcagccaaugaacaggccccauucuuccuggcagccucuucucggggagaugguuugacaucuagggcacugugcacuuacagaguuuugccuagcacuauaucuuugggcagcuaccaauauuugguugggaaccccaccaguuucauacugcaagaacagagaccaaaccaagaagugcccuuuucuacaggccuagaguagcccuguagacuaugggagggaacacccagggcagagaucuuucccuuucugguucccuggucuuauccaagcuccugaaaucugcucuucagguucuacccuccaagcagaucaaccgaucaagccuccuuucuggcugacuaacuuucaucugaucaacaauuuuauucucccaagaacugcuacucacaggagagcugaaucucacucagagaaauccaucuuuagacucucacuguggccaacacugugugucuggaaugcuggcacucuucucuggagcugggucagucugugugugaagagacggucauaugggaugcacaugagccaccucugucuccuguggcugcugagagccaggaacuuguagaucaucaacaggccagcugucaccuccugaucuuccagucagcuagaggaaaugggaaaagcccuccagcuguccuuucugaaggcagaugguggccuuguauuuggagcucgggcucagggugggagucaucugucauuugcaagggguucuucaucugaagagucuacuccagcuuacggccugguccuaucuucucacaugccacaucagggucucucuccagcuucucuuugggguccuauucaugcauucacuauaucugauaaggcaaguauacagaaggugcccaauaaguaugcuuuuuaacuagcugccuccaaauagauugugacuuuucuaucuaugaaucugcagccauuugaaguugaguucaaauuuggaaguaagaugacuacuuuagauauggugcuauuuugcuuugcccugauuuucauuuauuugguuaguagaaaagcugagcauuuccccacauguuuauccacucaacauacuaguuguguaguuggccuccugcccaauuuauuuauuucccucacauugaaccuuugcugaguggguauuaaccuuaaucuacguuacauccuacaggugcaaguuuuucaauccgauguccuuuuuacuuauuuucuuuauucucuguugcacagaauuacggaguacaguuaauuuccauucauauuaaguuguaucaucagugccgcacaaucuacacugaauguuggaagugagucuccucaggcagcacacacucuuccugccccagcaagcugggugagccgagcagguugaaaagggccacagaaguguuuccaaaggcaaacacuuuguuccuuaugucaucgacccacuggcuccugcacgcacgcguguugcucuuaguuaaaaggccagccacuuguguuaacagcucuacuugaucuugauggagcucccccucucuccaccuccugaguacuguuuuccuuaaucaaaugucacaggaucagaaaacaugaauggagggucauugcguugcugaugaggaccaaaaguccuuuccgcuuugguugggcuucccuaugaaacauaugcuguugugcuuggauccccaggucuucucagcagcccucuggcacaggaguggaggguuaucuuccuacaguaucugguguggaaaaugaggcucaagggcuuggcucuguucccuaccagucaggcaaaggccagaccuucccccucugaugucagaacugauguuuguuuugccuaacaaguuccuacuaucuggacauggaaguaagcaguguuuugguccuaaacucagcucuagaaggaaaaugaucucccaaccgcuagaaguugcuagauuaaaugucuggugacagucucaccugggugcuccugcagggagagcaaggugauguccaaaaaaagaaagaaagaaaaaaagaaaaaagaaauaaagaaagaaggaaggaagggaggaaagagcaacuggugauauccagcaugcuguggaaaaucugcaagaagugauuuaacuggcagcuuugcaaucaacuucuuuugcuaaacaggaucuguucuuuuccagaacuucauuauccagcagaggaaacaggcaagcccagaccacucuuaaaaaaugugggaaaugcaucaggcgcucaugcauucauucagcagauacuaagaauuauuugcuaucuaaugucccaguguaaaauaauaugaauuauucuuaaccccgucuagcuucaaauggaugagacucaaacugugauuuauuuauuaagcucugugcaauuauugugggaugaccccuaaucuaacuuucuaaugcuagacuggcuaauuccccaauugugcuccccaaauacuugcuguuagaauuuuccuacguuauuucugcuccagcagucuggugaccuggacgagaauuuuacuugggcacaugcugcuggcccaucaugacuaauagagaccucuuauuuauccaucuucuccuuuguguucuuguucucucucucucucucucucucucucucucucucucucucucucuuccccuuccucucucucuuucucuuucucuuucucuuucucuuucucuuucucuuucucuuuccccuucccucccucccucccuagcucccuccuuucuccauccccuuauggucucuacuugugaaccccaggcugguaauucaaacucuaccucauucuauucuacccaguaauuaauuauagccauuuuuuuaaccaaugguuuuaaauugaggaguaagguuugcauaacaaaggcguaggugagaauuugcuccucuuggcauaaccagauccuggaguacagaauuuagcauagaaauucaagcagcaccagaccaacccccaacaucccaguaaacacagcagaccaaaaucaggaagcuugcagcagggaaggccaaaaaaauuaauaaccauugugguccacacacuggagccuugggguggcagucagagucucagucuuagagaagcacccuccaugcagcacagagaaacagggauuaaguucugcucucaaaaugagggguuuugugcuauccuaugacucucaaugggggcucaauccaggcagucagcaagaggaugcauugcuuggugaagaaaagaguaacagcauaagagugaaggucugaaagaugugggaacuugauagcaaggcuagagaaaagugucgaaaaauucaagacucuguauggcagacugugaggguuugguggcauccacaaggacaaggacaccagggccauaugcugccaugaccaugugcauaccauugcugugagucauuauuaugugagggauauuagccaguggccugagcaaggguucugacauacuccuguaguaacauuaagacacauaagagcauauguaagagucagacaccccuccugaucuucuaaccucaaagaacauccuaaacgguguccaauagugaaugcauuaguuccugcuuucuugcugcuaugaagcauccuaguuaggguuaguauugcugugauaaaacaccauaaccaaagcaacuuaggggaggaaaggguuaauuuaaaucacauuuucaaauaacaguucaucaaaggcaaugagggugggaacucaaacagggcaggaauugaugcagaggucauaggaggaggaugcugauuggcuugcucuuuguggcuugcuuagccugcuuucuucuagaaagaucaccaucuucaccaggaucaggacaaccagcacauggguggcacuacccacaauggccugggugcuuccccaucagugacucauuaagaaaaggcccuacaggcuugccuacagcccaaucuuauggagguauuuuuuuccauugagguuccuuccuuucagauaacuuuagcuugugucaaguuggcaagcuauucagcacagacuauaacuuaagaaaagaaggguuucuaucagcuggaggggauucauucucccauggugagaacagcauaggaauacugaauucccuaugguguggcggccauacagugaggcauauacagaagaauaugaugaaaacugguguugguucaugcucuuuuuauucagucuaggaccccagcccacguaauggaguuuauuucauugaagcugggucuugccauuucaguaauucggucuagacucucucucucucucucucucucucucucucucucucucucucuccccucccccagacauacccagagguuuguuucuuaagagauucuauacuccgucaaguugcuaaucagcauuaaccauuagggugggagcacccugcaaugaccuuuucauuguucuccaggcuaucaaagagcaucugaagaacuggcccaagcaagaggaacuuaaggacaugugaggacuaaauugaauuaggcaucauggcuggggauccaggaaaaaaaggagcauuagauauaaacccuggaaagcugaauaagcuauagguguuaguuaaaauaauuucccugcuuugguucaucaucuguaacaaaugcagcauaguaauaggaagauucacuauaaggaauggggaauucucuguacugucugcauaguauuuuugaaaccuaucacuucagaaauucuuuuuuuuuuuuuaagauuuauuuauuguuauauguaaguacgcuguagcugucgucacacacaccagaagagggcaucagaucucauuacggaugguugugagccaccauguaguugcugggauuugaacucaggaccuucagaagagcagucagugcucuuaaccacugagccaucucuccaguccgacuucaaaauucuuauuuuaaacauguaaaacauguauuauauuaauaauguuugggugugguuuuuuuuaaguaaaggggggauauauguaaaauacacaccccuccuuguuuuucuuguuuuuccuaucguugggaagagcucuuucucuucugucuuguucucuccucuguccaugacuucagcuuuaccaggagagaccuggcggguguccaccugggugggccugggagggcugagcagguggguaaggagucugagcuagagaggaagucuguguuggagucucagccuugguuuccucccuggggcuaguuuccaggaaagugacuaugcagugguucauuaacagcccugaugucccacaccuggugguccuuucacuuccgcuggaggacauggagcccagacacuuggaucagucaauaaaaaggccaccuguaaccaaggcuugagcagaguagaaagcaaaugugucccaagaucccagaaccucuacgaaugguggggagcugaccucugcugugaaccugccaugacuugcucaucuagagagcuggcugggguuuuaugccuuguuucuguuguuugguuguuuguuuguugauugguguuuuugguuuuuuauuuuguuuuguuuuguuuuucccuuccauuccagcugguaucuaucuguuuauccauacuuuaagaaaauacauuucaaugcuucuuuacuaacaaaggcuguauugucucuuaguggucaugccaacaugccauuucugcucaguugugucuuugcuggacugucauugguuccauuaaacuccaggcuccccugaacuaaagcaggacagccugaccucccucaagaguuugugugucacgauggaacuuacuggcauucaguggcuuaauaaaugguuggcuuuccccauguucauuuaccagaaagagucauauuuaacucucucucucucucucucucucucucucucucucucucucucucccacccccuucagacacacacacacacacacacacacaaacacacguaaagacuugacuguaugucuuuaccuuucuuccugcagagcuuccuccucauccccugcaugccucagcuacagcucauuuccucacggaccugcccucuggccagucccauagugagcuccccagcucagcccaaacccugaccuuggugaacaucaacgcauccucaccgagaguucccaagcaccacugccaccugcacauuuucucgguacuuuuauccgcucaggcaagaaaacagaaaccaugccagguguuucagucaagggaaucuaauccaggaaauccauugcagaauugaggaaauggcuaagaaacaguccagggaucagcugcggugggcaauccuucucacuucuaggcuagaaggacggugaggcgggaccagucagcaaaaaucaggaggagcuagaaccacuuugcagagugccucucaggcccugagacgacagaggguaugugguuacugcuagacauguuaucuaagacgaagcaaaacagggaggaagcaagacccuggcugcacagggacuuucauuaggcaaaccuguccaggauccagugagcuaggggagaccgagaaaaccuauucuccuuccaauagagcagggcagagaagggcaguaugggaaauaaaucaggagccaaaaaccaaguaguuacaauggcuguucagacuucucagcuagcuguacccauuggcuuuguccagugcugagcuggaccccuucauuccugaaaacugcucuuuucugauuucucugaucgugacagcugccuucugauaaaggccuccuguuccuaugcaguccccugagaucaggauuucccuucacgcuggggaaggggcaaugacccucucacaccacacgcuggagucaauaauucugacuccuguauguagcugcagucccgacuccuuuagagacgauggugccucuuuucuuucauggacuccuucagguauaaugguucuauuuguccuuaccaccauggcagccuccagaguuaagcuagaccuugaacaauuaucuuuugauguacaauauuacacucaucacucagaccccacuaaccaggcacaauaugcuggcaagagccccguucgggagcuauuggggaaaaacuagugaacugcaccaggggcuucacuucuuguccaggaaggguaaucaguuccacccuuugagcuuugugagagcauuucccuccucugcuaacuaagagcccuuacugcuggcgcaagagcucuggacagugcuggaugagagaaggaagaauccaaagacagaacagaggaagaaacgaaggcccuucagcugcugcagccaaggaaacaggaaacuugagaaaggcuuuaugcuugccuuuuuuguuuugcuucggagcauugcaaggacccaggcacauuauuguguuuggauugggggaaaaaaagcauaacuucgcggaagaaaauccuuuccaauuuuguucuggcuguuagguggauuaaaggaagcugagagaggaguggauugcacaaggcaacagcauccaggcagggcccaucccucuccgccugggacgugcuaggacagcauuuguagcagugggauucccaugggauucugucuccaucccgauagauucagcaucagguggagucgugugugucacuuuuucuuaacuuuaauaucaaugguaauuauuaaauauuaauagcaguauugacaauaaagugacuucccacaaucucauagaacgcaagaacgaguuggcugauccugcuggagacaaggaaguaccguagaguuaggauggaguacuaauccugcggaguuuguccugugcugugggcggcuccagucugguucucucgagcugugugcucuuuucucuauugcagacuuacgauauuaccaugauaaaauacgugauaaaaucaacuuaaguagaguaggauuaacuuuuuuuuuccauuuuuuauuagguauuuagcucauuuacauuuccaaugcuauaccaaaagucccccauacccacccacccccaauccccuacccacccacucccccuuuuuggcccuggcguuccccuguacuggggcauauaaaguuugcgugucuaaugggccucucuuuccauugauggccgacuaggccaucuuuugauacauaugcagcuagagucaagagcuccgggguacugguuaguucauaauguuguuccgccuauaggguugcagaucccuuuagcuccuuggcuacuuucucuagcuccuccauugggagcccugugauccauccauuagcugacugugaacauccacuucuguguuugcuaggccccagcauagucucacaagagacagcuacaucuggguccuuucgauaaaaucuugcuaguguaugcaauggugucagcguuuggaugcugauuaugggguggaucccuggauauggaagucucuacauggaccauccuuucaucucagcuccaaacuuugucucuguaacuccuuccaaggguguuuuguucccacuucuaaggaggggcauaguguccacacuucagucuucauuuuucuugguuucauguguuuaggaaauuguauuuuauaucuuggguauccuagguuuugggcuaauauccacuuauaggauuaacuuuugcucacaguuagagcauauaguuugguggcucucaaccuucuuaaugauguaacccuuucauacaguuccucacguuguggugacccccaaccauagaauuaccuuguugcuacuuccuaacugaaauuugcuaccuuuaugaguugugguauaaauaucuaacaugcaggauaucugauauaugaccccaaauggguuucgaccuacagguugagaaccacugauagcaagcacaucauggcaagaaaggcaggauggugagaacuugaggcgucuggcuguauuaugucgacugucuggaugcugacagagaggaacacugaggcucaggucacucucucccuuuacgcaaucugaaguuugagcccacgggacgcuacugcccacauuuggaacgugucuuucuaccucaauuaacucaacccagacacccgcucacagaggucuccauggugauucuucauccugccacauugauaucaagauuaacucuuuuauucauugugugaguuucugagggcgguuguaccaaacaguauacaggaauaggacaagcaacaggaguuuauuuauucacagucauggaggcaaaaagucucaggucaaagugacagcagaccuaggcuucccugaagaugcuguaacggagaauaaccuguucaugccucucuccugacuucuggaaauggccugaccugugaugacauaagucgcauugucauaggcuguuaucccgugcacacaucugucugccucugugccaacauugucccccuuucuaaggacaccaguuuacccagaugauauaguucuauuuugauuaggaauaaaaaggccuauuucccacuaggguuugaauuauaguauaucuacuguaaaggacacauaguugaccuucucucuuuugggacccugcaauagcacaucuucucagccauuacagacagacagacagacagacagacacacacacacacacacacacacaguuggauuugggcagcaaaccuauaggaacucuugcaauucauggcaugccauggcugacauuguuaacaagccaugcauacaugucagaacuaccagaaaggaaauagaauagaaaaauuggcuacuaucuccagacaagaaaauggcagaugagaucuagccuucuuuccacagcugguuuugcccacagaggcccugcauaaaagccucucccucccucacaaaugaggacauccaguuaaauauucauagagcugagaacuacauauguauuuaggaaaauauauaugcacauacauauauauaacaaaauuaaagaaaaugaggccauaaaauaauaaaauaaauucauagggagauugcauaaagccaucugcugccuuuauuauccccacccugggaccccaugcauuuaaaauauacaaguguucacccuaaaacuuuccaucacagcaauaugauggagcaucugaguugguugacauucaagauugauggcagagaggaagucaggugagagaggaggcauguaagcaagcgcagggcucuuaccuacaccugucccaagcaggacaauacagaauggcucacguuacugccauacccuuuggagaaggugucauucuggauuugagagagaaucugucugugaauuuauauauuuuugugucuguuuacucucugauaugaacauugaaucaccagcaacugcagcuaccauaauaagaaugauauaaucugcuucacucagucuagagagauaggcuucaaagucaguacugcaagugaacuccggcauguaguaugccuucucuucuucuguugacuugaaaauuuaaugaaccuguuuuuuuccagagacagagaaagagaacuuuugcugagcauucauccuggugcugcacugggcuaggcugacccacaugcucagcaguguguuuacauuuaguuuggaggcgcugugcuuccucagucagguuuuguaggcuccccuacucucaaucuagucugauucugggcaaagagcuuggagaauuggcgauauuaagagguuaucaaaugggauggcauguguaauuggcuuggauuagaaaccaaagcucccagcauagcaaaaaggugggaaauugugagcuaaugauuuagacaguaaccagcugguuuccuggacuaucgcuuguguucuggaaggucuacaucaaaacagacuggugcuaggaaagcucauaagggcugaagauugugcagcuugcuugggucucagaaaucaggcaucuaauauggaaggaggaugcacagauaagcuuggaauccagaaaugguggccaucgcagaggagcauccagagcugcaggaaagaaagaugaaacguuaaacaagugcagggcucuggucaugcaggugaggccauaacugugaacaucucaguggggcugcagaacuugcuuccuccccacgcccauuucuucagcuggggagaagcucagucacuuuaagucucugccaugaucuaauacccagcagaagcgacuccaggaaggaagcgcgcuuguccggcuuacaguuugagggaacagucucccagagcuaggaaggccugggggcaggagccugagggcagcuggucacaucgcaucugcugucaggaaggggagagagacaggacagaugcucagcuugcucucucccuugcauucacucugucacucuagacugaacuaauucauguggguaguaugaauuaguucagucuagaaaaucccucacagguguguccaaggaacuguauccuagcuccugcuagauccugccagauuuaauuaauauucaccacuacaucauccuugcuaaggagcuagcaaugcccagaaugucguguauuaaaagacaaaaagagcaccuuacugccugaggcaggaggauugucaugaguuugaggccagccuaagcuauacaaugagucuuuuucuaaaaauaaauaaauagauaaauagacagauagguaaaccagaggagcuauugugcugccuauuguuagucuguggcacucauuauuuucgccuccauuuaaugaggaugcauaagaagcuaggagauuggcuucaggcaagggagcugguguugcuccaggagggcucagggaugagcucacuguucagggaggacugccuggaggacuccccagggaggauugccuggaggacuccccaugcacuuggagcaucuguuaaacguaaugucacugugacaaaauacccaagaaagucaaggaaagucaaagaaagucgacucauuuugucucauaguucagaaguuucagaccaaugacagguggagccaaugcuuugggccaaaauagugagcuagugcauccaugagcaaggacagacuggugcccuuguagauucugucucccacuugugucucagugugcacaacagaccuuucuuggucuuucagaguccacugcuucagugaucacagcuuuggcugugagaggagagugcacacucuuugacugugaggacacugcuccccuuccccuacggugugacuaaggacaauggcugucauuugggaccaaggaacaguuuaucguuuuggucugugguccuuuaggggagagacuaacaggagccaaguguucucugucaggauggcccuugaggugaaggagccacaaacauccuggggcaugcagaauuggacacaugaacagaagcugggguguuaaguggacacauuguguacagagucagaacaugcuucccagcacacuugcaaaagaacaaacaggguugggagcaugucgccacggcuagcuagcugaggauuugggggaaagcaaccuagagcccccacagccucccuccuucaccagcaagucagagaggauaaugcuugcuuccugcagcuacuuagaagacucacagagauccaaaugccuaacagucagccaaaugccuagcagauagccaggagcuuccucuccuaacugccuccucuucagacucuucaccugucuguagcauaucuccaauaaaaucacaucucuucucaaaagcccuccuggccuccuauugcuaagcagugcuugcacauaugacuuaguccucgggauccugccuguugaagcucucauauccuguguuaugucugccacccgguauauagccacacugagggaugaguguauguguuugcccuuuccucucuucccguacuuuuacucccuugcuuggagaacccuguucucucucuaugcuguagccuaccccggguaagacugaauucaaguacucuauuaaauuccaccuaccccaucccaccccccaguuugucagccaaggagauccucugauuccugucuucacuuacgguuuuucuguaucucuuaugaaacuucugggaaaucaauuuuuuuguggucaaaccuuguuuuuauugccuaugaaguuucuagagucaggauuuuguccucagauaauccacccagcaucaggcucaucaaaugaaugaaugaaugaaugaaugaugaaugaguggcauccauuccuaacuagaccuuccuucaauggaaggcuaucacuuuuucagccauuuauacaugcugguuguuuucugucagcuugccacaaacguagacauauuuaggaagagagacucuucauugagacaaggccuccauaagauuggcccauaggcaauuuugugggguguaguuuggguuauuaaugauauaggagggcacagaucacugagggcaguuucaccccugggaagguggcuccuggauuguuuauggaagcaagaugagaauaccaugaggagaaacccaguaaguagcgcucacccauagacucugccuuucucccugccuucagguucugcucugacauucuucaugacagacuauauucuguaagcugaaauaaacccuuuccucuccaaguuacuuuuaguuaugguguuuaucacaacaauagaaagcaagcuagcauugaacaagcaugaauguuuugguuucaugaacagucauugugauguggacuaaaaacugagaaugcaauaacaaaagagguugcucucaguggggccuuagccauggugaaggcaggaaaggcauggaaagggcaguccugcagcuucuuccaguugugaagccaaggcacaaagcuuuggccugcagccuuugugggcuuaguggaaucuuauaaucugacaaguguuccaucacauaucaucugcccacaucagugaaugugaccaguauuccaacaggauccuuaggaacaaacccaacagaucuagaucguaaaagccacaagucauuugggauagguccugacacagacaccaggcaugcuuuaccuugcccaugagcugagcagaacaaguuaaguugcugaucucuuagaagccucaggggaugauauucucaugaacaagaucuuguaaaucggaauugaguccuuguugguuaguuuuggucaaccuaacagguuagagucacccaggaaaauggaaccucaguugaagaauugccuccaucagauuggcuuaugaacauauuugugaagcaauuucuacacuagugauugguaggugggcauauccuacuguaagcagugcuaccccugggcuguaucagaaaucagggugagcaagcuucuauggcuuaugcuucaguuccugcuuccaaguuccuggccugaguucgugucuugguuuccuucaguauuggauuguaagcuauuagaugaaauaaacauuuuccuccccaaguugucuugaucauagugguugucacagaaagugagagcaaaggauaaagucccagagccauuugagaggcauagaaugagagucauaucguaacuuaguauaucagcuuuaucucuguguguguguguguguguguguguguguguguguguguauguguguguguguguguguguguguauguguguguguguguguguguauguguguguguguguguguguguguguguguguguguguguguucaaguguuccuugucauaguguucuuaugugugcaggugcacagaugcacauguguguaaaggucagaggucagucucgguuguugcuccucagcugcuuuccaguuuuuguuugagucacaguugcucauuggucuggaacuucucaccaaguugguuaggccagccaguuuccagggguuggccugccucugucccccuauucauugcugcuaggaucacagaugcacgaugccagacuuguguguaugugugugugugugugcguguauaaguagguagauaggcaggaagacaaggaaagagggugggaggaagguagacagacagauagauuuuagagauccaaacuuaguccuucaaguaguugggcaaaugcuuuaaggacugggccaucuccucagcccucuaauuugguuuagaagaaguuuuuuguuguuguuguuguuuuguuuuguuuuguuuucuuuucuuuuucuuuuuuuuucuuuuuucuuuuuuuuuuuuuuuuaguuuuucuuccagauuuauuuucauuauucuguagcaggucaugaggucaguagaucuuggcccuggagaggaugggagucccugcacuugggcagagccuggaaaugugccugccugauagcuacucuuuccuuagaauaauuagaauuuacaguagagaaacaucugagacacagggagaguuggcaaauuuucacacuuacaagauuuuuguuuuuaaugggaauuaccaguaauuccucaccuuauaagagacaauaaugacuucuuagcaggguuccaagguauauuuggcaaauauguauucagggaacuucucaaauaauggcuugggaacaaaacucagauaaauuaagugucuugacacccagcucuuugccugaaagcucuuucugcagagggugcuccagagugucuguuauagugcauggaccugcaguucuccagggucugugcucagauuccaauuccuuuugcugaaaucacccaaggcaaaugacuuaaaacauuacagccccucccuucuuuaucagugggguguaauuccuugcacucauuugacaauuuauuguguaaggauaacagugggugcugaugagucaaauucauaggcuuugaauucuaggacaagaaaaaauuucucaugacacccagaucagagaccuaccuaccuuccuuccuuccucccucccucccucccucccccccccauucgaaaauaacuuuauuuggucuaggguguuggccagaguccccuuagaacuucugaaacugcuucuuggugccagcagccuuggugaccuugagcauauugacuugaacauucuugcucaggggccugcacucucuaacagugacaaugucuccaaucuguacauccaugaaacggagacaggugcacagacauguccuugugacacuucucaaaauaauuguauuuucaaauguaauggagauagucccggcagaugacaaugguccucugcaucuucaucuuugucauaacaccagacagaauccgaccucagauggagacauuaccagugaaagggcauuucuugucuagggaggugcccucgauggccucuuugggcgucuugaagccuagaccaacguuuuguaguacugagggagguuuucauugcugguuucuaccagcaaaacacacuucuuauuuugaaaaauuguaggcugcuuuugguaagcacauaccaucugaaugucugccaucuucccagcagccugagaaaaggagagguaggcccacccccggcuuccuuauucaccacaugaggucaaugaucuaacugaggcugagaaagggaaugugauuuuacagagggccagaucagauuucuucaugggagaacccaggcccaagugacucuguagucuacacgguacaucccacagaaguaggucuguuuccuaagccaagugcugaggcuccaagagccaaggugcuucacguauuuucccggcaggccacugauacugucacaagacuagugccuuugggcuucagccccacacugugugccuuccagcucaucacagagcacaggauccucucuauccaucaaacaguugcucuugugcuucaagccuuacacugggcacauguguugcagagaccagcaauauagccucugccuuggagagcuugggucuacaagaaaacauaccugcagguaaugacugacuguaagacaaggugaugacacucauagcaagauaaaugcagcauaggacaaggcucucccaagauccacgggaagcaauggagaugacauguuuauucaaggucuucaggguuagaaccccaacuugcuucacuucauggccaugggacuaggaucaaaccccaugucccaacuaaaauacauuugcaaaaggguucuggggacaagucugagagaaaguauuagggaccaaucaugcuuaaucccucuucuucucuuccucaacagaacccauaccacccuguucucugggauccgauggccuuggagagggggcugcagggcccgaggacaccaacucuucccagagcgcuggcauggagccaggucagucccugucaccuccaaucaucaccuauaagccuggggccuagugagaaacacaauguagaaucuggaaaugcguauacuucucaggcuguguaggaagugcaggagaucaagugaccguggcagugaaccuaauaagaggacaagggaggcugcuaagagauguagcaacuacugcauuuaccuggggaacagaugguagaaucguuguuaggcugaggugccuggccccuuccucaugugucacacacugcaagccugaugaagagggagggguaggugggguugggcauccaacaggaaugaugguggugcuggcagcaaguagguacuauccaggccugaucaggacaacaacgggugugguagaucggagcuugcuuuugcacccaggagaccaggguguauguccuggagcuaguggcgaugccagagucauaguugagccugggaagagagcaguagugggagacugucagaagggguccaagaaggcuccccggaaggcuuucuucauacugccgugcaacuucacaauaugaaguggguaggaaaugcagccgaguugggauaaggcagggcugaguagagaaagugccaagauguuucaagcuggaggaguguggcccggaguaggacagcaucaaacauggaggcagagcccaaugaaggaggcugcagaggcaggaggggaguaagcucuucauuagagauacacugcauggcacuuguaucaaguucugauucuuauucuucaagcagucccauaaggugacauaugggcucuauuggauuccauacugcuggaaucaugaaucaaguccagaaucccagcagauaaacagacugaguuuuuacucacaauaaaggcuuauguagucugguagagagcccugcacaccuccuggaacaaauggcuaccuugguaaccgcugcaguacuuagagcuggaagguguugcccauuaaguacucaggucagaagugacgcacccagccuccuagaucacagucucuuccugacaucuaggguucugugcuauaugggaagcagauaaugaacgaauccuaaucacacuggcuggauuagauaacuacuuccaccuuacagaccagcaauugggagacucagaggcauucgcuguacugccauggggcucccaaaaacaaacugcugggguuuggaugcugcauaaccuuugccugaaacauucauguagccauucaacaaagacauauggaguagucaccauggcccagggaaugacuaaacuggagguggcugaagcauauguaacugcacaagauagcaaguccucugccuugauagaagguucucuaggaggcucugaaaguuuuaacuuuugccuagaaggacagugaaaaugagacuacacguauagaauccugauucacacaucucacuuaacucaccuuacccaggagccaguuuucauggccccauuauuaagauaaguaaacugagugucccacccagguaaaaggggacacaucagcuccuuauccccaucaauaaugacuugaguuccaguauaacaggagcugaauuucucugacuccaccuaaacccuagaaauguggucccacggucuuccuagaagucuucuccaguuaggccuuuccuucccugcuuccuccauaugcccaagauagcauguugcaccgugcagacacugacuuaggucugacagagggagacugaauugcucauccgcauuaugaugccacccacagaguugggccuggaacaaggcuuguugagcucaucuagaugaagggaaggaaggaauauauggucgaaagcucuguaucuggcagcagggggucacacauaaaccuggacauccgagagcuugguacaggaacacucccccuggccuuuccagcuccgucauccaccaccccagccccgcacucuaugcuguauuuacauugucagaucauuucugcccuucccucaugccugugaucaccucugguagacuucuuuccuuucuguguucagaacagaggcgccugucacagcacucuccgcuccuaucacuugccugacaaaaccuccugugacugucuaccucaugcagaucaaaaagaaaagaaaaaaaaaaccccaacaacaaaaccaaaaauaccaccaacaaaaaccuuucuacaggcccuccuuccaccuuggguucuauuugaacccagguccaucucuaggcuccaggcucccaugccacucacuucuuccaaguucccugaagcacagacugcuccugcuuuggagcacugaacaugggccuuccccuaaccuugagaaaacacaucuggaccagggaacaaaaagaagugaaaggcauuguaccugugagcuggcccaugagggugagacgccuuuagcugaagcacacuagcugccuugauggcuguaaagccagggaguugaugagggauguagaagggcaaagccuucccuacccuaucaccuaagggaaaggccacuccucccaggacaguucguucuucuagggaaacauuuaucuccaccugguauauuacuuucuguuaaguuuauuuauuuucagaugucucccaauuagcaucuaaucuccaggagagcagguacuuccuucuuuauaguuuuugaaaugccuucaugcaaagaaggaugcaguaaagacagagugaaugaaugaaugagugagugagugagugaaugaugcaguaaggacagaguaaaugaauaaaugaaugagugaauggugcuauaaagacagaaugacugaaugaacaaaugaaugaaugagugaauaguguagugaagacagaaugaguggaugaauaaaugaaugguugaguggucaguaaagacagugagggaaugaaugaaugagugagugaaauggugcuguaaagauagggugagugaaugaaugaaugagugaauggugcaaugaagacagugaguaaacuaaugaaugaauaagugaaugguucaguaaaggcacacauagugaaugaaugaauaagugagugagugaaugaugcagcaaagacaaugagugaaugaaugaaugaugcaguaaagacggagugagugaaugaaugaacaaacaagugauuggucaacaguuucuacaguugcucacuucccaacaggacagucccaacaggauuugaccaauucugaggccucaagccaagauaccuccaucuucucuccuccauccuucucucugccaguccaagaggcugaacucccugcacaucacauaaguauugucccauccauccucagguccuggacuuugagccugccauacugggaggaccugguuacugcuuguuggccucaucagggcagagaggaacuuucucugcagcuucagcccagagccucuugguuucuccuuuucaaguucccuuugccuggagucaagcacuggggagccccuggcuaucagcuaggcccccuccugcuuaccaccugucucagagcucaggaagaggaggcaaaugggacacuaaugaaauucagagugaaacuaaaucuggagguguugcaaacugcauggaggagggagacaggauuuaaaaggaucugucuggggagccaagguuguaaacagccaggaucaguuucauacagacccaucuuggacagugcaugcagugugacccagcucaagcucuugaucccuaggggugucacuuugcaaucuuuaaauuagagaccuguuaauugauggacugacucauucaagccuucucacuccaaugacaaaaagaguuugaguggauucacaguuuaaagucaauuaauccaauaaucaagacaaaagcauuuaauaaaggcagaacauuaggacaaagagaaggggaagaaagaccagaaagggauguguaggagaugagcugcaagcuguuaucuugaggguggcaaugaccaugugacagguagcuuaggccuugaaccuaaugagcuuugggaaugagacgcucagugguagaguuagggccuuuucagauccgcuguugacucauucaguuacgggucuucacuacuucacaccagggguagcccaggcugugcucucugcggaucucauuaaacucuuuaaaaguucugcaggguggucucuguagccaccaggggaacuggaaucagaggcacagaguugcuuaugcugcccagccuuucuucuaccaaagcuuccaucuccuaccuccuuaagcccggggaagaggauacauuuggggggaggggaaggcugcugugccacuaaaggcuuucacaggaaggugaggaaaccacgaggaggguaagaaaucccauccucacgaggcaagcuuccucaucucaggacauuguuuuauucaauguucccaaaguccgcagagggguuuuuguuuaagccaauuguacguguugagaugcuguuuguuuauuugucauauuaguaauuaacaauuuaaaauauuaaacugguaugcauaacuuaacaugaaauaccaagcuguaaugucagcaucaauagcacauuucuauaaaaacugauucccccccccccccccggggaguuggagaauagaagacuagaacuguauaggaaagcgucacuuuauagcauggcagauuucuuuacugguuggcucauccaaacauguccuugcucuguuuucagucugcaggcuucacguacauucaugagggagugagagggaaaaugaggcuagagcaguuuuggaaauaguuugaucucauagacaaccgagggggucuuggggaccaucagggaucugugcaccuauguuuugaaagucauacagugacacauaagcaccacaggcacauauacuacacauauauaccccacacacacccacauacacacaacacaagcauaucuuuccaagcauaaauuuuaauuauuggaaaguuggacagaaacaccaaaaauguuuauuuuuaccaacuuuucaagucuacuauggcagauucuaaagacagcagccaaucucuacguuugcauugcuuccuuucagugaauaugaccaccguuaagaugcaaacccaagucacuaucaauuagagguacuagggacucugcuauauucaaucaauuggcuagaucguaucagagacauccauucugcuuugucauggcaaccagggaagugaaagaaacugggauagaagguuaguuuggaaaaauaauccuaaauuagacccuugacuucuuguauaaacaauaaaacaaauaagcuucaggaagcuaagaauguacagccccauguagugccagugacgucagccagcaaggaugaacacacauuuaaugaacucuuacugugggucacaucugugguagacaagaugcaaguuuuaccucuaguacaaaagccuauauaucuguguguuuaugacauaggccuuucccuauuuuuaagcugugacucagagaaaaaucuugcucgggaaggcauaagugugacauggugaagucauugcuauuugcuuuguccucuagcaaugacacugggaggaaauggugagucuggucucacagagagccaggcugucacucugaggugggguccuccaagauucaauaguggucaugcuaaccucacguagguuucaggcuuucuucucaggcgcugucucuucccuggcuguguuuccuguauugagucuauaccuccauauucaguggagacuuaggacauccacuaccuucaaugccuccaucaccuuccagcaaauagccuuuaauuaauguucucaggugaacaaaauacauguuuaggcuuagggagaaagagagaacaauuaagcugaguagaaagccaaacauugccccugacugagccugaaguccacaguucugauugaccaaacagacauccccugcaaaggaaccucuucuguugucaaagccuuguuuagaaaucuuucuauucuuaaggccuggcaggguuaagauuagacgccuugaguccagccaguacugcagauguguuugccuagguucccagcccuuucauaucaucuuucauguuaaccuuauuuaccuuauugcacagugggagguguauguguguguguguguguguguguguguguguguguguguguguguguguguguguguguucaaagaaaucacagagacauuuagccacuugcaagcugaaugccuaauucacuuccaacuggaagauuggugucauuauccuuggugaauucaaucgccaaaucauaaggcuugcuucuuguugcuaauugcaccuucaaccacauacuucccugcccaauuugaccaaagcaacugaagcaggaucuaacuacccauuuccaaggcuuuagcccucugguuguauugccuugacuuaccuacuaugaaagaaauauguuuagcuaucuuucuccucucauugccuuucugaaaguuccccugauagaaaagaacaagucaaccagaggcucagaauccuguuccuuugguacuguaacuauaguggaaaaucagugugugcagaaaacacuccaggggugagaagaaacauuuguugagggccuauaagaugucauccagugagcugagcauuucacaguccauuucacccucacaacuacugggagagguaagcauuguuauuucugauucacagauggagcauggagccuuagagagggucaauggcuuaaagucacauagcugggacaugggggaaacuagaauuggcucaaggucauccaccacaaagccccaccucuucccgaugugugggggaaagcaaccaggacaacuagaacuagaacuaccauuuguggggugcccacucuaugccugacuugcgugaacccauuuaaccccgauaaagagcccaugauauuaaacacucaucacccauuugucauaugagaaaaccagggccaagagaagugcuuucagaauggauaauuuucugagaguggcuguuuagaggauaagccccagcaaucugucacuguuugcugcucugucauaaggggcucuuagccaaaucagcaaauaagcaaaggcauugccuauaggacauacuuaguaaucuuggugguugguaauuaauuucguaguuuucuuugcccuggagugauuauucugguugcuacuuguagcccauucuagccagugaguugcccuccacugugcgagacaccuaauaggucagaggaucccagaguguugagcaucgagcauaguuggaagccaugagccauguggcagagagagaagacuuucagaugaccccgauggaggccagucuggacugucaacucuggacucugcgaaaguuauuagagcucuaugguuugguucccuaauguauaacauggauaugugaaguucagacugugcucgauaauuauagggaccgaaauucauguaagaugcuucuagucgugggguggcacaaaaaagaaaagccgaagaugcuucccggugugauagaaugcuuagagaaucagacuuagacgaugacguagaagcccuuuccaucuuagcuugggaacgccaggcuuagagaccggcaauaauuuacccauuauacacagcacacagcauuuuuaagacaacuuguugcuguuguuguuguugucguuuugagaaugaugauaaugaugaugaugaugauaaugacaaugacguuuaugacagauuaucuauguagcccuggcuguccuaaagugugguguacagaccaggguagccuugaacccacggagaucuaccugccacugcuuucugagugcugggauuaaaagucuuaucauuuugguucaccaaggcccaugcugauacugcaagucauacuuagaccccccaguuuuagaaccccaguuugagaagcucauguuucagucugccuugcuucucuggugguguggucuuaguaugaacuuucacaguccuugcaguaugugaacauaccacacccauuauuuuguugccugugucugacugccuuacuacuuaccaagugugggucuggucauuucgguugcuguuucuccugacucuucagaugguggcuccuuuucuuguauacucuuugauuuucaugagagaguucaugauuuggaaauuucucggaggcaugguuugaaaauucacugcugcagaaaggguuugccuuuguucuagaagaaaucaccuuggggcuacuucaaauuaaggauacaguuuggacuuugggauuuugguuuuugggguuuuuuuuuuccuacaaguuaauacauucaagggccauuuuguguuuggaaauucuuagaggaucuuuuguucuuucuccuuaccucuggcagggccauuuuccuugcuguguccuaccacggugugggguucugggcugcucuaauuccugacacacuggaguuaaugaugcugucuucggcccuagcuuuagcugagaaucccagccugucuucccuccuuuugaggcccuggggcuuuguuuccuguguuguugccuuauaacccacagccccaagaccaccauggauggcgagauaccuucagacccaucaucacuucccacacuguguaaccucuguggauggaugguaucuuauguucuuauggccucugaggaucuccuacuucuugccagcuuagcuaugcauuuaaagguaaaugaguguauuaaguaccagaauuacuuggggugaguaggaagcugcaugucuggaaguagaaaccugaaguguucguugcuggccuucccugcuauaaaugggugacuucaucagguaaggcuucccuggucauuacauaauugcuacacaguguaauuuuccuucugaguuaaccuguaagucgagagaauagagccauuucugagccauagaaaccucugucuuucagcauuauuuguuuucguucugaucucgcuuuugcucagucccacugggaccuugaccaccuacagaugucuacaaacagaaacuuguuugcaaaaaaaauaccugcuaaauggccacauucuuaaggaaucccuacauucuguuucugugagccauccggcccacaugguucuugcauaagcagggcaacagugccaggcagugguauuaucacucgguucauuuguucugcaaacauuuucuaagcaccgaaugugggcugugcccauacaagguucuagaauguaccauuggguaaguuacgguccuucucaucauagaaaaaaccacuuagauggaaugcgaucacaauuuggcauugagugugaaaagggaacccacacagcuucggguagagguaccagaugagcuucccagaggauggagaagaugaaaagagcuagaaaagaaaagauagcuggucccucaaaagcaaacacuacucaaagaaauggcccuucugaaucccuuuuaaaguuuugggcugguuuuccaucccagaaacugccauugagagucaccauuuuuaauuuaugucuuuucagaggggcaguacuguuucuaagggguuaaauuguuacuugggaauuaugggugaaaaauauuaguuauuauaaugguuuguguuuccccaagggccacaguauauaaacagacaugcagcacuauggugcuaagacaaacaaacaagaaauggacaggagacagggagggaucaagaaaaacaaguuuaugaaggcuccuugguaaagcuggcagaguaacacugagcagagacacagaggugcugaguuugccuagugucggaaagagcagcagcauuggagucagccacaccuacauucaaaagcucagcccuguugaaagcauauauaaccaaggcaaauucaucacaaugcaccucuguuuccucgucuacaaaguguguguguguguguguguguguguguguguguguguguguguaauccucucuucgccaugugcuugugcggauagcauaaagucacaucugcaaaguccccagcauguagagguaaaugagagaugccucuguucagcccacaaccggcuuguccagggagagaagaugccugagagcucucuuccaugcugccuuaaagacaugcauuguccagagcucuuggcgucaccugggaugggguguggaaugaucugggauauucaagguguugaauccaagugauuugaguggaucuaaguauauaaggauuuuuuucuuggguuuucaguucauuugaagcccucagaucuuugucucugaaacaucaugcaaaccgaagcccaggcaggcaugguacaguuggaggugggcaucuugaagugggaggcacugaagguagcaggcagaguugaugaagaaagauuagguuaacauccccuguacccugaaaaccugcuucccuaucugcaucuuuccugcccaaugaaagccugugagaauuacugaauaaugccuggcauaggcuggacccuugguacaugccugucaauaauaaacuaucuccucccaugacauauaaucagcauugucauuuguugauaacuuguuauuuugaugcauuuuuuucucuucacccucaaaguaacucauccaucaaucuaucaccaccaccaccaccaucaucaucaccaccaccaccccuguugcaaucaagcuuuacuggacuccaauuuacuccauacuauauaaaacaguauguuuucagguuguaucucauucuagaaaguccauuuuacaagaaguguuugacucuaacuugacaaugccccuuuuauaggcagguaaacugaagugcauaugagauuaggcauugccucaggugaacagguuagaaagccaguguaagugcccccuucugugugucuuuuaccccugggcuuaugucccuuuggcugucauggcugcccagagcagggcagaaggcuuauuccauucugaagccaaggagagaagagacagaggaggcuuccccucuagccgugagcagagcugucuuccuccuccaggccugucagagaccccccagcgcagcugccagcccuuauuccugucuggguguguaugucaggugugacaggcaagucaccuuugccacgucagugacauauagaagacagcaugcaggcccauguuccaaagagugaaaggaugucacggggucucccagagccgguagcagggcuucugacaccagcuauuuccucacaagccugucacaagcaagcaacagcgguuaagcauuucuuaaaucucuguauagaacacgucaggacaaaagcccagcagauccagcgugaccuggggugacuugcugcagcucucccugucucuucagccccagucuguacccgcacucacucagucccugcucucucaaccccucucagugucugccaaggaagcacacaggggaagggcagggaggcugcaaacacuggaaacaagcuugcuuagaaauggggaaacaaccugcugcuuuucagagcacagugcaggcggccaguguuggcugugugcuuuccccucgaccuucacgaugggccauuacaggguaggggucguugcaucuuggacgggguguggugcuguguauauucuggaaggagcugcaugggcuggagacaccucgggaucuggccagguuagagggagucuuuacagaaacgucuauucagguaacaauuagcagagcuggagacagagcccagaaccucacugcaaaggccacauucuuuccaucacacagugacaucucagacuggagagaacauguaggcuauggucugucccugucuagcucugugaacucagagcagcagguaagaguucacugcccagucaggagacauguguauuuggcuucucugaugcuacgucuugucugagagacaagaagugggcuccgguccuuggauacugugaauucucuaaaccuugcuccaucuuucuggaccacuggaaggugagcuccugcuagguagacugcccugacauccuagaaucucuuguucuugccucugucccacagcaggagucaucacacuacucuggccacuccagcaugugucccuauucucugggcagauacaggguauuuauggaugucuaugcuggaaguucuuguggguaaggaaauguuugagaguaggagagcccacacuggauguuuguggcauggcucuguuuucucuuucuguucuucccagggcuaugaaagucauaauagauauuugcaaggauuuaggcaaagaagacuaaagccccaagcagagcagugugggagguacacaggaagccagggcuccaccuggcugcucugcaccuggcagaaacagauaguaucugggccucauuaucugcucacuggcaacgaaagucccaaacagcauugaccucauuagaagaagcuucccgccuuugccaucggcauucuguauuccagacuuucaggaagcucucugcugcauucugggucuuucucaaggaccaugggagauuuuauuacgagguuucugugcuccuaugugaggccuagaaccucaaaccgucugguacccaggucgaauuuccuguauaccagaccagaugcucagggccugucccagcauuucugacauccccuuucuccuuccucuguuuuuuuuuuuuuguuuuuguuuuuguuuuuuuuuuuuuguuuuuguuuuuuuuuguuuuuuuuuuuuuuuuuuuugguuuuuuugagacaggguuuaucuguauaguccuggcuguccuggaacucacuuuguagaccaggauggccucgaacucagaaaucugcuugcgucugccucccgagugcugggauuaaaggugugugccaccaugccuggcuaaauuaggccuucuuuaggaugaauaauauggugaaagucuacuacauaccuaccuacccugugcaggugauaagauuuuauagaauuuaccacagacaagcacaauccaaaagaaagagugaauaaaguccuugacuauccaccagcuguguuaguauuuuauacuuccauaagauauuuucaccaaaaaaacugaggaacaugcacaagggacucuaugaauugcuucccacaaaagcauuuauaacuaauuuauaaacuggauuauagcuggauguauaacuauauguuaguuauuuucucguuacugugacaaaacaccugccuaaaagcaucucaagaaagggcuaauuuauuuuggcucucaguucaaggguacagucccucacagcaaagaaggaauaaugguaggcgcuugaggcggcugccauagcaaucaagaggcagagaauugugaauucugcugcucaccucacuuucucuuuuuuacacaguuucacggaguggugccccacauucagaguggguuuuuccuccucaauuaauccugucuagaacucucuuaccaacuugcccagggauguguuuccauggugauuuuaagucccauuauguugauaauuaaagauaagcauuauaaucccagcauacacacacacacacacacacacacacacaauuuuugagucagaguuucccuuuguuauccagcaguccuggaacucagucucuacaccagauuggccucagacucagagacaaagagacagaaagcagcagcaaagaucaugauaccagggcauggugagaaacauuggugacaagaggcaggagaauggagacaagggagaccuucacaguggggaaggccuagaguaaccaugugacagugcuagguucucauggcagcuccaugaacagugcaugcagggggcugcuaagaagugaacaugccaggcucacauuuaccccagacuccgcauaaucuccacuuccuaguuccuucucuaguccacaaugucuucuccucaucuuaguugguggcccaggagcuugugugccauuugauugcaccuuuaccuguccuccagucuaaucauucaccucaccuauuaauucuauccugcagcucucaagucaaucccaauguccuuguugucucccuccagcaucucugcagcagcuuccguguugucuuccuguuuuauagauucuaagcccuguucuuccugguaauucaugauucaguucacucccccuuaagauccuacaauggcaucucuuugcucugaggauggucagaggguuguaggucauuugucgcacccuuauccaucacaggcuacugugagucuuggcuaacuacaccaacuaugccauugagcgcuuaccugucuucucuauccacucugauucucuaagggcagagucuguuuauccagaucaguauccccagcaucuaauaagcauucugauucaugguaacuauccaauaaacucugucucugcuuacauuuggauagucuuggcaauuuucagaacucuuugcccaguuaucucuuucuuuggcccucaucucugguaacuuacaaauaggaaacccaagacucagagaugacaaaggguggucuaaaggcccaacaguacaugcaaaugacagggcuagacuggcaauaagucuugcagaggaguuauuaccagaaucucauaaauaaagcacagcaaguugcuauuuccuaugacucccaaagucacuccuagaucagcagccucggcauuauugcuaucaaugcaugcccgugggcuggagaucucucaguggguaaagcacuucugcacaacugaagaccugaguuuagaucuccggcacccacacacaaaagccagacacaguguaugcauuuguaugcaucuguaacucuggcacuagggagacaggcagauccagaucacauagucaacaaguucccgguucagugagcggcccugucuaaaagaaacacaagguggagagcaauugaugaagacaucuaauguuaaugcuaaccccgacacaugcauacacaaguuuguaggugugugagugcaugugauagaauaucaagugcucagaucuaaacuccuuaacuaccaccauccagguuggguucucugugcuacauugcugaguucuucugggccagguagaaccaaagcucucuccuacagauccucugcagcuuucaauuaggucaaaagccauuugagggauaaucauuccuaucugagugugcucugccaagacagauuacuggagugucucuccuugaugagucugggcauuaaggcaaccagaaccugaguccccugaaaugccccaggccaaacagucucccagcaaggacagaaacuauuagugacaagcagaaaguucaaaggcugugacuacgccugaagcaacaguuuuguccuuuccugcccccaccuugacuuugaaccacugucacgaaagaucaacugaaacuugaaaagcaucuauguggcagcugagccccacagugaugagauacaagccuaagaggucuggccuacgucacucugauacaugaccuuggaugaacuuugucuuucuagauauguuuggcucuggugaccuaucucugaggcccccuuccagcuuugagguugaaaaucauagcauuuucuugcaggacauuuggacacugguugcaaugugggucugaagaaacuuccccccaguuucauucagggaggucagugggacguggucagcuuauaccacaggagauuccccaaacuccaacccuugaaacuuaagaaugugucaucucugagagaugaugaaagcagagauggccguuuucucuugagaccuccugagucucagaggcucuggcucucaagggcuuuaagggucaccuugcacuuucuauucugcccauccagucuuguccagacaucugguucucaaauugcaugguguacuucuaacccccagggagugagcaaugcuauacccccagaguuucugcuucaguaacucggagacgaaccacuagauaguucguuucuaguguguucccaagaugagauaggacauuucuaaaguacucccaugugagguuguugcagccuugaggguaacagugaaaacggauacucugccacaugguccccagagaccucuggugacaccucguucucuuccaggugucuccuccacucuuuggcagcugucccuggaaguaguuugaaaccuaucuccuugcuuauuuuaccugcuuagaguccacagcaagucacacugcuuggacaugauggcaguggucuuuggcacuauugucaaguucuugguucaggauuuuauaugcauguuaccagcucucuauucuuguggggagugggggacguuguucuuuccaccuuacaaggucauuacaauauaaaacaaaaccugugagauaacuuugugaucauauacacugauaagaauuuaguuucuauuuuuaagcuuuaauauuuguuagcuagaacuucugccuuaugauaccucagagcagaacagaguaacugauuacacacacacacacacacacacacacacacacacacacacacacacacacacacacacacacaguugugggagguuauaucugugaucacaguguuggcaaguuuggauucuuaugagcccuuuaccuuucuuugcagaggaucgccuucuugugcuguccucaccuguuugucucccaccuguguggugucugugucauaaccucuucuucuuuaggacaccagucagcauggauuaaagacacacaucugccuucauuucaacccagugaccucuuuaaugauuuucuaaaugcagccaugucuaaauuacuagggacaagaucuucuacacaugaauauagaggaaaaguguaucaauucuauaauucaauguugaggaauagcugugugacuauaaaggaguuacuuaaccucucugagccaucuuuuuuugccaucaaggccaagaacauaacacuuucaagcacaguaagagguuuuaaauagggaagagaccagauuuggagaagaaauauuauuaggauggacucugcuggaucaaacagggucuccuuguuugggcaucucugaaagcuagaaaugaggcuguagcccacaccgcagagggagucuacagaaucaccauguggagugacauguuccggagcuucaugucauauauguggcaguagagguaaaaggcucacucugaagaagaucccagaagggaagcccagagccugugaccucccaauccccauuuaccacuucacccagggaggcugcugucaucugcucucugaauucuagaauuuucuggagagggagccugugguagacuuuagaaauaagcauaaugucuaccaugagaaggaauaagguaauuuuagucacuguuauaguuuaauagaauacaacauuauucauuguauuguguucuugucagcaauccucaagcaguuauuaggaaagugucugcacuuuacccuugucacaaccuaugaugguggucacuacuccugacccacuucagagaugugaacacuaaggcucagcaucucuggcuacagcccaggacauaaaguaagaucauuccagagcaaacucauaugcuucaucuuuauaccaugcucaguuuagguccugaugcagaagaguaugaaugauauaggaaggugccuuugaugugauauucaguggggguggggccaugaagcauggucucaguuaugcaaauagauaugcggagaguauguguauacaugguguaugguauauauguguguguguguguguggucaugugugcaugugcuacaugauaugugugggguauauguguaugugguuugcaugcauaugcuauguacauguguguagugugugacagcaugcgagcacaugugaacgcuugugugugcaugguacaguucugagggcagagagaaagaauagucaguuguuauuucuggaugaaggauuaccauuugauguuuuccauauuaccuaaaauaaugaauaauggauuuguuuuuuaagugcaaaguaaaggauucauagagagagaaacugaguaagaacccuaagcccugccucccucgacagauauucaugauaccuagcaacccaucacuacccagccccuggcucuuuccaaaggauucuggccugacgcugagagacaggagugaggaagcacaccugauugagguucuauuuuugaaggaggccugcacugccauccccagagacggaucacaauauuucccugaauaaccacggcuauuuuuagaggcugccguugagcugcaccccaggagugcggacgggaacuguaggaugcuucugaagacccugcagauccagccucaguugcucaucaugcucugugcuccuggugcugugcagcucccgcuguucugugcgcuaugagagcaugggcagcugggaagcuggccccagggccacucccccuuccuguguggcaucuuccuuguaggcugcuagcccugagaguauaagaacugguuggauucaucaucuaccccccugccacugcaggaaaacaagaggggauuauuguucgagugugaagccucaaagacaggcuugcaagaauuauuagcgacagacagcaaucagcagaguucagagcuggguagacucauggauucuuuacucugagggccccuucuccagccauugacuuggauguccuggucagccugagaugcagacgccaagucaaggugcacuuccccugagaaagcuuuagucuguucuaggcuguugacuucuuugcucuaagaagucucacgugcccugcccagcaugcccggugccuaaugggaguuaacaacagagguaaacguguacuguugcuuccuaugcauguacugcacggucagguauauuguuucuccugguuuauggaugugggaucuaaaacaaugucuggcaugauugcuaucaugugguuaugugcuccuugcugugguccaugugcucauucaagugguucuacacaagcuaauuaguuuaaucuaaucuucaccaaagcccucauuaucauuucugcuuuagagauggaggucagagagguuaaguauauaacccaaggccacagagcuucuaagagucugaggugguguuugaaccugcccucuccaggucccaaggucauguuccucacuccccuugcuaccagcacuguucucucucccauuauucccgugacuguggggaauguggaacccugccuaccgucagggcucuuccaaggccacucucuccuccuagucacuguguuucuggugcucuaagucaagguugcugcucaagagaccuuccuuccucuggccaguucagcacauuuuaccacauggucuccuagcagcccaucuguccugcacuuagaaacagaggcuccaggggcaggauggcacugcuguccucagcuaccuacccugaauguuguugcuuggcugggaagcccaugaaauaggcugggaauuccaguuccuuuagaaggcaaagcugugcauaaauguaaggacagggugggggcuucucaccuacucaccagcuuacccuggaaagcuuaggugccuccuagcaaaccagaaagcaccccauacauacacuugcauaacacaaauguaccacuugcaaacacauaccacacacacacacacacacacacacagucacucaccacauacacacacaauauacacaccacacacacacacauauacacaaaccacauaaacacauacagaccacacacauacaacacaaacauucccccccacacacacaucacacauacaccacaccucucucucucucucucucucucucuuacacacacacacacauacacacacacacacacacacacacacacacacacacacacacacaccugcauacccauugccaaacugguagggucagaaccuuugguuugagauuuucacuuucccuagcuugaucugugagauggugcuuugaaggccaaggcacccacagagagagagcccuucugagaaagugaaaccaagcacggugugguaaugcaaagccugugaucacaaggggaggacugcaaguuggggcuacauagacagaacguuaucaagaagaagagugggggaagggagagguaggaauggggaggagaaggaagaaaagugagggagaaaaucagacaugcauagcccaacucagucacuccacacacaccagagaccuaauucaggaggcucacagaccccuguggucugacgauggccucuauuccuuaccacuuaaagaugagcgacaauuacgguacgcugagcacacguucagaacguuauccuauuagccugcaucacuagcuaaugccacugccuuuauacagaaggagacccaaauuagagucaugugguagggacuugggccucuaugaagaguccgagccuguguucugcaaagacccacagagccaaaguguugcccacagagcugcacagccacagaauuacauacuucucuguuucuucuucccugaaccugguacaggugggaaagcuucugccugugugacuaacaagacucggagauagaaaacuauccugacuggaagcccucaguauucugugauaggguuuaggagaaagccaggauuccccccauuggggcccccagcaaaacaaugcauuuuaaauggcuccaaaauugcuaagcuauuucacugcuucagaggagaaauggcuugggggaagcuauuggcccuuuaugccuugaacaucaaaacaaaaugccaaaugggaaaaugaaauaacaggaggucgggagaguagggaagauuaugugggaagagucugugugaggcggagggaggguguugaaccugggauucugcgagaaucuguagaagacugugcuucacucugcucaugaucuugggcucuggugauccagggucaagaccugccugggcucuggugguccuccaugugacucacacacucaugccuguaaaaccuuaguguuaacccuugcaugcaaggcacuggugagggaagguugaaaaaugcuaucuucagggguuucuaguucagcuggccugguguuggucccucaagagacaucuugagagcuguccacacgugacucaagagggccaaaccucuacuggccacuccccacucuuucugagccuguaucuucacccaucaaaugggguuaccugaggaaacaacccuagugccuuccagggagccaaagagaucucugaguaggugggaacaggcccagccuguuucuagucauaccuuugacucugagaagagccaaugccaaaccuguuuucuaguuggcauaguugggaagaggagcugcuguuggguuggcauggagcccugagaacacagaauaugauuucuuucggcuggaaaacccauuuuuaaaaaccuccaaaauugaaauuggcugcuuacaacccaaggggaucugagacauacucccugccucccucccacccacccccaccuccacaguuguaucccagaaagagguaggaccucaauccugggaaaaggcaccugguaaaacuguauagaaaguucuagaaaugcagauugagcaugugcugggccagcagccucacagcugagccacaaaucccuagcccauaaaaagaagaagaaagggauauuguagcuucgaaaacauccugcuugcugaagagccugggauugggagagaagagaugaagaccacgugagaccaugaccgugucaggaggagaugugucacccuggagacauccucgguagcaauucucaauccacaccugagcugucuugugugcagcuggguuaacaagaauuacuucugacagaacaccaggaaggacuaaccagaaacugccacgguuucccacaacagcacuggguaacugaguuggaccugaagcccaaggggcuacagaaccagcccacaguuaggcuggggucuggaugauguugugacgccuuggcaacacuuccuaacuuaucuucucagcaacccuguaaaauaagagagaauguccuuaucuuuauuuuuugagucucauauagcucagccaacauauauacuggccucaaacucacuccaguagccaacaauaaccuugaacauuuuaucccucuggcccuaccucuggaguacuggaggaguggcucacaggcauaugccaccacacucaauuuuauguggugcugccgauuuuuugcucaaacacugggccagcuggguaagcuuucauuuucaucuccuuuaauuuccuugugaggugcagagaggaccauguaccucccagccuccugcgagacuaaggagacaacugucccuggcccuuggccccaugcugucaugcucagucaaugccagcugcugcugcgugcugagggacacuuucaggcucacagacgcuaauuaucagaaaguacagaagccacacaaccauccucucuggaggcagauggucaaagaaaacaagcgucacugagcaaguaguggaagggccagccaguucagucccaugcucauagccacagagagugugacuccguaagaccuagggagaaggaaaacauuaaguggguaacucuaauggcgaaguuaucaguaguggucguggugguggugguaggugggaaaucucucuguguaugacaccauucuuuucucugcuuacuugggagcuggggagcuugggaggaaaagaccacuggguuuaggaauucuccucagguuauuccuuauacuuccuucuacauccucaccuagccuuagccuugcugggaaccguacaagcaaggauugaggaacuguggcaggagacggcuaucagcagagguagaaaccucugcuggaaaaauaaccauccccucuccauuauucuccaaagcauugucugcaugcccgaggugcucugauguaggcuugauacucaaaaucuucuuuuaaacucuaauuacaauugaaauugcuuugcaacacaggaaaacaguaccauaguccugagucgcacuauucauguugacuauuaacaucuuuuuuauuagguauuuucuucauuuacauuuccagugcuaucccaaaagucccccauacccucccaccccucuccccuacccacccacucccacuucuuggcccuggcguuccccuauacugaggcauauaaaguuugcaagaccaaugggccucucuuuccaaugauggcugacuaagccaucuucugauacauaugcagcuagagacaggagcuccgggggguacugguuaguucauauuguuguuccaccuauaggguugcagaucccuuuaguuccuuggguacuuucucuagcuccuccauugggggccugugauccauccaauagcuaacugugaguauccacuucucuguuugcuaggccccagcauagucucacaagagacagcuauaucaagguccuuucagcaaaaucuugcugguguaugcaauggugucagcguuuggaggcugauuaugggauggauccccggauauggcagucucuagauggucuguccuuucuuuucagcuccaaacuuugucucuguaacuccuuccauggguguuuuguucccaauucuaagaaggggcaaaguguccacacuuuggucuuuguucuucuugaguuucaugaguuucccaaauuauaucuuauaucuuggguauucuaaguauauggucuaauauccacuuaucagugaguacauaugugaguuuuuuugugauuggguuaccucacucaggacccuccagguccauccauugacuacuuacauuuuuuagcauuuccuuccacauucauucuacuaaagccuguauuucaguauugagggguugccuguauugagucuucaggauguuucuuauagaaguagagauaguauuguguaaauucaaugcauacucugaauauaaacaugaauaaugagcaccuacucuuuuccccgaccuugagccucaaggaaaaaauaagucuaaguacuuauggccuucaagaaaggguaaggagaggaaagagaaguugcuauugacaggauacagggacacacuguguaccuuuuaucucuuugaaaccuguugcaaacucagaaccaagcugagacuugggauggaaagucaagcacguagggcacuuucaguaguagucuacaagaggaaaaaaauaagagccuaugccugucuagcaggcuaaucugaacaucucuucgaauaucaccaugauaaccugcaaacaagacauacaugucugagcaaacccacaguguggauggagcuacaggauauuuagauacacacacacauacacacacacauauaugcauauauauauauauauauauauauauauauauauauauauauauauacauauacacacacacacacacacacacacacacacacacacacacacacacacacauauauauauauauuuuccucccaaauuaaauagaaggaacagggagaagagcaagugcuuggacagaagguuccaaaagguugcccagagagagugccauuucuauagauugcugucuucauucugcuggaggucaccaauaauacagaaggugaucauugccaucaguaaucucauucugccuaccacuggcuccgaaguuccacagugcucuguaguuugagcccagaaaugggaccaugaggguggcccaacauauguuuugccccuacaaaaacccauagaacuuaaacagcuucuagcacuacccuugccaggccucucugauauuauucaugccaacuguggaguccagucaauauuagcuuugguuuucauucagaucaaagcaaaauccauuucacaaauauuuauuaaggcccaacagguuuuuuuacacuggcaguguugucuagguuuuaucaguuggggaucagggcucacuguugucuuugcagugauuuucaaagcaacauccauuaacccuugaaguuuaauaacucaucauucuguuuuccuaaggagacggucuuuuuagauucuuagauuccuaggaauguguuaguggaauucccaaauccuaaucaccaguaaaugucacucuaauucacuguauccagugagacuuaaacgcaccuguagugucuugcuacuacugaaaagggaagaucuaaaaagccuugguaggugauauacaguggguacauuucugucuuggggaagcaaaauugaagugcccuggaacccugcuauuugcaaauaagcaaaacugcaaauaagcugcccuggcugccauaaacggggcugccaugcacggggugguucguguggcugacauugauuuccuacaaguucuggagacugaaugucuguggucggggugucaaguguggcauucccuuccaaggccucucuccuuggcuagcuguugucuuugagugucuucucaguaccuccgucugugugucugugcuugucuccuccucucacagggacacaucauauucuagaguagggucauuggcaagucugcacuuuuccugcaucaucauuuugaaggcccuguguacagucaauuccagauaccagggauuagggcuccaucauaggaacuuagugaagggggacauuuggcccuuaacaaacuguacguaccugagggggugacucaggaggggaccacacaaugccaauucguggaaaccuauugcacuuauaacuuggucuuaauucaaaccacuaucgacagaagguuauuuaggaagcacuuucuggcugaucaggcccaggauuaauuauuaagaauccauccaugggccaaggaggaguugcggacacuacauuagcgaguagcagacccacguggucgccucuucucucugacagauagcaagaaguucuguuuuauuuauacacacagcuauucuuagucuugcacuucucauucucugugcaggagaagggauuauuguaaccacugcauuucaaacccuucuugucauucaauuaauaaacagaguucaggucacuacauuggaguucaagggcuggggaucaucuuaacucccaagcuuaucagucuguuagaguugugugugugugaaacuuugucucccaagguuuggagagaaaagugggaagauguaacaucagugagaaagaaaagcccccgugacaauuuuucuuuuuuauuaauaaucguacuuauucuuugacguuuucauauauguauacaaaguaucuugauuauauacacugccuacucccuuucacacuccucuagaccaucccuccaacacauuccucuuccaccuucaucuccucuucucuuuaaauauauauaaccccguugagucuaguuaauguuguccaugugcacacgagugugggacuauccacugagcauaggcaaccuacuagugaccacauccagaagaaaagugacuccaucucccagcagccauuaacugccaauagguccugagcuagaaguggggggccucauguccccucuuccauccaugcuagaauauugacuagcuugaucuugugcagucuugugcacgcaaccacggcucuaugacuucaugaguggcauggcuaugucauuuccagaagacaguaucuuacaggacacucuucuccaucuucuauuucuuacacuuuuuucuuccucucuuuccuuguguucccuuuggccagugaugauucuacuuauaacugcuucucuagaugaacaagaggcuucucugaccaaggugaaaaaucaucacuaaucuaugggcaucaucguagucuaucauuaucauaauaugcaagggcuaucacugaguacgauuuuuguugcauucuuacucccacagccuuuugguaauaugaaagcuagccaacagcaaagauguuucuaagucaguugacacugagcuucucuauguccugaaacccaaguguguggucucuucagcaauaguaucuuaacauccagauauuguagaaaaccaagagaaaugccaauagccuauguuguuuugagaucucugugcccucccuggccaguaacucauaagaagguaccuuaugccuagcacagagauuuuuguuuaguaacacaggucuucugguaguaagacuguccacuucugcagguuacccccuuguaagcaccuuuaaauauauguguguguauaugcaaacaaacaacacacacacacacaugcacauacacauguacacacacauauauuaguuugcacuuuuucauauguguaugucuauauacauacacacauauguccauacauacauacaugcaugcauacauacacacauaaauuuguucacaaaguaguggacuuccauuagacuuuuuuuuaaugccaugguaguuuuuauuuuauuuuauuuauaugaauacacuguagcugucuucagacacaccagaagagggcaucggaucccauuacagaugguugugaaccaccaugugguugcugggaauugaacucaggaccucuggaagaguggucagugcucuuagcugcugagcccucucuccagcucuccauuagacuuuucauacaucuuuaauuuugguuaacccaucuaaacucccucuuuugcccuaucccucauuaccauuccugcuuaaacauuaacuaccaauauucacucccucuguuuucacaucauaugugcucucuuagccccucuuaaguccucuugugacuacuuucugcuucuugacuucuccagacacuccaaguuaaauauacaagaaauauauaagucuaagaaguaaaagcuaggauccacauaugauagagaucacauggcauuugguuuucugacgccggccuuaucuuaguaaaauaaaaauucaguuccauuuauuuuccugcagauuuuuaaauuuuacuuuuuuguuagggcucaauaaaauccuauuuugucuauguaccacaaguuccuagagccucuacuguagugacgggucugaacaauugcuuggugaauauauuugauuauuauuaaagauuuugcagguggcugaauugagaacagggcuuuuaacuuuucuacucacaacuccuauuugcccaagaaaauguaugugaccucaggucuacagguauacaaauaguuaugcaaaucaaacaaacugauaaugaauuauacauaaguguauuuuaaaacaaugguuuggugcauauaacuucaccauuuauuaaagaugagaggcaaucugcauggcaacgagguggauuugccuauuuauuuuauacaaacagcuaaaccucaccugaauauuugauagugaggauguaaagcauugaucuggauuuugguuuuauaauugccauuccugagagugccacuucacauaaacauauagccccaaauggcagaggucuguauagagauauuuaaaaaauggaccaaaauccuguccugaucccuaaccaaaauucacugacuguuuuuuuaaugaaacucaagucagcaacucaaacagcgguuucuuuuagacuuacucauuuuauguguaugaaauggcuugccuucauguauaucuguguaucacaugcaugcuuucuguccucugaagucagaagagggcauuggauccuugaaacuggaguuucugaugcagaugaaccaccaugcggaggcagagaauugaaucccaguuuucugcaagaguuacuaguccguccucuuaacugcucaaacaauuuuaaaaaucagacauuuaaacauaauaucaugcccaaaauauacugcuuugaaaccugcaugcugaggaaugggaguaggaaaauuucuauaauuaagccauuauguuucuguuagauggggaagcuuuguguaugcaguaaaaacacugcauuuucuagcaugcaguggucuuaagucugagccaggguguuuuaaacaguggcuauggcacaguguggccagaucucaugagcaauucacagugcucauuuugugaacucagaccaagguugccaugaagcagugugacccaggccaguccugcuacuaacaccuuggauuuauguguugaacugaaaauaaaucaauuuuuuguuguuguauauucaaccaacuuuuaugacugccauuuuuuuucaugacauccccauuccauugugcaugucacagggugucauuuacugugcauacacacacacacacacacacacacacacacacaaaauuccacaauuuccauccuaaacauccaacucaucacuaccuuugccaacagcuagcuaacaugaggcuucuugcaggaguauuacuuacccaauaugugagggaauucuuaaagggaauucaguauuuaaaaaaagaaaauauaucuugcaguuagaacuagauucagucccuaguuugucccuuaucuuagccauacucuuuucuaccaaucucugacauuuugucuuuagaauugagaauugagauuuuuuuuuuuauucacuagucaaaauggcuaggaaaagaaaaccuacuguuucguacaacauaccagauugagucacagaaaagacacucagccaugcugucgucauugcuguggcucaggccgucacaucaccucauuugcagauguuaaaggaacucuaucaggagggauucugagaaggagagaugcugcguggagcuaaacuucuugucuucccaacugaugcucugcucugucuacuacacacauuaggcaguaaucaacaacugaugcuuugucuacuacacacauuaggcagcaauccccccuuuccauagccucaguagcuacucucuaacuuuaugucucugugaauuugauaaucagcuauaguuagaaucacacacacuuuauaguuagaauccuuuuccccagcuuuaucucacuugacaaacucuaaauuccauucauguuguggcaaagacagaaaugucuuucucucugagaccaaacaauagcccaccauguguguaugcagugugucuucccuauuuagucuuuugggugggcuccuggauuacuucaucuuugaccacuacugcugccaugaacaccuguguaugaauaucucguuacaucccuaucucaguucuuuuugaucauauacccacagggggauuguuggauuuuugagaucuguuguuaauuuuagucuuuauugcugaaucagcacauucauugcgcauugccugcagcaucuugcauucugaucaacaguauacaggacuucugguuuucccacuuccuuugaagugaauaucuagugguuucuguauuccaggcccacuuaccuaaugacggugcuguucacacuggccugagcccuccuauaucaauuaauaaucaagauggucccccuaaagacaugcccacugaccagugugcucuaggcaauaccucugucaaggcuuuccccucagaugauucuaguccuaguuggcaugacaguuaaagcuaauuaggauacuuucuuuuuuaucuguuuucugcuuuuugcuccuuuccgaagaccaacugcuugucugugggugagcucugggcucugcagacuguacuguugacuuauuugucuacucuguuaccaguaccgcacucccuugguuaguauaaauagguaguuagucuugaaguuaguuuuaaauguugguuucucuaaauuuucaccuuuucauauaaaucaccaaucaguuugucauuauccacuauucuugcuaaaacaugguugagggggugcucaaccuacagguaaagcuuagcaaauaccuuugaaacauuuuucgagacaggguuucucuguauagcucuggcuguccuggaacucacucuguagaccaggcuggccucgaacuuagaaauccgccugccucugccucccaaacgcuggguuaaaggaaugugccaccaccgcccagcgagucuccuuuuuuaaaacggaaucaucuccccaaucauuuaguucuuuucugauuucuucuauuaaccuuuuguuugucucuauguuauugcuguauauaguugaaaauguauguaaauauuuguauuuuuguauauaauuuuucuauuuauacaaauaucaauuggaauguauauuuaaauuucacaucuucccuggucauugcggguacauaagaaaagcuccucuccguaaacugcccuaugucuugcaacuuugcuauucauuugcuuauaaguucuaggagguuuguaucagcuugucugguuuuuugguuuggagguuuuugucuguuuagucgguuguuugguuuuuaguuguuuugguuuacugagacaggguuucucuguguaaccacucuggcuguccuggaacucucuauguagacuaggcugaccuugaacucacagagaucugucugcuucugcuuccauaguacaccaccaugccaggcuuuaaacacaucaucuguuguguuauccaagguuuccaauacaauauugaaaacuguggccagagaaaaauccuugccugguuccuggcagaauagccuucucguuauuaccugugacguuaccugucauucuuugaagauauccuuuaucagagugaagacacccccucccguuuuucaguugacugugauaagccucucacaaauacauauugaauuuugucaaauucuuucucugaauuuguauauguaauuaugugauaguuaaccuguuaaugugauagauuaaguaacugauuuuuaaaguugaaccacccuuguauaguuggagggaaccccaugcuuuaugaucuauaauuaucuuuguguauuauucagcuugguuugcuaauaugcuaauauuuggcagggauuuuuuuuuaaaucuaugcucauaagagauauuggucuucaguuuucuuguaaugucuuuguugguuuuggcauugagguaaggcuggucuuacugaaugagcugggaaugacccucuugauuguuacauagagccccaugggauacuggccagauccuggcuuucaggcugagauaggaaccuuuagaagucuuaagcaaagaaguaagucguaggagacaaacagacagaggggacaaaguaacauaaagguguuggccuuggcaaaauaaguaauaucauggccagagauggagaagagaaaggagagucagcagcucuuuaugcaguugcuaugagcaaggcugugcuguuuuaguggaugcuugaacuuagggguggggagaggugaaggcuauagguuuuuucaaggagucgcauaugaauagagaaguugugugugugugugugucugucugucccacacuacuuagggagucucuagcguguuucuuuguccucucaguuucucucauaugcuccacacagucuaccaucauuaaugccauuucuacuuuccacacuacacuaaggaucaggacacaagcugucacuuccccccuaucuguuaucguucaccugcauggcuccauuaacacugcuagcuucuucaggugcuuccugcuuccuucuugcuccucuuuauucuguucuauguccccaucuucugcuuacaaccuucuaaagcagugguccucaaccuuccuaaugaugcaacccuuucauacacuuccucauaagccauaaaaugguuuuucuugcuacuucauaacuguaacuuggcuacuguuaugaaucauaguguaaguauguaggauaucugauaugugacuccugugaaagagucguuugacuucaaagggguugauagccacagacugauaaccgcucuguucuaaagauucccaucacagaguaaaagccaaaaucugccucauauacuacaaggcucuacauaaggaucacacuggucccauccugugcugggggcucuuccucugcucucuauaccccaguucugcuacaucagccuccucaccagccuucgaacauaccagucucuccugccaccuccuuuugugccuacuagagcagaauucggagguccucugcaagcccauccuagauuaauucuucaccuccucggaguggccuuuaucaaccuuacugaggaacagaacucugauauccccucacugccccuucaaugucccuuuacugaccgcccccuucugcucuacuuuccucugacacugacugacaccugcugugaccuauacucgcuuucaguucugcuuuagacccaagguuaugauaacuguuuugucagcuccaugcuuggaccuggcccuacauuaucagguacagaugcccaaggaaccuuuuaugagagaagagaaaagaaauaaauugaagagcagagagaagucagcacccaccugcaggacgaugggugugccaaucucugaaagucacgaaagcuggagaggacccgcaaaccccaagccauccugugccaggaaagcacucaugugaccagacuguauucggugcauuuauaaaauucccauuggaacauuaaaauagucacagugcuugucuagagguguuuuaaaggcucauucaaagcagccauccuaagucugggaggcuucuggcaagcuugccccaggagagucaagaugcuuugucucuauguuaugaagaugaggcuggcagggaaggggcagucagaggcagaaccacaguaagaauccagcggggaagccauagaaggguuaaugucagaggugauagugauagugugaacuucauccggaaaccaaaaggguaagcaagugcucuccuccaccagccugcuuccuggaugccagcaucaugcccuauuuccugccuuuccuuccugaaugacuaaaauacaugugaugcaugcacaaccuaacucugcacuaugguuacugagaaggugcgacgcaguacaccucacucacucugauggccacacacauaagagcuugucuucacacucauagaugcucaugcaguucuguacuagcuaauuuccuucccgagucuucuggaagcagaggcagagggaaaaugagagaguaaauaauugggagccuaauaauuaaaaguacuauugagaaaggaugucucuugaaucuuucuguuuuaauuguuuuuuuuuuaaauauaacugacauagaugucucugagaagauaucgcugauugacagccuauuugguuauuaauaacauguuaucaaucugcuaggaauacauuucguguucgggggagggcauaucugaacaagacugcuggaguacuggcaacagucucagaucgggacacaugucugccuuguggagaggcagagaacccugcacagaacuggaauuagcaggauaaaacagacagugggccuggggaucccaaugagucgaguaucaaggauuugaaaugccagccuccuccagggagaccagagccguugcuuaaauaucuagcuuuacaggcuguguguuuuguaaaauuggaggcugcuaauaagcaguuccuggauaacaugucucuaaaauuaugcuaggugguuuugaaaacuaugcuuuauuuugauauuuucucacuaguaaaacuauuuauucuugagguuuucgaaaguacggauaagcaaaugggagaaaaugagccacauuaacaaaagcauugcugauguguaggcaaguacacgcaguuaaagaaaagguguaggcaaauuaaacuuagaguuuauuagagcaaacugcaccccaugagccaugcaacacucagaguccuugccuggcugccugaauaaaauagcagaauuuggaagaucugaaauaaaagcaaagucaggaaacuaccugccugguugcagucuggcaucugccuguggggcgcgugguguguugagcuggcuggcucugauuggcugaaaccagaugcuuauggcuggcugaaacuugguuguucuuauauuuauaaugaagagucgucaguaguugguauauaagauuuggaaguacaggaacacccucaggcaaacaucuuugugcuucuuuaauauguucagcuagucuugugaucuucuguuucauugaccaauauacauaucuuucccuguauuuccaguauuuaccuacacaaugagucauuuugugugguugcauaguauuccaugccagggaaagucgaaguucaucuccguuuuucuuccuauugucucuguauucugcucaguguagaugcaaugccuccucugagacuccagcagcuggcacucaaagacucuuaaagauucuacagacuccuaggcacuuguaccagugacucagcauuucuguaccccuaggcaccucuuuaugcaaauucaaggaugauuagaauaucuggaauuuaacauuuuucaggauauuuugacaaacugaccucugaauaauuauuuuugccuuauaaagaauuucauuguguccagaaucauuagauaaaauaauaaugaacuauuacuacugaccugcuuggcaaacugcucaauaauucuuugcucuuuucuuuucuuuuuuuuuuuuucuuaauuucuuucuuuuuccuuuucccccuuuuucugaaaaucgauucuucccucacauaucuuuaguaugguucccucccucuccuccucccaguucuuuccacaccucccuucccacccagauccacuuccuuucugucucucauuagaaaagaagaggcuucuaagggauaauaauaaaaucuaacaaaagaaaauauuagacgauaaaaaugaaaacucucacauggacaggacaaaccaacaguaggaaaagagcccaagagaaggcacacgaaucagagucucacucacuugcacacucaggaaucacauaaaaacacuaaaccggaagccauaauauaaacacagaggcucaggugcaggcccuaugcagguugcuucagucucugugagccucuucccaccuccucuuccaugggguucccugagcucugagaggagggauuugaugaaaacaucccauuuagaauuguguguaaugccuggcugugggucucuguauuugucccgucugcugcaggagggaaccucucugacgauggcugaacagggcacugaucugaguacagcagaauaacauuagggcucauuuuaucacucuguuucccacuuuuuuguuuuauuguuuuuaagaccaguauuacuugguuuuacccgagguccuugggauauccagucuucaauucuugguuaucgcacaccaauaagaaguauugaauguagguucuaccugauagagugggccuucaaucaaauuagauauggguuggcuacucccacaagcuuucuggcaccauugcccuaguauaucuugcaagagguacaccauugugaaugaaaggguuugugacuggcacaguguauaucuuuccauuuugguacugugcaggaaggguaucuuccgguaccaaagauuuuggggaaggcucuaaguagguaccaguacaaccacucagaagucaaugaguuagauagcuguuaucuucagcaauggggccuugggaauguauuuuuagaaagagagaaagauccguuugaagucaaagaaagacagaccugaacauaaugguugacauggagcuguccuauauuaaucagguccuagcaaaaaaauccuuuacaccaucauaugagguucucaggcuggggagggggaaaaugauguuaagcauagggagaaguaaggacagccacuaaaguuagugaaacagcuaagaaacuauccuccgaggcucaauggacagagaaaagggcagguacuggccuaggagacaguuguaucuguaguuaugacucaaccagggagauggggagaugaugucucagagguuaagagcacuggcugcucuuccagagguucugaguucaauucauagcaaccacuuaguaacucauaaccaucuauaaugugaucugguaauauauaauaaauaaaucuuaaaacaaacaaacagaaauauucaaucagggguuaugcacucuccuacauaggaacuuagcuccugcuaauccaauacccagagaguagucauccagagaagacauccagcuucaugcucugaacugucucagacuuccuaccugugccucuuauuggauccaucuagaagccaugaggagacccgcugaucugcucaugguuaggacacagauucccaugcacggagcggucuggaaaaggggcagaaagaagaggcgcaguggccucagccuuagcugcaagcacgggcagcuucauuuuugcugcuguugucuuuacagucagaaggaugaaggaagaauggagcaaaggggaaaaauugaagaugcugacaguguccucuauugcuguaggggugugugaaaaaguaguaugugucaguaugaccgcacugggagcuucccaaacuaggcuuacuuuuuguccccucuugcaagccacucccaguguuugaaagauguuguuauugguuuuguuguuguuguuguuguuuuguuuuguuuuguuuuguuuugcaauaccugggccaaagagcaaaggaaggauaaacugaugggagaggggagccugguuugucuuauguaacucacauccucgugagaguuccauuugcuuuuauuuuaagaaguaccauuuaugaacccucugggggguuaaagagcagaggagaugaggauucgaugucaauaggaaaaucgcuuagcucccgggauaaaugaugcuucuguuugggcuuucuguuuuucaaaaggaccaucuguuuucauaaacagaaaugagccucucuagccacguuucccuccauaacccucugucucuuugcacaaaugacaguauucccuucgugauucauuccuggagacaguccucugagcuaagcgcggcugcuaaaucugcgcuugaguucucaccgagccccacgugguucccacucgggcagcaacugugguuggauggcagcuuuuguaucuccagagccagagauggcacacacuuggcuugccaauggcucugcgucaggcuugaagcaggggcuuuuccuauucuugggaacauccaaagucuucgagggaguccaauaagugauacuccucccuccccgaauuuggaugcacuuacugagaggcaaagaguggcagauggaagccaagauaccauguugauugcuugggaugaauaacuuaguucagucugggugccaaacagacuugguaauuggauucagaguuaggcagacugacccaucuggucacgggcagugauggguggagcagaagaagagccagcuccuuggaacaagaagaggugugugccaacugccaggccuuacaugguacuugaaugagcuaaguucacuccuuguuuauugcugcuaugacucauggcacugcuuauggcugaagggacagagggacugccguggcucuccuucucauggaaguuagcauuagaaaucagggauaggugugguacaucccuauaaucacaggacuugaaaggcuguggaagaggaccauauguuuuaggccagccuggagugugaaguaagaauuugucucaaacaaauaaacaaaguaugucaaaaacaaaggcugagauguagcucagugguaguucacuugcccagaggcaugaggccagugcccugaguucuaucccaacagcauaagcauacccacccacccucacguacacacauuaacaauaacaacaacaacaaaucgcauuagaacuuaugaugaaaauuucuucccaaagagaccucugaguagcuuggaaguuagaauauggcuuugcaugagccucguccauggcauauucuauggaugccuacaguuuuuggugugcauuuauuuaauacauuaauugagcaaacaugcaugaccaagaugaaaggaugguccuugauucacaacacaacaggaagcugcugaaagauucugaauaaggggaaagcauaauuucagauuuguguuuuugaagaaguacucucuuucuucucuucuugucuuuuccugucucucucuuguacccucucuucuuccuuccacucuacauaauagaaaaaagugucugaguagggugauggagccaaagguuccugcuacuaagaagaaaugcagcaaugcccaggacacaauuggaaucagaagaagggcacagaugaacacaugagcaugggauauguagauggagcugaaugggugggcuggagggccgguguugguguaagaaccagugggagagugagaagauuuaagagcuguguucuuaucugagugaccggauagauggagauccagcuagggagggccaggcugggcaccugcuugaauaaucagcugaaugaauagaaacuaggcuccuuggugucucuuuuagaagcuacauuggacuacacuuuauccucgugugccuauggcauaucugguucacaccuucugacuguagaacaucauucagaggguuucauguuacccucuuuuagcuucauuuauguuacugaaacacucagaaccagcuuccucacgccccaaagcaacuuaggaaagaaagagugugugcuuuauaccuccagguugaaguccaccauuaaaaggaaaucaaagcaggaacuuaaagggacuucauguauaacuuccacaguuaggagcaaagagaaacuaauauagccacgcugccuuugcuuaauauucagccagcuuucuccagucuuauacaguccagagcacaccccauaaaauggugccucccauauucaagguauaucuuccugcaucaauucacagucaagacaaccccccacagacauguccaccauccaaauucuuguagguaagucuuugauugagacguugcucaacggggguucuagguuguggcaaguuuggcauugaaaacuaaccaucacacccuccaaaggacauuccuuaagugagggaaucacuguggagcuuguucgggaguugucacuuguguuuugccuugugacaaacacuggguaaggaugaaguauccagcaucaacagucaggcugaugauucgcccaaaggcugcgucuucucugcucaguagcuucucugauuguuuuagguuacauuccucuguugucugauucauuauccaugccauguggcucccacccuaggauagaacucaaguuccuauguuguccucccccucuuccacuucuuccucccucagugauuuuuaaagcaugcugcuuaaccagcccaugggcucgccaccuuuuaacaguagcccaugauugcucuuuugaccaaaggcuuugugggagcacuaagcacuuacuuccuacucuguagcuucuucauagccuggucuucuuccaaucuuggaacaaaauccccacguguccuagcucuuaaaauaaucugugaaaauggaaagaaccacuuuuccaccaccccccuuccuugagaaugucuaaauauacaguugugcccacggaggcuguagcauuucacgcaaauggcauaguucugugugucugcuggccgaggcaugcugguauuugaagggcauuuguagauugcugaguuuuagccucaguucagccuccaccucgcuaacaagaacaucucccuauucugagcuuucaguuccucaccucuaauuacuucugcuuugacacacacuuacauuauggaaaaugaagaaguacuucaugggccugagccuggugacaccaaugacccagggucccauguacgacugaaacucacuugagccuuugcccagaugaguacaagucccugugguuuucuugagauccccuucuggaccccuccuacaacugaggaaaguugcacugcccuccugaccucagaccacacaaagguaucuuggacucuucuuccaucaucuugcuagcauaggacugcaccacaaggcaccacaaaauugguaacuuccacuacucacaguuaccaucugaaggcugggacacucagccaggugucacaggcugcuaaugucucuacucauccucucccuuagccucugccagucucugucagcugugguacuccugggccaguagauaagaugcuucacucuggucccucugucuucccaccucaagauguugcccaggggcucaccugcuggcccaaauuucuguuuauuuguuccaggcccauacuaccuagauuugaccucauccucaauuaucugacugccuccaccaugaccccauuucaagauaagaucccgugacugaggugccaggaguuggaauaucaacaugagaacuuugaguagguguaccauagaccaccugaaugugaaaaagcccaggguggucagagcuacugcugcagcuuaccccagcuugccucccagacacugagagguagcuaucuguucagugucagaacccugaaguagugaacaaaaaaagaacagaagcuggggcuggagaagagaauuagugaguaagaaugguuauuauacaagggugaagaacuaaguucaaaucccuagcaugccccaacuuuacccuguguuguaugcuagagaaauguggaucuuggugaguggcuagaauuucagauuagcugaaacagugagcuuccagcucagugagagacccugucucaaaacaauaaggcaaagaaugauagagaaagacuccuaaugccuuccguuggcaucugcagguauacacacaagcuaauguacccacaagcucagauacaugcaguaauaccauacacacacauacacacaaagaacacacacagacagacacaagcuaaggacagucuuauauuaguuuuauugucacuaugacaaacuaccugacagaaacaacugaagugaagacagauuagcauugcuugcuuugccaugacaucagggagagcauggugaggcagcucacaucauugcagacaggaaguauagcugagccaccauaggaaagagcuauagcgagaaacaaucccaagggcaugucuucaguggccugcuucuccagucauuccccaccuuucaaaguuccaccaccuucuaauagucuaucaacuccgugaauggguuagacuauucaagaggucagagcucucaggaucugucucuggaacuaugcucacagguacaccaagagcugugcuauaccaauugccuagggcuuucucaagccaauuaaacuaacaaucaagacuaacuaucauggcuucauguggguucaagcuaugauguguuucaccaauacacauuuacugagcaaguccaaugcccgguacuggcuucuagauaccaaggugugaacaagccauggcuucgacucacaaagacuccaucauggauaguccagguuuuaucaaacagauugguaaccaaucugacaagaagggcaauaacauguccaagauccaggagcuggugucucucagaauuagaauucagaucccugugaacuguuuuguucaaagucuaggcggcuuugggccugugugacauggggagugcaggucgcaagcagcaaaucugcgugugugauucuucuaacuaacaagcacuugccuuuucccugcucuguggccauagaggaacuggugguggcuugugguuaaacacuggucucaccagugcucugggaaggggcucguagcauaugcucugacauugcaucagguaaagaaaaccaucuuuggaagccaggcaugaccagaauuuguuaaauuaacagucucuggggaagcucgaguuccugcuguacaaaugugcugauuaaagaggcagccggguggaaagagagggauuugagcccuggacugcauuccagauucauugcuuguucagagaguccaggcaggucccucaguuucccccauuguccauccuuugccucugagucuucaggguagcucagaagaccuguaggucuagagcaauucuggcucgauucauucaugccucagauucaggcacugaguggccagacaucuccauaugccuaaggauaaaaauguucuugggguguuggacuuucauuuugaauguuagccaaggcugugacuggagaaagaggucccuugguaaaguguucaucuugcaaagaugaggacuugaguuuaaucuccagaguccauguucaaagugucuugggccugcuccugcacuuguuuagccccuacacuauagagacaggcagaucccuggggcuuucuggccaguccacuuauccuacuuggugaauuuuaggccaguuagagacucuaucaauagauagauagauagauagauagauagauagauagauagauagauagauaauaaacaaauaaaaacauagugggcagcgugccuaaggaagaccaucugcaguuauccucuggccuauucccauauguacauaugugcacaguacacagguaccuggaaauacauacauacaggcacauacacacaugcauauacacacacguguucaaauacaugcacauucauguacacacacauacacagagaaagaaagagagagaaagagagagggggagagagggagagagagagagagagagagagagagagagagagagagagagaacuggagaggaugagcugggugccuuggguuagcuggucgcucuacugaggcucagugucaucuaaagcaaagaaauagcaccucuccacgagacuugaucaucgucauccucuguaggcugcccugggcuugguccccuagggcuagauuuaacagguggcaugucauaucacagagggcuguggaugcaggcaagaccugauaguauacaauuagugugcuccggcacuaaaggcuuugugugcaucaguaagacagcuuaucaggcuaccaggugugacaaugaacagucuuggguccucccugauacccucugugugccuugcagaacccccugucugucaggcacaggcagcagaacaagauugcauuucugcacaguaugcugcucaguauggucucagcgccaccacaaagggggaaagucugcagccagugacgggguuggugguacagcaggugggacucuucauuuagaaucucuauugugucagacauuagugccccagccauagucauaaagacccagagggagcccagucuagaaagcagauggccagccagccucaggcuucuauccgcacaucacccuuacgucagugccaagccuuuguguccuggcacucccucuguucgccuccccuugcccagguuucuauccccuaacuggaagucaucaagucaaagugugcuuucuaaaaugcacaaaaauauauguuuaaccgaauacacaauacccagaccacccaguuuccucugcuccaggcugggccaccuugggucacuuuccuacccugucugugcuucuuuacugugcuacuucauaaccagaaauaaagggaggacuugagcuucaagguugcuuggugagauuuggaaaguacuuacuuaggauagucuccaguguuuacuacauuaguuauagcaucuuugccugccucggggccaucaguggguccucuguaagccacuguguuuacuacugaaauaugaggacuuagcccuucuaucuuugauucuguuaugagcucagaauagaaugcuuagagguguggcaguugucuuacacccaugaggacaauguuaaggcuggcagagccagaaugcaaaaggagcuuugaugacauuguugccugcuagaagcaacucuuuuucccaaauguaacuucccauauucccaugggaaauaaucagccccccuccuugugaauaauggaugaacagcuugucuuagcagccaugcuuggcauucauaagccaucaagggccacccucuuucucuucugcaacaucauucccaaagugacaccucgaccucccacuccccaugcugagcuaccugcuugacuuucugcauacaauaguuuugccucauaacuguugauuaaguuuucucuuauccuuuuccugucuagaacuuccugacccagucuuaaccuaucuuucugccauugaaaacuccuacucagacuuuaaaacccaguucuucauucucuucuaugaugggaacuaaucacuaccauucuacaaaauugaguuugacugacagagugugagcccccauuucacuagcaacccaucugucuuaguuaggguuuuacugcugugaacagacaccaugacaaaggcaacuauuauaagcacaacauuuaauugaggcuggcuuacagauucagagguucagucuauuuucaucaauucaggugcaugacagcauccaggcaggcauggugcugaaggaguugagaguuuuacaucuucaucugaaggcugcuaggagaagacuggcuuccaggcagcuaggacgagcaucuuaaagcccacaccuacaauaacacacuuccuccaauaagacugcaccuccaaaggugaggaaucaaggaacugagcugcccugacccagagaugagugccuggggcccaccaggaagagugcucuuguuugcacugucuuuuuucuaagcuuccugcagcccucagccaugcaaagucuucuaccugggcagugguugccugacuuuauugggaaugacagggacuucucgcugggcuguagcccaucaccucugggacaugugggagacuuucagccaguuccacauacuugggagccugguagcccaacucucagugcagaaggagacugugaagccucugaggguaaccagggucccccugcucaucucugagacuguuuccucacuugcaaaaggaggcuaaugaagauuugaguugauaaguucuggggcucuagggaagccagaacauaaugaaaacaaugccagucaucccgaguguuagcagagacauggaagaaucagaaagaggaugauaauaaugaaggcagacacagcaccaucaguacuagccaagccuugacacucacaguuucguuuaguucucucaaagugcucuccaguaauaacuaauugaaauggcacaauucuggaaggaggguauuauuauuacccucauuuuccauaugaacaaaucaagggacuaaaaucuuaauuuugcccaccacaugcaacagucaaugguggaucagucccuaaugcugcaugauaugauuucagaagccauugugaccuuaaucucaaaggaagcucuugguguggcugcacaucugcagccagaggcuuguuccuacuucacuguggagucaugcaacuuugaccuucugaaaagggaagcuggggucggggguggggggaacaagaacccguugaaccauagcagaaagcaaguuugcuuucuguaggccaccgggggugaggugggucaucuuccuccugccugcaccgcacacuguacucagagauucuucauuuucuagcuccuccucuggcugcugcccacaguccuugacacacucugcuuauggacgcgcuaaccuaagcuccuccuacaccuucacuaagcaccccaauucugaccagugccagcuccuuuuucaugaaggcucuccuuggauguagcauccacucuaaugugcuaugacuucauuuuaaaccacuaauuacaucgucagagaggcgacaugaguuuuuaggggacucugaacucaaacgaaagcauaaggagaggagaggaggcaagcaugugccucugaggaaaguuucuccuccaggaaacaggauguaggaagaggcacauccuuuugguggcaugucgucccugcuggcuugcugcuuuauuagcaccccacugaggccaagcaggaugccugaaaucuuagccaagagacaaauucuaccuccccaguuucuccaggaaccagggccaucucucuuuuucuuucaugcccugaaacacuuccuaaaccccaaagucagcugaugguagcucucuccaaggcccacucucugcugcggguggaggaggagggaaauggagaacacucuucuuuucaagggcacagcagagauguggcagugauaagcucugcucacacccacuggccacaacuuaguugguguaucucucagcaagggaaucugggaaauguagucucuggcugagaggucacaagaccagcuaaaagucaggagaaugaaggagaugacagcaccaagggacuauaggcuuagaguaugagaaacacccaacacacauaagaagccagggcagaauugcuuccaucuucugcuaucauauaguuggcaauguccuccacggcggcaaauguucucuggcacuguggccugucacuaagguaaaaugacaccaggcuguucauaccuggcauccaucagcccuccucuuaggaggccucacauugcuuuucagauccugcucauaugucccagcucagcugagacuagagauccuggaauagagaggccuuccaaauguccugccuggcugcccaugcuacaccaggccguggaaucuguacccccaggcacugagcucccugcccaggcugccugcuugcuuuccugugugcuacaggaguuuguggaaagaauguucuggcauuagggggugaaagucaaaacaguaauuacaggaacaucuguuccugaguggaaagcaugucccacacacaccaggagacaugccugcacagcucagcaagcugauguucaaauggaagagaauguucuggaagggagggcuaauggaccuagccaagggagguucagcuuccugguaggaugcugugcugugcugaagagcagagagggaggagaaaggggcaggcagggagugaauaaguggauguauaggaaaugggagggaaagaagggggaaaugauugaaaagugccaaugaguuaaucaaaugaguagaugaaaaaggauaagcaagaggaaucagagaaagaaaaagugaauuaauauaucaaggagccagucagugaauaaaugaguaaauauauggaacugaaauguggagaaaugaauaggaaugaauggcuagauccaugaaugaaugaaagugaauaaaugaauacuaguugaaugaagguguggagcaauaucauacacaaugagagacuggguaagugaccaugugguucugucaaccuucuuaccaacugggacaggccaggagagugggcagagugggaggaguguagacacccucagcuucucaguacugagaggacugguggaaggguccaccuccuccccugucacagaugaggaagcaacggacaagcagcauccagaagccaugggaagaagagcuuggagacagcggcuauguggcgguggggaagguaguccuuucuuauuucaguucccugucuaagugguggugaugcugccucccgcacaggaugagaucaaggaaggcccagugggcacaaacuguuauuuucuccacauuaaucugguguucugcccauaguuugaacuuagaaucagaagucaagcuagggguuaggaagagauacagugagagaggguucccaaacuugacuuagcugacacacaaagauccauuccuuauuuuugucacauaugaaggucaugucccaccccuuccuaguagcucuucagccuagcaguccugacuuccaaggucucugugguagaguguccugguuaguaguuuuguuuuaucaauuugacacaagcucgaaucaucuggaaagagggauccucagcugagaaagcaccgccaucagguugcauggagucaacgcuguaggauacuuuauugauugaugauuaauguagaagugucuagccaacuguagauggugccacccauggacagguggucuugggugguguaagaaaacaggcugaagaagcaauggggagcaagccugugggcagcauuccucugugacaucuacuucaguucccaccuccagguccugccugaacuuucccccauggugaccuacgaccuguaagcugagauaacccuuuuccucccuaagcuguuuuuggucgugguguuuaucccagccacagaaagcaaacuaagauguggaggauaagcagaaugggggggugggguggggugcugguucucugggcccaggauugacagguguccauuccacaaccccuuccucagcucuaccuccaggaagauaaauggggcaguggcuaugcaguaguauaagacacccuaacuuacugguguuuuggagggacguuagccaugcuagaggugaccaucugaacauaaguauuuauccauuaauugaagacccauguaaauguauaaauggccuuuucuguggccaggagcuccugaagacuucagauuuuaaggcagaguuagugaguccaggacaaccugucugccuuccucuggcuuuguguucuuggacaaaucauucaaugacucagaacuucuauuacuuucuuuguaaggugugucauaauacacuguuggagaauucacugggacaucgugcauaacaucaguuucugauuuauaaaccauagaaggcaugcuauucuuauuguauucaccuccccagaucauacaagaggcccaagagucacuucucacugagaaucuaauguuacauuccauaucccaagagucuuauaucuucugaaguuuaucuuuguagcaacagcagaaaggugguaugguccaugcuaauauccagaugaggaccuggaggcuccuugcaggaaauaaaaagucacuaaggccuuagaguuggcaugccagagcuaaggaucaaacccaguggucuuaugccaagacaacaucuugccuguuucugcagucucuuguggucugacgaacuuugaagaaggaaaucauuguugcuuccuuguagaaccaaaauugucagaugcagaaagcugagcuugugcugcuagcaggcaucuuauuugucaaaacuauacaaaggugaauuugccuccuguggauguugcacauucacagcacauccucagaaaauccacagcauuaaauagacauuaaggauguaggugcugugcucauagagucugugugagccaaaaacaaauucugaggccagaggaggcuauggaccaggucaguugugcuuuucuggaaaaauaaaggguaggagaaagacuauucugcucuuccuuauaaccuggccugguaagaggacacugguuagaaauguaacgguaguccaauuaaguucaaaauaccucggguacuuauuagcuugaccacugcugggaugcagugauagaaaggcagucucuggccuuguauaguucagaauaauggauccaagauauugaacccaccaauacaggacaguguuaggugauuauaagagaaagaaaauggcuauggauucuagugaagguaaaucaaaagagaaauguagaagugauagaggcucaugagaaaggccucagggguggauaauagaccuaagacaauaauagagagcuccuuccaggcaggcucacaacaugagcagaguaccugagagcugguggccaucuauaccaaguaaauggcugauguccaggaugccgaaaaccaaaugcuaggaaccagaagccugaaugaagaccaagagccuaaggacccagagaccaaagacugugaggacaaaaauucuggggaucaggaggcugaggcccaaaauggugagaaccaggagucugcuaaggacuaagagcuuguguacuuagcagcugagggcuaggacuuccacuaauuuccaaaaggaaaauacuaagucaacuuugucaccauagcuguaaacauuaaacauacugcuggguagcaacuagccacaguuguugaacaaagguuuaaaagacaaaacaagggaaauggagggaggccagaaagaucaaagcuuaaggaagaaguccagguuuaugggccaauuagguuuggaagucucugcaggaagaaauuaggccacagagacccacaaugaugcaccuaugugucuuaagaguauaucacaggaagaagcauagcuccaccauuugaacaggacccagccauaccauagcuuauuaucugagaugucaguuccaauuuucugauaguacagagaagcagcugaggcucugcaggaagcagcaacucacuggacagguagucagugaccuggauugagaguuucuagucacuacugggugucccaggaucauuucucagcugccauuagcuggcaagccauuagaggccucugcccugccccugccccugccccugccccugccccugccccugccccugccccugccccugccccucccccucccccucccccucccucucccucucccucucccacacccugcccccccacacaccacuggcuucaauauuccuuaguaaaauaugugcucuguaaggcccuuugaggccucccuaccaaccuaugucauguggucaaaaagcauccacuaaguguacccacauaucauauuuguucuaaaaaaauaccagagggauggucccucccucagaguccuccuccagaucuuauuauucaauccuuaugugcuuuaaaaaugcuuaugugucugccauuccacuggacuccaagcuccucggggguguaucugaccuuuguguuuucuuaaauucuucuuagaguaaggcagagagucaucgaugcauagauuaaguaauguauugacucuucuuugcacaugugugcuggucaagcagggacucccucacacaucugcuggaggcagguacaacaguagaccacugcucaaaaacaagagggaucgccaaggaagcgcaggguaggaagaauuagcuagagacccaagccagccagagagugaggagggcuuaagucuucaaugacaaugagaaauugcucaguuuaguaguaugaggaagagggagaaaaagaaaagaaaaaagaaaagaaagaagggagggagagagagacagagacagagagacagagagagaauguauauagagcacuagggccugagaaccuugcccauuggaagaacugaaagcaguuuugaugauguaagauuuuacccuucagcuugucccuugaggacuucuuaugaaacauacauuaugcacagcucaacaaagccagagugaagccauauucuagugggcaucccacaaauagcccuuugacacacaggauugcucuauggaugauccuaggguaacaaaacucuggaaccaaaauagugugaugggcauaacagguccaaaugucacuucuucagacugccagguggguggagccuuagugccaaucccagcccuccggccugcauagugcagggaugaccaguagacauuccuucggagcacaguggcucuucacaucugcuggaaauggccuaccaugacugcucucaccaaucaugagaaaaagcaaaaacucaacccuugcugggagggaccugaaacauucucaaaguuacauuaguucuaugacagguggcaagcagguaggauggguagccugggagaugcagagagauaaggaauagaaaagagaagaggacucugggaucagaagguucuagaagcaaagacaaaacuccaauguaacccaaagccaauauacucagaguaggaaggaggaaggaggggggaagaaaaggagaggaggaaggaaggaaggggagggagggagaagggaaaaagcagaguaucugacucuacuuggaaacaagcaucaaauguuauuuaaacaucaaauauuauuaaaguagaaaugcagccagcuuccggagcccuccgcagugcaucuugauaggucgccauugcucugggguuaauaugaggaaauggcauucuuaagaacccauauuaaccugucuguuguucuaugaacugugacagcugcauuuuacaucuuaauggcuaaccauuucuuucacgccaaaggggggaaagaaagggaaggaagaaaaagaaaggcauuuuuaugccuaugaagccagaacucaaggcuggaaacuuggcuccagaaguaggcuaugaggucucugccugcugugugucccuucacaagaauccagacacaggucuuuccuuuuguggauccccuauacuuuuuucucugagcugcuauggucugcaggaaagacaugcuacccacuuggauaaugguuaacucacaggaguaaauaaggcuggaaaagcaccaaguacaagggaggccagaggagggagggucaagccaagccaccuucaggaaagaaaggacuugacuuacauagaaauguccuuggugggauuuuauuaaggaccuacuaggugcaugcguugcuauagagauaucaacaaaacguauguugaugaggucacugugugccuggcucccagaggacagacaugauugugucuacucagaggacugucauucaaggcaggacauagacuuuggucauagaaucucucacaggucuaaacuccccaguaugggaagcugggcaaaaaaugugaauuugagaccagccugggcaaguuagaagaccuuauuucaaaauaaaaaguaaaauggcugggaaguacccugauagagcacuugccuaggaggcccuacguguagucaguccucugugauaaaacuauuuuccaaccagagagaucuggaugugauuacggggcucugaaggaguggggugagaggauggucaucccagugugugagcagagugaggcucccccaggcacucagucuaagugaggccgagcgaguggagagaggggugagugccucucugaagaaggcagccucugugucuuggauggagccguggggugagcgaauaggaaggagagaugcuugugagccaucuugaacacagaauucaaucuguccaguccuucucagcuuccaaagcucuucaaguccaccacuguugucugugaaaguugucaggagacucaggcagaucuggggaugacagaccauggcacugaaguucuuccaacuuucuggagaccccuguggagaggcaaaugaaagcugggaucauuaagagaggcaagcgauaugaacagaucagugcacaugcccaggaugggugacagagcacuguggcagguagcaaguuugcacaugagggcaauguagaaguguuaguccugggccuggaacucggugggugcuggguauacacugccuuccuccccucacugugagaaguacuuuuuuaguucaucuccaguucccucauuucaccuccugugucagugguuugugggauuugacuugguuaaguggggagugcuuagaguggcaggcaagcuguuauugcuuugaccugaaacccaguccccucucuuagcuacagaugacucagcugggagaccugucucugcccaggcaccaugcagaaaacuggagaagaaacccucccaggcuuucugguguucugcccuuagcccugucacauuccauaggaccuuggucagauagucuuuggcagaaggagauacuuugggggacuggggguuugcccagucaguaauaagcuugcuguucguggggacccgaguuuggauccccagcaucuacauaaaagagguggugcaugacuguaauccuggugcucaggaggcagggacaagaggaucccuggagcuugcugccuggccucucugaaaaguuagagaacaucacauaacauggaccucacacgugugcaacugcacaugugcaagcaugcacaaacaggcggacaaaagaaagaacuguuuuagaauuuauuuacuugacaaaaauaucuaguauacauuuauuaaaacuucuuucacacacuucuugcuucauggccaggguagucuucugagguaguuacucauuauggccauuuuauaaaaaggaaggaaaacacaaacacaauucugcucccagccuggcaagaccugucuuccuugagcuguauggcucaaccucucugcguaccaugcuccacugggacucucagaaccagcccagucggcuucucccugugccaaggcaagcugagggaagcuauccugaaaaaaaugcaccuaguauuuguagagggaaucccucauuccuccuugagauuagucucugcuguguuuggcuuagugcaugcuaaugcucguagaucaauuuaaggcucuucuuucuuccacagugaauguuuuggguuucccuguaugcaaacagggugauuuaggcaccuuucuguuacuagaagagucaacuuggacccugcuagagacuucaucaccaaagucauacuucucagggacaccagaacccagaguucuuguccccucucauggcauguccacuggacaucaguagauggaugccugccagaauggaaauuauggcuuuggaaggggacuggaggaauguggcuggcuccaagccucuucuuuucccauucgacuggaagguuauguucauuugagcuuugaaaccaaaaauaaaucauuguaauccauuugcuaauuauaccaugugaaguucuagacgcuguaaauugcagcugcaauauaucuagaugaaguuuggagaguuuauuuuuagugauaccaaaagcacuuggcuuccuggaggcuucauuugcuggucugggaguggagagagagcugcguggacacagcccuucuggucccucugcugaucccugguuguagugacuuagccugaagcccuuucuaaguucugacucugaucuuuugacugugggaacugggauaugucuggauguaggucuccaauguuaaauucaccuggagcaugucaaaauccaccucacugacguguuugugagccacggugcacgaauuucauguucaaugggaacauccuccccuuuugggcuccuuaucuguuggauggauucgauauuuccuuaguucccgguguuuuuauuuucauccacugagaccugcauuugacgauuuuuggaugccaacgccaucuuguuuccaucgcugacguuugugugccaagcccuagguuugguucugaauggaucaggaaugaacugacuucaccuucaagcccagcgacagcagugaagaugcugcagcuccucuugaacugugacauucgugauggaugauggaaugccaagugagacuuagcuagcaaagaugaucuggagugaaaguggguucauuuacaccucuuaaagaaagggaaggcgaaucucucaagaaugagaaggcauuugaguguggcuugauguguaaaugcgauucuaaaauguggugauuggguaaggaaauugacaagaccugguuuaguaaccuuggcaaccguccuggcuagauagaucacgagaauuucguccaugcacaaguucugagaagaacuucucccuuacccaagcaccaugacuucuaacuucuaguaagcuucuuccuauuauaacaauagccuguuguuguguuuccaagggugagcauuuaaaaaacaucuuuaggggugcuggagagauggauuaucaauuaaugcucuuccagaggacucugguucaaaucucagcaccuacaugcaacacaacuauccaugacuccaguucaaaagguuccaaugccuucuuuauuauccauguauccuagacaugcauguaguaacauacaggcaaaacauggcuaugcacauaaaauaaauaaauccaauuaaauuaaaaucaacaaucaaagagaaaaagcaaagcaagaacaaaagaaacacugguaacaaaucccuuuguuugguugcuucuauuuagacuucuagaaagcaguaugcucuguauguucaauucuuaggggaccaauggguagcuugggauacagaauuuucauaaugagggaugggaguaguuucguugaguaggcuuggcagagcagggccuggaccaauggguuguguuucagaccagaggccuucugggggaggcagaacgaggugaagggaggacaguguaacaucauggggagaugguaaucucagaggccaagaacuaggaggcuggcaggagugaggaccacaguggagccuauaugcucuggauuagaugaaacaggaguuugacuccuaaucucccaagucuuggcugagugguccuaggacuuuauaagacuuuucuacccuuccauucucucaucugagaaauauaaagaauagcaucuaccucuggugguuauugugcaaaugaagagaaauaaaugauguucaacacauuaaccggcaugaagguauugugcacuuaauaaaugguggcuuagggucauuguucuuucugaagugauucuaaugaaaucauagaaauucaaauuccaaugccaaagggacuucuuagaagauggaaaaggcaggggaagcccguggcauaaaugcugaggcaggacaguuuccagaaggaugggcaguuccugugacugaugagucagagaggccaccguggauccauccuuugcagugucaucgucacgauccugaugagagcauucagcagaugagagucacaccacagcgauccgugaagagcaagcguaggcaagaaagacgcagacagaucuuccagcuaagcucggaggagaaaagagcacacggugggggcgggggcaaggucaccggaagggcgugugcuagaggaagauuccuggaacucugucagcaucgagcugcucugcucgccgcccacuaccuaaccccagcccucuuccagaauuacaucugccaaggagauugccucugaauuuaccuccugagguuguauauuaaaaucuugacagaauguaaucuuggaaugaagcagguuagaaaggagggcggcauugcaggugaucaggggagcggaucuagaggacagugacugagaagacauaucugaucagggcaaggagggcagcauugcaggugaucacggggcaggucucacagacagugagggagaagauguauuugagagggcaaggagugacagagggaagaguaagagauccagguuccaguacucagggcagaguguauaacugcacgugcacuuucaugcacaagcaugcauacacaacacauacaugcaugcgugcgcgcacacacacacacaucaggaguuucuuccuuugcuaccuuuuaccuuucugaguugacaccauggcuucuauuuagacagacuugcuaagacccagugacaaaugugcuuauuauuuagaaacuucaaaugguuggagagcaugagacacugucguuuauauuauuauaagcaaaagcuagcccaaccugggcagcuuucgcuuuuacucuccuugguuuuugugguuuguuguuguuuuucuggcuuuugucaccagaacuaaguguaauuuggagcugucugcguugcucacaaccucuuuuaccagcaaagaaaugggaguguagaaggggcugaaagaaacuggccuaagcagggcuauggcuagagugcuugccuacaguacccaaagucaauccccacuuagcacucuggaggugggagcaggaggacucgguguuaaaggucaucuucaacuacauagugacuuuguggccagucuggcccugucuuaagaaagaagggugaagauaggagggagaaagaaggaaagaauggagaaaggaaggcaggaagaaaaaaaacuggccagagaucacaucagaaaacacauuaauauucuaagcauauacgcaacauuuacaaaaguugacuacaucuuaguccauaaaacauuucccaauaaauuucaaggaaucagaauccuacagaccgcauuuucucaccacaaugcaauuaagcuaaaagucaauaacaggaagaugagacguuuucuauuuuguaucuuuuaaaacuguauugagagauuuuacaaacacacuacuaacucacucuugggucaaaaagaaaugacaauagaaauuauaaaauaguuacaaaugaacuaucaaggaaauauuaaauaucaaaaguuguggaauacagccaagacaacacuuagagggaaauuuaugaucuucagugcuuauguuagaaaaagaaaagggcuaaaaauuaaugaauggccuauguauccaauuuaagcacaacaauagucauaaaucagucggcuuagaguugauaccaacagcagagccagaauucuggucauagauaaagcuggcccagcauuccucguucucauuacuacaccacaaacauggcuucagugccguuucucauaacaugcucagggccaagaaauuuuguuucucccacagaguugaagaguuaagccuauagggcagcucucuguaucaaaguucgaugauaacccucauuuguccacccuuuuucauucauuccauauagcuugauugagcccuugcucaaacuaagcacuacuaccuucauugugaaacuagccucagcuuagggcuacuguaaugcucugcccuccccccuucccacccccucccacucucuccugcaacagcccuacacuuccagaaucuuguaagaagagcaagccucaucaauagugacugauuucuuucuugucuuuuccaacagguagacugaaauuaccauguguccaaauuaaaauugcguacuucaaggauuauuugaaggacuauucuuagacccuuuuaagaagauuuuuuaaaaagugagucaauuuuuuuuuccacuucagaguauucaugacuuaaguuaauguuacaggugcucccuucccccaacccugccuuuuaaauaugcacuaauagguaacuucaucuccauuuauuuuauaauaaaggucucccccaccccaagaacaaugaacagggaggauggguuuauugcuguagcgauuugcauauauuucacaggcuuaugggcuuucagagaugaaaggguguuagaaguguggagguuuuuuguuuuuuuguuuuuuuuuuuacucucagaguagagauugcuauagaugucuggacuggaccuggagcuccaggaacuaccaggguagcugaugucuguccguacuccagccuuuuagagcauucucucgacucucuccauuugaaacccaccucuucuucucccauccaccaugccuucccugcuagacaauucuaaccaugguuaugcaacaagcacaagaccccaccccaccccugaccauuuucuaaaucccuuguucccccaauaaucccacauaguuucauuucuaggacaaguccugcucagcucaucuuaccaaccuagcaaaugucaucuugcauuuggagccagccuagaacacaagcugcaggcaggccacugccagcaggaggggcagugcagaggcaagccugaguucucauugcaguuuugcucaugcugagcugguggggaggccucuguguuuuucugagcuuagagaaauagagaagagcugggugagauaagcccacugcugcugcucccuccauccacaugguuuagcuaacucauaguaaguaagcaagaugcugcuucugacagucucuggcaguggaaugagucaggauuugccggucaguggaaccuggguccaaucccggguuuuaaggcuugcugacuuuguauguggcuauacacugucgcuucucaucuccaaacuucuaucucuucauuugugagacagagaagcuaaugcaugccugucagagacggucuguguugggguaauggucaugaggcacuuaguaccuggucccuaggagauacacaaucaauaugaguccuugaguucauuaacuggugauggaauuacuuaccuuuggcuaagagaggacaagaggcagaggcaacuuuaauuuuuaaaaaaaaaaaggaacaagaagauacagaauguucauuagacauaaaagagaaauguucauacuugauaaacucucacacaaacguaacuccaagccaagaagguccaugaaguuaaaacucagagccucauaaggauagauugauugcuacagaaacacgcagcugaaaaggacaaaugaauauggguuccagagcuguacaaacucuccuacccuauacccagggucaaagcucuaguccuggacagcaagaacucaugucccuggaaugagggcccuagacuaucaggucaggggccaugugaugcaucauguauuuguguauguuuagaaggcuauagggaacaucagaugagcugaugaguggcaaggagaguuguaaacuguaaaauaaaugccccacacuuugugcuuugaauuauacaugcauuagagacucuugguguuuucaaagcagcacaagguaagauccagcuggguguguauuauacuauuugaguacagaccauagauuuuugagaaagaaaaucagcagcauguauacacuuaugggcacgccuagcaugugcaagugcuuauacaugugcaucuguaugugugcacagggguuuguauguaugagaaucuccagucguuuuagcaugaccagccuccacacagugucugguucccaccaagauguauaaccugggccaugaaaucagucaaucuggcgcuauugccaguucugucaacugacuagcuccauuaucuugggcuaaauaggaucaccuuguuugacaagaguccugucccugcuugcugaagcuuugagucuguggagaacgcugcucugaaggguugggggagggggaaguugaguggaacaacacucaaguacucuagcuguggggaagccuggauccgguggccacuguuggcagagcuaaaggaguguuguucuucccugcagaauauaaaggacuucuggaagugucuuacauccuuggcacuaucugagggccugcuauaucucuggguaaagagccauaucaggaaaacauaucaucuaucauuacuaaguuauuccacaauuuguucauucccaaagucuuuucccuuagccugggcuaaggggcuggcagaauuagaaucuccggagauuuggauguuguugucauuuaagauagaaaauagauuugucaguugguuuuaacuaaauaaaacuaauauccuggccuuugcucuccagacaguuacuggcugcagacacagaaaugcucugacugcuguagagccagugggcccuuuaggggagcuccagcccuguggaagccagacaaccaacuugaagccauuuccaaauuguggguggugauccauuucaaguuaugaaaugaauuugaugauucaaggccaucguuuauuaaaacuaauuagaaugacccauuagccuacagagaagguguauguauuugauuguuuuguuuuguuuuguugaaauagguucucuuuuucauccaggcuugccuggaaauugugguucucuugucuuagccuccccuuccaaacacugggauuacaaacucaccucacccugaugcuugacucuucaacaaagacuacuuauccaaaauauaugcaguaggaaagaaucagcucuccauaaaaaucaauaaccaaaggacaaauagcucacuuaaaaaugggcaaaagacuuagaugcuuccaaaaagagaguagaaaaacagcccccaaagccauggacacaucacuauucuugagaaauugauacaugagaaccaccaugagauaacugcuaccacuuccacacuuccaugagaaaggcuugaauggaagagguggaguuugcccagcaucuaugaccauguaaagccacuggaauauacucacacugguuggguugaauuagugugcugacuucgaaacacucuucaguuaccaaccauucagaaccuaggagugcaaguguguccacucuguggcguguacccaugaaguguucauaugggugcguguaauacaaaaaucacaagccgcacacaggugugccaaacacaugccacgcccagccuugaauggacagaugcagucagucucuucccacaguggggcagaacauucagcagugcugaugacccuggaaaccguaaaacugaaagacagaggccaggcacagggcuuuauaaccccccuuuauaaaguacaaaagcaggcaagacaaauaccuuagcagucuagggagugauuacccuuaggggaggagcugggguuggggagagaaugggaaaggcuuccaaaguacugauguuguucuggaggaucuguuuuggggugccugccugcaucacuggaccuggcucccauggguguucucacuuuuugaaacugcaucaagcugcugaguucagauggguucccuccacuguacuuagaucacacuuuaauaaaagcaugcaugugacaauaauggaggacucauggugggucauaaagguuggcauuguucaguaauggggcagccuggugccucugccgauguaugucugcaggguucgggugucagaugucuuucuuacugugaguaacaggccaugagugagaaccauccacguaauuaauguaagcuuccacuuuuaggugaagaacuugauacccaaaaaagaauuaagagcuaggguaacacagagcgaggugacgggcucuagguuuccaaucucugugaauggggaguauguagccaguuuucaccagaugggccuggguggcauggugaggccagauggguaggcuguucagucuggcaccuuucucaagggaggauguucaagauggcagggguaguuuugagggggcauuuucccaucccagccuggcucgggcuccccaggaucucucucgccuccuuccugccuccucugucugagucuguucaccccuguacucuaucaguuuuccauuuguguagaacagccuuggugccaaagccaugcagucaugcuguagaagcuggaaaacagaaggaaacaaauaggacuacugagauccaauaaagcacacuuccaacuaguuugugguuuuguucaagaauuuugggcaacaggaacccuacucugagcuuacaaaaccauugggcuuucugguuaaggaugaguuugugcaaagguucugggacccucccaaaaaggguucauuaaccacuugccaaccccgcuaaccaggaucacucaauacaagcuaccugagagcucuuuacucugggcaugugucaaccugcauaaauacaaggguaagguacaguauagaauccccaggcugauauaaagggggccagagagggucucagagauauugagcugaagcuaaaaaccaaggauaaggaaugugccugcauaagguugcuggagaaucaccauugucguauuaggaagcugccugcagucccacgcagggagaagaggcagaagaaauggagugggcagagccacguacugauggaaccuuccugggugaugaggaaaaccucaccagagacuuguaaggcaggaaacgccugucaccuaggagacaggauaaaagaugcaggcagaugcugcuaggaauguugguacagguuugaaauuauguucuacagcacucacuggcuuaggccaucuuuaaaggccugugcugguguaggucuggcugaaggccagagguagaaagaugaguaagagauuucccagcaucacagcccugccagggacccaauacucaaaaacagacacaauuugaugucauuaauauucuagaacaacuauccuaaacuguuucuaggauacaucaguccugcaggauagucuuucaucugugugugugugugugugugugugugugugugugugugucugugugugugugugcgugugugugugugugcauguacgugugacgugugcauguagaggguguugaaugaucugagaugcaccauggauugaauccauuuggggaggugugcacacugcuagcacgcuaaagauacuaagaaaaccugcaguggggauguuaaugguuuggagacaaaauuuucuaauauccuaaaauuguccuaacaucuccauauuuccugugaggucaucgaagucuguuccucagcuagagaagcccaaucgugagaugggccagaggcuucuuaaaauaagagaacaggguuucucugaggagggaaauguggauauuauauaagguccagcccacccugaccacucauaaaauugucaauggagugauggcuagugcguugccuugcggagaagaacuuaaagcucucagcagaagcauuggcauuguagaguuucucagggaaccuaaugcagggcccccguacuuccucaccugccuccucucuuccagcuacuugggaaaaggcaagaugcaggaaaauaguuaauccaggcgcggugaucuaugucuggaaucccagccuuccagaggcucaggcagggcgucaggaaguuuaaugccagccuggacuacauuggaagacucugucucugaacaaauaauaaaggaaacugguuuuagaacaugcaugcuggagccagaccaucugagugugaauucggugcuguuucuccuuuccaguuccuuagacaaguuguccagguaccacacuugcaaaggcaguggccagcucaguacccccugggaugaaguauguucacuuguuuccuagaaggcucuagcaugaagcaaauauuguaguugcacgaaaaccuuccagggugcccuuuccaacaacuccugguaguccaaagaaucuccuacuuggaguaauggaguaaaugaccugcaaauccacuuuucucaucagcgucaggaaggguugggugcucuuccuuccgugacaauaggcaggacuguuccaagucaggcuuagguuccacuccugguuuucagagcugaagcagcugccaaggagcguggucccagggacuucaaugcaucuauuauuaauuuucugcaagcagccguuggcuucccagacaagcuccugucuguagaugacuguagcccucucagagcgcuccugcccuuaguacuucucacaaggcucgaaggaaacagcccuucaugccccugugucccugggaagguggauuguaguguaaacaaugaaucaaaggcccaggauggucauacugaaucugaccuacgaggauaggacgucuuguuuuuucuucacaccuccugccucaugcacgguacacaggcagagcuguagagaucuccuugacagcaagauuccauacccuauuaaucagagggcugugaugccaucuacagugugccaugcaucccgucaucucucucucucucucucucucucucucucucucucucucucucucuguguguguguguguguguguguguguguguguguguaaugucaccaggaaacuccaagcagcugucuuccuugucguccaaucuacccuccccaaucacugaacuaaaucuuccaaucugcccuccccaaucacugaacuaaaucugaacugcuucuuugugcacccucgggcacacauucccucuuccagucgcuaucaaaucucucacuucucuguuuggccucugauuuuguuguaucugaauuauaagcucaugagaguaggagccuguucaucuucuaacguccucagcaaugugaaucuccucccagcgaccacugcaagaguguaacuuacccaccccaccuccuagcucagcccccacccucugccuuccucucucuuuuguuucuuccuuccugccuucuccccuuccucauuuccuauauuuuucuuaauugcuuaacaaaggaaguuagagagcaccuagucaaacaauucucuagaggaaaccauaggcccacuuaaaauagggaaaauacugaacacccaagcucuuagccuggucagcaacccacacuuucucucuccuaacauaagaacaaaauugguucuccugugauaaaagauuuagacaacuucaaucuauucuuauagccucccccucccccagaacaaaaugaugccaagugccugacauauacacguucagccaaaacgagcaagguacuacccucauuuguagaugcgggauguggucccaguuagcccagaaacuuacccaugcuggacacaccagcgucuaacagauccagaguccaugagaguuuacacacuccagucucugcauggcuaccuucuaccucccaggggcccguguuccaacccagcaucuccucagacaaccuuugagcccacuguagcugcaugugccaaagauaggccauuggguuuuaauugacaccacuuggucauaagcacaggcccucauuccugagguuuccugacagugcaagcguguguugcucauuagaaagcaccacaucugugcagcaccagggaugagccugcugccccacaaaguguccucauggcuaaaaugaaguucuccaugaccugaaguaccaaguccccaauccuguccacacaggcugggucuuccuucucaaaugucaggaauuucuuccaaggaaauccuagagcacccggggaaagaggccaggcucuaugcaucucauguagaccuuuacagucucuagucuccccuguguucccagaacaugacauuuugacuuucacuuuggaaugagguugggcuuauuuuaaacaauaauggaacuggaauggaagacagggaggcuaaacucucacccccaacucccuuaagaauuuacuggguagaucacaugggcucucaaagacugucuccaucuuuaaaauguauauuuuagaugcuacaaucucuucuaccuugacaaggauaacuaaaaaauucuaacuugggagcccugcuuccugaacuuaaaucccagcucugacccugcuagugugcaacauggaucaagcuauaugaguucucccuggcuccaggugauuaucaguauaaugagaugauaguaauggccaucucauagauuuuuucuugggauggcauguaacucuagauggaugcccaacccacagcacauuuguugacuguggcuggugucaucaugaauccacaguguaugacuuuauacuuuuguuugccaaugcagauccacagucuccuagcuucuauuuccuuuccuuucacugcuucaggaaauacaggacagaaagcuguuauaaaucuagagaugauuggagugaaugugugcagaucauaauagcucccgaguacauuguacaaggcagugacauauauagacaguguuuagagaaauaguguacagauucccaaaucacgccaguaccagugugucucucaguuagaaaccuccaaucuagauuauuguuuuuucuuccaguuugauucacgcauacaauaggugccaagucaguguuuaaauagacagguauauguauguuuguauggguggauggauucacagaugaguagauggaugacggguggguggguggguggguagauggauaaauccacuuuauauuugcuucuucauuuaucuuaagcagaguaguguguguguguguguguguguguguguguguguguguguguguauuuucagagaaagcuccagcuauuucucuuguagggagguagauggccauagcuguguguuugcacauucccccaucuuuuagcauauaaaaucauuuuucaagucuuuucagcuguccaccuuugacaacagauaugcacuucucuguuucuccugugccuuccucuuccaacaaugaagggcuuaugcugggauuauugcuuguggcugccucuuuccgaaggucccaaagcuuggucuggcuuuuaucaaugguauugauggaggauggggucucagacaguuggauucagggaguggugcuguggccuggugccagcugaauaugucaggcuaagauggguaauucaggucugcucuggauauaggcagcuugguuaccuguuauccagcuguuagcagcuguugccuuagaagucaucaagcuguuuucccagaguuugcugcaggccuagagaaugguggggaucgggaggggaugggcuggccauggcauaguggcauacagcuauucucugagugugaagaaccuugucccacagggcaaagggcugcucucgccacugccucuuagagcuccaacucccuaaugagauuaaaaugccagcauccugccucugugcacacuuaggaacgcauuggcuugagaggcuuaaugaguguuagucaggaaucuaagugaggucugggcaggcgccuggcugaugcuucguugauuagaauacucaaugugcugcccuuugaaagccagcaauugccggagaccaggcucugugcucuguuuaaagaauuccuuaguaacccuacauucccacagcuuacagaccccuuuaagugcccagugaucuggcauagguugauugggacaagaaaauggguaacaaagacaaaacugauggucguuaucacaacaguaaagaguggcuuucaaaccuggcacccaccaggaacacuuaggauugguucaucuguuucuugggagauauuuccuucuuuuuuagagauggggucucauguagucuaagaugaccucaaacuugcuguaaagccaagaugccauuaaacucacgaaccccccugcuucugccucccaagcugauagagguaggcauaagccaccaagcucagguuaugcugugcuggaaacugaacccaggauuucaugcaugcuaagcaagcacucuaccaacugagccacaccccugaccccuuggaugauacugucaugguucucuuucucuagacccagagacaugggaaucuaucugcuuauuaaaggugcuguggggugcccauguccuggcugagccccaacacugggaacuguuguucagccaucuuagugccagaacuggauucucgaaccacagugcugccacuuccuaauuuguacauccuugcaccugcuguuuagccucugggccucaguuuuagcaucucuaaaaugggauuggacaaaaugauagcacugcuauagcaaacaauacagaagcugaaauugacaauagaguuacaacaugauccagcaacucugcuucugagcauacaucugaagggaaaacaaacaaacaaacaaacaaacaggagcucgaggagauaaccugugcacacucauuccuagaaccauucccacauccagagguagaccacauuaagugccugcuaacagaugaauggucauggcaguucucuacuacggaauguuauuaaacuuuuaaaaaguagguucacauauuccaccauggaaggagcuugaugacaugauauaagugaaguaagaugcauaucaugaauccauucuuaugaggaacuaagauggccagaucuguaggugguuguuggcagcuggagggagggagagugggauuuuaauuaucucacaaguucagaguuccaucuguguaagcugcagggguccuggagcaggauggguguaacggaaggacagccgauuguauuuuagugccagagcuagacccuugcaaacgaccaacaaaauaauuguaugcucuagggcacagugucucugcuuuccaucuugcuguaggagagcugggauuacagacgugagucaccacauccagcuuuuagauuuuuuuuaaauuuuauuuuauguauauguaugggaguguuuugcuuccgcgugugucugugcaccacaugcuugccugcugcccggggagacagaccaagagugucagaacuccucaaacugaucuugagaugcugcaugcguguugagaaccaaacuagcuucucugaaaaguagucagugcucuuaacugcggagcuaucucuccagcccccacacuuagcuuucuaugaguuccaagaaucaaacucaggucuccagauuugcacaccaagugccuuuaccagauaaaccaucucacuaauugcauagcuagauuuuuuuuuaaaguucgacauauaguaucugcccuccagaaucccuuuaaggaaaguauccaauagcaucugcaaauggcuuagcacagcuucugacacagcaccuguauuuaaacaucccuuugucuucucuccaucauuuuucaaguauuuucaaaaccauguuuaaccuagggucuuuauauguauguucuuaucuccaggaaugugucuagagggagcaaggaaggggacacacauuuguggagaaagaacacaaauacuuuugugggggguugaauguaauuggucgauaggcccagagggaguggcacuauuaggaauggaggccuacuggaggaagugugauacuauggaggcaggcuuugagaucucuuaugcucaagccaugcccagaguggcacacagucuccuucugcugccuuaagaucaagguguagaacucuuagcuccuucuucagcaccaugccuaucugcauugccaccauaaggauaauggacugaaccuguaagccagccccaaugaaauguuuuccuuauaagaguugcuguggucauggcauuucuuugcagcaauaaaacccuaacuaagaacgugcguaccuauaugagguuuaaguucagagaugucucauagucacaaaaugaaggcaaggcccaucaaggcuuuccucaacucacccuucugaguggcuuuuggccugcggauggcuaaggaacauggcuuccacucuucaaagagagccugcaaaacgucacacuugccaguuggcuuucauuugaggaggugggaaaguauacugaguaucuucccaggaguccuuugcgaauucuugauugaguccaagucuugucuggcguucaccauacaaacaugcuucauguucaugcuucuauuaggcuagacccagugauacucacagcaucaaaaaaaucagccuaucccagagacugggauugucugucacuagacaggcuacaaaucggccuugaaaagagccaccugccuacuuaggccaagcaggaaagauugauggcccucagguccaaaggaaugcuccuuuuccucauagcgugucucgugugugccugggucuacgauaaagaguugaugaaggggaaaaccaugugggaauccuguagucagaagcccaacgguaugguuccugccaaagucaauguuaagacugggguuuuguuucaaugagugaauuaaauuggacagcaaacugaauagcugaauuuucaauauuaucauaguaaauugaguaguuaucuucuuagagagcuaagugaugaugaugaugauagugguggcaauauuacaaaagacaacuugaauagcugaaguggagagaaaauuggguccccccuccucagaaauguuuuaauuuuacuuaccauaggcaugaccugugcuaaugacauuaaacacguugcccuguuucucuauaaauagucagagaaguguugucucugcuuugucaauauggaagucugaaaccagguggcuggugugucuaagguuaauguugucuagaaacggaacaggaggucuaccuggccccagacucuaugguauagacuuacugugucaugacugaaaccacagcuaauuacgcaucuucagaaauaugugcuugcuuuacagggggagucauuuaagaaguaacucucacccagugugcuuuacauaaagcccugauuagcaagagucacuuggggggagagcauuuucagucauaguuuaacccauuggagugguggcaguacugucacagcaaugccaccauguuaggugaaacaugaauaacauggcaccaccccuucaguaacuccuagucguuaaaugagcagaaaguggagcuggggucccacagucucagcucugccaggaccagccaugggaacucaagcaaaugacuuagcagcucuuuuguuguuguuuugagacagcguuucucuggguaagccuaacuguccucgcauucauuuuacacgccaggcuggccuugaacucagaagcuucugccucucagaaugauaggaggacaacagcacacucuggacugccucacauuucugagugucagugaauguguguaacaaacagaagugcacauucaauguaugucauguauauucugaacccacaauaccacagaguaaucgaggaauuuacucugccuacccaacaaucaagcgagaacaccccgacuuccucccugaacaacucuggcuaagccuuaaccuuuaagcagguuggugucaguuaucauaguuauauugguuggggucaguugucauauuggcauuccaucuugugcuucagucucaugugaucuuccuuaguaucuucagguccccuuaacaugggggaaauaguuaacaugguccuugguaaggucaagcuauuaucaugacccuagguuauagaaaauuccacuacauucugccuuugccauggcauuguucucaggguaaagaaauuuagaguucuagagcuaagcuggcccuggagaucacacagcaagacccacagcagggagcucagccccuaagggguagagaaggcagcugacugauacaaagaacaggaucuaucgaguccccuccuuacccacaggcuccuguauccuaagcaagcacaaugaaaugcacaaaagugagagugucugacaccaguggggaaccgacuucuccccuuucagaugcccagaagcacccucuggaacaaaggcagucaguauucaugucugaaauucuagaaacaggugaggacuaugggauaagauuuaggaucauggcucaagcgucccuguagaauccccuagggaaggggaaagcaugcaaggguggagagaagaggugggguuugcugcagagaugaggagaaaugaagaucuaucuaaccuucuuuguaauggcaaaagaauggaagaaagaauuccgaagcauacgcaggaaaaagugguuucugcuuguuugagaguuggggaaaggauaugaaaaagaugacucagagcugaccaaauccaagcccuucccuaucccucuccuugcccgcccaguugugcaaguuccugcuuauguaugcucuaccucagucuccacaaugauaaacucacaggguauugcaauuuucuauuuaugugucaacgucuucugguuugcaucaugcacuaucuacugacuuuauccccugcucuguaccgaagacugguccccucacccucucauccucauaggacugcccagcagagaaagucauuuauuuauuauccgucuccccugucagcaccuacguuucccagggcagggacggaggguccugcucgagacccuuuugaucuagagcuuagaagaaggcucaauaaacacuacauaucuccugcucccuccuucagaaucccagagugagaaucccuagucucccuuaagccgacacauagucuaguuuccuaauuauccuugccacagucucagacacacauuagacacagcaauccaaagguguuggcuaaagaacugggcggauaaagauacugauaaucagaaccaauuaccuaacauuguggcguuuggugcucaauaaaacugugccagguuuuuugcuuucuuuuaaaauauaagaaagccauagcaguggccuccaccaauccuguuugcuucuggguguaggcccugcgcaaccucaugcuucacacaccgugaagccggaucuguugaugaggaccagaccuuagaagacuauaaauaccagauacuggauuuaugguuugucauguaaaaacuaaggaacuacagaaggauucugaacagaggugacauuucaaguuuaucucacuguuuccugacugugggucauaagcacuguggaaaauaugcacaaauacagaaaggcauaaagccugguuaaucuccuccucccucucgcccugcaggcacccaaccccacaggaacuggcaagccuuugguuaacauccuucaucuccccaaguucaugucuuuccgagucuccuaguaaggccaguacuucuucagcucuagcauggagcuuugcuuuauucaagugacauuugaaggaguggagaggagcuuugcuuuguuuagggagccucggucuggaagugagcuuguggaaaggcagggaggaccauucauaggguugccaguaaggcauugaauuggagguugaugugggcucuggaguuccuaauggguggcuguggagagauaggcagggagcugguucaacacugacaagcuaucccaccuuucaugaaagcccuucuucuggaaagaacuuccaggauuuggugaaccuuucggaggaucugcagguggcagcagguauuaggacuccucaguccaauauucuaccuacgcguccgagcuaagguugagccuccugcuaggggucagguuuugcauccuaagcagccugggguauggccauggggauaguaauccaccagagagcauguguggagggucaggcuucccaacaugggcggcucacgccucaggguucagauuugcacauuuucuugguaauccccugugccugggcuggcaaaggagagaguuaacauugucaucggauccuuaauugugcguuucaugaauuuucauguuuccgcuugcaagcuuaauguugcuuucuccgugaguucuuuauacucaagcauaagagacucguaauuacagaguguuguggauugcagagggugauuaaaauggauuucaugaaaucugagauucaacccccaaaaccccaccccucucagcgcgcacgcgcgcgcacacacacacacacacacacacacacacacacacacguccauugggcaggggaguaaguuggaaucccacuauguucagagaauauaggaaggguaugaauuuucuuuaugauuuuccucccuggaucuuggaucugcuccaagacagcccucccccaccucuccuuccuccucccuuccuucucuaacuccuccauuuccugaaaggaguccagcuccaucccugacccccagccagcucugaccccccacccccacccccggggcccucuggcugccucucacuccaagagacaaggagacagaguaggcuugucuuugcuugagugcaguugagcuuucucaucaccacggucauggucagccuccaucccugucacuuugaauaaggccugaagaugcugaagccagugagggguaaggauucccaucuugugugucuuucuuccuaggacaauuugcuuggugccugcuagacaugagguguaguccucucagccuuaaucuaaaucaggaaugggcuauuuggcucaugaguugggagaguuagcuggaaggcucccuugaggaggcaggcuuuaucuugaauaaagaggaacugagucuccugagaaggcgagccgagaaguaggaaacccagccuggcaaagcuggaaguggcccgccucuucagguguguacuauaguguuggaagggagcaaaauacuucuguguaaaaggacaacuguugccagagcaggcuugaaugagaaaacacauagcccgccccagacaaaagugaaugugcaccaaauuaacccucucagcuucucucauggagcaguaaaccaccugccccauguuguguggcagcccuggagcagagugaagccaggccuuucugugucucugucuguguccuccucguggcacaugacccauguaugggggaaguaucccuagcggcacuugggccgcacugaugugugggcugaugguacaauguuaccagcagagccaggauccagggaagcaucugugggucgcuacaaacucugcccaggucagguugugguccauucuccagaaucuuauugaggcuccagcacucacuggugcaugagucaagcuucacggugaaaucugagagagggagaagccagcuuggcacgcagacuaagaaauagauauuccucauagcagguaaaagcaggguagggcuuuuggaaccacuggaagagugcuugggucccaugcucuguuccaguggcauuccuuccaaagcagacaccuucccagguauuacccagauugggacccuuucugaagcucacugcucuuuaacugugaucuuggaucuugccugaaggguacauccucaccagccuggcugcagcugugagaugggcucuaacagcagaugcugagagcaggugagacgugauccuccauggagaaugcagaagagaggggcuucucuaaaacuggaugggccucaugcuagggugaagaggauggagacaggcaagguauucugguagcagagauggugaaggcuagcuauauuuuaacagagguaauuagggagagcaucuagaaaaugagacauuuaaaguaggccuucaagacuaggaauucaccagcaagaaauaucaucuggccucagacaauggaaggcagguaggagagaaagcaguagcaauaauagcugugcuaguguuaacagaaggccauccacguauauacccugggguaucuccauuuacagaugagauagcuaagcaccagacugguucagaauuuuucagagucacacagcuuguaugacuaggcuucaaaaccaaacuguugcucucugacccauucuucuucuaaacacugagcgaaccaugucugccauggcuuaggcauuucccaagcauguauuuauuaagcugucucagcaccucagcacaugugggaaaagauguucuaacgggcugggaugaguaucaaacuucugcuugccugcuaccaugagcucucuacccucccucccucccucccucccucccucccucccucccucccuccuucccuccuucccuccuucccucccuuugggagccccugugcuugcaacaauccagucaguggcuccaagccugccaacauggcuuucugggggcuuguccuuggccaaaguuauuggcaaacucuauugauacauuuaaacacaagaagugaaacaaguaguaagugguaauaguaugcuuccauaaaaaugugccuccaguucggaaacucagucgcaccuggcuuccuuacacacuguggaaguguuaacaucccuguguaggcagauaagcugugcagaggaacauacaaauguauguaaagugacucucugcauaagauggccuccuaaccuaggagaccagauuacccagagccugcugaaacccaggguguguuugugagucuguguuuaggugagaagaagaggaaggugggagagagaggagaugggaggggaggggagaggagaggagagccugguggacauuaccacugcacaggagggacagcaaaggcuugacucuacuaguuacuuaguuacucuuuucuuuucuuuucuuuucuuuucuuuucuuagauuuauuuauuuauuuuauguaaugaguacacuguaguuaucuucagacacaccagaagagggcaucagaucacauugcagaugguugugagccaccaugugguugcuggaaauugacucaggaccucuggaagagcagucagugcucuuaaccacugagccaucgcuccagcccacucuuuuuuuucaauuacaugagaaauacccuauaaguauaugugggagguggguccccacuggaaugcauaggcugacuuauuauuaaugauggcuaucuuacuaaugauguucuuuaaguauugauuaagauacuauguuggucagcacuguccaggaaaacagaaccaacagaagauucucauggguacauacauauauccuuauuuuauaaucuaauacauacauaugcauauaggcuuauuguggggaaucagcccacaugccuguguggcuauggaauaugaaguccauggggcaggcagcaggcuggagauucaggcaggagcuacugcuguggucuuaagauuaaacuuucuaaggaaucacagcauuugcucccagggccuaaaacugauuagaaggcguuacccagauucucaagguucaucucucuuucuucugauuacagaggucagccauacccauauaacuccuucauauacaaagcuaacaucaacaguggcuucugauuucucccauugccaucuccccuuagucaacggaacuuuguugggagauauuucaagaucguguguauguucucuccuuugucuaaccccucccaccugcaucaagcauccauugcugguccuuccugaaaggaagcaguguugccuguaaccauuauguaaagagcuuucccuugaagaaaaaguuugagaacugccuacccaugacagcucugccauuuagucagcccuguggccuggucagguucucauucaggaccacuugcucacacaaggcggcuggacuugugcaacugguacagcauucguuagauauaauaacauguguaaaaaugcuguguauaaggaagguggcuuagagagccuuauacagacucaugcagccuucugucauggcuaaguacaucuuuaauuaggaaaacauuuaucuuagucuuccuccccaucacagugaagauacaaugaguuaauuuaaacagagaccuuaaggcagcagcuggcaagguuagagcaaggguuagggucuuacuugauuaaauaaaagagaacauucuagacaucuguucuucaguuaaagaguuguuacuguccuugaagccacccaaaacuuuagcauuaauuguguuauuuauuuauuuauuuauuuauuuauuaauauuugcuggcauuuauugucacucugccuauacccaagcuuacugugccaccucucugaagagucccuaaccugcuaugguagaaagaacagaaagcuggaugccaagggugugugagcuacugucccaucccuuccauggcccugugcuaauauuuugagcaaguuacgccucccugaacuucaguuuucccuucugcaaaguagaagggucgaaccagcuaauacuuaaccuaaugcuggcuguaaaugucccaaguagcuuuaguucagagauaguugggccaacuaaacuguccagcacccaaugucugccaugcauuccucauacgaagcuccaucggguccccagcgcagccuugcccuggauguguuaguggaguuaucccaccaaugcucugagaugcuggaugccuguugguucuccuacugguaaaggguacagccaggacucaagccuggagcugcccaucccaaauauccuuugcuuugagcuggcuuccacuaugaucaguaucucagagauugaauuuagaaggcaccaggcucagcauacagaaagccccaucccucccagccugaacucucugggccucacagguagaaccauccugcuugagcucuuacugauucugugacuuggggaaaaucauuuagcuuucuuaugccucaguuuccuggucucugaaaggcagcuauuucacacaguuauguugugaugagacuugaagagaguccugcaaaauauuagcacagucacuaggauuuagguaaauugagcuaaauaguuccacugggucagccucccaagccugaugugaaaacagaugcaacaagccauggaaaguauauuauagauugcagugugcuguuuauauaugaaggaucaggauucuaagaucugacccuggagaagcaguugaaggcaaggguaacaggagccgcaagggacggugacccugccgauuccacacauuuuuuuguuguuguuccugaguucucaagugcaguuccccccacccccaccccccgccccucagucaagcuagauuuguuaggggaaacaaguaacaugagucuauaaacuuucaacucaacucaauuacaaggaaguggguaaccggaagugggaauuccaaaugaaaccaaacuauaugcguuggcuuuacaccagcaauuaaguauguugaugggaagaaaacagugauuuuacccuuuugaaguagaguugggguuacggcuguacacaccuguguuguauuaaguugugggaucaguagguauaauuacagaauuuaauuauaaagugugucuuacugacauguguaugcauggguguacauauuguaaacccuuucaagacgguuuauuuaaaacaaaaucauagaaggucagcuucucacugaaagguucauggugggucuuccugagugggaggagcccagaaagucuuuauucucuuguguuauuugaguaggaaaauaccccacugugugucucucccuccuucucuuccucccccuuucuuucuccuuucccuucuacuucccuguuagaucuccuccacccccuccucccaguaguacuauauaucaaaccccagccuccugcacuguacacaaaugcucuauucuugagcuuggaugcuuacaagacaaccauuucuuuagagaaacuuacaguccuguuagaaaugacaggcaauaaauagucagaggauuaguuccaaucucuacuaccugcuaggaaaaaaaugguguaguuaguuugagaacaaccagggaagggcgggguggugaugaaacagacuucaucuuugauguugggggagccgggggcacucgggccucaucugugauaccagaaagaggcucucagguagaaugugggaugcucugagaguccuaggaagacggaaaaccaauucucagccugggguuugggggcgggccuucuacagcccuuauggaguucggccucuugugucucuucgaaaguauguccuacuaggacuaguggugauagaugccaccagcccaccccccccccccgacccagcugcccuagaaaccauaacaaaguuacuggcuuugaagccucuggaugcucaagucuucccugucucaggcagcuccccucuugccagaguucuuguccuucuguggaguccuaggcugccauuuagccuuucccagagaagcaccgcagggccagagauaaggcuuugcaugcuccaggcccuggguucaagccccaguaucacagaacauaaagauaaaacagcucucucccagccacauccacuuacacuuugugacuugcuucuuguccuguguggaucuaacccauucuaucuagggaguggagagaggccucaagaaaaggcaaggagcacaggggccccaggaaaauuuccuuuccccagugggggaguagggauauuuaugugcuucuuugucuagaucuuaucuacuuuuauuuuaugcauguauguauauaugccauguguacacaagugccugcagagaccagaagagggcauuggagccccuggaagugaaguuacaaguaguggggagccacuguguggguucugggaaccaaaccuggauccucugcaagaacuucaaaugcucuuaacuccugagucaucuuuccauugucugcuggaaacgcuuguacuaaauacuucuauucagucaccuaccuugggaggcagugggagguguuucccacuaacuaacuaucaucauguggacuucuaaacuguagagggucguuucuuguacagauaguuuacugggcauuuauuaugugacaguguauccuaggcacagggaaugauguggacaaauuuccugagcuaggagauacuguucagggcaggucuugucccagcccuauaucugccuuugaucccauguuugccauuauuauauacaauaaagauuaaaguguggauaauauuagguaauaaguauggaagugcuugggaaagcauccagaaaccuggcugacuuuccuuauaagccauucuacaaucccagaaaagggcuggagcauuggguaagcacaccuguaguucuuucgucauaccacuagaugucagugguguucaggaggggaggaggacacguggugaugaccuuuuagccagguuguggagacugcaaaauaaagacuuucuguauacuagaugcuguccugaaugcagugaauuucccauaucauuugaugcuuacagaggccccaugauuugcauauuccuaucccuaguuuacaguucucaaagaaagaacugcugcuaauguuagucaguuuucuaucugaagccaccauacaaagauugccuuagaagcaauguucagccagacaguccuuggcugcugccgacccacugugaacagugucuccccauacacgggcagcaaaugacugcacagauguauaaagacaaaagcuuccauggaugucugaguagagugcagugcaggugcucauuagacagacagaaagguacaggcugacaaaagccugcagaggcagcugggcugucuacaucuccuguuagagagguuagaaaucauaaacacucuugguggggcugggacuugacaugaggaauauaaaaaggucucagugagcuugacuuuaaaugagcauauagauagagguacuauaugccauuccaacaaugaccagcauggcaagauguuccaagggcauaguaguggcacuuauaucuuggggguaaccaauacccauccaguuguaccuaaggccuacucaguuagaggacauucaugacugguacuguaaaucuaaccaacucugcauggcugguaaugucauagacccgagaggaaaacaguacagacaguauagcuucuaaacuauauucuaaaugcuuauacccacagauaaguauagcucucagcccuugucauagaagcuucuuuuugccgaaaacauuacagaaauuccaaacuggucaaaaagaaaaacuaacugugggguacccagccccacuuuaugcauuuacaguacaaccccaaaccuaauucucaagaaacaucgcaaaaguagagaaagaaaaaucacuaaaaacugaaaggccaggacaucugauaauggcagagcagcugagcccaugaaaucccaaaaaugugguugcuuaaauaagaucugcacaacgacaccaguuuacaugccagugugaauaggggaaaucucacaaggccuggaagaagagcuauagguaacuaauagcuacugagacgaggagaauuaguauuucccauagacuaggccagcccccugguaggcgauccaaacccaaguggucagcuuuaaacaugcacauagcagugacucuaaaugggcucagaaggauguauguauaauauaauagacauugguuuacauuauauaauaauuuuuuaaaaaggaguuugugaauuugagauggaucugaguacacaagaagaauuggagaaguagaggcucucaucuauaaaauucucaaaaaauauauuaaauuauaaaaagagcuggaguccagaucuucccuaagcaaugccugaaaguugcugaaaguuaaagaaaaaguagggggaaauucaaggucaaaguuauacaaagacagacugcguguaguagcugaugguaauuccaggccuuugggagcuggggagguggcucagcuguuaagagcacacacuggucucccaaagcaccugacuuugauucucaacaccuauguggggcagcucgcaauugccuauaacugcagcuccagggggcucugauacccucucuggcuccucaaauacccucuccuguaucuagaaauaugcaugcauggugagugcacacauacacgcacacacacacaaaacuaaaauaaaugaugacgucauccuucccaagagaagacaugacaaaggcaagaaagacacugcuacguuucuguccucaacacccauagaccuucaguucagacccuggacuacggcaaggcagggagaaugaugugaagaguggaacgcacacagaaguccguagggaggccuugcaaaggacagaagaaacagacuaggcaugauucccacgaaggaaaauccaggagcccucucuuaaguugagccccacccaagggacagcccuggcgauaccugaagcaaaccaauggcuuuggaaauggcugggcaauggggucacacaaacagagggagggaaggcucaaggggaccugauggcaagaugucucugugaugucugggguaccuacuagcuuugaggaagcagguuugggcauggcagaauaaaugguuacauuugucccuguugaaccauuuacaaggucauuucuacaugugacaucuuguuugaggucaguuagcaaggagcugaaggggcucucuauguucuuaccugaaggaugaguaaagccgaccuucgugcucauucauuaccauagguuugggugcuggggugaaaauucugguuuuucuaguugcuaugcuacaucgauuucagagcgaugaugucccggaauggugauaaaguugcuguuguuuaugacucuggggccaggcauguuggucugguuugcaccuggaagccccugagccucgacaaggcacaucacaugccuaccguaacaagagaaugugucuaggagagaggggaccaaaugcaaacuaacaugugcaucugcuagucgagugcuccuucugcuccucgucuuugugggaucgggugugccccuguuccuggagggugggagccuauucugguggccugccgccagcucuucuucacgaugagucuuccuuaggcaaaugcuugggaggagccaucuccaguuaagggccugcuuuggaaggcaaguucucugacucaugcugaguaaagucugcacacaagcaggugccugacugggagcacauuucuagggcuuaaugagcaucuggaagggaggagacaggaggguccugggggcagagcuuggcgaucugcuaggaggaggggggaagccggagaaauaagccugcauugggagugauaugaucacauggcauccaugaaagaugacuaucacuggccaggagaugggauggaggcaacacaggagacccaggaugaugcuguggaaggcagcagauaaugcuacuugggcaggccacugcaaaacagcagacagcccugaggacagaggaucaugugaguugagaacgacguguguaccugcgauugcugaguccucccuuucagccuucaccaguuguggggagggcauuucccuucucaacaacuucuuaugcugccuaaguaggagagccuggcccauugucacaguuuauaguuaucuguaugcuuugguguuauugucuugugcucuguagacucccaauuccaagucaagugguguucauuuuuuaaggcuucuugccuaguuucacguuggaguucuaaaaaguaugugugacuaugaccaccgugggaaguuaguggcuagccacugauguccagguaacucuaauggucacuguuugguacuguauugacaguuuauuguuugaucuccccugacuucuaguguaagaugcugcuuguaaaugguuuuuaggauuccuuuguucuauuuugaaggguugagggaccugguuuucuucauuguuguuuguuuguuuguuugugagauuaaaaaaaaugaggaaaauuuuuauuuuccaaauauauguucuggaagaaggaaucugggcuuuaauuaucuguucagaccacagagaggaagcacagcuggcuaggaaugcuuuggaaagccagagaggaagccacgguauaaagugcaaggaauuuuggguugucugggcuuugagaagcagagacuuuaagaacugauagagucccucuguggccuuacaacagaggagggagcagcucugccugguaagcucuuuggcccagaagaaagaaaaugggccccugggcaccaugucuucacccuguccuccgugccagcagugcagaacuaguaucugccucuggcaagucagcuugccucuguuucccuaucuguaaacuggauggagauaacagaguccucucuuggggguugcugggaggacuuggugugaugauaaagaugaaagcuacuucuuuaguuaacaugaauuuaaugaauaguauaguaauugcuauuauguaauacauuauugaaauuuuuuaaaaaaauaauaauuagaacuuuacuauuaagaacuugcaaauaaaauucacucaguaagcuuagccagucccaaagucuauacacugaaaucuuacuaaucauauccagggccaaauuaagaguguguguguguguguguguguguguguguguguguacucgcacaagaacuggucuuccaagaaaagggauuuaaaagugugagaaaagagcagauuguucccuuagagaccagaauauccugggaaaaugucuauaaguugcugaaacuauuuuagaguugccagaauauuccaaggaacagaagaaaagccagccaguggcccagcuguggacuuuacuagguugcagguccauauguuuggcuaggucuggucuucuggcaucccagccucucugagucggggacagaucccaagaauuggcuucccagacagcugcuugcuaucugcaagagcugacuauggguaaggcugagggaacggggaacugaugcuugccagguuuauguggacauaaagaagaccauuggucacuuacagagugacuguuugugcugacaaacuccuucugggcuucucuguaacaguggaccugagaccucuguaacaguggaacugaaacuaucaccccaaaauuuuguccucgcagcaaccucccucaucucucugcagggccaacagaguguucuucacccugucuguuuccuuacugguuccaauggaagcacggccaucgugaucuugaacauuuaucaguugcuuaccuucgaccaguguggugccagaugcuucaggggaauagucaguuaccuggguuagguagcuaggcagaaccggaaacagagcuggagagguucuuuauagagagucacacagcuggcaaguagcaauggugacgucuacauccagguucaggcuuuaguguccacccuugcaaccuuacugaauguuucuuauuuccuggaugugagaccccccccccggacagaacaacagagaggugacaaucacauggcccagccauggguuaacccaggcuagcccauucuuugaggccaccgugcugcagggaaagcauaacagaguuaggagacaauguagcuggguugagcucuagggcugcucugcauuagcugugagucauagaucccucugaucuccuucaaauuggaugacaauauuuacuuuuccaggcuaccaaaagaaacgacgauaacaggcuggccugguacgugcugggcaggugucuggaaauggcaagugguaccacaguugcaggaaacagagaguuagggcuuuguuaaacccgggaagucugaucccucacugcaggaagaaacaggcugcuagaggcaagcacguucccaacucucuugcaggcugcaggcugcaggcugcaggccugguguuggcccuggcaacagaauccauuuuauuuucuaaguauuucaggaccagaugagucagugugcuuucaccuucaguauagcauaugggagaaugcaaaggagccugcuggcuauucuccaugaggguuguuugucuuccuugaucaagagagaauggccaaaugugggcagcugugugaggagcugaagacaagaagcagaggugugugagcauccugguugccugcugcuuaccuugggauaccacuugcccucuggagccauuguucccacuuuugaaacgaggguccaagcuucuuggaaggguuauuauagugguugaagguuagcuguagguagucccacaaaccauuaggacccuacauccaagguugucaggccaugccuccucugccccucccacacccgacuugucuagccagguaaaaauggguguggccagauauagcccuccugccagacauagcugaugccaaauccucuggagagcagauggaauagaucuggccuacucuccuggguccagccucagaucuuuugaccccucucugggucagugcacaacuuggggcuggggcaggcacagaucugggacagccuggagccauaagcagccucguaaaucaggcccagccuuggagacuucugcaagcucucuguggagccuaggagccccagcuucuuaaagcuguauccucucacucccacuccagucuggagucuaaggggugaacagaaccugauuuauagagaccucagcccagccugugagggaggccccagaaagaaugggcuuccccuaugaccugccucccaagucacagauagagacagaggugcucuguagggagaaccaccucccucugggccaagguugaaaacugaaaacuguccccaacuauccccuucugggacuuggccuucuucacuggaaagauccaauuuguccuuucauaaaugaaugaaagggggaaacacuuccaaaacggccccuugccacagagcugcugcagaaggaucgaucgggucugaguuugagcucaaacuccaccauccccagcuuagacaagucuucucccauccacuccuguaucucagucuucucccauccacuccuguaucucacugucuagucucccacauggcauagagcuggugugagagacaaccgguuagcagaugccaggcacacuguacauugacaagcaguuguguauacuugaaaaagcuucucuccccgaccccugucugcuucuucaagucaaacaggagacaccagguuuggacccuuguacaggccugucagguggggacucaugaauuacucuccgaccaccccgaacuucuagaacaccacugucuacacuuagccagucucuacauguggcugcuguguucaugaaaugugacgauacaauuaaaaaccuuaauuguuauuuuaacagcaauuaaaauugaaaucuauuacaugcugugggugacuacugugguagacaacccaggccuuaaccacacagucuugaagaccugguucggcauugguucuuggauaagcuuaauuacccauccacgccuccaauguccucaucuauaaggcaaagaguguguggagucagcacggaaaugccucacuccagucacaacuguagguuuucaaggauuugucaugauuuuugacucuugcugaguuaagagcaagggcaggcuuuagagaaggcaggagcccaguuugggacaaccaucugauuagagaucagcuccuauguggaagagucaugggggugcaguucuaauccugcccccaguguucaaagguacccuaguguggcuugaaccccucgugcacugugucuaccacuucuuauaccauaaggacuuucccuacagccacagugcuuucgggaugaccuuagcgccauguuuucugccaugucaccuugcacucaguuuaccaugagauaacaucugguuggaggcugaagcugucaccuaggauagauggugccuuggguguuggggggggcacagagauggagaaagcagaaagggcaaguggagcuauaucaccauccuuaagucugcuuugaugggccaucauggccaccugagcucacauuuaggauaagaaggaaauaugugguaucagccaucacccuuccaaguuccuucuaccaguaagcuuccguucccaacugauuggccagaauaaagucaugugguuaccaauaaccgcaagggagucugggaaagugaauagcuggcaaucaugaacuaggcaggcuuguuuuauuuguuggacaaaauuuguuucagucuggggaaaaguaggaagagaaugagucuuggauuugccagcaaucacgucugccuuuauagccucugguaugauuauuauaauguuuucuaaauuaccacauacguuucagauuugugauccuguuugaguuucucaagcuuguggacaacagagauuguaguccucauauuggagauagggagaaugagaccgugugagguagaguaacuuacucuggaaacaguggcuccugcaggaacuacccaguuuuccacauucuuaacuauccccugagcuggaggagaaaccucagagaaggaagcaagcagaugguauuuauaguuauagcccaaaauggcagccuugauggccugguacaaaguagcuauucagcuaaccuuugcugguuauaauuaauguguuacuuuacuucuuuauugacaugguggacaagguaggucaauucauauaaagcaggcuucugagaacacagcucagaaaccaggggguguuccucagggaacaaucgggaggagggaagacagcauugguuuccuugccucuaguaaguagcuucaaaaagagucagguuagcaagcauccuauuugcagaucucuacugagaaaacguauuuguacucacagcucugucagucuaucuuuauggaacuaacugggguuuuccaaggcaaccucuaaaccccaucugcaccccaggaccccaaagcacagggacugagguaggaccuggaagggugcaaaggaaagggaaaaaaaagguacaccccaccgucucuuggauucaccuuuauuuguaguaaggcagaccuuugcugaccauaagcagcugaccaacugcugaacccugagcucagggagaggaggucgggccucaguggucuuauggaagggaaggggugaguugaggggaaguccaggcacagggcagcuggccuugcaggguuuuagcuaccagugugcagggaagauauucuaggcagagggcaguguguggacaagguaaaggagcaaguagguggucaggauugagcaucaagaguggaguguuugaaaucaggguggcgaggacaugagcagguagcagcaggucuuuggauugaaggguugaucugguuuccuauacauucaaugcccaccagucgucaaugucaugcaggagcccugaaagucuaguuucagauaagguagagccugagacucugcauuucauacaggcucccagaugcugcugugacaagcacugcuuaccggucaguggaauggcaaggcucucaguggucaagccaggccagcucuucuccuauuuagcuggaugaaguuaccacagggccaugucucaguccuuuuuuagaaaaaguacucagaaagcugugaagaaguuuccagggcauagaagaaagcaggcaaaaugggagguuuauuuuuucuguauuccuaaaaccuagagugcuagcuagcucauaaaagauaggcaguaugcauagaaagaaucggauguucagguuagcccagcugggaagccagugcucuguacaucucuugcugcggucaggccaaaucacuauguaaagggaguugauuccuaauuuguuuuuaaccauucaucaacugaucauacaugugaaaugccaaaagaacacauaugugaagcacauaaguaauugagugcccgcccagauuagcccaaggauggggacccugaagccaauagacuaguucucuucucuccccaacaccagugacugccaaaugcccacugcccccacccagcucucacaguuuugguuuuccuaaagaagccaggccagaucuucucccauuucgcuggaugaagcauccugcugcuagaucucagguagugacugauguaucuggauugguucccccaacuaaauaguauuauccuacaggauaaaaccacaaaagccacauugguauaucucaugccauacacaaaacuaguucaaaugagguccuugggaaagggugaugggagguuaaugguagcuacagcaaguccgaaagacaaggcuugaauucacagaaugccucuccucccaagcagcaagggagguguggguagccaaggcauacgggagauaagauucauauguaauacauauauauucaguauaacauuugagggcucaaaucucagcuaugcugcuuuaguuaaguacucagcaucucuggucuuggcuucucaaucauuaaaggaguaggacugguccugccuuuggagaugugcacugcgagaacuagaugagcgacuagaugcaagcagagcuuuuuaagcucugcagcucuccccagacacugccucugccagcucucagucugcuuugcuucugcacaagugucugcauacuguugcaucuaagcaagaagcaucagucacgcugacaaaucucugugcccccagguaguguuucuaaccaguuagagguuuggcauuuauucucaacugcuuguugguauauuuuucaaauagccaaguauuuaaauaccaucagccugauugcuucugcagauuuguagcccuuguccugcaucagggaaauccucucacaggcuguuguaacagaggcagcuaccaccuaguggaaagggcacuaggaugcagagaaaaagaucaaauuccaccucuauuuccugccagcaaagugaccugggacuagacaugucaccugguggaggcuucauuucuucaaugggaauaacacgaauuuguguuguucaguuucaaggccauguauaccugcuggugugacacacucuaaaccucugugacuguaaaccaaguuguagccaaccaaucuccaaguuguagcccaaaacauugaaguucauuguguaaaccuuugaaugccauuuuccuuaaacagugaagugauaccaugagaagaugguucgguccauaagguucuugccuugcaagcauggggacuuggauuggguucccagaacucauguaaaauacuuauguuugcaaucccagcaccagggaggcagaagcaggaggaucuccugcaugcuggcuagacaagccuagcuuaauggcugagcuccaggccagggagagacccugucucaaauguaaguggaugcugccuaaagauugacgccccaaacugucuuucauccuucacaugugugcacccacaugcacaugcaucuucacacacaugaacacagcauacaugcauaugcagaccuggagugcucuaggacaaacccuugcucaccugauauggaguuuaugguaagacagagaagcaccacaagguggucaguaagugaaagccuuccuugggcuaugauuuacauagccuugucauuugaugaucacaaagcuaggucugaagucagcucuccugagcuaaaugccauacuuuucccucacccuccgaccugcugagaggaaccugugacacaugcuauucaggguaguauaaagucagauggcauaguguaacugucacaguacuggguccagguaaggccucucagcauggcauacucucaggguggccugggccaucugucaauguauagccaaucuuggcauagguuuugacuguuaaguuugcacauuaucuagaagaaccauaggccaggcuguucuccguuccucccucaaggcucugacuuaagcacccaugcuugaauucgugggaauaggaagaggacggaccuaguagcacccugcccccacauuaagccauagcaggggcacaucucaaaaaggucuaggcaaagugggccaguguccagccaccugccuauacguggggccuuggccugcuguguggagugggguggggggacacuaauccuauuuuuuuuugaagcugucuuggagugggcacagagccuaagccaauuaaaaccuccucuuugaaggugguuuagguuucccagagaaggcggguugcaaggugaccugggauaauugcucucaggguuugaucuccucccugccggccugagcuggaggaacacaggggcccaccgccccacugugcucuguagggcccggucagacaaugguauaggucaugaggagaaguaggacacuaggaauauuaacaacccuugacaaaggaggaaggcagaaccuaggaugauuuaccaugguccaugccuagcaaguucuagggugagaccgauacugccuguucaaauucauuguccagauccuggucacacuguaugucaucacuaaccagggaauuuuguagguuagcaauagauauuuauucugugacuaagugaaugaguccuguuaaacagaguuauuuugugucuuaccacaaugcugaaugggcuggagaaagccagaccugaauacaagcuacagugagagcuuugcaaugaagaugagaagcagccaaauccagggcugaagagacugcucagccuguaaaguguuugcuuucucaucauggaccugaguuugaucccuaggaccuacauuaaaaacacuagcauuuacugcugaucccagugcuggggaagcagagaggaaguccuuagggcucaccaguuagccaaguuugcaaguuucaggcaaguaagagacccuguuucaaacacugagguggacaguuccugaagaaugacaucacauacacacauaugcauacucucuacacacacacacaagcacaaacacauacacacacacacacacacacacacacacacacacacacagggagagagagagagagagagagagagagagagagagagagagagagagagagagagagagaaccugucaagugucagcugcagccugcucuaugugcuuuucaauauuaaaucacuagccccuccccugcaucccuaccauggaagaaaaaauagcauuuccacuuugaagagaaggcaaaaaaguggggagguuaaaggagugucauggaauaucaugugauacaguagagcacagaucagaacccugagcacagaaggaucucucuccccccuccuucccuccuccuccuccuccuccuccuccuucucucucucucuuucucucucucucucucucucucucucucucucucucucucucaggacugcccuucuguaagguagacacaguagugaguggauggguggucuguuaagaacacuacccgacaaaugggggcuucugcucccuuaacaaagucgggccuggccccuguaauguagccugcuaaggcugaguggcccacuucucucccucuccugcagaguggccuccaaggcuggcaccauuaauugagguuaacaacccgaaagggcagaauugauggagugacaggcagcauuucuuaaugaaaacaaauuuaggucuaugaucaagagaacaaaguccccaggaagccaggcugccaugacccaaguguaacauuagacagugcaggggcaaggaccagggcuuccccacagacuccggacccuccugaaaagcagagagacgcuguagccacccaagaggcaguucacaggagcccacagaggcagcggaggaaucuagcuugcucuugguguccgaggcugcugcaaagguaaacgccauuucagguauaguugggcuucuuguggaagauugcuuaggggcgcuugaagaugaucgauuuucuauaguaagcagaagggaggauaggauaaaaggaagcaggcaucugaaacuggucccacauacagccugaccuggggcugaggagagauggggcuguccugugcucucuccagucugcaggaugggagccauguuccugggucugcauggggcuggaugauacaaguucaugcaggaccucaacuagcaaguaucucugaucccaagcagugggguucaugcugguaugcuuuagccccagcugggagcuuauuuugaucagaauccucuuagcauggcgaucagcauuccuuaaacauauggaauucauccagcaacauucccuccuaacugugggguaguuacucauuuccucaacugucuugcccucaggaugcauggaaaauuuaagggcagaccuuugcacucuggggcagaagaacagagcuucauuggaguccaggcgcuguuagcuguauagcuuggcaacaaaguccuucuccuaucuuggugcaggucuucuaucugagacagcucagcuacucagagauguugccuguuuauccaguaaaucaaucaguaucuauuaagugcucaauguuugaggaguuugggagcacacaguuuagaacauauggugaagcaguuaccuaaauauaaacauaauauugguauaaacgguaaguuaauuaaaaaaauuuaaaagguccaaggugauuggugaucaauuaaauugcacaaacaugaggaagaaauguacaaguuuuacaaugcugcuuuuaacuugaaucaccugagucucuucaucuauaaugggaauuauaguaauauuuauagaaauuuguuuguacaguguacuauggcaccccaaaaucuaguggcguauacuggucauucauugguucuuauuucugaagcucaguaauccaggcuugguauaacuggguaggucagcucauucaugggcucccaccguguggcuacaauccaguaagagcuuguugcuccagccaagaugcuaagcauuuuguaugaugcuaauuguccaaaagaagcaagagaaggcaaguucuaauagucaagggucuucccugccucugcuuugaauuugcuauuuuucuuuugguccacaagaagcaaggcacauggccagcccuagaggcaggguguagguacacaggguuugaauacguggaggugugcuuccuuagaaguuguuauagcugucuaccaacaugacuuggagauuuagaaagaaauaugugauacugagccugugguguuuguauugaugcugacacccaggguuggauaaauaugaaguugagcugcuugcuuccuucuuagggaaaaagacauugcauagagaauaaauggcagguaaagucugucaucauggcuagaaaucauacuaccaggauugucugugguaaugagacugcaucagacucugccaucaucaauccugccauuaagaaggugacauggagucuguaguaauuucucccugaauguaccuggugucaucugaucuccaaagaguaguauuaaccaugaaaaaucuuuucuucagaggaagauggacagaaaggaggcaauguaggugauagcugaaucaggcaaaggcacagaaauauuugcuggauaaagauguuagauauauaccuguugccaucugagcccuuggucuagggcaggcucaaagagaagugcuuccauggauuacaucauuuaaaccugaggacagcccugcauaaugacugacacuaccuucauuuuacagauggggaaacugaggcgcaggcucagauacuuuuauuuguccaaaagagcauagaagaacauaaauagauccaauguucaaacccauguguauuuuacucaaaauucaucaauucgaaacacucguuuaaaauauuuuauugagauaauuguaguucacauacagaaauaaugcagaaauacucugcauccuuucaaugauuucccguagucauagcacuuugagaagcaguaacaagacagcacacaucaccacugggaucuuggcauuggaacuucaucuuacuccauucauccuacuuggguuucuuauuuuacuugagagcccuugguuagcucuacgaaaccugacagcauguucagccaagucuaugcaggaaagguagugugacaucccucaucucagggcuucccucacgguguccuuuacagccauacuggaccccauuccucucuguuccauucuucugaagagucgggauucccaaaauguuucagaaguggaaguuuucaaccuucuuggcuguuuuuucucuuuucacucaguaucagucccuggagguccuuugaugucauuacuuacuuccuuuuuaucaucaaguaauaugccaugggcuucuaccuugauauaaccaauccccugucaaaggccaucgggccuguuuccagcuguuggcuauuaagaguaacucuucagugcaugucauugugcaggcuuuugugggcacauaaguuuucauuuuugagggcuaaacacccgagagugcaauugcuagcauguacaguaauugcaugcuccguuuucuaagcaaugugccaaauuauuuuccagagggacugagccauuucucauuccucccagcaacgcacgggugauccaguuucucugcauccuugucagcauugagaguuguugcuauuuuucauuucaucccugcuggugcauagaaggugauaguucauugugauuuuaauucccaucuccugugcggcuaacaauguugaacaucuuucccugggcuccuuugccaucuguacagccucauugguaaaauauuuacucagaucuuuggaguguguguuuagcucacuauugaguuuuggguugcugaugggggucuagauacuaggcuuuguuggugguuugcaccauuuuucucccacuuuguagcuuaucuccucauccuguagacagacuuucacaaaaacagaagaacuucagagaaguacaauuuaucaauuguuuuucuguuugaauggugcuuuugcuaaaagccuggauuuucauucacuaugaucuacugcuuucuagagccuggggaagagaaguccuacccugggaagaggauuuucuuguuugugggcuuucuaaagcagagcuaaggcaggcaggaaaucucuuuuaaagaaaacaaaugcuagcucacaagcagaaugagccaggcaaggccaaguuuggaggaugcaaugugacaggaguaagcacccagucaucagggguccaucaagggcuggcagggucuguggggacacacagaagccauccaagcuucagaagaguuuacauuccuuucuaagucugaggaucuccgauugguuuuuagcuuuugauuuuuuggaguuuugggggguuuuuuguuuuuguuuuuugucauccuugcuauaacuggaauuuuuaacagacaauagcuuccauagaauaacgcuguugagaaauuaagaaaugcuuuccauggcucagccaggcccagcagaggccaccguuacuccauuggggcagaaggcacagaguagucacugaggacuguucgcagggaccacgaccucuuccuggcucccuaucccccaucccaggagcuaguaccaugucugccuccuccaccuccacccaggcaguccuuucuccaugcugacugcccuggagaauuccuuucuuuaaggcacuuaggagacuuaauuacugauggugagucuuuugaggcuuuggaugaaaggauggaggcagcgcagggcuugauuaggcguguacgucucugggcacaauuagcuucgugagagacugguccugccuuuaucugucuccaguucugugagacuuacaacaacuaauuauugaaaugaaaaucgccuggccacccaguugcuggcaagagggcccuaauaucugcccuaaugacuggaaauggaggcagcuucaggcacuuaggguuuucccaucauuaaagaacuuuucuccaccacuuccagacuugagugccuggauaugcaagugaaauucugccaaagucacuucucucugucuuguguucuuucuaugugacaugccuuucugggauaccuucauuaacugaccuccuguguuaagaguaccuaagggguuuuuaauccauguaccauacaggaauucuggugcuugacagcccccucaacacugucugugugugaucuucucucucucucucucucucucucucucucucucucucucucucugugugugugugugugugugugugucugaaugugucucugugugugaggacccaagaagaagcagacagccccugucccuucacuucuggaauauaacuaagccucaaucucccucacuauaacacaaagucccccuugguucuugggaucacaggcuguugcuaccuauauacaaaucucagggcucauguaggcucuaaagagaaagugggguuggaggguacauuaggaaaugguaguuaggugggugcgagggcuccagccaccugagcaggacacaaggaggguaugucuugagugcuauugagugguaugucaccagggauauuuagguugcuuugcuauuucggcugucaccaagcaaagauauaaucugagggaucugcagcuugggguggaguucgcacaucagaggaguuucuggaacgcuguguacuuuucuccacuuuguucaauguagcagacccuuccuuugcuucuacacugccccuggcaucaagaugagguaacugccaagagaacagauucagguuugggagcucuuucucagggauggagaaauugaggcagagacauuagggggcuugcucaaggaugugucaccugcucuaauggccuaugagaguccagaugaggguuagaaggcugucuguaggcccugcaacuauggugauagugggacccagccauuuaaaggucugacucuuggggacggagaggauguaagcagagggguaacaauagaaguuccugcuccugcugcacccugauccuuggucagucccuaaagcccugagcccaucaccuugaagccauugggcagcauuuugggccuugagccaguuccacccucaagacucaacagauaagggugaauaaaucauacuagaaccuucucuuucuaaucaagugcugcagaggcucaaagacucuagguacauacacacaccccacuuucccaaagacaguuugagggugugacagagaagacagaaggaagagaggugccaguuccuuucgcaggugaagaauuccccccaaacucucuucagacugaagaauucuccaugcuaaccuggcgagucaaugaguaugguagcucaugccuccaaucccagcauacagaagccuaagucagggaacugcaagcucaaguguggcuugggcuauguagcuugacucucuucaugguauuuaaaaaaaaaagcaaauuauauuuuccaugaaagucuugcuauuucuagaauccucaaacugcugccugcuguacagagucugguuucccucagacuccuccuccucauuuguugaagaggaagccuggugggaaccccagguaauugcaggcuaaggcuuggccacgguaggggauguucaauuagucagcaucucuacucuacuuugaauauuuuauagugcaggucuaggccaagcccacugaaggucauggaaaaacaauucugugauuagugggcaccaaaauaaaccaaguugcagccuugacucuugcaaggguuuccuaggagaaagaacauaggugcuagucugugggcuaaucuuugaagagguaggcaaugucccaaggugguguucauaaagaaccuggaaaccuagaagaugacccuguagaccaggguggaucuggcucugcaaauccaauaggaccagcuuccugggguaagauggagaggggcgcaguggacaaauaagagaggacaucacucuauaagggcuccaguggucugucacauaaugggagagccaagggacaguaaagaacaccuucuucucugguccacuggguaacuccagacucagccuggugguucaguucagggaccaucucccuaaacuaggcaucagagaccuagaguugguaucucaucucugcugguaggcaucugugucaauuauuccuuuguacccucugugguggaaacaaggguagauguguuugaccugcugacuacuuugugacuccacagaaaccaaaaucgagacaacuccucaggcuacaccccaggauauucuaagagucuggugagaggagggaaguacagacaaaucuugagggaaauuaccaagaaggcaagggcuuggagaucacuggagacaugcucucuuuaacagauaacucaaggacacagauuggcccugucuucagucuggaaggauuauucuguggaauaaaacacuagacgaauuuccuagaaucccaggggauagagagcugagaccuauaaagggaagggagcugaaaagaggcagauuuugacuccauaagaggaagugaaagcuagcaggcagagcugucccuagagauagucaaguuaccagaguugaggucaugugaugaucacagaguagaacugggacugagagacaucaaacacccaaagugaguguugucuucugucugaacucugagaugacauuauuuguaaaagguacuuugcugugggugccaaaaauggacacagcaggaauguagacaguacaaccaucaucaucauaaaaccuucugcugacugagguccugcuguguccccaaguccugagcauccccagcccuuugaaggggaagucucuggcucaggaucagaguuucugcccuuugauaccuggccucugacaagccuccaacagaaggcaagauagcuccugcaaacagugacaccaucugucaccugccugccaaccacugauuagagauguccccacagcaaggcugggcacagggccacacuccauccagcucacucccaggaaagccgucucccuggcccaguuuucuguucagugccaaacucccaaguaacccuguagaauccucucaccuagcacaguucaaauugguggcugaguagguccaccggaagaaguaacgcuauuaaagaaugaacuaauagaacacugguacaacuagaacagggaugaccagaugggaaacaguauagguuguguaaaagcuugagucucaggguaggacagcugaggugugacuccugcuuguacuuucuuccuaaagugguccucuaagcaaguaucuaaccugucuaauccugggugcucaucuguaaaguguaaguagggcaugggaaggcuuaaaugagggaauagacaugaacaccuuggcuuaggcaccacuauucauagcacuaucucucugcuuaagagguaaggggguucccacagugacagggcuagagagagauauucuaggugucacaacaaugagcauaaauauggaagccaguguccaggaucccuguccuggugucucauggacuuguauuucuuugacccuguaaaccuuucccaaauccauaacacggagauaaugacgccuuccucccugguuugcagacuccagcacagagucuggcaccccgauaaggaccaggucuuccuuucucccagcugaaaacaaaggauucuaagagcaaacuuuaaagcacuaaggaaaguaagauuuaugcuuuucuacaugccaagcuacuccccaggacuuucauucugcagaacacauguuagcucugaaauguuuaugggccuuucugacacacacagaacuaaaaauaccacccucugcuuauguuaggcaaaacugauaaaauuuuagcccagcaggaauucagucaauuuccuggcugguuucggguaagcaggugauaacagcccuugucccugugggccagggcaggggggacgguguauuagcaguccaggcccuguugucuguggauaucucccucacagauguuccauaccccgccucuguguaaauacaacuggagaaagguccagaugugggguucucuccagacauggaagcuuuguuucugcauaagccccaggucauucucccaggcagucucaacccuacccugcugcucuaggcaugagggucugugaccccagcugaaaguacccucccuagggacuuccuuuggucuuuggccagcaucgccugucacaugaacccugcuucuuacuguccacugauauuacaguaaugcgccucuucuaggcaagccauacuccauacuucaagcuucaucccccacaucuucccucaccauggucugaacuccaggaauaaucuggcuuuuuuucugcucagggucauucauccaugcugugagcuacaacaguguauucuaaugccaguuggcaauccauuacaauucuauguaaguagaauggacuugaaaaauaccaaaauccacccuggcaguaugguuuggcaccaauccaugaagcuuugggcuuaguuagaaauuuguaauguaggagcuaggcagguggcccaguggguaaaaugcuugagguguaaacaugaauaccugaguccagauccccagcccguguaacccuagugcugggugggcagggguagaggauccagggaccuuacugucuagcaagccuagcuguaaacagugagccccagugagguagccugucuuaaaccucaggguggagagugauagaagacaaucuacaggcacuucuguccuccacacauacacaugagacauguaugauacaggugggccuugaauuguaguagcaucagugcauuuccacuguguaucagagcaguauggaggccacacaucuauaccuuuuuucccuucuaaccucaaacccucugcugaccaccuuuuaccuaaccuucuuuguccuugguuuagauaccacagacucuaguaaaggaauccgaucaucuuucuagugcuggccucucucagccuggccugauggcccugucacguucgucccugucucucucucccuauugaaaugcuucuugaauagaggcuccuaggagucacagcuaagcuguguucuugucucugauaccucaaaucuggccugagacagguagcuagggaagaagggaagcuacccuaagggagccagaggcagaggcagacuccagugaugccaguuugggcccuccgcagcacugagcuaagaaaugggauuuagugguuauuuacuuagugacccagccugugguacuaggaguucaauguuuuucuuguuuuuuaaacauuuuauucuguuucaaauauagaaccagacaugaaggaaccauguaauuuugaguaauucacuuuacccccuugaacuuuuuugaccucauugcuaaaucaagaauaagagaaaauauaaaauaagagaauagcgccuagcuugcacuguugccaugggaacugggaauacuaugcacacaguaaccagaacauaaggaagcauuuagugaacaggguguuuuguuuguuuuaggucgugucucauguagcccagacugugauuaaaauucacuguguagcugagacugucuuuuaucuccugaucuuccugcuucuacuucccagauacuggcauugcuggugugggccauggcacuuaacauaaacugauugcaugcauagcuucucuaagcuuuguuucuaauacuggcaauuuaacccacagccuugcacaagcuaagcaagaacucuggcaccaaauucaaacucuagauuauguuuuuguucauucuuucucugucugaagugcucaucugaucccuaucccaacaagugugucucuggccuccacauuccaguuccuccaagacuagcucaaugcaaaggaaaaugacaccaaacaaaguagacaugaaaaugugguaagggugguuacuuuaaaugaauuacaacuugaguucaaaucccuagcacccauacaagaaaagaaaggauggcuguacgacagccuauaaccccaacacuaugagucucucugggcuugcuggcccaccagccuaccuccaggcuuagugagagauccugucucaguggagagugaucaaacagcacacccagugucuuccuuuggccucuauaggcaguucagcacacacugguacauauauaccacaaacacacaugauaaauacuaaaugcugacuuuaaaaucagaggguuuuggguucaagcccuagccuuuuccuuuacccacaguguaaacugaaucagcuaccaguguccuuuagccuggucuccaugaugggaaacagggcagugggaacauuaugcucugugcucaauacauauaccuuccuuuuguccuccugucucagccccuuucucuugccacuggaagaccacaucugacacccaugucaaagucuaaccaggaacuuaggcauccacaguuucucauucaucaaagcacuuugcacugacaggccuucugcugacacucuagccaggcagaaagcuguuauuacaaagcuuuucucuugaucaucucuggagacaccaacacagagagggacuggacuauugcucucauggaaaggaccuguaaucacuacaccuucguggugguuggguuguagcuggagaauaaucucaaagagcugugcucaggaagguuuggcagccaagccugugccaaggucuugcucaguuccuagcuauggccaacaucaguguucucacacagggaccaguauucuaccugacugccaucauaguugcagaugcuucaucuagcuggaagccaauagccaggccuaccuuuuauuccuuggcuauucuuuaccugucacuagagugccccuaaaaucccccaucugcuuaaguuagcucaugguuugaauucugacauaauauuaugcuuaaaaauaauuuuuuuaaaauguugaugaugauggugagaaggaggacaaugacaauuaugauauuaaucauaauaauuuaguggcccagaguauugcaguugucaaagcauugaaacaaaacaguaucuuggcuugagaaaccuucccaaagucacaccacuaggaggugaucagagcucauccugccucauucagucaggggagagaaggcaugggaagcccuugaugacacagcugucauuuuaagccgguuacuuaacuucucuaaaccucugcuucuuccauaaaauggagccagagaugcauagagaugcaaagggugagaacacaaugggcccaucaagcccuucacccuaucccagcugacugcaaauuguucuggaacucugugcucucggcaggacagugcugccaccucuugacaucagagaagccaugauuuccuggaagagacucuuagaagccugguaccauuuacacugaggacagcaaggacucagggagcaacauaguaguguugcugcaacacagcagucccugacccucucugaggauauacaagcagguccauagcugcuaggagacuugaaaguucuucaugcuccugacaguaaucccaguuuaacucauuggucaaccaagguagacuugagugaaaucccuucuuggguuugucaucggugcccuaccuggcauaaauagauauuuguucaugucuccucgggagaguuuaaugaaaacauggcagucaugguuauuaaggaaguggcaguggggauaauggcugauaguuaaccagcuaguaagaggucaagcccuagcaugugacaagguccuuacaggaaacagauucaccccauaugucauuaaugaagagaccgaaguauggcaggcucaaggagccaaucaauagaagaugaccaaggcuucaaaagagcaggaagggguccauccuggaccuucacagggaaaaauccugugccagagguagacaggccaccuggugggaauuaguguaaaaacagacuugcagaaacuaaaagaaguaaagcaaacaugcauagaccucucagcagccacacuucagucccucgccuccuuugccccuccugcaggggaacauuacaaacauuaaaugcucagcaucaguauagggaauaggggaguugagucauggcagcaagcuguauagagauggccuucuguuacugugauaaauacuauggucaaaagcaacuuaggaaggaaaugguuuauuuuauuuuaaguuuauaauccaucaugaaagacagccuagcauggcuauagcaggaacucaaggcaagaagcuggaagcaggaacuaaaacagagaccauggaggaaugcugcuuacuggcuugcucccaugguuuguucagugugcuuucuuacaaaagcugggguugccucccuagggguuguauugggcccucuucagucaaucauuaauaaagaaaaugcuugcacuugccuacugacuaaucugauugauaguuuuucacaauuaagguucccucuuccaaguugaccuucauguugacaaaaaaaaaaaaaaaaaaacuaauugacacagagacugaaauagacacacaugucaggggcaagagacugaggaaaugaauuguucugggacaauaaaaggacauggaaagaaaguuuaaagagccaggucuagaaagaccuagaauaccuuccccucuuggguuuuaugggcaguggagaacccagagguugguugauuccuuagucaucugcaguugauauagaggaccacaaguuuauugcugcuuguuucucaggucugacguuugggaauugcaguaucaggaagcaccaugugggcaucuucuugcuuugugacuauaugguggaggguaucacuuagcagucuagaaugcaggaaagaaacuugcuugagcaucucuucccucuccuuauaaacccgccaaucucaucuggaggucuccaaccuaauuaggucaucaagccuaauuauuucccaaauaucaucuauacagcaauggugugauggaggggggccccuccugcaagcagggaggggaugcaaagcacauucaagugauagcaauggguaaaaaagugccgggugugcggaagcaaggcguuuccuccuguuuguucuccauccaugcauggaucacaaagccacugguggaaauaaacaccuuccccagcaaagcuccccauccuucggcugagagcccugagucacugcuugcuuccagggaguucuuguccaucuccuuccuuuuucucacauccucuucucguucagcuaaaugccaauuuaagugugaacucugugugaccccuugucucuucagaaaaguaaauauuuacugaauugcuacguuaugcugaggcucucccugccucugcucugccuggggaugucugagauguucuuacgaacuugcaugcaguuacugucuuuaucuugaagcuguuguauucagccaggagagacaaagauggaaguacuacauccacuaguuuugcagccauaguugccaaugguucuuugacgugucccuuuuucaauuguaacugacaucuaguuaaagccuucucaauuaugccuuuuaaaaccggguuucugacauuaauaguuaauauauauugagcauuaauugugugucuggggcauauauugaaacauuuaauccccagaacaggcaaaagaagcuuugccaaugaggaaacugaagcacaggcagguugagugacuugucugaagucacccagcagaucaguucaagggcacacacuuugaacacaggcugacuacuacuacauauaaaaggacauguuucaggauugccucuaauuuaguuuuuuauauucaacugggcuaguuguuaccuauucaacuaaagugaaccaucaaaagcuuguuaguguuagaaggaaggaaauaagugccaaacaaaucuccguuugcuuauuacucaguuacgucuucgaacacuaugaaagcccuucaaagggagaaguagacucaaagccaguauggaguuaucugugaggagcauguccaacgggucgggagagagcgccuugcacaaggaagugaaagcgguucuugggaugcagugagaugcuccaaaucuacaaguuuauuuuugucaagaagguagaauugguccuaguggcuaggcagggaugcaaaggggucacaggcagaucaguggcaugaccugggcuuuggaaauucaccuggcauagcccaaagggaacaaaaggauccaaacauccaugugacaaauucaauucucugggucauaacuugggcucucgcagagcuguaugaccuugggcaggagaaucacccuccucaacugaaauuuucauaguuccaugacccacauggcaggcuuggcagggagaucugauagcuaucacuuagaauagcaauuaaaggaagcacccaauuaauacuggcuccuaguacgauuauauuugcuacuguuggugcuaauuugguaugauuaugagguguguuggccaugcguguucaugauggcuaaucuuuauugugugcuuauucauagcagcugcaucucuaucauucuggggauggaaaagccacaagggacagacgcaguaguugcuguaaaucuucacccaaauuaaaccaaaacagugcugugggucaaaaaaccauuuugggguuauaauaucaaucuaaagaguuauaaucagccucucuuuaaaaauuaaaaagauugaggggcuggagauauggcucagcaguuaaaaauucuuguuccucuuucagagggccugugucuaguggcucacagccaccuauaacuccaguucuaaggaaaucagaccuccacaagcacacacggacacacacacacacacacacacacacagagagagagagagagagagagagagagagagagagagagaggauaaaagaaacugauuuuuuaaauauuaaauuagcaugggaacuaugagcaagcauuaguuaucauguaauaacuuccaaagauuuucugcucccaguaacauacuccacagauauuuucacuuagcaauguauauauggguaucauugcaagauaguuuuuaaacuaaagauuauggugaagaaauuuuaaagaccuuggcauagaagguguggcuaaucucuggucuuccucguggccuugcuucucagaccccuagaacauggucuuggcagccaguauugggaagcugggcaucaagacagaagucaagacccgaagagaucacagaauagacuucuagaaucccuauguggggauccaaugccaucuucuggcaccagccauacacaugguauauagaacauucauccacauaaaauaaaaggagauagcagauuucagaaccuagguuugggccuuagucauguuacuugauucuugugugaccuaggucaauucacuaccgaauuaucaagcauauuuugagaaccaagacccucccccuuaaaaaaacccacuccauuuaacugcauauaggugcaacuuuggucucucucauaauuccagcuuugcuacuacuacugacccauggcaugugccaaggugggaaacugaauggcucaggguccaugaaaauagucccacuguaugcuccaaggcuuuuauacaacacccauaacaucacaaauaucuaugcuuugaacaaugcagggaaauguuggggaaaguccauagugagcacucagaauccauaauacauccaaaguggauguauaauaauacaccgagugcuaacuccagaucaucuccuugaagagugacugugguauccuguuuaggagauaggguugaccuucgugggucuacagagcucuggaauagagcuaagaacuacccuggagagggccuuugaggucuuaggagggaagagcuaaagggcagaugcagaugccagugaccacaggcuaccugcuaauccucagaccaaaccuggacuaccacuggguuuuguuuggucugcaacauaauuugaaauuaaaacuuaaaaauaaauuuacaucuuaaaauuacauauuguauuucaaauuuuaaauuucccagcuugacuuaaaauuucaguaggcauccccuaaccccuucucaucagcuuaucguagacaggcacugagcaacacccuugcuggccaagucuggucaggcacugagauucuagguacauucuguuuaccagggagccccuguuuggcugcuucucuagcaaaacagcaaagaggagaauguuugcaugccuguguugcucugacaaauggaacacggggaagccagaacuggcgagguuaagaggcuucuagaaacacaaaccgucucauuuguugaucaguugaaugacauacagcuuuccucacagacugaacuccugacccuuucagaaguggggagagguuguguuugugccccagagcuaaagaaagaaucuagaaggagaaugcagaugccacuaagagaaacacucucaggcugucagucuagagcaauaaagccacugcuuucugaccuaggcgagauugaacucaaugcaguguuauuguauaggcagaauggcaagacacugagaagacagauaacaacaaaugcugguuaggauauagacaagaggaagcccugauacacugcaggugggaauguaaagucggucacuauuuaaaucaauauggagauuguuacuggauacaguaauaaugccugcacaccuacugugaucuagugagauaacugaagaaauguuugcuuccuggccuagcuauagucaaucauuucucagauucccaaaaagcccuuaaguucaggguuagggccucuuucagcugauauggugggaagagcagggauucagccccuaccuccagcugaaguaccagcaccuuguggaaucugggcaucauugauccccagcccaagggaagaacaugaagcauccucagauaagcccgguaacagcaagaggauuguucaugcgaagcaccaagugccaguacccuaugcugcugacugucgcuuagcgauggagccugcccacaccucggaagccugguuaaagagucucuuugauccaggaguuuguuaagugcaggauagauucuggcauuugaacccaaaucggggauucaaucuuuccuucauguuuccccacugcagaccacucggcccugagugcggcaagggcccaauucguggauguggaagagcgagagccagaggccauggacgugaaggagaggaagcccuaucgcucgcugacccggcgucgcgaugcugagcgccgcuacaccagcucaucggcagacagcgaggagggcaagggcccacagaaguccuacagcuccagugagacccugaaggcauaugaccaagaugcucgccuagccuacggcagccgcgucaaggacaugguaccacaggaggccgaggaguucugccgcacaggugagugcacgccaaaaugugggcugaacgcaaauguguacaggugugugccuguaugaaaaugcaagugagcuggccagggaggagaugccucuagaaaaauccaaguuccuacugcuuuggcuccuggaugagguaagggccugcccuguaguucauugcuaggcagaccuguuguagcccaccugccuaguuuagagugguggcuggaggcuggccuucauccucagccuagagucaagcucuccugcugaaugaaccuuguucuucuauguuagauggacaugagcugucucccuaucacagcaacaggugagggaggccucagugggaugguaccuuuaaguuguaagcaugauaauagaaguaagcgcuaaacaaaugcuagggcuuaguuugggaauuuauucauuccacaagcauaucuuagcaccucccuugugucaagcuucgugagugacguugagagaaagcagcuccgaagguuagagugacacuuaguaacacuggugucagagccuccuuccucacuucuuccuuacuguccucaccagagucuagcaaucccuucccagaauaccuuucggccaaacccuuuucuccuuuuccucugccauuguccaggccuggacaugguuauagguucuggaagauugaccucaacggccauccagcccagagccauccauucaggccacacuccuucguaagccacagugaagcuugagggugaauccaugcacuaucuccaggcuccucagccugacacuaggagaccuuccccaguuucccccuugucuuccuagaauuuuuuugucuccugcuucuuucccaccucuccacagcccaccuacauccaugaccuagcccagcuaaaccauugcugcaucccacaggaaugaucacuuccugcugugguaccuccaagcuuguuccacuucagggccucucugugaggccugguaggugaccauagucccucccaauggcagcagcccacugagauucugccgugaucuucuccccuccacagacagcaucagccaccccagaggcugugcaauucagauaauguuuuagcaaugcuguuaaauccucacaacaaugcaagauugaaucauguacccaagaucaaacaaguaagaggagcaugcaggcacauacacucacacacacacacacaugcucacacacauaugcucacauacucgcacacucgagagcgcucacaugcauacacacacacagaaccaccuauggccucauuuccacucccugccacaggccuggacccacaugaaagcugacccaccauggaggcugccucucaggcuugaaaaaugacagcccuucccagcuugugguuacaagcucaggcucuggcaucagacagaucuggauuugaauuccggcucugcagcuguuacagcccuaggcauccucaccugugcugagggauaaugucaccuaaugguagggugcucuccgggauuagagaagacuguaagcaagauccuagccaccagagccuggcauguaacugaugcucucuaaaugcuaccuacugcucguggucaccucugagucccagugaagggaaucgaaaagaccccucccaagcucuccucuaacucagcccagcugaugcuugacagagagcuaagugagccugugacucagaggcaagccuagcacaccaggcuaagaaaaggagucccuccgguccuugugaagaacaaaugcucacccucaagcacgugcacaacaguuugcaaacugccaucugggaucuuaagaguuagaugcugaaggaggugcaauggcagcccaugcuuuaggcuccucaggaaggaggucaaaggucauaaaacagaacacaugcugaaaaaaaucucccaccucaccaguugccucaccagggaucgcugaacucuaggagcugggguuuaccuugcguuccuucugucuccggguaccucggcucacagugccaauucugacugcuucaaaggggauggggggcaagccauauggaaaucaguguggcccagaccguuuauggcaaauaaauuugaguuuucacuuagcauagcagucauucuuuacaacaggaguagccucucuggagaggcuuagcccaguagagcacagcuaugggauggacggggagcagagcagggcuagaggacugugcacaggagccaggacuuggaaugugcagagaccugcaaaggagaugggggacugggauuccaauguacgcuucguuuauucuaagaagaaaaaaaaaaaaggagagccaaauacaguauggcacaagggggugagguucaacauauggaacaucuggucuggcccaccucccagccaaucagaaccuuugccuggccacugagcggagcccagaggucccugaggcacagggccugcugaugggaaacuauuugucuagcagcuggauccagggaagauaauggagagggguggaagaagaguggcaacaguagccaggacagaggaucggaggcaccagggaccucugauacugaacacguuauuuauccacccgcauggaaagguuucaugacuuuagccucagcucguggcugugcuagcuucugaacucucucccauuccaggcuccacuggccuggccagaaaggaacuccugguuccaggaaccuaaguaggacucauccaagaaguucuguccugaucuggacuugucaacaagucccauuugcgagaagagaccagaaaccuucaaugcaauuuaacagacauguuauacugcgugcccugaagauacuguauuuggcuggugacacagaaauuuagagaaaaacaagacauagcaccagccuguguagaagccaccuucagcagaaguggcaggcuacucuaucaucuaguggcaccagggcaaggcaaucucucagggagaacugggugcagaagacagaagaccuaugccuauaaguauggguagacaauggggagcucucauagaagaaggcaguuugaaucagcuuucaugcauggcacuuggcuagagaaggaggggugaaggcagaggaaguggcuggagccaacaggggaaaggggcuucugguuuggaaaacuugcccccccacacacacacacacaccuucccuaugauuaucuuguuuccucucaggcacuaauuucacucuucgugaacugggacugggagagaugacgcccccucaugggacucucuacaggacagacaucggccucccacacuguggcuauuccaugggggccagcucugaugcagaccuggaagcagacacugugcuauccccugaacacccagugcgccuguggggccggagcacacggucagggcgcaguuccugccuguccagccgggccaacuccaaccucacacucacggacacggagcaugagaacacagaaaccggugaguggcucaccuggcccguugguuacacgggguuaccagggcaugguuuuaauuauaauauugauuuccugcuccaucacuagagcccuggugaagcugaugaaaaauugcuuugcucucagugggcaaaagucagagccuuuugcagugucacaugaaauacccacccaucagugacaugucagagaggggucacugcacuuuuaguccagacuggggcagggcuaaagggcuggguuauuacuuacaagguaagggaacagagggcugcagauguugcuagccgccccccuauagagcuguuuccuguggaguccagagggacccgaucugcucugagucucucuaguguccaguugcucagcaguccuaugcaaucuccuguccuauuccaugccuucgguugcucaggaggauuauggaccaagauuuucaaaugggagcaacuuggcauuugggguguaggggagauagaggucaagggcuccaaaguuccaguuaggaggaagaagcuuacaugacuguacgugugagguguccaggaaccgaaagucuuggggucaggaaauguguggcauagaaacgugcugcauaaacaccaccugguuugcccugccaggucagcccuguggagggguccacuguggaccaaugcuggggccuuggagagacuggcagagccuaaaacagucccaccuggggagaucugcuucugagaagcucggccgagaauguguguucauuacuguaacuggcagggcaacacuggagauuguuuuuaacucagaaugaggaaagccagccaggugccagugcccccuacuggcugccagcucuaaaugcaagaaccuggauuuccagccagcaucugggucaggaugagaguuuagcccccuuuaacaagacagcuccagcugagcugcgaagaucaaagcccagauuagagaccagacagcugaccaggguagucagaaccugguagaggauuucauccccuuaaagagccagcugcggcaggauuccaggugucaguucuacucucuggacccuccgaguucuuuguaggaguuaaggagcggccaggccuaagaacuaacuugacagagucacccacucccuaauuccagggaggguccugugcccucagccccuguggaucuucccuuccacaguuaauaacuuguacacuuucaucugccaccaaggcccaggcugagcuaacagcccugacucucccuaacccacuguacacagaagcacagcacaaguuuaaacacuagggucgcucagagaaaaugaggucugguuggaggaacagaaguaucuacuccaccacuggccuuggguauggcauuggcuauguugguuucuggcccucacucuccccacuuggcguuuaaaggaaggccucaccccucauuuucugagcucguggauuagaaaagggaaaagucuuuuuuuuuuuuuuaauuaggaaagggaaagcgguuuuugcgacauugcagugaggaaacacgaaacacgcaucaaccaguuuuucuugugcaggacuucucagagccuuuaaaacauuaacaggcaugcugauggauaaaucaccaguauuuguagcacgcuuuguagucuuuaaccacagaacccuuuauucucagcucaucagggagggggcaguguucugauagcugccuucuguagcuucaagccuuguagaccugggauucuggccaucuaauauugcugugcugaggacugagguacaagggagaguacgagggauggagagaguuaaucacgguuccugauuaucaaugcccaagcacggcugagcacuccagccacaggagcucauuuacugccucuucaacucuuugaagucgauuuuauuacaaccauugcacagaaacagggaacacuggccacaaaagccaagaaaucugccuggcucacaugcaggauggaguuagaacucuggcccuuuuaccaaucuaaaaucuuaacucuguuagcuuuaguuacuguguugaauuuucuguguagcaaaauacuaggauugccuguucuuuugagggcuucuugcuauggugcuaaaaggaucacuuucuauaaagucaugacagagcaagacacguaucgcccacguuacuguauaucccugagagcugaauuacagcugaauuaagccucuguuggggggauaaugacauaugccaugagaaugcagauaguggggccaggagguugguugcugguucccuggcaugccccacccccucuuuccaucuccacucagacuuuaacacuccacuuagagcucuaaggcagcuauacucagaggaaccagucaggcaaaggaguggaaggagaguucaacaaaggaccucuaauuucugcaucucuuucaggcuuggacucccaaagcagacacccuacagguuuccauacucucucgagcccugacuccauugggaaguuuccauuaauggcugucuuacacuccagccugaauaaggauggcgaucaucagaauggcuugcuauuauucauugauuggguucauagaauuguugcuuggccgaggaaauugaggaucagagaaaugaagggcacaguccugugugccuggcugaauagaggguaggcccuauccagagagucuguucucuccaggaucuucuuccuucucucuugccuucccaucugaccucccaccaucccauccucugccacucaaccauccagcccucuagaccugguucuguccauuuucucugaggagugcuuggaucucaucagaggagggauuggauauacugaauguguuagcuagucaucccaucacagugaggccacugcucaggaacaagggaaaucagugcuugccaagggccccaguacacacaugagauagccucuaauucccauaacaccgcaauggcauucccauccuccagacgggaaaacaaacacuccacaaacaaaagucaacuagcacgacagcaacucucagcguguuggcaaagcuuugaugggaacguggaccucucuuguuugcuuccaucugagucacagggacuuugggaucucuccuuugagaacagcagcaaugugaauccuaguucuuaagggggaaccgccugaugaauguaaagggcugaaccauaaaccccugugaccuucagccacagaaacgugcacuccccuuucccggguggccuugcauuagucaguaguaauggucaacaguauugacagcagugggagcuuucucugaggacacagggcugcuguguguaacugucaucaguaauaacuuuuauagggaccauuaaagccaguuucugucccugaaaguuaaugucagccacuuuuaugucaguguuuaauugaaauaaauacaaaauugacuggcaguauaagcccuccuccucaggacugucaggcagagcuagccugcaggccccuccuccuagaaggcgaagucaccaaccuggggggcagugaggauuauccagcauggcagacacccaguaggcauccaauaaauguuuuccaaagacagaggaugugaucagggcuccauccccaacacuggggcaggauggcaaaaaucucucuuguggauucaugugucauuuguuuugugauugcugagugucccuggcauggcaggcauuauucuaaaauguaguaagcagagcagcagugggagaagugggaagucagccaccuguacguauagcagaggcaucccagacuggaaaaaucacugacuucagaggccugccccaccccaaccccacaggagaucuggaccaagucccagcuguuaagccuuggacaacuugguucaccuuucugagacacagaaccugugcuuuaaaagcaacacacuaauaguuauuagagaugggugaggggagcguaaggcaugugaugguuuguaugugcuuggcccagggaauggcacuauuagaagguauggccuuguugggguagguguauuacuguggguguggacuuaagacccucauccuagcugccuagaaguuagucuuccacuagcaaccuucagaugaagauguagaacucucagcucugccugcaccaugucugccuagaugcugccaugcucucaccuugaugauaauggacuguaccuuugaaccugugagccagccccaguuaaauguuauccguuauaugacuugucuuggucauggugucugcucacagcaguaaaacccuaacuaaaacaagggaugauuguuacuggcuacagagcuccaguugggagaaugaggagguucuggagauaaacagaaaugauggucauuacaguauugcaaacauacuaacacugccgagcaaugcucuauaauagggcucaucauucaguaauguuaaucaucauaguucaaaacuauaaaaucugaggucuggggugauggcucagucagugaagugcuugccacauaagcacaaaaacuugacuccauccuuagaaccaacauuugaaaaaaaaugaacagccaggggcaguggcaagcuugugauaccagugcuggggucauggauccuugggucuugcuggauacccaguauagccuaauuggcaaauccaagaccaacccuaucccaaaaagaaaaaaaaaauuagggagacagcgccucaggaaccauacccacaguugcccucuggcuuccacaugcguguguacacacagauucaugugaacccauaaaaauauguaugcacauacacauagaagauaaaaaauaauuaaaauugaaaacauaagauuucaugccaauuuugagguguugcuagcucguccaucacugggaaagucccuguuccgugggcccugaauucaggcaaucugaucaugccauuugcuuaaagguccaccugaaggagcuacucacuuucccugcguacgaggaggucaguccucuuccucacucagguucugaaccugggucuggagggcuguuaugaucugauugagcgggaaagagagggguucccagaggagcccacugcagagccacaccuggaggccugaagaggccuggguggccucucugcuuuuauccaaggcgccaacuuagaaaaucacuuagaaaauaaaaugaaagaaauucaggucuucccucugcucccccaugauuauacagucuggcaucaaagaggaaauggugaguuaagcuaaugaggcaccaaguccacagaacaggcggguaucuccagggcaugugaagagagcgcuuaccaagucggcuugcuucacccuccacgcuccccggccccagacucuugagaguuauucuuaccaagaucuagaagaaaaacugucaggaagcucgaaauguucaaagugcugcaauucaaccuacuguccagagagacagcaccuuccagaacagggaguugagccagguaacugggcuagagacugaacagugccuucggaguuugucucuuauugggcagcucaccauguaacuccuggacacacuguaagcccccaaguucccaacgaggcugaaaaagaacaaaccugguuuaagucagagaauuuaguaauaaugaguuagaagagacauuuuuguuuucauuuucuaggcaagcacauugaucuggaguucagugacauggugaagggacggccacagccaagacuuaaacccaggugugccccuuuccaucaucauugucuugcuuggcaacuccacuccauggugugcacuguuuuguagaaacaugugcucgacucauaaacugugaggucugggaaauaauucuggcucuaucuaggacauaaauuuccuuguccauguuagaaacuuccagaaaagcaaaugaacuuauagccucuccaauaugaucuggauauaaaacaaacaaacaaacaaacaacaacaaaaaucaacccaggccacucucaaacugggucaagcaagagaaaaaguuuaagaggaaaguccaacuagaaagcaucugagaaggcuccguggaggaggcgcuggacuccaggcccugagggucaggaggaauuuagcagguaaagaaacugaaagcagggcauucuguguggacagccagcaaggguguccccagaggcugugcagaauagacauucgaaaguguguuguacaggaaucuggggauggagggugggaagauguaagacugaguccagcacuguucuguacgaucuggggaauguaggaaccguucuuucugcuucaaaugagcgaguuuauuaagcuuguagcaaacaaaaguaaaagaacaaacagcaaguagcuuauagguaacaaaaccgcaucaaagcagaugcuuuuaacauccagcagggaccaacggaaugaccugauugagagagagaucaaaugcagguaacaucaucaaacugggcuuacaacauccagcagcaaacggcuggggaagaaucggucucgcuggaguucccaucagggagcuucuggcuucuuaugacaaccacacuuguuuucacauuguaggauaaacaauagcaaagucuguuaggaauuguuugccuucuacguguucucaaggacaccauguuuuuacauccuuuggucuuugcuguuuuucccuguccuuguuacaaagccaaugaguacccugacccaugucaggauuuggacgaugcuugauauaaacaggcuugagucugagacaagggaagaccuucuugauaccacaguccacucuuggcaagcccaaacaucucaugagaauucaccgagauaaugcauauuucagaugucaugcuauuccuugggcacuugcuauagccuaggaaugguuuuaaguacugagauucugucaaucaucaaaacuucucacucuuaagaacauuaaauuuuaauggggagacagguugggaaauuaaacuguauacugugugucaagauaguaagugcugugcgaacaagucccagggugagggaggagaguuguaauuuuaaauaugguggccagagaaggguucauagagacagugaauuggggguuuugucauugauaacaggagaugugagguuguggaaugaaaaccaguagagggaaggacagcugcagggaccuuaguguagaauguuaauggcuuguuugaacagcaacaaaggggccaguggguagaacaguggaguaugccagagauggccuggaguggaaggugugcaggcuggcacuagaacuacugagaacuuugagggaggaugggcagggucuaaccagugcaugaguaagaucauucuggaugcugcauugagaauagacugcagcaggcacagguucaaguguuaugcuagggcaaaaauccaugcaaggaaggauguggacucugaccaagcaggcaaaccuuguaaguagcugggguugccucugugagcagcuucccuguccuguucugcuccucagggaucucgcuucaccaaagaccccuuacucuuaguccuaggaccagcaagaauucccagguacucuagggcaagagaaccucuauuugguccucuaaccacacaccuacugugggacaguugcuggauuccuuagccgcugucccauuccgugcucccucucucuucuuugauccugaaccaucaucccgagccuggcucuccauccugcugcugauccucuugcuuucugauccugcugcuuuccucccaccccuggccuugcauucucuuccccaggaggcaugugguacacgcuuauuuugcuaaaacuccuccuuuagcuacaauuccaacccguccucugucugcucagcggccucagacugcuguagcagcacauggcaagggacuucuccucuacagcacuccgccgugaucuggaagcugugguuuaaaggccacgagcaauuucuugggaguuccuuguuagaggacuuuacaaaguccugauccagagcaggugcuccccaccucccucccacuuguaagcuugguuagagcuaaucaggcugugcccuguuucugaacugggaaaggagaaggagauggggcgagucagaccuugcuaaaugaaaauggauugcuuucuuaaaacuugguucagacccacugagcguggagagaggugcagcaaacaagaauuuugccuuuaauuugcgccaacaugacuuucaauuccaguggaagcaacacaguaaccgaauuccuucccaagauaguugggaggcauuuuccuccuuguguaauaagcucugcuuuguccagggcaaguugguuccuuagccuguuugaacaucaucucacucaagaugaaagaauagccaguagugggaagagagccuucugcucaggagagcauaguugcagccucagcauccagagacaaucugguuucagaacuaggcugucacuagcccuugugcgaugccagaccaguuacuucucuucucugagcaccagcuagucaaauggggacucgggucucagucaguggcguggcauggaaggaggaucucagccacauagcaacuggggaguuuuaugcaaauuacugaaguucagugaggcucgguuuccccgccugcagcuuugggaugagcuccuauuuccuaaggauauaaugagagcagaaaagagcucuccauggagaauauauggcacuguucuccaggcagggcacgauaaccaacugugaaauaaacucuacgacuuaggagcguuguugaaauaauaaaugaacuagagagaugcaggaggaaagacacagcacagagccagauggguugacuucagaguucagguuuuucuaagucuaaagggccagugagacgucuuagcagguaaaagugguugccauauuagccugaccacccaagcuugguuucuuaaacccacaguggaaggagagacccagcuccuacaaguucuugccugaccuccacguguauguggugacacauacaccguauggaugcauucuugcccucacaucacacacauaauaagauaugauuuuuuaaagacuuuuaaaaaaugcuccacacauaacuggauucuccaaauguuaauucccuuacuuuuuaaagacccuuuaguagaaaaauuccaugauucacuucaugauggguuugaucaaaaaccauuagccuacuaucugggcagaguuuuggguucugugaucuauuaggcugacucuaaaaucucugagcuuguaauauaacacugggcccccuggccuguggaaccagucuucccuuccuucugugccuccgaugugaaugugggaauagaugacuaauaagccuaagguggccacgaacugggaggguggcaagaaaggcauccucaaacaggaaaugcugcccuggaggcuggaugagucacaagccaccuggaccacucugcucgggcagaggacccuggggcacauauuucagaauaccacauguagcaagcuagcauggcaaguaguaucucccaaacccuuaccacaauuaaauuucacacuaauugcccagguagauggaccaccauguagaaacugcuuucauuccuuugaccucauugugugggggaaacacgggguagacaaaagguaaagggggcccaaggggcucauauggccuugauacaugaagcuugaugugggcaggaugacacuuguuagccuugggaucucuggagccagguucaggggaagcccagaacaaaccucccuaaaugauuuagagaagaugaggcccucccccaaacuucacucagugacaaggaaggccagcugucucugauagggaagcagccaugcagagaagaagagcacccccagcagugagggggcugggucugacugcuggcuggguguacuguuuaucaaauagcuagcguuuguuauggcuggagcuuuaaggagcuaagaggugggcuaaagggaagccaggcucccugaugguguggauaaggcugaaucacugacuuguaugcagugguuucuucugaaagugauaggaaaccaacugaaguuuuaccagggagaaagaaaagaucccaccugcuucacacuaggcugcaucuagugagaccuuacucucaagaugacaauugccuuuggguuugcacaacaaagcaauccagcagagaaaccccacugguguagcuggaagcuguauucagaacgcacuggcuugacucacuggggaucucaggacccaucugcuaaacuuggacuagaggucaagucaguuacuuguauauauaucuucugcccccuuguauugauaaaacugaauuggucugaguuuucgagagaacagagauucaggcacagagaagagcccaugccuuguucaggagguauacuuucagggcaguggggacaagaugaaaugaggcaaaggugauacccagaagaaaggugauaugcugccaugcuaauuagcacuucauggugagcugcagggacauuccuggccucuacucaguaggccugcucacuaggucccugccaacuauauagacaagccaugcuuccagagggaaggaaggaagggaaaacagaaagacaaacaauugaggguagaagaccucagugagcaccaagaaggucaaacuggccacauccugcagguagaucguuucacuccagcaggugaagacaacaggagaaucagcaaaggugcuguguuggauagucuuauaucaacuuagcauaaacaagagccaucugagagacaggaaccuccacugagaaaaaugccuccaggagauagggcuugugggcaaccccaugagaugguuuucuucaauaaugauugaugugggagggcccaguucccuguggguggagccaucccugagcuggugguccuggaugcuuuaugaaugcaggcugagcaagucaugaggagcaagccaggaagcagcauuuauccauggcuucugccucccacccuggcuucuuuugaugauggacuaugauguggaaguauaagcugaauuaaacccuuuccucccuaaguuucuuuuguucgugguguucaucauagcacuagacaggugcauaaacugccaucagcaccauuuguucugcauggaaucagaaguguuccccgaagguucauguucugaauauuuggcaugaagacuaugacaugauuugggagguucuguagcacugaggagugaagcgcgacugaaugaagugguucacugcaggguggguuuuugagguauaucaucucuaccuacuucgagugaugcucucucugcuuccuccccaccaugaugugaaucauucuggaaagucuuccuuguuaagggaaacccaaaccucuaaaacuaugauccaagauaaaccguucugcccuuaaguugucugauggagguauuuuggucagagcaaugccaaguaaucauuaaugcacugggguuaacuauucccucucccuccuucuuccugcccuucccucucccuuuugcucauaaauucuacauugguuaauaagggugucccuaauuccugcuaucuaucaugcacauuuacaguaagccaggcaguaugggugcuuuguuucauuuaauugccccauucaguuuguaaagccauuuguuauuagcauuuuauaaaugguuaaaaugagaucuuaaaaguuuuaauaauuugccaggcaggaagucccaggguucacgucuaagccagagcugucuaaauccaaagccugagccacuuacuguauuggcucauggagacaggaauacaaagugauuugaagggaugacuaccaaugcuuuugcagguuaaaaugauaugguuguaccagacuuaccuuuccagaaaaacauaguuacccacacuuaagcucagacucuggagccacguugucuggguuugaaccccaucacuuucucuacaugcuggcaaagucccuucguuucucuaucccuucuguuuucuugucuguaaacuggggauaaugcugcucucugcuacacaggaaugcuguaaggauuccgugaguaaauaaagucauagcaggucacauuauuuggcacauaggagauacuguguggguauauacuauuauuauuaauugcacagcacuuccuggaugauaacaugaagauuugcaggauucuaagagguaucuaugaggcucuucuuuggguagaagugcucacacaucuggaucgaggcagagaugggauucaacuccaggucucucugacuccacacccacgcauggcugcucaugguuccaucuggcagccagucagcuuggcucucauuccagggaugauucccagguacccgggccaagucuaagggcuccaauaagccugguuuuucuccaggacucuucucccaggcugcuccgugagaaacugccaccccauuuaagaaguacacuucccuucaaauaaauaggcaaccccuucauguuuugaacacuaaagaguaguuuucucuccgcccccaacucuacagccuggcuccuaaaugaguuugcuacacuuaguuuuguaguacccuaacuacaaaauaaauugcuuuugcggaauacaccucuacgaagggaguaaggacaguguguggaacaacccagguucaaagcaggguauaaacagagggaaaugguucgcaauuccagcuccuugcaaagaugggagagggaggagagaagagccaucuugggugugaaguggguggugaaaaugcagaagccacuccaagugggaaacaaaugggcuggaggcagaaggcaggcagcagugagaauccaggcauccuuuagcugguagcuaagagagagugugugcuuacacacaaguguuacaauacgagacccaggguaccugacaucucugggcccuuguaccuuggcucagacauagaaauggagacaguuauuaagaaagggaaagcccuccaaagaacgggagugagccgggaagccgaggcaagagcaugcacucaaaagagcagaaccacagggacucguggucccucauuggucuuuuccacaccaacuaccuucccacauuugugugucagggcgguuuccaagcaugaccuguucuuuauguguaggccacauaagggaagggauuccagccucucucugacaacugauuucuuuccuauguuaacuuugcuauagcuuuuucuagucccuccuccuccugucacacagaaacugccuucuuccuggcuguacccuccaccuucgcacuuacaacgucagcacuacuguuaguaaagcuaaaggauggguuguauuugcaaaaaauauuuaugccacauuucccucagguagaaaugaaaaggucuuagaaaucggccccaguagccuggccauuauuauucacuuuuagaacaagcagaacaacccacaauaaauaacucuucaauaccugcaaucccauaaauggcucuaccgucauccagcucugaacucugacagugaaguuagaacuuaaagcagguguugggacacacccacaguucagugacacccugguggggccagcauacagcaggauucacugcccaaauguaugauccaagagacggcaaagcuucuaugccgaaggcauacggggcagagugaggaagaagccagcuccaagcgucccuuugcugagugacaagugcucgugaguuauaaugacauccacauggugccaucuuccagggaaaugcaggagagaccuagagcccgagguuuggaucaggggauugaucaucuagguaacaccugaaauuccagacucagaaacaauacagguguuuaacaugagcacauuaagcagcccuggcaucaagacacucuuaugauucagggaggggcuguuuaucagcagguucccagacuagucaggaucauccuugcaagcagaagaagucucuaagaugcaacgucaggucugcuguggguuagcucuuuugcaugcugcccuuagauuagccuccugcuugaucaaagaaugauccaagcagaccaccugguacauacuucucaggacagcauugacguuuuuuuaacacucucuguccuuacacacacucuuaaccaguggcuguacguuuuagcugggagaacuugccuggcgaggaacacuggaugcuaguacagggaagaagggaagaagaaaugaaaugaugucucuucaaagaaagcaacuuguguuuaaacgaaucucgcaguaggagcauguuucuaggugugugguaguggguggguuaagcugggcagaacagugcagaaaucuuucuuuguuuugacuaugcaguggacuagcuugcugcaggaagucagggguggucucaaccuagggguucauaguacagaggagacaguggacagccccuacauagccaccuugcagaaggacaccucagugcugggaugagcacugaguggccagcagccagccaaucagggaagaacugccacagaaccaugggaagaagcagcugucccuaauacuaggcagcgugggcgcuguuugacgcuuugugguuuggaugaugcuuuugggcuuugccugaauucagaaaugaccccaggguguccuugucuuuggcuucaucuacuguaagucacagaauugucuggagcuggaguauaaaaggguguugguugcuuauauccaacaggaaaaugccacagucuguguaagcugagggugucaggccaguuccuggucaccacacaauucuuuuuuuucccccucuuuuaucucuauaauuuacuuuucucaaugaaauggcaggguacccagcaagagucauuuaagggaaggagaaugucuucuagcucagaguucaagcgugcaguccuucgaggugggaaggcaucugagacagcgggucacuuugcauccacagucaggaagcagacagggacaaaggcuggccauccucuuauuuccucugcuuuauuuggucuuguccucuagcucauugaauagguacuuggacuuaugguggcucuuccuaccucaguuagugacagucgagaaacucuuacacagacggccagacagucuugauccucccaggcugaugaugaguauuaaccauuauaguaugccaaaccaaaaauaaagaauagaacauugauaacagguaggagaaccugcauugaaagccuucagugaacuguauguauccuucacaaauuccaauguucaggggacauaauaauaaaaaauggcuuauuuaauaauaguauaauuauacuacugaauuaagugcuauuaaaauuuauuuaauaauauauauucugcaguaauuauuacaggccaaguauaaauauacucuuuaaaaacccuuauuuuaccuucuugucucuauaaaacugcuauguucuuuuggagcagauaagaaaauaggaacugagacauguuaggcaccaaucaugcgaucacuaauuuaauaaguggcagggaccaaguucaagcauagauaucugcaugacuccacauucucgucacugccuggagcacuguugacuugcagaugucauggauauugaaagacauggcuggccaagcuguuuucaugagccuagaguaaaaccuuugugacaaauuugaugcauguucacagacagggaauauacaggagccccaaaaggcagaggggaaguuccucggagcagcuaucauagcugaaccaagugagcugguugcugcuggguauccucagaaagcaagguaaggauuugucuauuguuuguuccuauguagcuggcuaauuagucuaaaaagugccgcccauuauugaucaguuuuguauuccaccacaaugaugucuuaaugaagcccacagucuacagcucaaaaauggggugaaaacuuuaaagcggaugugauaguuaaccuugcuguccccuucggggguacaggacagucucaugaggguauucuucaaugagccuuuuaacuaugccucaugguuaaaugcauccuuuuuucuuuacauuuaaccuuuuucacaggucuguguaugucuuggcaaaacuguagcauaugcaucuucauggguucagagccuggacaugagaguccaugaauacacauggguuugaagguauucaucauauauccugcccaucaugcccauuauuugagaaugcuagcuagagauccaggagaaugcaagauauagaacucuuacacagaauacaagacugaguaccucagaacaacccaauccccaaaucucucaccuugccacuucuuugccacucuggaugaaagaagccugagauguagggugggcucuuucugaagucugcaggauccuuccucauuucccccuggcuucugaugaguugcuggccauucuuaccaucccuuggcucgcaucauggcagccucugccuucugugacacggccgucucucuaucaauguaugcauuuauuucuugacaguaagggcagauuggauaaaggggccucuagcuccagugcgaccucauuuuacaauucuagccauagcaaucuuauuuucaaauauggcaugugcugaggucuugggcauaagacauuaaugugucuucugagggaaaaacagccagccccauuagaaaugccuguuaggcaccaggcacucugguaggcaccaugauuucccaggcagaaguaggauucuugaauucaugggccucaugaacagcaggcaagaaagaacacuugagucugaaugguggaccgguugccacuuccuacaauggacuccagggacccugaagcuuuucccuacucaagccaagucagaccucccaaucuauaccccuucuuggugacucagcccuucacgggggacaggaugaccccagaacacauuccugccugggacuacagaagugacccggcagcagagccugagcaacauuguguguggcugaguacugaccugacaaugugucugugcugaaaccacuggaugcaagcaccugcaagugucaagggaaggugcccuugacaguaugugaguuacaccaauauacguguucaguguggaaacaaauuaugccagugcuugggaagugugguaacaaguguguauggauuugagcauagaugagggugugugugauggaaggugaggguggaagagagagagagagaaagagaaagagagagagagagugaggauuuucuguuaaauaccuguuguauucuagaaucagccaacaagcaaagaugaagucuuuucucccauuauggaaggaauuaauaauuccauuaugaagacuuccuaacuuuaaaaaaaaaaaaaagccaucuagcuaguguuuguuaauuaggaacaggucccugggaagcugcuguacagcaacaccaauaaaucacucauuaacuguccauggcugccugccuccaagucagcuguauugcaacuccagagggagcuaggccaggaagauuuccacuucagaccugucagcuggggagaguuguguguccccacccaguccuccugugggcacuccuaagucacaccaggccagauagggcugagucagcacuccuagauuccuagacuuaugucugucucugcauccaguccuuccaguccccacuuguaacaucacuggcauuccuguucucuggucugccuugacugguuccaucuucaucauguucucuccgagcccuggucauacgcuucucuagugucuuacggcuccugugccuguacuucuacugacaccucccaccacagacaugguccuauggguacuccucuuuagccagugccagccaaugcucauaaaguaacagcuacuagcaaugcuuuaaauucuuaucuuuaucuaaaaccaccauaaccuggggaggauaaguggaguaacucuuagugagaacagaaacuucucuugggagugaugagaauguucuagaaccagguaguugcaaaaguugcaugaccuccauccaaugcuacugauguuuauggggacaaaaaaggacaaaaaaaaaaaaaacaaaaaaaaaaaaaaacaaaaacauccaaacaaaugaaaacagaaggaaaauccuaggacaucuuaucuucuuuaaauauacuuacaguuuggugucuugcagggcuuugcaaaaguaugcuuuacugagcaaaacccucagccaucacacauucauccauuagaucgguucuuggaauauggaaguguuugggguaggaggauucaggcuaacaagcugcagaauacaaucugugcgguccuccaaaaacuaaaacacuccuuucuauacuuaccucuacuuuauauacagagaaaccuccgaaucaugaagccauggaccuugccaaagucacagcauccuaaggagcucugcuaggauauggaucucagcguuuugcuguuguguguguucaaugccuuuagcuuccuccuuguuucuggcccagcaccagcuaacuccaccauaguaugacuaaagaguaggaaacacagucuugaugaagguaccaaggacuguggcuccuccuccucugaccuggaacucuccuggccagccugcuugccuuuggacgagggccuuccauugaagcacuuuccaaaucaggcucugucuaacaucuuagcgagacauuuguaugagcacucugcccuucugccuaacagggaccucaaaaccugugacgcuggaaugaaaugcauuaguauguuuguuuuugaaaauacguggaaucugucucaaauuuagaaccugcuuuugugcucaacuaaaauguguugaauguuuucgggauaguaacuccaaaaauuauauagugauacuugguccgaugaaacuauuauuuaaucugguauagauaggggaaggaacugucagaacugaaagccuuuggccucgggagcugaggacucuucaccuuggagccaaauccagauauaacccuggaagcgugcaggguuauaguuugguagaaaagggauaaaaugggccaccaguuccccuccccagggcacugaagcagacagcagcagcugcauguaguuuugauugucauaaguacagaacuguuucagagacaagaaccaaaaaguucaguccuacccugaguccaaacagagaccagcggagcacugugggggagaggggauauuggggugcuagcaugggcuauuuucuuuugacucuagguuucaaguuccaguuucgagaccuauuugccuauucauucccguauccuugguacuguccaaugugccgucaguaccuauaccugcagguccgauuuuggcaauuaucgauagaaacaguauuucuguauuugcaagccugcauuugugauggaacaauuagaggccaauccugguguuuccgugauuuaacuggcuuugcuucuucuguuagucagacuuugcuccgcaucgucucucaaggauccagaguaauagagauugcauuuucugcagcaaauggcuuucuggcugcuuuucacagcccauggcucugcuuagucauauggcucugccuaacuacaagggagcagagaaauguguaacuacauagaugggggaaggagagaauauggaugcagguugugauauaguuuuuggcugugugcaagcacuagaccagugauucucaaccuuccuaacgcugaagcccuuuaaugcaguucgugucauggugaucuccaaccauaaauuuauuuucaaugcuauuucauaacuguaauuuggcuauuguuaugaaucauaaccugaauaucuauguuuuccagugguggucuuaggugaccccugugaaagaguuucugacccacagguugagaaccacugcuaccuugccccaucuggccuauuauaacaaaaugacuuaggcuguaaacuauaaacaacagaaaguuauugcuggaaguucugaagucuaggaaguguaauaucagaggaucaguagauuccucgucuggugaggggccuacuuucuugguuccuuuucuauguccucacauggugggaaggggaacaguuucuucaagccuauuuuauagaugcauucauucuagaaauaagggcagaguuccuaugaccuaaucaauuccuuggugccuuagcucuucaaacuaagagaaugccugaaauuagguuucaacguaugaauuuuucagggacauaaaccgucaggccaguuggcaaggcaacuguggugaugcagugagggaugcuagggcaugacuguagagagagauaauaagcugagagcuagacauuguugugucugaaggacccaaggaaccucuaaagccaaaguguuugggaagcacuugaauauuagggccagaggcuuaggagaguuuucccacuuucccuaguggcucagaaauuaaaggugugggggugaccucuggggagaauagugcuugccuccggggaucucaaauuacacaucgaucccaauaccagaauugcuuuuuuaaauugugugacaaucugggugccuuugaaauggagucacuuccugcuugacacuuuccuaaggcccagucuccccagcugggagaagucacagcucccugggcuucugccaccccacccaucccccagcccccaccccaucccacccucccguggguguugggauccuacacugucauuguucagaggcagagucccggggguggcauuuguucaccaguccuggugcccaggugcucagguagaguugcuugaacaaaugaaugaguuaaugacaagcuauucaaaacuacuggaucccuugugagacccaaaauaguccuuccacacuggagaggcuuuuuaauaaguuauaacacagcaaauuaaaauaaacauuugucuaaacuuccaccaaccaagucuccugaggguugaacaccuuuucaucuacaaagugcuuucaaaacaagagcugauucucccccucaaggccccuggauauuguaaacaguaaacacauucagaaauagauuagcauucaguagcuacguugcugcaggcuaguuuuacagaacaccuucucgggaaagaaaagugaauugucuuugggauuuuuuuuuuuuuugguggggggugggcagcuuccacaugaggcagggguugugucaaaggcuuacagcaucgugguguuaugcucucgaggcacauguagggcaggcauucugcuuccugcuuuagagauuucaagcacucuaagguuccaagucauaacuuguccaagggcacguaauggauagaugaaaaccaagaacuucucuuaaguucugcuaaugccucaaccaccggccuucaccucaaagguuuauuucccaacauuuggucuacagauugcccagacuaacagcguacagggggugaagcauggccccagccaagauuuauuagaugagacucuggagggagaagcucgggaauggcaucuuuagcaaagcucccagagucgucuuugaucaccuagaccuuaugcccauagcgugucucacaagcugagagagaugucugucuaaagggaugagaggggaaaaucaaaagggaaucacuggguccaaacaccucaugccucguguugaguuuggcagcucagcucugugcacaaaccauguggcaacggcuuccucccccugccucugcaggcugcgccggccaagauggaaagcuuccucugugcccugcuuuucauggcaagccuggguggauguuuucucuccacuccauauggauuuugcaauuaacucacuagaaaaguaaaucacagggugccuggaauaaugagugcagugagcagcagacugcagccaaguagacugggcccggauccagcaugacuaagguugcugggcgggcacaggaaaaaggcaggaggcuggaggcuaaaggaaggcaagggcugagggaggaggagagcagccacuggggaagauggaggaccuuugugaacgugagguuuagguuccguguuccuguccaacucguagguuucggguuacucugacuggccguacuaaugauaucauuuugcagaaaaagaagcugagacccagagagacaccauugcuccccaacuuugaacuuuccuaggaagccuccaaaccuaucuccuggccuacagggaucuuuucucucauguaguaacuaaguaggaagaaccccuuccucauuagccuggggacaacugggagccugagagagagcugaucugggggggggggggugugcagcuccucaucugugaagugggauggcgauuacuccuaacugacagcuauccaaucugguaucuuacagaagagcauguuaaacccugcguggcacacaauaggaccuuugaaaugccacucaccuuuaaugaguggugguuccuucacagacaaaaauaccauugaaugacacaaggaacagagacaugaacaagcuaucauaggaagugggguuucuagaagccuuguggaucgagaaggagauaagucauggaaaucaagagcaguggccaaugccucuggucauccuagagacugcugcuggugcugagucuacugacugggaaucaaaaggccuaggacacugccuuucuuaucauccuacuucucaaugggccgguuuaaucuuucaagaugguggguugagcccaucuuugccuggaaagcuuacugcacgggcagaaccaugagaugcaacuugacuccacaggcucuaagagacacucuugggucaagcuacuagccacugcaggggagccaugggcacacaugcacuuaccauggguucuuuuuucuuuauuuauguuuauuuucagcaagacugaagccugggccggggccuugucuguauagugcauaugggccaccacugagcuauaucucuaacccuccuuugcuuuuuauuuuucgaccccuaguuugcucaugauggccuuuaauucauucuauaacccaggcagcucuugacuaauaacccucuugccucagccuugcauguagcuggguuacaggccuguaccaccaggccuggcuacaggaugaccucuuugucaugaacaguccuaucuagaugucuguuauucugucuccuuacucuagauccauaauuagucaucagagaagacuaauaagaauaggaaaaacugauggcaugauuagagacaaguagagguucuguuugccccagcuggaaaguuuggcagcugccagaaagccuuaacuucagacaugaaugccaauguccuuagucugagagggucuuaccuacuugccgguugauaugacucuuuucugcaaagcuguacuggggacccuguccuggaccugaugcacccuucucucuggccaucucuguauccuguagguuuaguuuacaagucaaaugaagguuucucucucugcauuuccaagccuagaaaucaaacugggcccuuucugcuuccagcagcuuccugagcagacacaucugagccugauauagauacagaaaagcacagggcuucuucugguggcuuucacucccugccaucagggcucccaagcccuucuggggcuguaaggaaaaugagaggagagaaaaaaaucagaggagagaaagcaugcccaggcucuccaugggguuuggugaugguuucuuugccuagauagaaaaccagacaaagagaacaggauuuauaaagagcagaugcagggcugggggcuuggccaguacagaaagugcuugccaugccaaagugaggaccagaguucaggacuccuccccaacauaaaagcuggcugcaguagucuaugcccacagaucccgggggauggauaaguacaacagaaauuccccuggagcuucagggccagcugccauggcauacuccauggaaaaacaacaacacacagagacccucugacuaccacauauguacucuccucaugcagguauuuuaaaggcagacacagccacuucagucagaaggaccauugcuuuuucaacugcacugcucagccaaacccucugcaauggcuagauguccugucugcauuuuccugugcagcuuccugcagccuccugugguuacugagugccuagggagcagcuaguaccaccaaggaauggccuuuucacuuuaauucacuuaauccuaugucuauucuuaaacugccaugcauggagacuggagcgugcagcucucaaaucagggucagggugugggaacagagugauucuuucaucucuaugagaguaggaaauucguccugugcuccauauucccaugccuaguacagagguugccaugggcucagucauccucagaagagugacuagagugugucagugaggcaguggguacagcguacaagaugugcucauuagauuuaggguagguuaaacccaaaagcaaaggcugacuccaaccgucgggaaugcggcagguguugguaagccuuucuuuucugugaaagucuacaaugucaacccuucucugagggaugagauguuccuucuuuggccuuuucuugugaccacccacuuccuacacccucccugucaaguucagugcaauucuaagauggcuuguuccugagucaggauucgaacuaaguucccuuuagagcuccuggccuccucugcuucccccaaucagaguucuauuuuacugcaacuagaaagucaguaauagagauagaugagcuggaagacuucugagacaguccagcugccucuaugucuaacccaguuucuguucucaaaucccuaaagacacaggaagggucagcgagauggauucacagguuaagacacuugguuccaagcuugacaaacugaguucaguuccugggacccucuugauggagggauaaaaccuuucuaugucucuguaaguuauuaauauauauuaauauuauauauuauacauuauuauauguauauucuuaauauuuuauacacacacacaugaaagccaaugaaaaggagcagguaagaaguguccaaaggcaucggagagaaaggaacacucacacugagagcuuuguagauaagggcagugagggggagaggcucagaugauuaaagaugguguugaaauuccagaguccugaaggagcaguuugcagggccagcgagugggguuugaugaguuagaauuguagaugugaugaguuugaagcaccugggaggcaucucagccgagauaauuacuagacaccuggagcugaauaagagcuucuggagauauugauuuagacgugaucaugcccucaucccuguauccauucauucaagggaaauguaugcagcaccuacuccauggggcugagcuggauucugggcuacagcgauuuucuaaaaaggaaaacccagaaaacgcagccccugacucuguuccucucccuuggcucaacaggacacugguugugguguucguuaucugucucuguucuccuuuuccucgagauguuccauuucuuuauuguuuguuuguuuguuuuaaaaagguaccuugaggcugggaagauggcccuuauaaaagguagcacaaguaaaucccagaguuucuacagggggauggugaaagauggagacagaagaaucaccaaaaguucaugagcccaguaaccugacauauguaguaagaaaacagcauacucugucucaagaggcaacguguggaccaauaucugagguugucuucugacuuacacacaugagcguauacccaugcacacauacacguccacaugagcacacacacaauugaacucgcaaacacacauauacaugcauaggcacacacauaccacacacauacacaaacacacauacacacacaaaacaguauuuuggggcucuggcuggaugacagacauugguucuagaauauaaacccuucacucuuuuccaccacaagagucauuuucuacuacuguugcucagguucgguuaggaagggaaaacccagucuuucugaauauuuuuaugcugaucagagucaugaaaguuuauuggaaagucaaguugauuucugagaucuggaaggauaggaauaaaaacugcaaaugcauguccuucuauguucucuguagguuugaguuauuuaggaagaaugauauuuauagacaaaucauggagaaauaccugcugcccauuaucagggaaaauguaagguguuguggucuauuaaagucguaaguuauucucuagaauccaaaagauuuuuaaaaaaugaaaaaagcacaauaaaauacaucaugcuuaacugcagaaacuauagggaccuugucugagcuuggcagacacugucuuacccuagagaaacccuagguuuuuuguuuuuguuuuuguuuuuuguuuuuuauccucagaaaauaaaaaaaucaaagcuucucaccauuuccuaggcuggaugacaagucuggucaucuaacugagucuccaaaggcacuguccucaacaugaccaagugucauggucaccuuaagguaccagugagcugcaguuuaagguugauauugggaggcggugggucuuggugagguuuacugguauagaccuaucuguagaagccacacugguagcuguaccagugcacagcugcuucuccucuaaauggcucuucuugccugugugcacagccccaccccacacugcuccugcuuucucaaauggugcauacugacccaguugcccuauucccaccuggaccucagucccaccuagaauccuuugucagaaggaacuuugaguauaguuucuuucacuggcuacccaucucugucccucaugcuccaccccucacuuuaacuggggugccaaaaaauacuuaccccuuuuggcugaguuuagggguuaggacuuugcuuuauuucuuugggcucugucauccagugcaguuaaaacccccuugugguugcauuucugggaugccacgccucugugagcuuggcgugaugguuaugaugucuccagccuuuuauaagaugauucacaccaaguuuucuuuuguuugggacccaccaucccccagaacucauuaucacugguuaccuaaaaucuuaagaaagacgugcauuugaacuuuauuggacuucacuguggucagucaggaaaggaucauaauguaacauuugggauaaauaggagaaacaguccccuggguguguuacaagcuaggaaggccugccuccagcagauggaugcccuugggucucguuccuagggauuacagggaaccaauggacugagccagucuagacugccucacaaaucucguccucucauggcucucagguacucagacacaugugaaagcugagaagcccugcccuagauuuuuaagaaaguugauuucagagaaaauacugaguccaguuugaugcccagauucuuuggaaugaaaugauccaugaggucugagaaaugaaacaugagcucugagaccaucuuuuaggauuuugagcaucagccacugacuauaacauggaaaucaauagggacaugucuauacguacaucaacgaacaguggcuuagugggauggugggguaggaauaaaggaagacauacaguuaugagcagcuuauuucuauguuucuugaauuuaaauauaugcauacauuaguaauauuuguugagagaagauauaugcaaacuaacauuucauaaaggacaggagauuaugguaauuguacauuuaacaacacaguagaaaauagccuccagaagcauugcaggcauuucagaggaccuuaauacagaaaaaacaaacaaacaaacaaauaaacaaaaacaugguuuuucuuuuuuguguuaccaagguagcuuggagaaguggaaucaugggugauugcuuucucuuucuucuuucuuuuuauugucugaauuuuaaauuuuccuacaacgaauguguauuuuuuauguucuaaggacaaauagaccaagaaugauauaaggaggaauuagaagagaggaugaggaagcaucagcuaaugucacaguggaaugacagagcuucaggguccaaauagcuauggcuguggguaaucugguaauuuaaaaaugaaauacacacgaagugacagaggaguauuaagauuaggugguagccgugucuugaaccuccucagcaagacagauacaaucaucucguaacugggguaccagauucugggagaacuacggacaccccucaaaggucagagaugagcugguaugcagaccucacaguguaccucuagcguugcccggcaacagugaaggcacuguuguagucugaaggugggcaugaggucugggcugacccagaggccucaguuccuccgcuguucaggaaaggugacuuuccacauuuucaguggagcaugggaauggguucagagccuuugagcuccucagccguccuccaggagccucugaaauccugaugaacagcaugaaagccagugugcagcagagauucuggagcaggguguguggcacagggguagagaacuugacacacaugagcaagggcuuggguucaauuccccaguagcagggagggcucguguaaaagacagugaaaaauuaguuccccauauguccucaggcaagaggguuccagaaagguuccagaucccccuacugcugagucuacuuucaaaaaugugcccagcaaauuuucuugauuggggauugaugggggaggacccaacucacugugacugcugccaccccugaguugguggccauggacugcauaauuaagaaggccaagaaagccaugaggagcaguccaguaugcagcgucccuccauagcuuccacuuugguucuuguuuccagguuccugccuuuaccuccuccaaugauggacuguaaugugggacuauaaacugaaguaaaugcuuucucccccccccccaaaaaaaugugcccagcaccucagccuggucccugccuauccaagauccacaguuacaugcucaccuugccauuggaauuccaaguaacaucucacaggcaucucaacugucccaaaugauagcuuuugagaugcuuuuuaaagacaucuuaaacauaucuuuuuuaaacucaacauuuaaaaaaauuuuuuuaauuaaacuucuacaauauuuccuacaugauggcuuaggauuuguucugaacauuuuguucuuugaaagggauucuggagagcuaaaaaugucuguaauuauacccacaaugagagcaggaucucaagugcaggccucucagagcuggagguuaacaaggcucacgccuucgugaaccaccagaauagcaucuguggcuaggccgacuaacgcuacaaauuacaagguccuuucuuccuugacaugcagcggggaggggaagacacugagcucagaugcuggcgucuguaagugggcucacuguuguaugcuauucaaaugguauguuuucuuccucuuucuuucuuucuuucuuucuuucuuucuuucuuucccuuccuuccuuccuuccuuccuuccuuccuuucuuucuuucuuucuuucuuucuuuccuucuuccuuucuuccuuccuucuuucuuuccuuccucucucuuguuucccauguacauaauuaaaguuguccugaaauuaaguguuugcaaguggauacaaaaugcuaacccuuucccaucuauaguggccagugcuuccaugccauggcuuccaaggauaauuuuaaggcuguguucucacagcagccuuauauacauuaccuguuagccucacuucaccggcucacugagaacugcuccagcaauagcagcuuugugauuugacucugcucuucucauucugugcccuggauuguccccauuacccuaagucaccuacaaugguuaaugcucugcugagccccgggugucuugaauagaccugaauuugggagauuguucaacgauggucaggucauuaagcccuuagcagaguaucacuuacuuguaucuuuguagaagcuuucaaacaaauagcuucauaaaucugaagucuacaaaucaaaucaagucuuuuuaauauuucuucugucugaggaaauagacuuuuagugcugugcagucaaagcaaagcaagcaucagcuugguagaccaggagagccuggcucuuugaaugcaauaccaucuccuuaucaggaaacuggacauaacacaaaccagaguccuaaugauucaguuuaguggguuauuuuuuauuugcuguuuauauaaccauucugccuuucguguucagacaguauucagucaauugcaugagacaggcaggacccuguuauaaaauagguguuguauuaaccauagauguugacuuuaaccaacuauaggcuacuauaguuagguuagauuaaggugagcauaauggugcauaccuacagccuuggcauuugggauguagaggcuagauguccacaaguuugaagcaaauuuuuuuuacauagugaguuauaggccaucuugagcuacauagagacagcuugccuuuaaaagaaaagaagaggaggaggaggaggaggagaaggaggaggagaggaacaaggaaccauaaaguaggcuaggcuaugauauuuggaaggcugaguggaccaaaugcauuuuuauuuuaauuuacccuaguuacaucaaaggaugggcuuaucaaagccaagugccaccuauauuuuguuuauaggcuuguccuguggacaaagccuaucacaagucucacacagaggaaacaaucaguagauagaaacuuccuuuggcauaacaaauauuuauucuucuuucugcuuuauggcuuucccccuucaaaauggcuguauugacgggaaccagcucuuccugucauuguuuaucugucuuugucucugucucugucucuaucucuaucucugucucugucucucugucucucugucucucugucucucugucucucugucucugucucucugucucucucugucucccuccccccgaccccgugugugugugugugugugugugugugugugugucugugugugugugugugugucugugugugucuucguaaguguguaaguacaugugaagggcuaaauggugacuuggaguccuuuccucaguccuuauuucuccccacccuuaguauuuuuagacagacucccucacugagccuggagcuuucucugauccauuuaggcuaucuggcuagugaguucuagggaugcucaugucugugcuuccucacugcuggaacuguagguguaggcugcaacuucugauugguuuuaaguggguucuagaggucggaacucagguucuugccuguugcccaaauuugcucaggcacuaccucuucuuagacagcaagcauuuaccaacacagauguuuaaugagugcccaccuauccucuacaccugcucuguggcugauuaagugacccccaucucucaggacaagucuauggccuucaauuuucacucgaaacgagucagcuacugaugugucucccuggaagugaagagccaccuuuuaaucaucaaaauaagucuccaaggccuggggaacggcaaggaaauaucagugcccauuuguaguguuuuuuauuuauauuaacaauauuucuauuaauucuuugaggcuuuuuaagcauauuuucccccacccaguucuuuccauaaccagccuucuaccaucuauuccuacccagcuuuaagauuucuccuccuacuuuuuuuuucuuuuuuaaaucauguccaauuuguguugccuagcuagccuugggaguaaggccugcccuggcauguguacuguccaccaggugccgucauuaaaggaaacugacucucccucucccagcagccuuccagggcaguagcuccucagcuaauggugagcucucauggucaccuucacugauccagaucguugucuggcuggaccuugcauaggucuugggugugcuauuaauaacugccacgaguccauauguguaccugcccuguugugucuggaaaaaaaacauuuccuuccuguuaucuacuaccucugccucaccgucuuucuaccaccucuuccucaaagaucucugaaccuuggagaaaagaguacaauauguaugucucauuuaggacugagcauuccauaguaucuuauuccuccccguuauccaguugagagucuuuguacugauuaccaucuauugcaaggggaagcuucucuaaaugaggguugagagaugucugauuuauggcuauagcaaggaggagucuugugugucccaggcuagugucaaacucacuuuggaaaagaggauggcuuugaacuccugaccuuucucccugugugucccuccuaucaaugagauuacaaguguaaacuucuauguguggcuugugacaaucuuuucacuaacuagauucaucuuucuucggaacuaaaggagacacacccuacuauuauacuguaaucuuggucuuuggcuccuucacacacacacacacacacacacacacacacacacacacacacaucuugggcucccugaucaacagucagucugaugugagcugaaucugguugccuguuagcuugcaagguuuacagcaggccaccuauauaccucacaccuucucauugcaagaggagcuucuuggaaacuaaauuaccagagacucuuucucauagaaaaaccucaaggcaggcagugcagagaucuggauuccaggccuggucugccauucucaaguccugauccaucaccucucucuuggacuucuuuucuuuacuugucaggcaaaguagugcucuuuccguuucaaugguccaagguuguaaauuccauaaagcaaaaggggagccccaaguggggggaaaguucuggagugcuguugugauggcugguguaaccucaggccucugggugagggauacaggcuugugucucugagugcaaacugcuaucccuuugcuuuaaagaaagaacgcaagagagcagcuaucugcuuucacauacugguguucaaucuuuaucaacaccaguuaucuuaacuaugaugacuacagcacucucccugaggccugacauucagacacagagaggcccuuguacucccagagagcuguagaaugcucugauauuuuacaggcaacucuuuguuguggaguuuggcuuguguguuguaguauguuaacugcaauccuugccuugacccuagcaccucuucuggguuguagcagccaaaaaaaaaaaaaaaagucuccaaauauagccaaguaucccccgaggaaaaauaauggaccccuuuuaagaacuagaugucuccgugccagaacccaaaguucuaaggccucuuuaggccucugugcccaccucacaaguugcaagcacagugccaagacccaagaccccaccucuagccuugacauucucauccuccauuuauguucccauucaugucugaauuggugcugaauucugagagaacagccaugaguucucaccucucuacccuccuccaccucuguuccaagacugugaccaugcugccagcuuccugguccucaggaggcggcuucucuucugaugauuguccacccagaccugaagccaucuucuugagggcaccauuuggccauucaccuuuucuccacaauacuucuuucccuauuuggaucugcuggaccucuggccugaaaacuagaucucuuggacucuccuacucacagguacuuccuaauauuaggcaggcauuuaauaacuauuugcugcauccaagacugguauucuaauauuucccuuuauuuuuaaucacacuugauaaauucuuagaguacuuucuccucuccucucagucacuaugcugggugcuggggauguaaaagugagcaaaaccaggcauggcccuguugggggaggggguuucaucacaucauccaucaugcacauaaaugugccuucaccagccuuccugucuccccacucuccccucccccugccuuccuccuacuuucugucuuccuccuuccuguuuugaccugucucuuaugucccugggcucucuccauccuuuaccugaauccauauccaucaggguccuuuccccaggccaguaagcagccucucaggucugcugcgucuccaucaagugccugccaaccuggcuuucuccuuugcgagagaaugaaugucauuuaagaggucugcugaggugguuugacaaguuggcugggcuaaaugauaaguaagaaggaucggcucuugcuggggaugguagggucugaggcucaucagccauccaccacaggccuaguuagcacauggcucccucugcuccgugugcuucugugagaaauucccagcaguggaggagugaggcguuaccccaggaugcauggccccagaugcccugcaugugauccugucuccuccccgauggagggaaaagacaugccaagccuuuucaacaucgguuggcauauucaaaggaaaccauuucuuccacuuuuuugguugaggcacagcaucucuggagagucagaucaaggaaggggguaaggaguuucugagauuuuucugauucugaaaaguugggaccccaaccugggcucccuuccucuccagguaaacccgagagcgucucuucaccuuuaagauuccguuuccgauagauguuuuagagacuaugaggcuuccaucaccccaugggugugaagagucaguugaugcuuugcaaaugauuagcacaauaacuggcucaugagauguuuggcacauucuggcucaacacccacacccacacugccaccgccaccacuaccaccacuaccaccaccaccaccaccaccaccacguggcugagcugauuuccccaucuccuccucugauuguauguaugacugcugaacgccaagucucucccuggauucauuccgacuguccugucggagaaggagaguuguggcuagcuacuaccuuucgcuacauugucccaaggcccuuucccucugcuagagaaguacagcuguuuaacagcuguuaacguacucugcuuugcagaccaaguccauugucagccuaggucugauuucuccccauaaaagacuuggggauuucucacaacgaaagccauuuccauagugaguaauguuauuaauaggacuuccuggaaaagagcccaccuggauggagagagcuacuuguuacaaauaccaaaucacccuugucccauuccacauucucucagcuuucuucugcccuccuccuuggaagguaacuuucugaauuaagauuccaacugcaaaggccccucuaggaauggaacugagaaaugcuggggccugacuuugagaaguucuaaaucacucuguccuccugggccuucaguucccccaggggcucuuggguuuccaagacagccaaacaucuaacaugaaauagguugcuguacuuggcugagaacaauuuaaugaugcagaaaguagagaacuuggauaaaggagaaaguaagccugugauccagugcccuuggacagaaagcaaaugauuggagggugggggaagcagacccaagcuauaaacccaucugcuaaauucuccaagcauguguuaucugggucccagaaaaaacacauaaaaguaacagaccaggcugucaaaggaggcuaagaggaaagauagcagcucuggaagaugccuggugucucagcuuugagcuccuugcaggcaaagacuggcucuaauauuuguaacccuagcaaguaguaaagacacaugagaggaaacugaggugugccuuggaccugugcaauauauuacugacuguaguucguuuuguuuuguuuuguuuuguuuuguuuuguuuuguuuuguuuuguuuuucgugacaggguuucucuguguagcccuggcuguccuggaacuuacucuguagaccaggcuggccuugaacucagaaauccgccugccucugccucccaagugcugggauucaagguuugugccacuacugccccuggcgcugaccguaguucuuaagugcaaauccaaaagcuguguuaacuagugccccaggcaggauccaugcaccuguacuauaucuguccugccuucugggacuugcaggggggguggggguggguauggguaugcugccuuucugcucuucaggcaugagguagaugcuauagagagucacuuugcauaugcugucuaagcucaagauucucauugcccccaccaccaccagagagugaacccagauucacagcuacuuuuuuuucugggaauuggcuucaccugaaaggagcugccuugcccaguccaaucccuguaggcugccugggccuagccucuucucuguagggaagaagaagggagaguagcauuccaaggccaggcuuccuuauccugcucaagaugaccuguaaaggccagcucaguuccagaacucuccgggacacuggcuggcauguguacuccaccucaaguucuucaccugcccaacccgccccugucuguucuuguagggagugcuugcaagugugggaaaccuccuucuagagaauugccauucacaaaccaucucucagagaaccuaggaauagacuacuccagacuaccuugaggcacagauaguccaaagaacuagguaagcugacauaugcuagcaauaacaugagcaaccacuaauacugauuuccuuuccuuauauuuuaaauguauuacauuuaguuugcccuaaaucuuuacaaucaucuuauuaaaagcaaaaacugaaacucaggaaaauuagcagugugugcagggucacauagccaaggagaggcagagcuaggguucaaauacuuacagucuggccuuggcccacuuuuggacacuguagauagucuucucaagaucaaacugagcuuauccacgugagccucacuaaucuacagaaggggcuagagguaccugcaggauuguggguccgaagugggucucagucacagacauauaccuaggucuugguagaccuaagagagcuggagccaagacaaauucaauaagcacuuuuuggagugcuuccuagaggaaguggguuccccauguccauggaaaucuuggaucuggcuagauucaaagaugagacaaggaaugaccaagucaaugagaggccuggguauaaggaagugagagguagaauaaacugaaggaaagagagugauaaacugugcccaccuucaacacucaggaaauacgaugcagcuaagaagaaugccagucuccaggacagugacaaggguuauccagguggccagguagggcccagauacgaugaccacuucauucacauagcccucuuccaaaauuacuagacucugaucugaagagucucugaaucuggguccauuacaaaacagcugugugauccagaaagagucggucuccccugaucuuggcugcagucgaaaacaaaacugagaauugaagcuugugaccaucaacauguucugguagaucaggaagcuuggagauuagaggaaucuuugcccuuuccuuaauuuggggagaaucauuggcccucugugguuuguggaggaaaaccacaaaccacaaauucacucuuaggagcauuuucuguucuaaccucuucccuugaauuuuacaagacucuuguuaggucuggaaaauuccaaguucaacccucugggccaaaguccacauuuacccuuucucugccuccucauucccuuccacccaccuccacuucgcagaggggcuugugucugcuaagaguggggccuuacuccucuccguguaugcaucagaguauuuuaaaaagcaacacugggacccgugguauaugccuuuaauccuagcacuugggaggcagaggcagguggaucucuauaaauucaaggccagccuggccuacaaagggaguuucaggacaguuagaguuacagagagaaacccugucucuuaaaaaaaaaaauggguguggggagcuagauaaugguucaauuaauucagagagcauacugguuugguuugguuugguuugguuugauuugguuugguuugguuugguuugguuugguuuugcagagaaccugaaaguaguuaccaacacccauaaauggcaacuaaaagugccuguaacuaacuccagcuccuuggcauccacuguuuuaugugcauggucccuucucccgccccaccccaccccacacuuacacacacucacauacacacacaucuaaucauaauuuuaaaugaaugaaugaaugaaugaaugaauaaucuugaaaacauagcacugggaagaccucaauaugaaggaucagaagagccagaauaaugaucccguaucucacugaaacccugauccacacacacagucuuacacagaaagguuacagaaccuucacggcauagcuuauguagaacaagauuguugauucccaagagagucuauggacuuugcucuuucgcaugagugcuagaagccuguccuuuacacaaucacccugacugaugccuuuugccaagaaagucauucuguggggcuuggggacucagacgggccagcuuuucacucagccugacaagaaguccucgaacuccuucucuguaaaacuggaauaacaauccuuuccauucuugguucuguuguauguagaucacaugaaauaauucagagaaaguacccaauagggccugccuccaaagaggcacuuaaaauauugugacgaggacucucuaguaccauugagcucucauuucugaucuacugggagauucccuaacuguucaaggcccuucccacuacaccuuguuaguagaaagcagcuguguguauucucaauaaaccuucuuuccacucagcuccuuggauacugagccccaaauuccgacugccaacaucacuccuguuccucccugcccuaacagggcuaagcuggacacccauuucccuuaaucucauugcacucacuugacuauuucuggcuucguguagagcuggaauacccuuaaggaauucucucucccucuacuaucaaauauacagccugcaauucugguguaaggacacucaagcucugguucacaccuggccagccagccaagugcugcucugacaugcugagauucucucucucucucucucucucucucucucucucucucucucucucucucucuccaugugcauguaaucagaaaccagccuugcaacucucacacagccuggacuuguuuccaugcuuucuaaaaggcucccaauggccuuccauucagucgucagcucagcaagcaucucacuagggcauccaagucugacugagacugcuugggcuugggcuaaggagccagauugcuugggcuuuaaauaaaguuucuacccacaggaccuuaggcuucaucuaagggguagagaugauaauaauagaacuuaucaggaagcgccuaccaaugccaagauuugaaugagcuaccacuagcaaaagacuugacauaguucaguaagugacugaaucucagaccagcucccaaauagaaaugauaguaguuggacagguaguuaagugguuaagagcauuugcugcucuugaggaagacccaaguuuggaucccagcaccugcaucuguggcuuacacaaccuguaacucccaauucuagagaacuuaauucuuuucuucugauuuccaugggcauuuauauacacauuuauacauacaaacacacacacacaaaacacacacacacacauacacacacacauacacacacacacacacaaaacacacacacaacacacacacacacaacaaaacacacacacaccacaacaaacacacacacaacacacacacaauacaacacucacacacaaacaacacacacacacacaaaacacacacacaacacacacacacaacaaaacacacacacaccacaacaaacacacacacacacacaacacacacacaauacaacacucacacacaaacaacacacacacacaacacaacacacacacaacacaauacaacaaacacacacauaacacaacaccacacacacacaacacacacacaacacaacacacacacacacacauauccaaauaaauuuuggaaauaaaagauaauucuugcccugaaaaaauaacuugaaaauguuauuuaucacugguaucuguuacaaaauacacuguggcucugagggccuaugacaucacacccaugaaagcauguagcuaucccacacucaucaguucaaccauuuacuucuucuugcaugguuuccacuguaaugccaaaucucccuucaggcuggaagugagggaaaaucacgagaguuugaccuaaaccuugcccacgggaguuuacugacuugugugagggacagagggacaaaauaaccaagcuuuuauggcaacaacagggauggggcaaagaaccaggagucuuucuuuacccaguauccuccaggcuucucaagggauccacggcaucucagugcagacugacuaugucaggucuucccagagcacacugccguucuucagaagaggcuguuucuaacauuucuuuuuuucuucugaaggaggaacuuauauccccaucaauggauggugacgugaacccugguccaggaaucugaagaccugguaccaucccccaccccuacugcuaugcaaugugcggccuuuggccaggccuucuagauucucugggccccguuuucuccuguggaaucugcagaaggcagacuuaguucuucucaaugugaccucugaugugccaucauuuuacagugauuccagcaguggucuuuacagaucucuuucuguggcagggcugugcagggccuuugagaaacgaaaaggggguaggaaacgggauuccugcccuccuguucuugccuucucacugagugggaauugaacacagauuaccuaagcaaggaacauggaaauacaagacaauauauucuaacuucaggauauaauuccauuuucuccagacugaguguaacuuuuccauuagguuucauguuaacuucaaagguguguuuccuuggauaggcaucacuuuaggauaacacgagggcuucugcuuaagauacacauauugauauacauacaguaggugaacaaccugagauuagcgucuggaaagucagugagggcuacugaaggaccugagaaaugauaccgagcagccacucgccucuaggugaagacccugccuugucuguuuaugcugccauuggcuuccaagauggcgccuugagcacuguggccucugaacagggaaagccaugugaauucaacacugcagaaaggccaaagagccuccuccuccaucaagcuauuauaaugcacuuaucuacccacaagguaggagucuuuaugacugcaacacuuccccaaagguccuaccuccuaaaacuguugcauuagaaaguacauuucuaaugaauuuuggggagacacauucuaaucauaguguguccagaggcaccagaaacaaauauauuucagggaggugaauugucuaagucagagauagacguggaccuacaauccagaugcccuggcuacuagccgugcucauuaaccaacauccauuauaugugccauucucaaugcauaaugaguagagaaauaucucuguggcaacucucacauaaacuaacuuccaaagcucaugaacagauaugcucaaauauuauuuuuuccacuugcugaauggccuaagaacugugaaguucuuauaacagugucuaaugucccuucuguuguaucacaguacaagacaaauacccagcaauggcucucagcaaugucagaaagcaagacccucuguuguccuucaaaccaccauagggaguagucaagucguaaguguuauccaaagcuccacccauguuuguccccagauguuaguccagcacugugagcuuucaagcacuccuaaaaucaaccaacccugcucaacuggcugccaugcuaccuagggcacaggcgguaaugaaaugcagggcagccccucucuucucagccaguuacugagcagcauuuuuacugccacauuaauuaagaacgaagcagauaauuggcauuagcuuauaggagcugaaaaaccaucaaugguucuuuucacacugguugucgaccguucacugugauaaaucuugaugugaauguaauucacacucauuuucauuuaucccuaaugugaggauagaggcauauucuugacacauggaaauuagaagggucuaguagcugcaguagguaaacccaagacugguguuugcugaauaaaugaauggauuuuaaaaguaaaugaacaaauggaggaguaaauacggcuguuggguuagcgguuaugggugcaugcuuuagguugugacuucauuucucugagcugcaguuucccacguuauacagagauacugagcaccauugcacaguuacugugauaaccacaaaguguaucugaaugccguaacaguuggucuauuuaagugcucugggaauggugguuguuccugcccaccucaucaucaccaccauuaucuucuucaucaccaucuucucaaucugugccccaucaccacccucuucauugucuucaucaucucuaucuuuuuuuuuuuuaacaaggcuuuauugaccgugaucaaagcuaaucucugcccuuauugggaauaucacuuucaggaaaacaaaaugcuuccuuuuguugcauaugucuuuucaaaccuuuuauucugaaauaauugcauuuccagacaggaccccuuuauucuguagucugagagguaauugcugcagccacugccauguugaaaggcuuccagggucuugugaauagaggcaugcaugagagccguccucccuccagcccuggaacugauuaucuuguuugcuuuaaucacaaaucagcacaaagacccuuugcaggguauguuuacugccuagcugagcccaguagcacauccuuugaagggccauggagaagcagcuacggagaagggcaccauagggucacacaaugaggaacagacucacacucgccucgauccgcuguuuacuauucagguuuuggagaccccaucacuucauaggcaaaguuauguuuuuacaacgucuuccaggguggcugcgaagagucacagagacagauucaugugagaaugacauagugccauggcucacaaucaguggcuggcaaaacacaucagauaaccuggagcucccuggcacuuucuguugguguucuggacuuucugccaccacaucucuggguuaccucaccccucaagacccuuuugucuuucugaaaacuggcuuucaugcaagaaggauugaaccaacccggcucuauagcuccacccacucucauaacaaggucuuuuccuugcucaacccaaagacacgguaguuuuccuuugaacauaauuuguaccaucaaagccaguaggaagcuggcaagagccucagcaagugagguugcuuaccuccaaaucuuacgaccugacacugagcuccaggagccacacaguagaagggagagaagugacuuccgaaugucguucucucaccaacauacacaccccguggcaagcagagaaaugcacaggcacaaauaacaguaauuuuuacaaaguuaaagccaauaggauacacgugguuacaucauacuagcauuugguacguggcauagggaacuucuugugucuuaaccuccagguacaccaugaugguucaaaauccacacucccccucuggauguucugggguuucccauaucaucauguggcagaauuacucaucugaaguugugagcagguauccaguuuauacccuuggaggauggcaguacagccagccccaacugugacugagcuccgcccccaauccuuuucuaauguagaucagguauuauauagaaucuacaacacucuccccgaccccaagggagcagccacuaaccaaugaaccaaugaccaacuaauguugcuauguaaguacugcagcuccuuuccuuccuuugucggggugauaaucaugaaugugugccacuggcugccuucacauccuuauuccagaagccagauugcuguaaagacuaugaaaagaaagguauauaagauaucagggagucagguaauauucacugaacaauguguuggaugaauguguguugcucaccaagaccugaguugguguagcaagaugccaagguggaaaagacagggacccuauccuugaggugcaguguacacuaagacuacaccaucuauaaagugugcaguuguagagaauaucguagaaacuccaaggagcagacccgggcucagcaauaacagcuuuucuucccauguggaaugaucauggggugucggcauaagugcccagaauuuggugaagcugaacuaagcuguugagcagugaagaaagaagucggggacccaauaauuccugaguauaacuuagaggcacuuucuucuuagacccuuuaaaaugcuuuuuuguuuuuaauuuguuuuuauuuugugcauauauggagauuuuguuuaaguauuuaucuuuauaccacaugcgugccuugugcccaugggagccaagaguguccagucuccuggaacuggcauuucggaugauuggauccaccgugucggggcugagaauccaaccuagauccucugaaagagcagugaaugcucuaaacugcuaagccaucuuucuagccacacuccuuuagaaaugauuuuuuagcauugaccgaauucuuuguggaagaggcugcacaugucaccguguacaaauggagcccagaggacaacuugaaggaguugguucucucucccauguaggucccagggauugaacucagguuguugggcuuggcggcgagcagcuuuacccacugagccauccugagagaccuuuuuuauucuaacauuuauuuauuuguuucuuagaccuuugauuucagagaagaagaaaaaaaacccacccaagaaaccugaacauugugagugacaguaggcagcagagccccgaaugcaagggguuuuguugucuuucuuugugugugugugugugugugugugugugugugugugugugugugugugugugugugugugcaaacuucccauuuauauucuaagguuuuaaaggcuuugggggaugagguggagaagaagcugagcuguaagcuauuguucaugcuuggcugauauuuaaucaguuuguugggucguaauugagaccacagcuccaguggcagaaauucaaauggucaaguugaagccugugagucuuucucauucuuuaucuuacaguagagauaaccuuuccauuauugagauauaauuuccaaaugagauaguuaauauuaaaacagaauuaacaacaugaguguaacguuugggaagaaauuucuaauagcauuuuuuuguuguuuuuauuuuauauuuuauuuuaaugucuguaaaauuaguguucagucuugcugcaguguuaauugaugauuaaaccgagcugagagacuagucccagccacuguugcuagcagugggggugggggagucucuugauucuuuguaucacucacaaaaccuagugaagucuauccuggcagacugggagcuuuguuuugcauuacauaugggcuaugauuggcuguuuuguuuaauaaggaaguauuagauucuggguacgagagaugagcuauagguauaugaaaagaugacugagucuuacaguccucacaaugcuauacagcuggcacagaaucaggauaaugcaguaagaaauggcaacagcuauuccugugcuuauaggucucuguuccaccuucacaccuaucuuuaccuuucauguuuauguccccaauucacagacacaucagugaucuucuucuaagaugccacuaucucacuucucuggggaucccaguuugaggaagguccuuugugugcccuccuccuuuccaaucucaaauucucacaggccacugucugcacacucaccucucccucaggcuuuucuccccagucugugaaccuaacgcugaccgcagugucuugucuuugugcucucaacggcuaccaaagaauuuguacauagcacagaacaugacauccaguaggugguuaauaaauauucacucaaauaauaaggaagcaagaauugggguggaagagugcuuugugaaugaaaugaagggaguugaaagugagcauccugaagagacaagagacagaugggaauuccagagucagagacagccauucaaccugcucuaccaggcucugccauuuugauucuuguuggggaaguagcacccuagaagugcucaggcacaagaguugagcuuugaaggggacaggucgcucuacucaugaccucugcugauagucaguuccccucauccucaaggaagugaaagaguggagguucagugugaugcuuucugcuaaacuccuccucauauauggcuuugguccaggccccaagaaccuaugggacagguccuggaggaauucccuuuccaaguacaagcauaugcuggcacugcagauggaagaguggcuuucacugggucacaggaguguggagggaaacaacccaaacaaguauucuagaauagauucuuccagaaaaaagaaacccaagagauagcgggagaguaagacagaaggacacauguuuccauccuacaagaguccagccccucucuggguuugccccacugugaaagguacuccugcuaacuguaaaucuauccccauuucugccuguuggcuagcccagccauucuaagccugcuaauuugaaaguuugggggagggacauccaugaagaacucauggaucaaguuggccuuagugaauugccuccacucugcucgcccugccuggcucaaaucacaucucacguauuaaacccauucagaaaaugaggcggggggggggggggggggcggggguggggguggggcaguggucuccaggaagcaaguaaaccuauuccaagcaaucucucucaccagccacucuugccuccugaggcagagauaagcacauuguuucaaucaggcccaaguuccauuuccuuaucuuaaaacuaucuucuaccacauuauaaauaaucagcuuaccagagagcuaggccagacacacguguguguguguguguguguguguguguguguguguguguguguguguguuacauuuuugguguaguauacaggacccagguagcagccuggauccucaaacagcccaagugaaugaggcucccaccccacaccaucacagcaaggaaccuuaggguaaauuuuccaucuaaacguuugcagcuaagaaaccaaaggcagcaggcacaaucauccaaugucagcugcaucgugcuuguccaagcuuagaccuugguaugugaaacagcuagaaguagaggcuugcugcaucgagucaggaaauaagaccucuaagacagagguccauauuuucuccgagcaggaccugguagauuguuuaugggaccaaauguaaaaugaaaaugcacuuugugcacaaagaguaauaauuucaagauggcagcagucgagaauuaaauggagccuguagaccuucugaacucugggaucuggacaggcuggcagggccaaggccacaucaccagcccugacccucaggcagccugaaccaaguuugagggcuccucgccugcccgcaugccugcuagcacccacuucauguucagguaaauaguuugagcaugugauguuuccuugguucgaaagucaaaugguacauggugacaugggcuagaaaugcacucuguccauuucugucucuuucccaaccauuucucagcacucuccaucauuccccuuagguaacuagcucuuagauaucccuccagaguccuuuaugcaaauguaagcauguucuuaccuguguacaguuucaaagaucccaaguuguauacugaucagucauucugugcccuguuuugaaacauucuucccggaguccaguagagacccacccuugcugcccuucuucugucugccuucagaaccacaccaagcaaggccgaucccucuccccaugugaaauacuucaaaguauggaaacugaagacaggucccuccucauccagucucuacuucuuugauuuagacuauuuccuuugccauuuuucucagguuauauuaucuggguagcuuuuguuaccuguaacuuccuauaugcgcaggaccuacaaucagccaaaaggucugccagaaguugagaaaaaaaaaauagaucucuucuauccuucucaucccucaauaucugauaauaauaggucaugcagauaauaacaguuuugacaguuacucugugucagaaaccaggcugugcaccuaucaacaugauaucaccgucaugacaaaacuauaggauauuugguauaauugccccuuagagaaggagcgugaauauacuugcggaaggucacacaacaaggcaauguugaaaggaagguuccaguaggucuguccaaugccagacuuuauccuucccugguccagaaucacaucucaccucucaguuuccuugggguccaauauaggguugauaguagauauguucuugaggaacuucuuugcauacaugauaucaacugugcaauuccuccuggcacguuucaaguacugacuuuucugucaccugcccuguuauugacuagucucagccuugacucucaagaugauguugugguuucaaggcuuuaaauagcacccaaauugauaacuuugacccagucaucuccucagauuccaaacuuccauuucaaaauccccauuuacaucucaucuugaguguguagugugccuccaaauauuauauuagaaaacaacacucauaaucaugacccugaguccugaguguccccaaguuuuuaccaucucacccuuagaguaauauguaaaucuacuguccuuggccuugcuggcugugaaauccacaggcucuggccaaggcugcaagguucaaggaugaagacuuuugcccaccacugcuccucuguaugucugccagagcccacaugcucucuuuuguaucugcaaaggaaaagagaaaaggcaguccucucuacagagagguacacacacacacacacacacacaccuuuucuccuugugaauucagcagcugcuuuuccgaauacuuugcugauccauaauguaaaauggaaagaaguggccuccagcguuucuccuucuucgggaagcaguagagcaccgugugagaacaguuguggguagcacucagcacagcaaaaaguguuugcaauggcuuuggcuuuggcuuugacuguggacaaaggggcaguugucuagguuuaaauccaagcucuauagcaguccuucaucucuacaguggaugauaaaaacacuaccuccugaguggaggagagggcuucauggguagaguaguuucacaaauacaaaaauugaaucugaucccuggcaccaaccuaaaaaguacagugugugcuuguacuuuuagcacugugaggaggaagcaagagguuccuggaaccucacuagacuuagacauuaaugaauucuaggugcaguaagaggcucugucucaaaaauuaagguggagagcaagagaagacaccuagcaucaaccuuugaccuccacacaaaucaucuauauaccugcacauacaacacacacagaaaccacacaugcaugcaccacacacacacauacacacacauacacacaccccacgcauaacugcauacacacaaauaccauauaccacacacaucuguacacacacaacaaacaccugcauaccugcacauacacaugccacacauaccuacacacacacacauacuacacacaacaaacaccugcauaccugcacauacacaugccacacauaccuacacacacacacauacuacacacaacaaacaccugaauaccugcacauauacaaauaucacacaucauacauaucugcacaacugcacaccuguacauauacauaaaucuaaacacacauaccuaucacacaucacacacccacaccuacacacaucacacacacaccuacauacaucacacacacauauacacacaccacacauaccuacauacaucacacacacauauacacacacauaugcacaccaaaacccaacccccucucucuguagacuccacauguaaauagauaguaccuggcagguaguaagcaagcauuaagaucauucgccuccaaacuacaagcugagcuucuaacugcuauucucucccaacaaccuaaagagguauuuuuuauuucaguuuagcacaacaaacauuuccuauaaacaccugccaaggccugcagauauaaacccaaaagaucucgucuuuuaggggcaccacaucucucagaguaaagucaugaaauaaggguugaaucugggucgcucucaccaccaccccccacacacacagcccccaggagacugugacaugcccccucucacccacacaguaauaugcaaauccacugcccuuggccuugcugguugugaaagccacaggcucuagccaagguugcaaggcuccuggaugaagacuugcucaccacuguuccucugugugucugccagagcccacaugcucucuuuuauaugccuaucugcaaaggaaaagagaaaaggccauucucucugcagagagguccucucacucaucacugggcaccuuggguggcugccucucacucucuagacuauugguggccaccaagcaauuagaccguuuggggccuaaugaagugcaaaggcaauucccugcccugggccccagagugcaacaguuccuggcugcugaaggcagacauuaaggagaaccauuuuaauugauuagaaugugcauaugcuguauugguuuaguuugagggcauuuuggaacaaauagcacugucauugugagccuuaauuagauaauaaauuaauagauaaauggauucccuagcuccacuggccucugccuguuugucagcaccagcucaaaguuagaggcucccucucacacugcugaggagcugugugagggacagagcugagccucuggauuacucuccugagguccuccugccuacagcaucccuuagacaaugcagaagucagaggaggagcucaagggcagcaucuugcuguggaagaaauggcacagagccauaguccccaacuagcuuagaacuuuguugcaguucuguuugugggcuuuugaacaggcuggggaaaagagauauaaguagcaaaaacuccugucuuuguagagagacaaaugaaauagguacaaaugucauaguuuguuagguagugaaagacaacagggaaaaguaaaguaggaaggaagaaaacuggaaccagaagacugggaaguuagcaagaaaggagguggaaauuuaaaauuaaaugguuagaaaggugacuuagaaggugacauuccaaccaagaauagugaggagaugagacaagaggagcaaguucagagacugagacaggagaaugccuggugauauggaagaaaagcaaggaggccuggcccauacaugaacaagaagcagaguaagagguuaagaggccagaaaagugaccguuccagcuagcugcagcacucugggucagagucugcaauuaagaaucuaggcuuuaauucucagcagaggaccugcauuccuuucaggauuuccucaucuaugauuacuuacaguccggaauaauuacuuccaguucugaauagcaggcaugcaugcacagagcaagaaaccuucucauauacccuuggcagacauugcuaauggaucacagaucucuuuccagugaacucaauucagugaacauuuuguuuauacagccuuucuggauucuaccaccacuuuuagguggcacuccagagaguguaggcuagacuggugugccuacuucugggaaaggguacuaaggaagauguauagggaaauucucaaugggugcacuuguguugauguuagcaugcuugcucuucccaucaguguaccuuuucuaggaagcaggagcagagaggaucacacaagcucccuugucagcuuuaaugucagauuauaccuaauauccagaggcuuguauaaauuuuacuuguaucagucuguagcaguguuccuggauggcacuaacaucucuuuuauucugaguuugagagaccuguauucuuucuguguuguggcucuucacuccacaccuagcacuucagaggugucaaugaaagagaaguagaugaagaggaaaccuauaucuuaucuauuuggucugagugaucucuucugaccaguuccauaguugaaauccugugcccuggggcuacuuggguaagagaccuaagaaacauagucuguggaugagcagaccuaugaagucuugcccaugauagugaauauacaggcaaacuaagcucugccuuauccaugcaggcagaagucucuuuuccuuaugcaaaacaagcucuuccaaguuagaauguuuaugaggaguccucccauuuacucucaggauuucuccugugaaaucuugaaugaaaugggugccgccggcuugucccuacaucuaauccagggcuucagacuaucgucaauaagauuuaagcuuccccauguuucaaaaaauaccacuucucgagaaaugagaagcaaauucagauugauaagcauuaguuaggugccuauucugugucagauaauggggaaacacccccucaguuuccuccucuauaaaaagaguaaacccucucaaacucucaguuauuaauuaggauuaagagagaggguuccugggcacauaaugggugcucaguagccagcagcacccauuucuuucaagauuucacaggagaaaucccaagaguaaauggauggacucuucauaaacauccuaacuuggaagaguuuguuuugcauaaggaaaagagacuucugccugcauggauaaggcagagcugaauacacaagagugaaacacagagggagggcuauagagauggcucugagguuaagagcacugaccgaucauguagggaaacaaaguuuauguccuaauacccagaucaacucuacauucaggacaaacaaugucuccuguccucugagggcaccugcaugcauauaaugcauguaaacacacacacacacacacacacacacacacacacacacacacacacacacacacacagagagagagagagagagagagagagagagagauuaaaaggacuuauguagugauagaucugaauaccccaugccuuuuaacucaaagcucuugaagauagcuuaacagaguucaaguucauaucccccagucccauugcuccagugggaaugccauagccuggaccaagagaaccagcaguguuuggucaauauuuuucaugaaggcuucaccugggcaccuugguuacaaucagccaaguuuuauagaaagauguauggaagggauaacaacaguccagaaguuucucccaggagacaagggugucaucucaggaaaggaaacaaagagaaucuacagucaagaguaggaucucugaaucagaaugguaguugaagucaaaggguuuuuuuggaagacuuuuuuuaagguaauauuuaggcuccccaucguaaggaauagucuccucguugucgugccuguugacuccauuaaugacugaccuaguguaauauuucucuaaauaaugcucacuuccgguccuaagugccuuccagcuaucagagaaguaaggaagauguccuuuggggugcuaagcuuccuuccugaagcuagacaaggcugugaaacaacagguuaagcuagugcucuacccaacagcucguugggugcaggcaagggaguggccccauguuccacacuugggaaucuagacacauauaccacggcccucagaaaggucaucuuaagauggagauucacagaaguaaggcaggacuggccuaggccugccguagucauguuaccagagcugacacacagaugcaaaauuaaagccaggucagaacugcuucucaggacucagaaaaaaacaugaugucuuccuuagcagagcaaagguaccuggaaagacaaggucaguuuuguggcuccaaauggguuaauggggcggggagcagggaaaggcagaguuuggcagaggagaacucucuaaggagcaggauggagcuaauccuugcaagggcccuucugaacuucugcuuguucaaacacauuuuuuaaaaagaggcuauucccaaaaagcuuaauaaggaugaacagaaaugagaacacacuaauuugauaucaaacguucuaucugcuucaucuauuuuucacaaacaacuuucuagagaucagaaaaccaagaaucagaaggaaauaacuugccaaaucacccagguaaugaggggcagagucugguucugagggcuauguucugucuucuaaaccacuguggacuauugcugggauuaguacuucagaugggauuuuggucauccuuucccuugcuugauggugagacccuagugagauacuucaucaccauaauguaagccaaaugaggacuuccaugcugaccuccucaacucuccccugggcaccaguggcccagauacuagccaaagugcacuuccuacucccugaaaggcccuauccccaggaacugugagcucuuuuagaggaaaaccuuuauuuuuaacuccuucuccgggugcuugacacauaaaagauaucauagaaagcuaaggaggcaccacuccuccacaucaacccuguagccuaagaguccggcuccuuggguucagagacuuuauaaaucggugagugugaaccucaaauguuggguugcccucuuagguucuaggcacagcugcgcuuguuuucuuacaaggagggauguaaguuggucuucauguucccugggaucuagguguaaggucaggcaugagagcaaugcauuaucagcuggugaucuauaauugaguuaggcaacagccugaguaucccacauaccugacaaaacuuuaguaccaauccuuccuccccuagaagcuggggucugagacagauaacauaagguacuaggaacuccauguguuccccacugguuuugugccugagaaauguuccaggauuaacaaaugggugaaaauaguccuauaacaaauacagcagacaagccuuucuauggcaaacacugcaguacaaagucccugcuauaacagaaaaggggcagaugacacacaaaugaacaaaaugcucagcuuugccacuaaccccaaaacauacaucacagugagguggagucccacuuugugaacuaucugauguguuagggacuaaagaacacaauccacaaagauguggcuauguaggcauccucauggaggguggaaagaaggcccaacuuaucaucucuaugggaagcaaauugaaacguauaucucaacauuuuaaaauguagccaucgcugaacccaggaauucugugccuuaaacucuaagcaaaggaacucacagaaauaugggcaaguuuuauaucaccagauguuuaugaugucauuauuuguagucacacagacacacacaccagaauccagcuccauauucaaaaauaugaaaaacaguagcauagauagauagauagauagauagauagauagauagauagauauucaacuuaguagaguauuacaaaguuaccuaaaaugaggucucucuacaaagagauucccacgacuccaaaauguuuaucauaaaaaaaguuaaacaaaaguuauaaagcuguguaguagcuaugcucaaacuaugucaaaaacguggguaacguguaaaagaauacuaaggcuaguguuguguuaaugaugucauugcagugugguuuauuuuuuucuuuauuuuuuugagaacaauuaucuuuauuuuuuaaguguauauuuuaaaggaagauauggaaaacaguuuguuggcaggagaguacuuaggacccauucgucuuugcaaucaccagggacugacugcuaaggaagccgguuaaaccgggggcggcagagccccugugccgaaaucacucugucucuggagcauauuuuuucuuuacugaggaaauugcuuuccauaaaaccagcucucugacaccuccgaguaccagggaaccaugcaagccugcuuuccuggggacauucucuaauagggaacuccaucacguuccagcuuggcgcuuccaacaaauccuagccagccauaaaaauuuuuagcacccugaaugcaagacugauuguggcggccucauaaaaaucccguucaccaaccaagagcuguagcucugaaacucagagcucccugcuguuuuaaagccaguggcaccacgcauugcuaagugacgccugcuagaacuccacacaguaagucggggcugggaucuagggcggaacuagcaacaaaacagaacacagugggcccuugugaggguucaggguacagugaccauaaaaagccaucuuguagcugcagguucgguggggugagaggaaaggaggugauuaggggaagauggcauuccuuuaagaagggaaagggguggggaaggguguuagaggaggagcaagcauggggacuguaccuucacccauagcugcucacuugggaugugaagacccuuuaugggucccaagacagaagcacaggcuacacaaaguaccucugucuucuaggaggcaccuuccugacuaagccccuggcugggguuuuaucucucccuccagcaguaggcagauguccuguuugcauuaggaacacauucucuaugcacugcaugaagucucaggaguuggguccuaacaccuugacccaaucucuuuccacacaaguagacucuaggaggccuguuuucuagccucuaagcucugguuaguucugucauacuagagguaccaccacaaagucuuucguccaccucugucccaucacccuuuaagggagaaucauagacuacauuccccagcugggcuguucccaucaccugcccucuacucacuauauuaaauguucacacaaaaggagcucaaugcuccaaucaauuaaaaucauuuaaaggucauugagaugacuggccagggugcuccagagaaacuguucuagugaggugucugacuccaugagugacuccugguaagggauuagcuugugccacuacggaagcugguaaucuuaaaaucuacagggugggcugcaggugugggauccagaaaauaugaugugauugguccgggaugaaggacgucugucaacacugaauaaagcuggguuuugcucuagugaggcaaucuguguaucugcuuaauaauucauucuuuuauuuuuaauccagaauaauguuuggcuaagcaucuaacccaaaugacaaacaaaauuaaucgugacagagcuagagagguagcacaaugguuaagagcauuggcugcucuuccggagaacccagguucauuugcuagcagccagcauggcagcucacaacccucccuaaccucagcuccagagggcgugaugcucucuucuggcucccacaggcaccaggcaugcaggcaggcaggcaaaucacccauacacauaaaauaacaaagugaaaaaacuuaaacaauaauauuauuuaagaaauaacuauccauuaaugcugucuaaaauauaguuaccccugcuucuuugaauucagaauuccaagucuauacugugcaaccaaauguaacaaagacuaccucaugcaggcuuugaggcccaugcucuauagcuaaacuuaauggauagcuacgucaggccuaacacauuccucucuggguuuggaauacaacugucuaugucuuaauucucuccucucugaaaauaagcgaaucuugcccacaccaugaggcuugggggaagagucagagcguuacaucuuuaagaagugccuugcacaauccuugaccuaguaaguagcucugcccugcauguaucugacugugaguuagaccugaaguguuacucagagcccacaauggauaucuguuuauaauaagguccuagugauuguguuuuagauaauacaagcgaaugcuccacuuaacagcauuggcccugacuaucaaccaauguaaaaguccuugaaagguauggugcuacuuugggguucuuuguuuguuuguuaauuacacgucuuguagaauacuaaaaaaucaggaagggguaaagagaaucccugggaaaugucauucuuaugccuugaaaaucaaguacuccugggagagggaccccucugguggguguggcuuguacuuggaagagcuagggauaggauggacauuccucuguuuuguucuuugugauagugguggugaugauuucaaacauaauucuguuauguugacaaaacacuguauaauuuuaauaccuuuagauuuauugguauuugcuuucuggccuuacacauaaccuagaggacgucccauauucucucuagacagguguaugcuugguagucauugaguagggcauuuuguggacaucuguuacauuugguggcuguacaguguuggucuaaucuucuauagcagcaguucucagacugugggucacgacccauuuggguagcacaucagauauccugcauaucaaguaguuaaauuaugauucauagcaguagcuaaauuguaguuaugaaguagcaacaaaauaauuuuacagucagauauuaccacaucauaggguguauuaaagcagcauuaggaagguugaggaccacuguuuuacaccaugcuaguauucugugucugguuuuucaguugugaauggguuuuucuuauuguuguuauucuguuuguuuggguggguagguuuuuuauuuuguuuuguuuuguuguuuuucuuagaucagggccuggugguggauaucuauaucuucagcuuccgagaaggcugagguaggaagaucacaaguucaaagcccaccucagauguagacuggguacaaguccaacuuaggcaacuugguaaaaucuauuucaaacaagaagagaaaagaggucuggggcuacagcucagagguccaguauuuaccuaguacuugcuaagccuggguucaaucccccaguaccagaaccaccaaacaaacaaaagaagaauucauuuuagaaauucauucacuauuagcaaacuuuccugcaauacuggccaucuucuuucaacaccucuccuuguuucuagacgcauuucuucucuugaguugucaguuuacagcagccacaccagccuugcauggguuucuugcuuucaugguaucaagcuuugcuucuuuucucucagccugucuuagcaucagucugagguacauacgccuccuauggaagucugauuguacagugcucucccguuccuugggucauguuuaauguccacgagauuagauuuacagcugucacuuucuuauuuccuaauuagauauauucugucuuucucaguccccuuuuccugcucaacccuuugugggugaaaagucuucaggauugcauugaauucucuuguugguguuuuaagcaugguuuaaggguuuauuguggcugcuaugagauuuaugauauuuguccuaauuuaucauaagcacuuccgauuaauacuaugauucugcuaaagcccuggaaugcugaccuaagaugacucuauuucuucuugaucuuucugcuguuuucguuguguauucagugguauaguuuugaaauuaguuaagaggaugaaugagaaaaugcauguugacaaaauugcuuuuaucaacccauguuuuccauuucucauguguuagucuuccuaccuacacauuuuagaacaucccagagccccuuuuuuuuuucucagcuaagagacuuugauuauuguauaucauaucuucauuuagauccuggagcuuugaaaugauuauuuuugucaccuuuguccaacuuuccaguucuuguggggaggugauuugcuaagauccucauguagccacagcuagaaauuccucuaauguuucuaaacuucuuuaugauccaugcucucaucugacuaggagacauaggugaggcagauguagcaagucccauuucaaagacagaggaaaagaaugagggugcaacuggagggauggcucaguggcuaagacuaagagcaaaccuguucuuccuaugacccaaguucaguucccagcacccauguuagguggcucaugaccuccuguaacuccagcuccagggaauccaagguucucuucuagccuccaucagcaaccacaccacauggcauacauacacagagggggaggggagagagagagauuauuuaauuauauuuauaaaaaaaaauuuguagcggaggagggggugaaacucagaaaguccagaugacuuuccaucauuauccaccuagaaacuagcuggaccagaauuccaggucaguuuucuaccuuuuggugucauuucugguuugccuagauccuggcugaggcuuuauugagcaguaaggaaggaaaucucuuagcuccagcagcauagcauagaguaggugguauacaaaacaugguuacgauuuaaugccuggaagacugagaaaucugagauagaggcugaugggauuucccugacucucuagagacuugguuguuucuaggaaccagguuacaaguaaacaacucccuucuugaugugucuuaacaugaccuuucucagaguguacccaagugggcaaagaaagaagagagcccuuccgucucuuaugcagccacuaauaucacccguaggacuccauaugacuguagggaccuucuucugcagcaucuccaaauucuaucauuuuuggauacuugaccuucauucaauuuaggaaucuggaggcugcacacagauuuaaucuauaaaggagucagcccaaagcugaaccucucuugcuggccaaagccacaauugcacugagucuccauauucauguagagucgaacuucugggcacagaaacaaagaaucaguugugccuguggccagggccuugccccucuugccaugaggugagagcuggugcuggggguucuguccuccuucagcugcccaugagggaugcugggccuaguuugugagcagcccauaaauuacaauugcggucccuauuuugacuggacugaaaauugcaaaagucacuuuuaucucuagcucccucugaaauaauucagcaaagaaaauucauaacacccaaaagcucagaauuguuucuugucccaaaaaguacuucuauaugcaaacucuggagguuggugaaguuuuccugagucuccgggaguauucugagcucugccuuccucauaaagaugcugcugccucuggaauagccucagaauaaucagcaaggggucuagucucauggagagaauguucuagagaaugucagaaucucuucccuaaugaacaagacugacacauguuggacuucaccauguaccaaauacuauaauaauaguuuuacuuacaaaaaccaugaccauucccaugccuguucaaucuuuggucacauuggauaauaacccagauuuucuguauuacuucccuaccacuaacaacuuuuauagagccaaccacucauuuggggcuuucaggaagccuauaaaugaacuuaagauauguagucauaauucacauuacaccugccauugcuacacccucuuugcuuguagcugagcccuccaccaauucugccuuguggccagcccugaguaauccuaaggcugcagaccuucccuggcaguggcucugcucuauaacuauuucauugcucuauaaauacucuaagaccaggagggaaagaaggacuuauauaccacuacaugcuaaauuuuaguaccugugucccagagcaucuguacuugggacccucccagcaaguuucagaccuugccugggucuagguaggagagaaaaccuuccuaucucaucugaguauccucuacugugaaaugaacuaccaccuauggcuuaacauaauaaccaucuuuuuuuuuuauacaauuauguagguugaccaguuagcucucgaguccuauuccagguuuucaugugguuaugaugcugugguggcuguggcuagagcuucugaaauggcuuucuucgcucuacuaaaaggcuagaacuuccuucuguccauguggucuucugacuugccuagcuugacggaguuuccugagaacuugaucuccuaaguugaacauucucauagaaauaaagcaaacauggcauuucucuuacaguauaacucagaaccagcaaugugucccaucucuugcauuugauuaaagggauaauggcaaggucagccaaaaugcauagggaggaaaauaaaacccaucuucuuaugggauaaggauggggauuuguggcuaucauuaaucuaccagcuccuuuccucauucuugggucuguuuccaagggagcaaaucuuaugcugaguucccuuuccuccagagccuccacaagacagcucuuuguaaacuccauagcagcuucucuauagaucacuuuuguaugucugucuucaauccaacaagauagaccugauaaccucugauguucaaugaaggaaccagaaccaagagggcauaagugauuuacucagggccacagaccaagcccacauggccaagcccggauuugaauggcaaucuaccuaacuacagaacaaaauuucuuagucaccccuccucugugaaaccucugggucuguuuuucuuguuguuguugguggugguggugggcuuuuuuugagagggaaagacugauaauuuuuuuaaagggccauucuuaagccaauguguuuuuugaagaaacacacauacuacuuuucugcaucuuuuggaugaggcuuagacccuguaggaucuauuuuuauguaucuugaauuacuauuauuauuguuguuguuauuauuauuauuauuauuauuauacaaauggcucuuauaaaaggucuuuccaguucugguagaagaacaugaacuucaaaagcccuucucaggccuguaaaucuccuaggaauauuagagugguuggcugccccuugggagaugucaaggacaugaguuuuccagcuccuguuuaaaaacuuuccauggcuccucccauugcccccaggauaaaaucccagcucuuaauaugacaaaggaggcccccagagacuuaucugccucucugggcucaucucauccugccaugcugagaugcuucaagcuuccugcagggcccucguaugugccauugccuguugauuaacucauagucauucuuggagauauugugcagauaucacagagguagggacacuuaccaccucucuucucccauggcacccuaagcauggcuuugucaccuggcugcuucauuuauaucucuccuaaaaucauggucuugcagaaaugaaccuucucauuuuuugccuccugucuacauccuuccucuucauaaagcaauucuaagggcucuccacucuccagauuucuucucuggcuauccuucagugacuggaacuacccauccuaucugcuagaggauggugaggauggacaugauauaugaaauuauuauuuccaagcuuuaguucucaaagaggaaacuguauggaucacaugcguggcucucccagcuuuagccaagaggagauuuaugaagcagcagagaaggagauauuaaacagagcacagccacccuaccaguggaggcgcaagugcuggcauguucacaauucagagcugguugaccagggagaaaggaauccaaaacuaaaagcccuguugagcacuugcaugccaggaaucucacaaagcugaaagacagaauagaaaggccuuguugaaugcuguggacuucaaggagugucugcugaaagaccaggguuaaucuagucaggagugaagacuauuuuugucuuguucucauggaguuuaggcuaagcuuugaaauggcaaagcuaaucuauccagaaauuaauuuucucccucagcaaagcuaaacacauuucugagggagacagcaagacccagagcccagauguccuagcacacacuggacaaccaaaacaucaugcagugcaaagaagggcacaggacccaucucuaaggaaagugaagucagcuaaccauaagugagcaaggagaaaaucuccuugaagaaauacccaaauggaaauauuuaauugaacaguauaguuuuugaaaugaaaauuuuaccaauacaguuaaccauuguuuauaaccuguguaacaaaagauccaaacacuuguagacagggcuauuaaaacuaucuaaacugagaaagacagaggaagggagggagggagggagggagggaaggagaaacuaaaaggagucuguagguaacuacuacuuaguauaacaugagaucagaaugcugugcuaggagauguauuuaaauaauagcugauaaguucccaaauuuaacauaaucuaaacucacacaugcagaaaucucaagaauuccaagaacaaauacacacacucacacacacacacacacacacacacacacaagaucacugaaaauuagaaauauagaaaagcuuaagaacacagauuguccugauccuaugaacugguuucuccuucgguagcucucugucuucccagacucccucucccuucugcucaacuccacuuugaucccuccuugcccagagcucugugucuaugagccauugccucuacaagauuuugaauuuugaugacuagaaaucaauuuuuuaaaguuacauuuaaauuuuuauuuggggugcacaucccacagugcaaugugaucagaggacaccuuguagggaccucucuucuacccuuuagauccucggggaucaagcagagauccucagacuuggcggcaaguuuucucacaacauguugcaauauauugccaauauuaguuacucaauaagcaaauuacauuaaugaaugaagucuacaagugaauaaucauaagaacagcacaaauuaguuaucaagucuuggucaucuaagugaauaauuucuaagauacaaggacccagguauuccuacaauuucaaaguaaccaucaccuuccagaauaauacuagugaaauccacaauuuauugaguguucacuggguggcuggcauuguggcaaaccauuaauaaacaccuaauuaaagucauccugggaaaacaguuaaauaaauugccucaggucacauagguaauaaguaguuuuucucgacuguucuuucagaauugauuucaaaagucuucuuuuuuuuuuuuuuaagaaagcacugucucuccucacuacugaggagauauuccgauguuucuugugucuguuccuucugucccuucaggccguccugugcuucccacacuaucuggugagguccacuucucauccuagauccacacaaagucuuccgucuagaggaaaaaucuguucacaaacaaccaugaacccagaaagcaugacuacacugugugguaaccaauaagaacaccaauuugaggcagaccuuuuccacccuaaagaaaugaacauugcgaucaaaacgccuguggagaaaugggcucacugcaugagagaagggagccaugcagauuuggaggauccugaaccaaccucagggaucagagaggacagcccagagcaagucagaccugagcugagucuaaagcagcaguuuucaacccuuggcccuuuaaggggucaaaugacccuuucacaggggucaccuaagaccauuagaaaacagauauuuacauuaugauucauaacaguagcaaauuacaauuacauaguagcaauaaauaauuuuacguuuggaagucaccaccaucuaaggaacugucuuaaaggguuguugcauuaagaagguugagaaccacugauauaaagggauaagcucuggccagugucuaaaauaucuaugggagaagaaaucccugugcuccccacaagaggaccugggcagacacccaggguccaugggaucguggcaagcaaucucagaaacugcucauuuucuccgggucuguccuagcaggcuuugcugaucuggagacccuaacagaagucugugguaacugacuccugcucuccccacaguccagggaacucaauuccuuucaaauagaucugccuuuaaagugagaaguuaauggcucacaauuuuucaaauuuagaggaaauccauaguugucccugcuuuauagcuugguauuauuggauaaucaaacaaaacuauuuucuuaaaauagaacgggucucccuugcacccucccagguucuuccuguguaccugcauaggcagcaggguggggagugucccgggauccaaguccagguugcccucuuuauuccagacuguguaauuggcccuugcagacagagguuaauuuccuaccgugaauucccuuaccagaggagcccugcuccuggggggaaagcagggaagaaauugcuuccaggugucaccuggccuacuccguggcuggaagggaagccuguggaaccuggcaaggaacaagggcuuggaaagccaacccuauguuugaacugaaucauuugcuagccaagggccucaagguucaguggcauaagcuccagcuuucaacuuacucaucuguaaaauggggcuaagaguucccuguuagccacgggaggggacucuggagcuugacauaguacuugcauggacaaauucuccugccucucagguauuccaugcaaucaaucccauguuugugucugucuuucuuggggaguuuucuccagaggguauucaggaaaccuacagucuaaauauuuccccucuaucaacaagaacaaauuguucuucaaagggaacaugaagaucaacugggggcagagacauucuaaaacuauaauuuuaaauaaucuauggguauuucuuaaaagggcaugucuccauuggcauuuuggguagaacauuuuaucauucauagcaucagaguauuaaacauuagcaguaggcuucuuagucaccgugacaacaaaaaagaccugcacacagcugaagccauacucaacacacaggccccccucaucccuaucucagaaaucauggccaugugacacuggcaacugauugcaccugugccuuguuaccccccccccccccgguguccuuaacauguuguguggaacaaagauucagaugcaggacacuacagcuacuauguauuaauuuuuaaugucuuuuuucuaauuaugcaaauagugcaugcuagguuggggaaaagucaguagaaaagcgugacaagaagaagggacaauaucaaacacgaaaguccccagcauuaacauuuaaauauuuaugccauuuuucuuauacaaggucacaaagucacacaguuaaaaauucaaacagugcuuagggcuauagaaugaaaagcaaaagacauuagcauccaccucacccugccauucacggcuuuauagcuuaucuuucuagucauuucuaugccaagcuaugugucuauaccuuuuuccaacacuaauagaauccuuuauuugugauucaacaaccucugcuggugucugcuaggcaguauucuguagcucacucccuaacaacaugcugagacgguccuuauuaaaaccaccaccaccaccacaacaacaacaaaaagaaaacaaaaacuugcaguguauuccacagaucacaggccccuggcuaugauguucuuucuucacuguuguggauggcccugcccuguuguuaauaggaauagaaaacaauuuaaacaugguaagggguggggcauacuugagugaugaccucaagaaucuauacguuuaaaaguuaugaaaugacccuguggucccuggggaagggguuguguacaacgaucuugguguagaccacauuccguaagcccugugaccuuggagagggcuggguucugagaggcuguguagggcaggaguggggaaaaccccagagaaguucgugucgaggagccagagcuguugaacaugaagacaagaggucgggcugugauuuaauuacucuguguggugucucugaagaugguucuuaacauuugcuccucgugcguguucucagaacacgaagcaaaugaaaaggcaguaaacgaaagcagggcaaacgugugugaggugcaggaauguauuugauugucgguauuaaacaaaacacagaaagcauaauugcuacggaaggagagcgugugguaacaucaauuauggcuaaaacaucugccuagggacagaggcagggccaaacauguuaguaggcucuuccccauguccugugauucuugcggucuuuaaaugcuaagugcugaccaaaagcuaaccuuugcuuaauguuaauagaaucuagcgagucuugacacuggcgauuaauauuguaaugaggagagcuguuaucaaaugccaccaaacugauaugcucuuugucuugcacggagcuaauguauuaauaaacaaggcacagacuuuuauuuucugcgcaauuucauguuacaguuucauggccuaucgguuuaagguuagggggcuauagcugaagaauugaugacuguuccuugacauuaauucuucuguagaucuaacaugaaaauaaaggauggaggccggagacuagccuucccaugcagcccuagaaauggaaggagauaauggugaaggccuuaaugaaucaaagagcuaccccccacccccagccugguccuaugugacugaguugcuggaugcaaagaauacaguaccuaucucucggaguugcaaggguuagaugaugagcccaucucacugucucccagucccugauuuccacaaggcuuuucucacagggauggagcacuuugucaaaggucuucuuggcaucuguucagaugauaaugugacuucugucccugaguuuguauuugugcuacacugcaucuucuucaucucuguaaaagcacggacuuggccgcaguguagcccuggcucuccuggaacucacuuuguagaccaggcuggccucaaacagaaauccgccugccucugccucccgaguacugggauuaaaggcgugcaccaccaugcccagcugugugugacauucuuaauguguucuugaacucaguuucugaguuuauuguugcaaaugauugcaccugugaaacugguccauaguguuuugcugucguuggacccuaucugguuuuggcaccaggguaauauuggcuuuguagaauguguuuaguagaacccuccaauccuguuuuguggaaugauuugaggagcauuaguauuaacucauuuucagauuuugauagaauuugcuaguuagucugucuauugcuaggcaaacuaaaaagacucuuuuuaauuuaauuauuuuuuuuuuaaauagagucuugaucucauauauuccagacuggcuuugaacucgcuaguuagccaaggcuggucuuaaauccuugauccuccugucuuuaccaccuaaauucuagaaugauaggcaugagcuaucauaccuguuuuaugugggguuggggaucaaacccagagcuuugugcaugcgagacaagcacucugcugacugagaucccgccgcaggaccgaugucgggaaggcuccuuaaaacucuuucaaucuccuuguuuucuauagaucuguuugaauuuuuuacaucuucuugacuuaauuuugguaugagauuugugucucaagauuuauccuuuuuuuuuuuuuucauuuuccaauuuuuuaaaauguaguuuucuaaagaauucucuaagaacugucuaaauuccauuugcauuuguuguaauauuccuugccucauuccuaguuuuauugauuugaguccucucucuuucuucuggcuagaccagggcagaccaggcccuauacucaguaaccuggcccaccuguagcaugcuccaguucugcugagaguuugucaaagaacuggcucauaguuucauugauucuuuguguugucccuuaguccccguuuuacuaauagcugucccaaucuuaucucuuauugaacacuauuaaguaaauaaauguuacuguuaggcaugcauuacaguauaaaucagaguccuucugacugcugagaagcuugcuaagucacuaaugggcaggacagauggauggaggacauuuaucauccuggggaagacauagaggguuagcaugagauuucaucacauuucucagaauccugugcugcaggagucauuuguuucuagacuucuucauuuauguccucaagccuuggucgagcauagguaucagaagccacagaaaaaugaaacuguaacuaaaaggagugaccgugccagucccagccauaguggcaguguuaguggugacaacagccgcagcauuaugcugguauaucuccuuuccuuccuucuuuccuuaaaauauaccuuccuggaagucagagucuacuaagaugagaaucggcugccucugaaggaacacugaguuucuugucacgucagcaacaacauaggagaugaucuucaagcauugaguuugggauguguggcuacacagauuacaguaaggguuuggguuuuccuuaaucuuguagguugaguccaucggugagacucugauccuaagaaccaaauauaauuccugccuguuuauuuugggagagaaacuguauacaaaaaaaaagaaagaaagaaagaaaagaaaaaagaaaaaaaaaaguccuucuaauaaaucuuuaggauaccuagccucucacagaaugaggaacuaaauuuuacugaguaccaaauaucacuauacugugauucauagauuagauuauauccuaagcuuuguauccacauaacaagacagagcuuggaaucuccauuuuacucuuagagagaaguaacuuguuauagaucacaaagaaucagauaugggguuugaauuuaaauaaaauauuucuaauuucaaaaccuggucccaucauuuccagaugggaaagcugaggcccagagguacagcaaaagacaugucagugaguccuaggggauuugcccuggcuuugcuuaccuccccuuacugcuguuggaauccaugacgguugaugggcacaugacuauucauuuauucuagaagccccugagaguucuggugguacagaaagccuaguccugguaagauaccuuggauuugcccaaggcacaaggaauguugcugagaagccaaagccagggcucuaacuccugaccugaguuccuacccuguuuauccacuuggcucauagagccucgaagcacaggacauuguccuugauuagaaauggccacagaagucucuaaagcaggaggggcagcuguagaagcugggcagaaggcacuuugccuucugauuccucuccuagaaugauuaaacucccgaggggaaugccuccccuccaucagguguggcagagguuauggccugauucgcccaccugcauccuuagugccagcauagaguaggccucagaucuacauggcagauagaauggauaguacaauggaaacacagaggagggcacaguucaguuuggccgaggucacccucaccugugcaauguuucgugcaagugcaccauaaaauaacauaaauauaacacacaguaagugugcuuguuguuuuguagcagauaucaaacaagaagcaauuugaaagaagaaagauaugugugggcucaaaguuucauagguuuuaguccacgauucugugagucugccauggugagauagagcaucauugccaagagagcaugauggcacagagcugcucgccaucuggcagucaggaagcaaaaaugauagacagggaggggccaguagcaggcaagauaugcacuuuaaagguauucccccagugaccugcuuccuccaaccaggccccgacucuaauagugcaauauaaacucaguggaucaaaccauugaugaacuuaauauccucaugaacccucaugaacgagucaccucuuaacaacucuaucagaugggagcaagccuucaacacaugagucuucaugggaauaguccuccuccaaagcauaacagcaaacaucccaugagucugugaguuuccauagugaccuagccccagggacugcuaugcagcuuucaauacuuguugaaugaauacaugaucaagugaaugaagacucaguaaaucuuuaacaaauauuagugggauguguggccuugacagccuuauauccacaacccaccuaagagggugaauucucccuccucuuucaaagaauaugguauuugaaauauacuuucccaacagauacuagaaaggguauaucuaucacaggucagaagaaaaauccacacaaaggccaaagaggucaggacagcaagcuccugugaguagucaguaacugugagcguagccauggagaccuucuacagaggucggcaagggcaguccugagccugguuuaacauaagcuaaucgcaguggcuuuauugaagagugacaacuuuuucaaaagaagcaauagcagcagcagcagcaggcauuacuaccaauggguacgcuggcaccugguauggcucagcuggaccucaggaaaucauuuaugacacagggagucaucugcugcacuuuggauaagcccuucuucaggaagugcacaagcucaggccuggcuggauggcuguguggaaaacuggcagugagaugguccccagugagcaugagcaggcuuccaagugcaggcucuguggggguguugaggagggcaggaagaaggacccugcuugagcagcugggacaugaugacacugagaccagcugugggcauccuuuaagaggaagucaaaguucacagcugcacaccaugcagaagcaugcaggaaggaggagcccggggugugagacugccgaugguggcuuuaucccuaauaagauacucucugccacugguucuuagaagaaucagaggucuuaguggaccugggaugaaaugugacaaggcauccaauagugccugccuuguugggcuggaaguaccaagaaagcaaagguuuucuucaccacagguuccucaugccaggcaugaaguccugaccagaaacuagugggguugcuacugacugagggaaggaguugccuuaggaucacugugcagccggcuuaaccacgauucucagguaugguucccgugucuacccucugacacaucagcucagagacucauggagaagugagggaaguggugaacagagacagagagaccagagccacacuuuguuggcaacugaacaaaguagcaguacuuagacuuagcauaggcuuagacuugaggauacgucugaaaaccucaaguagugggaguaaaguuuuaggagcacucuguuauuuuucuuauuacuaugaugauauaccuaacaagagcaacuugaagaaaaggggugacuauuguuguuuggcucgugguuucagagcauagagucuaucaugcacagagagcgcagugguacaacugugagaugacuggacacauuguuuccacagucagaagucagaaagacgaaugcuaguuuucaguuagcuuucuccuuuuucuacuugcauucagucuuggaccccagcaccugugacaaugccacccacauucagggugggucuuuccucauggaaagcucucugaaaacauccucagagguuuauccaaaggugugucuccuaggugacugcaaauccagcuaaagugauagaggagauuacucuucacaacagaagccaaacucaacuuagcuguaaccauuguuguuaacucaguccuucauuauaucucuuagcaagauguucuaaggcaaagcaauuccagacaugguuugccaaagcccaggauagcuucuuggcuucugcuacucuaaucucaagcacuauauacaaauggcucaacaucuaggcuucuccucaugucacacugacccauggucacacucccaagaggagaauggaacacuguaauucuccagccaaaaucuagcaauggaggcacagagcagaggccuggcccacugaucagagucgggaugcuguuagugagggcaauggguauugguagacaauagagagaggcugccacaagcaaaaccuaacauaauuagcucuacuccucugccugcagggccaguaugggaugcgaugagauaauggugugaaaggguuuucugcaccagcaaggguucugcacaugggaugaauuguuauuauccuuaugaaauaauuacauuucuauuauagaacaauagcugauaccugaaugcagucuucugugcuauuccugccuuugcccccuuucuugucaugcugugccccuuauauacacaugcacacacacacacacaugcacacacauaccccuacacauaaaugcacauauacauacacaugcacacucaucucccacauacaugugcacaccacccacacaaugcacacacaugugcacacacaugccacacacauguacacacacauacaugcacaggcaugcaccacacauaugugcacacacauacccgugugcauguacccauacacacaagucauaugccaagaacuucacuguagugguugacagugcucucuguaaugcugcuuauaaagaugucacucuggaaaacaacaugcacuggagaaucagaccaucauggauuccaguccagcuuugugcaguugccaugcugcaucacucuauguacguuacauaauuuucuaaagauguuucuuugcaaaguaggagcaauaaacucacugcccagguuccugugagaaucagagauaagacacaucagguaucaugucuggugcagaacagguaacaagugaccacaaauguucaaauggagcuuuugggucugcacucuuaucccguacaagccggcagugcaggagcuaacacuguccccauucuacagugaaagugcugaagcucugagaacuuagaacuucucacucaggauagcacagcuuguaaaugguaaaacagguaggaacccaagcagguaacuucaggcuucuugcucuggcugcuccaguccaccauuuccugcuugugcauaucuggcuguaagagcuagacuguuuguaagcuucagaguggagugcuuagcuucacagacugugggucuucggccauuuggacucaccucugguccuuucuaugccuggaugaccacaggaccuugaccaggcugacugagcacuguaaaaggaagacuccuccucucugaaaugggaauaauauaagcaucugcaccaucagauuguugugggauuaaauggauaugugucuuccacaccaugugaaagacugcuaaagagaaaggaugggaucgauaguaaccacugugagcauuguugugauuaacgagucauuuuuuuccuccccugcauaaaauuccuccugagagcaaaggauucgguuauucaggcagaacgcucgaggguggcuucuuucagaaaaucauagacuuucagaauguagucacuuaaccuuccugaacuucccucuucucaucugcuaaauggggguaauaaagaggaacucggagagacagacucgggacucgcagaauggcgagaaucaaucuugcuagcuuuauuacuggagcuuuaggagggcgcuaaagguagccuugucacgugcucauuuucagcuucagggaaguuugguggcucaauucucaugguacagcuuacuugguugcugcugcuaagucuagagccaaagaaggaguggcaggcaagauuguacaguaagcuuucuuagaucguaagucucuccacucaucucugugacagaaacauucaacucaucccacuauuccuuaacaggagugugcuguuuccuaccuuuggaccucagcauaugcagguccuuuggcauggaacauugaccaaccuacccuaugcauacuuagcacacaacugugccuaccugccuccuaagccugaccccucagcucaccaccaggcuucugcaaaagugucaucuccauuaggaaauggacacugaguuaagggccugcucuggccugucccaccaccacacucuaugcauuuaguacaacagguacccaggaagugagauaugauuagaaugucugaacuagucuguccagugcaauuccucauaacauuaugaggaauugaccuacugugcauuuuauuggccuuuaaaccaagaucuuuuacaaagacagguaagggcccagucuaagucugcaguucuacuggaauauugguuaaaaccaauguggaacugugagcaaugaauggucuggucaugacccauguauagaagaacccuuuaaaaggagcuuugagcaucuccuguagcugauaauugcauucucuggcuugcccaaggaccuaagguaauucagacagaacuguuuuaaaugcacacaccugccucucccaccaccacacucuaugcauuuaguacaacagaaccuccuaaauguauuuccgaccaugcaggccccccuuucuucucucauuuucccagacacaugaaacucaaagccaacacagaccuuggaauuggucaaggaaugcugucccucaggauccgcucacagaacugacccguccagcagguccaguuauucgagggucucgaggggaccuucuccuaaaaaccaaauggggggauagagagagacgacaaccuuguguaaagaacgacacacugaagcagucugaguaacaucgagguuccaagguauugagcaaggcccaaggcuuaaaugcacaagcaaaagaggaagugccuuucagcaggaaggauggggcaguagaauugcacaagcaaaaggggaaguacagguacuuaucagcgggagggguggggcaauagaacuucacauucuuuaugcaguuacaaggggaaacaggaacuuggcguuaucaggguacaucuugagguaaggacauccagcgcugacuuagggcuggaacaaucugugguuguucucagagcggugcgucgguggcccgcuuuugaccaccuuuucuucucagggguaggggggaggcccaauucagagaucaggacaauaguguugucuuaauagcucccaacacggaacaaaugagaaacuuuguacaccugauggcgugcucuguguucugcccuccagaaagcaaggcucucuuuugccagccaugcugugguucugguacccaggaagugagauaugauuagaaugucugaacuagucugcccagugcccugagcuuccaaaguauaaacucuaucuacagaugagccuuuuuaguuaaaaaaaaaaucagagguauuuaaagccuucccccagccccacugaauccaguuuacucuguuaggcugggcagaaagccuugaagagcaagccaauuguccauuuuuuggugucuaaccccuaccucaaugccacugaucucuuagugacacuggguagacagucuuaucuccuuguguuuuuuucaaacaucaugacuuccuccuauccagcccucauuuucuucagcagugagaugaggauaacacuuauuucauagagguguauguggaaguccuuuacaugugaauggacaccagcugaauaaaccuuaugugggcaaggagcagcauuaaggcagauacccuuugggcauugugggaagaucuagauuugauuugugaguuguugcuauagaucacuugaccauuauaauggucacuugaccauuuugucagucaaagaagauucuaugcuccacaaaaugguacuguagguuaaauugaguccuccaucacuccacagcuucgcaaaacuagauaggaugcaauucuagccuccaguagcucagcauaugaaucuggucacuguaauagcuguuagcuaagaugaggucauccugaauagggugggacccuaauucaauaggaccaguaaccuuauagagagaaugccaugugaagacagagacacacauggagagcauccucuggcagacaguaaagugagaugcuauagccauguuggaagucaaggaaugccaaacauuuagcuaagaagucaggcgggagucccucacaggcuucggaggcagguuguggugguuaauguugacagucaacuuggcaggaccaagaaucaccuaggagacaaaucucugggugugucugugagggaauuuguaguugaauucauugcuguuggaagacacacccugaaugugaacaccaucggagucugugagcugagguccagggcuggguaccagcacacaccucccugcuucccagcuggguagauacaaugcagccugcugccucaaguuccagcugcccugucuuccccacuguggugggcuccaucuucaaacuaugaaugaaaauaaauccugccuauccuaaguugccuuuguucaccacagcagcugaggaaggaugcccuggccccgccuauuucuugauuuucagauuugaauaguauugguucaauagggacuaacggcuuuugcgaacacuguggcaaagcacaccuaaaaagcucaaaagaauguuccaugcaccagaggccugugguaaauguccuucucacacaaaagcuccuuucccuacacgaugcaguugagaguaaaaaguaagucuguuucuccaucacguucuuccuuaaaaccugaucaaggauuccuuuugaaaaccucccucuggggcuacccuggaugagacaaagucacugggaaacgagacugagcaaccugucuacucugccccuaaguguuucucuugauuuuucaaggcagaucucuggagcucgcuggccagccuagccuaagagugugggcuuaggacccaucaaagaacgguccacagcccauccuggcacccaccaucuuaguaaccuugagcaucuugcuuaaacauccuauucuacaucugucagcgggucuacagacugaaggugaugauucacuuaaaaaugguuccauagagcuggacacacaguaggugcuccauuacugucaguaaccacucuacccuccagcagcuagcucuuugcccccagggcuuccauaucucuugccucuucccucuaggcccuagaucccccacaucugaguagcgggccuggcaaucggguuaugcucuuccucgcuuaugaggccuaggauguugcagcuguguaaauggagugggagaaggcaaauaucuggagacacagccccaggaaguaauaaaugauguugagcagcuguuuggaagugcuuucuuaaucacaucucagaguagaaguuaagcugccccagccucccugauagagcagagcucucucuguagccagauuguuugaggcucaccaucaauuucaguggcucuuuggucacauuugccagcauaguuugacagagagaaauaauacagauggccuugcaucuuccucucccacauuccauggaaaguagccugcugcccuaucacaauccuagccuccaggggccuagauaaaggaucuuauacuccucuaggaaaggcugcaaaaguccgugagaagccucaguugggacuugaaacuuagagcaguugccagucacccugcccaucaguaccucccucaccaaucuucucuuccucugcaucccugccucucuccuguaaugugaugcaucucugucuccugcauccuggaggucugagucccuccagaaugagggcugguuuuaggcuguguuugcagucccauucaaggcccccacagaacugccuugggguuugacugugguuggccaggaaauggauaugagaggcaagaagggagaggagagagggagggaagaagagagagagagagggagagagagagaacaugaugaauauauuuguguucauuucuuuuucaugagacccauuuugaguagaaccaaauugacauccugaguuuuuaaaagaugaagcaaccugcuggaagucugaguuccaggucucgagcuuacucaacuccccuaggcuagagucucauuuagcuccuuaacaguuggaaucacgugucaucgcacaaaccacaucacccguccucauuuccccuacccauagaaggagaaggauggaguuagaucagaggcgacgacaaaugagaugcuuguguguaaacuguaacacuaucacaucucacagcuuuugugauuaggagcuuagggaguuaugauauacucuaacacucaaugggauccaucccagcauguaacagacuccaacuacguguggaaucacuguguuggcugugggcacaugcaaugaauaagauccaucccuguccugggaggacaugacucauaagacacauguaccuggugaccuuccuuugcagaauuuauccaucuauaaccuggccgcuggaaagaccuccagacucaucuguagucuucuccauauuaauuccauucaucuagcccaguuaguuucuuugcugugccucaaacgaccaugguccugcuauaaggauuuugucauugcuaaguuugcugccugaagcagaggcaaucuccagauauugaauggcucauauuucaguuacuuuuacuggcaccuccucagggagacuacucuuuaccacacugcagaaacaacacagccaccauaucacaccugacucuguacucauuuaaugucucuucguuuuacuuacccccacauucacacuugauugucuuccauauagauauuuucucauugauugucuuuuccacuagaaugcaacuuuucagaaggcagggaucugcccuucuuugccuguaauucucagaacagugccuggccaaguaggcacaaaauaagucauuugagaaaaauuucagcguugcaacugaguuuuauaaaaauaaaaauaaacuuaaaagaaaaaucaaacaacucaacuuaaaacaggaaaagaaaccaaggagaaaccaaagagaaauuucuccaaagaagauagagacccaaguagucaguaagcacaugaaagcagaucaguuuuacuguagguaaggugccaauaaaacacaccagaguggauguauucagaaagguagguaauaacaaguguuggcgaggauguagggaagucagcuguuagugggaauguaaccugaugcugccacuuuggaacaucaccugauacuuccuuaaaagguuaaacauggagcugccaucugucuguugcugagauaaauuacucugacaaaaacaacuuugggggaaaagguuuauuuuaaccuaccaguuacaaucuaucaaggaagccaugccuguuuguuauuccaaugaauugccucuaaccagggaacucaagaaccagcaaaguauagcagaaaccauagagaaaugaugcuuguucacauucaugcucugcuagcuuucucauauagccuaggacuaccuggccaaggaauggugccacccacagugggcugguacccuguauacuaacaaucaauaccauccucaacaugcccauagguugcucugaucugagcaauuccucagucucuucucaagugacucuagacugugccaaguugacaaagcuaacuaagauaacauccaauccagcaauuccacaccuacauuuauacccaacagaagugaaaacacacuucccaugcaaaaccccaugugcaagacuuuagcagccagcaauaauagccaagaagggaaacaagugagguuugauauguggaugaucaaaaucucacauauccauccacuguagugcuaacuggcaacauagggagauguggguaaaauuuaaagacauguucagugaaagaagccagucacaaaagaacccagaauauaugauuucauuuccuugaaaauucuugaauaggcaaaacuguaaggacggagaacagaucugugauugccccaagcaacagggucuggaagaaccacgaggagugccugcagguaccuaugauguuugugggcaaagcaaacacucucagauauauuguguaguaauagucccacuguucgguggauauguucagucccacugagugguguccuugaaacagguggcuuguagggcacgugaauuauuucuccaauaaaauggagauuguguaaaaugaaugucuuccucaaauacugcucugccacacagcauacuaacuggagagagucaguccccaugugaagaucgggcaaaccuuacggcuaucaucuccucuguguggaggagggggguccuccuuggcaagcccacgaaagcagagcucuguucuucaugagugaaggaaaacaaaaccaaacucccuaagacacucgugaggcggaggaggagaucagaugcccugaaccugaguaauuuacugugucuuguuuccaaagaccauuuucccagcauaagucacagagacagaugaccaggaccugcuucugaaaacaaacugaggggguggggguuggggguugacagagcaggagcugcugggcuggagccugagaaccagggcuugcccugcucacugagcuugggacuuacagggagggaguuccucuuaccugacuuuuuccagcagggcucuuggucaagaacugguuccugaguuggauaucuuuguguguguugucuucccuuuaaaauaacuuuuacuauuugcuggguuuuuuuugcuguuguucuuuaauuuaauuuuauuuguaauucauuuuuuaaacuccauauuccauuccccaccccuuccccaucuacccucugacugcuccacgucccaugccuccgccccacccccugucuccacauggaugcccccacccccaaucccaccugauuucuaaacuccaggggucucuagucucuugaggguuaggugaaucaucucugaaugaacacagacccggaaguccuugcguguugggggccucauaucagcugguauauacugucuguuuggugguccaguguuugaaagauaucaggaguccagguuaauuaagacugcugguccuccuacagaauugcccuucuccucagcuucuuucagccuucccuaauucaacaacaggggacagcugcuucuguacauugguuggaugcaaaauaucugcaucugacucuuucagcugcuuguugggucuuucagacggcagucaugauagaucccuuuuucgugagcgugccauagccucaguaauagugucaggccuugggaccuccccauugaauuuguuccuugaaaagaaugggcaaugaaggaaucaggcacuguggcucaugccugaauccuggcaaggcugaaacaggaggauuaccagaguuugagucugaaacuggucuguguugcauagcgaaucuccggcaaguguaggcuaugaauuaagacacagaacagaacagucagacacagaaaccaaacaagaagaggagaggggaggggaggggaggggagggaaggggaggggaggggaggggaggggagggggaggggggaggggagggggaggggggaggggaggggggagggaaggggaggaggggggaggggaggggggagggaaggggaggggagggaaggggaggggaggggaggggaggggaggggaggggaggggggaaggagaggagugagggaaugaguaauggguuagggaggauagaaggaaggaaggauggaaggaaggaaggaaggaaggaaggaaggaaggaaggaaggaagaaaauaaacuccaaaauuuuacugucuuaacaugacugauaugaaauuuuuuugcagaugugugugugugagugugugugugugugugagagagagagagagagagagagucagaagagccuuuaugcaguuuacacccugcuuuucugauugcccugugugugugugugugugagagagagagagagagagagagagagucagaagagccuuccugcaguuuccacccugcuugucugauugccaucauuauaagcacaguuaacagacucugucuauccuaacaucgcaugccugugucuuacuuuauauaacuaugcacuuguuuuuaaaauaaaagauguuuaaccuuuugagaauuuucucuaaauuuuucaguuuuacuguuaugugcuaagaacaucuauaaaaaucuuucaaaagucauuuuuacauaaguuuuuagagguggaauugcucaguuaaaaauuagcuuauaccuagcuauauuaauacuuucaguauauaaaucuguguuuauacuuaaggccaacagcucgcuuagcaccuacuagacacgggauauuuucaugcuuacuacuucauuuccccugcaguuuuaaaacaccgguuuaaaagcaugaaaagaacuacauaugcucauuacagagcauuuuuuauguuuuuauuuguuauuuauuugaggggacaugucugccaaggcuuacaugugaaggucaaguggcagcuugcaggagucuguucucuccuucugucaugugagcucuggugcuuaaacucggugucaggcuuuauggcaaggaccuuuccacguggagccauuuccccagcaugccauugaacaauagauuaaagauguaaaagcauguucaaauuuaaaauuguucacauagugauauuauaaagauuuuuuuuucaauuuuugcuaaccuuuuuucuaauacauuuacccaaacuuguaccuucuauaaagaucuuaggagccuuuccuggguuagaagaaucugaucuccuacuguaacuaaaaucauuucuauccugcaucuuuuuauugccucuuuuaaucuucugaacaacacaggaaguauaggcugcuguugcuuccauccuuuguaaagcuggaccagggaagaaccuugggaauuaguucaggugaaaggcuagaggaucgccagguagugagaugcucgguugacauugcccagagcauccuccugcuccaugacuacagauuccucugguguugagcucaguguauaccucacugccuuacaacaggguaaccaccuaauacaugguccaaauaagauccuuuauaaaaacagggugccauuauggauuaguacagaacagcaaguacaaauuggggcugcauccccccacaaggcacucccaacaagugacagauggucacucuccauucccagauuuucaucccuuugaaaaggaaugagauggaaucaaugcaaauagccaggggaacaaguucggcaaauuggugcugaugagagacucuaggcuggaccagagcacagagaugaacagugcauggccccuggcuggcucaagcaguagacaugaagacaguugacuggcauaagaugcagcgugugguguugcugcaaaagggcugcugacccuccaccuguccccagucucuuagguauuaucagugccccugccucuccucagaacuggacaggauuuuacuuguuccaugggcagcuagacaguggaugucuguucaugagaagagagagaaggugcuccaucuaggugaagugauuaaaguggcgcugggaaagagauguugugucacuuuuuagugaugcuugugagcuaggcucagcacuucuauguuacagggcuuccaguucaaaaguuaccaggaagcucuucagaugacccagggaguuucucaggaucaucucuccccaaaggccacaacuaaaacuguccagauaggggcuuguacuuguugacacuuuacacaugccacagauuucccuaccauagccuggaugggguuaaacacugagcaauacaauuuccuuugggcagucaaauggauuucucaggaaugcuaaguaaaguggggggagggaggaaggggggguccuucuuguuaauagaucuucuuugaaagaaaugaacuugucuaucagcuaaugucacacaauuuagccuucugauauauuccaaaauuauucucagaauccagagugcuaaaagauguuccugggacaacuacuguacugugguuggagggcaauguucuuuucuuucauucuuucucuuuggguguauauuugucuuuauuucaucauugcuuauagugguugagacagguggccuccagcucacagcaaucuucuugccucgaccuuccaaguguuaugacaccagaagagcauauacguuggauuucaaaugguuuucuuuuuaaaggcuaguaucaauucacacaaaggugugauuuagauaucaggauuccuugaccugcagucucuccguauauccucucucucucucucucucucucucucucucucucucucucucucucuuuuucuuuuguuauauuaucaaaugauacaauuuuauagaagucucauuggcaggcuugcagaacucucagugucucuuucugaaaccgacuucuucaggucucugcauggagagacagcagagagagcaguauuuguugagccuuuacagagagcaagcugacuccugggcuacuagugagccucaggucauuaacucccagcaacacuucgcucgcucuugcuccagcuuuuuuuuccccauuuuuuuuauuagguauuuuccucguuuacauuuucaaugcuaucccaaagguugcuccagcuuuuaaaggauaaaacagagacgugcaaugucaccugcugguaaaacuugacuuugacccuggguuagaccagugggaaggaagauggugguaauucugcuuucucuguaucucuuucccugagccuguauuuuucucugagccuccuugggaauccaaauuaggguucaucaauuuccuucucaggauucagugauaagacguuuucagggacgaguuuucuaaugggucccuuuggccacagacaaaugauugcacuacucugagccuccaccacuuaagcuuucccaugggaaauggagcuauaucuguaguaucccauggggaagcccacgcccaucgcugguaagagcucugccacgucuuccaccccaaccuugcaggugucugcucucccucaguuugcccaauuuuaccuacuccaugcuaaaguuggauucacugggaccguauccuaagaaauguacauagcauauauguauauauccaaugaaaguagaggugacauuuucaaggggauaaaugaaaaaggggaaggacaguaaaaaaaaaaaaagaguaggggagaacuggaaaaauauacucaaaauacaauauauauaagaguuaacaaaaauuuauauuaugaagaaauucaagcagucugauauuuaauugauaugguuauccuauaguuuacauagauaggcaaguucuuccugcaugcauacauaggaaggaauacacacaaauacugaguggcacaaaagcaaaugucuaguugguauuaaaagugcaaauauuucuuccuugucuaccuaagcuuugcuuuuuuuuuuuaauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcguguccaaugggccucucuuuccagugauggccgacuaggcaucuuuugauacauauacagcuagagucaagagcuccgggguacugguuaguucauaauguuguuccaccuauaugguugcagaucccuuuagcuccuuggguacuuucucuagcuccuccauugggagcccugugauccauccauuagcugacugugagcauccacuucuguguuugcuaggccccagcauagucucacaagagacagcuacaucuggguccuuucgauaaaaucuugcuaguguaugcaauggugucagcguuuggaugcuuaccuaagcuuuucaaacccaaauagcuauuugucccccuccccccagaaacugguguggcucuuccucgcuucuauggccuugugguuguuggaauggggcaugagaaaguucuacugagggcggggugagggggcugucagaagcauucuggaacaacauacucucuuccuuagcuuuggucugauauuguaacaucuuggcauggcauggcccaguucaucaaagacucugauuggagauuuuaaaaauauauaugagaaaauggguguauauguuguuuaauaaaugcagccugguagagaaagauugcaggaggagaagagucaugaacagggaucuugauguaaugguuuuguuccauuuccuaaacauuugguaagcucugacucugggcuccuauaugcucuuguauccuggacagucacacagaucaucuuuagugcugauagcagcugcauaaaaaccagagugcagggggaguggacagcuuucuaaugggcaaauggaagucauuuucccuaaaaucauagagcugauaaaacgguagacagugauguaaaccucgguucuguuagaccuaggaagcccacucugagugugacccaugcccacaggauguauuguauauuuuaguguugcagauguuuaaauuauaaccaaaaaaccaaugguaucaaaugggggaaaccagguucagagaaagcuguauucggccuuuugugcuggcugcuaagcgugucagggaaggcucucauggugaaucaggaauacugguuuggacaguugaaucguagcccaaaguuuuggggugaaaaaaaccaagaccaagaacaaaaagccaccccaaauaauguaccuuggucacugauuccccacuuucugcauuguccuuaaugaagcucugaaaugaaccagccaaaugucaugaagcaauucuaugaagcagugacuggcaguuagacucagggguugacagucacauggugggagcuguaaaauacauggcuuugaaccaugaggccuucuguuauguguaccacccaaaucagaaguucugugccucuaaggauccugcuaaauguucugaucugggaugggcuguguuuccugaggcuguggcccuucgcagaacuggugacauagggcuaugucuuacacauauucugccaguccaggugugagacaguaacagcccuugcugccgggcaaugccuauguuguacuguauaccuguguaugugucugugcuuauguccucucuuguacucgauguacugcauguguggaaagguucuccgcagacaagaaggugaacucucccgagcugucccuuccuucugaagaguugggcauuuguuccuagaacuguugaaagccguacccuuagaacuuuguaauagcccuauaucacagaagaucagagucaggaucucugccuuuuggaacccauaaaaugccagugucuuaauaugacagacuuagaaauguuaucauuucagcuaucagagcauaaggauccuagucuaucagaucucuagcacuaauaugugcaacaagugucuccucugugcuuuccgugagccuggcauuacguuacgcucuuugcuuaagggagugaguaagaccacuaaaacccuugauugcaagaaguuugcaaagaaugucagaauuuaagaaucguaaaaaaaaauguuagauccucggagaacuaaaacacugguaugcugacguucuuaagcuacuaaaggugggggagagccuuagaucauuuuuuccagcucucacuaccuuuuuaugaggcccgggacuuauugcaggcuagcuggauucaaaucucacuaauaagaacaucauuucaguucagugacaucacagaauggcugggucgcaagggcucggccuucacccaacccuggcugcucauuuuaccagagaggccacuguggcuuauagagggcagccgguuguucuguaaaaaaaaaaaaaaaaaaaaaaaaaaaagcgcagucagcagaagacaacccgggguuuuccggccucuguuaaagaaaggcuaaacaagaagacccuccugcuguuucugagguauucugcuaggcccacuuuugugagcugucccugcucuucagaaggagcgcuugcucgccaacuuucucugcacagggacagcccuugugcgggccacacgugcaguggaucgucgcguucagagcccccucccccguugaugcguguuuuauuuuguugccuccccuuccccgugugccucgaaaucgauuuucauuauuauuuuuuucugucuguguuugucuuuguggcccgcaggugcucccuugcauuguucaucugcuucaucaaccccuauugagcagucccccuccccgccccccuccccuccggccaaugagagccagaggcgguugcuaggcaacgguguggcccagccaaccccggacucagacucugaggaagaguuugucccuaauucauucuuaguuaaaaguggcuccgccagccugggggucgcagcaaacgguaagugcuucucuuuuuugcuaacuuuuaauaguuuguugcuuuucuuucuucucgugggcuaugccugcucucgaccgcuugcaucuugcagggguggaguggcuuggugcauggugggcuugugggcagacagggaccugggugguucugugggcuugggguagguagcuccugucucugccccaugaaggagacuuuauuccgugacaggugcacgaaacagaggaucacagacagcaggagacaaacaccgaacagagacaaagacccaaauuggagggugggggacauguugcacugauuggcuugcugcugugggcaaagcgaccgcgccagacauagucaccuguugcuucauuagauucucccuacaagguuuugaaacuagcaggaauucagugcuccucaguaacauuaugaaaacugagagaaaggauguugccugaagcccaaggcuguuuuucaaagugcccuagccugaaguugcaggcagcuacagagcugagucugaccacgggcagaacuguuggguuucagcaugaccugccugcccauaguuccaugguucgcuccuuuucucugcuuuccucaagagaaggaggugugaggguguagcgaaagaguaccacccagauccuguacuguuacacuuggccagagauacccaccugcccagcggcagccagugcauuucuccacaaagauguucuugcaggggauccaagccacuaugggguggacauaagacuggaugugagagggcuugggauuacaauaauggcaccaaaguuuuccaauucuaauagaagaaaguaggcuuuuccagcaaaggggaaaauauacaugggacgauguauauugacuuggcaagcauuuauuugugaaugccugcacaggcuagagaggugacucagugauuaagaauauauacacuguucuuccagagguucuggguucaguucccaacacccaugucaggagacucccaacuaccuguaacuuuagcuccagggaauuuaacgcugcuggccucuguaggcauacauacacauauaauuuaaaauaaaguaaaucuuauaagugauuuaugaaacugcauccuaagccauauuuugggaaaggagcagagauggagaacaugaggcaggguuguuugguggagccacacaguucuguaaccaaucaaagcccuguggcugggagcuuuggacaaaucucacugacuucccaagguuuuucaaauguaaaagcaggcagugugcuauccaggucucagugaacagcaucuuagggucugggguggggguccaguaaauguaaaugcuuaccccaucagcugccacuucccuguaucggccacacagagugucucugugaaagcucucuacacauaguggagcacucgguaugcuaggagaaacaccagaggcccuuucuuuucucaggaacagccagagaaagcuaaaggugauaagaaaggaggagccucgagugcugggugacagggugauugagagaaagucucaccacugccugggggagcuggaaaugccuccuagagaugccggcucggugggaaagaaugggucaaguggacuagacuuugaugcuagcacuauucuagacagaaggguacacauggacauagaaucccggguaggaguuggggagccugcuuccacuccuuuacaucuuggaaccuugacacaaaauaaggcacugaccuggaagggugugaaaggcuucacagcaacaucauuggagcuucuccagcggcugaacagagcaugcgcacacaggcccugcauacucugugacagaaccccauacaccccagggccccggguuugggggacugucucugagccagagcauccuuaagaggacagaagcaggaacccugaacuaagggugaaagaccugaguuccagcucucugggucacuggauaucuguccuuggcaacucacugucucgauucgggccaucuugccagugaugaagcaguuucuaagguauucuggcuuuauuaaugucaugugguacugcugaucaugacucugccagucagggcaugagcuuguugaggaagaagaauuacaugugugaauacauaugcauauaucuacauauacauuuguguguguauguauacauguguguguguguguguauaauagugcacauauguagaacaaauauagauagauugguagauaacuaauaauguucugcauucauuucuggcuaaauaagccuuucaggaaaaagaagaugagagaagaaaguccuuaaucuaucccuuugcuacuaacugacccauagcugcgccuuugucacauguucugauacaagcugaggcacuguuacuuuguagcugugcagggaccacaggagguuguuggccuacagauguuugcucacuucagcuccucugugcuccugcuucccaggggccuccaucuuacucuggauuaccccagggucucgcucugagagugucucccugaccaucauuaguaaauguagccuuugugggaagggagagucuggguucugcuugguuguuguucugggguaggugccaugagagucuauugcugugcuccaucaucuuuuugucccuaaagucccacaugggaauguccuguuggugcaagugacaaugaguaagucaccacauguggcuccaguaaauguuuguaaaguuuaauuugauuuuaaggggggagugugaauauauuuuaauggaguuaccuauauugcuuuugguaauuauagaaguaaggauacuuacuuauaccccagaugaucuaggaaagugaaagugacauucucacauaaucuguauuccagaaaaaaaacacuuucagcaguuuugucuauggucuuacaaaugcucuuuuuucaguauuuguuuauucuguauugauuaauaagugaaugaaugacccagugagcaagcuacagagccagcuccccaaugugccaucucaggaaggguccccauccuccucccacccccaacccccagucccaguggacaaccugccauaguugugauaguuuuaaaauagcaaagcuggguacuguggaugaaaaucagagggagaaagcacuuugcuggccugagaggcccugggcaggaucagaaaauaacagagaugguagguaaaugucccuaccuccacacaucaucuucugcuacugagcugaggcuugagaccaccugaggcaggucaaaugcuaaauccccaaagggcagcucaccugagacuucauucccacuguaugggcuucauucccaaugcuaugagcugcuucucuggcuacuggagggugacagcacagagguuucucacuuuccagugguuuccggagacagugggagggaguuggccccuuggaaccuguuuucucagggcccaggcugccuucccccuagagucucugccagcagauguguuagcuccaggcagugcugggaccagggucugcgaggccucagagcugcccugcagaaauccccauguaaagcucagaaagaaguguggggcaucucugcacagcucauuguccccauggaaaagaagagaggguaagucgcucuuucugucaucacuauccuaauccuccccagggcacucguacagaagucacccaugugaauaggaaaagaucaacugggcacaguccaggagcucaggaagugguuaggauuaaguagaugccuguccuaaccccauagaaacgcccagaaucaacaguguuucaucaauugagcuaaucugaaucccaagccagggggcuuuggaaacuuagggguggggcuuaacagggucaggaagugaagagcccugagauagcaauaaagagcccuggagagcuuccugaagccagagaaggcaggagaggcaucuaaugagcaccuucuguaugcacacauuuccuuuacgugcauuauugucucugggcuucaguuacuuacauuucauuugggggaaacugaggcccagagaugaggacagugaaguaaucaugaccccacuggaagacaaagacgcaacaccaaagcaugcuugccuccagagccucucuauugucugccuuauuucugaugccagauucagaucuuucuguauccagcagaagacugacaggguaagaggacuccuaccagaacugaguggacuuuuuuuguuuguuuguuuguuucauuuuaaagaacuccagguuguuugauuccuauugcucaccucacgagcauuuaugaagcacccagcacugaggagccucuuuaucuuagggagucuuuggcuccucuuaucuauccugugagcuauuccagucucugggaccagagguaacauggucccggagagguaagccacuuuccuuucucugcuucugggagccccugaugauaaggucaaauuugaacucuaggccugccugagaccauagcauggaaucuuuauggaauauuuguauggggacuucaaggguuucauagauaaaucgggccagauauuugccacauaaaauauuguugcagauccccaaaagcaaacccuccacguguccuuggcucccccaggcuccaggcccuuccugucuggccuuagaaaaggcuucaguggccagcagcaagguugcuuggcauuuucauugacuugcuuaggucuuaggcagcugggaguauuuuuguuuugacuuccaauccugcagaggaguguuuauuuuucuuucuaaaugggaaacacugcuauguaggcaagcuccuuccaaaaaguguuuucuuuaaaaaaaauuuuuaaauccaacuuaauuuagaaccuaugcagaguucucaggggagucugcuggguccuuuuaagucagcuugugaaaucagaaggcaaaaugaagccagcuucuaacgauagagagacgugcccagucaaauugucuuucuucuucugcugggaguuccauggaaccuguggcagccauaggacuugggucugccugcuugacacguucccggagcgaaaggcugcugggguguguaaaguucucugccaaccuuguccucagcuucucucaacccuucuugcaucaaaggacacuuguugguaaacccguucuugugacacaagcugcauggggaaaucaguaugagcucccuuuucccugcuaggaagacacaccgauuccuuccuuucuucauucaucccccgaagacauguuacgugguggugggugcuuuucagaaagaugaaggugaagaguguuauaagcagaaagcucuuauugaguaaaugggcccuugggaaccacaugccuggcagacuccuuucuucucagaccucagaguaaauggaguauccuguguguguacuuguccuaaaacuccuccugucaccaaguacaucagcaucucuucagaaaagcauacaaauacuuuauacuagugggaagaaaggaagacagacggacagacuccaggucuuguaucauuucaagacacauuuuugcaaccaaacaagauggauuguuugguugguggguugguugguuggcuggcugacugguuugguuucauuugcuuugguuugcuuugguuuaguuuuuuuguuuuguuuuguuuuguuuaagacauggccuugauguguagguuguacagguuggcuuugaacccgugauccuccuaagccaaccucccaaguccuaggauuacaaauauggcuacccacacccauauccaugcccagcuucaaaguuguuauuguugcuuaaugucuauuggcauguguguguaugugcacauauagaucaaagacagccugaggugucaucuuuagcaauguugcugucuuccuauggccuagaacuguccacuucugugugucucgcuagucagcgagcaccaggggucuucugucucuaccucccuggcacugugauuuuaaguguucaccacagcacucggcuuuuuaucuagugccagaaaucaaacucaaguccucacaccuguuagacaagcacuuuacuggcugagcuaucucucugccaacaauguauggaugucucacuguccuuagaacagauaccaucucugcuugugacuccauuuccuggcccaauuucaaguguauggaggucagcuuuggcuuugccugauuccuaacuugaaaaaaauaaucacagcuacauugaaaagucaguuaauguccuuucuucucccuucccacuuacauaggacacacagccaucccaggaccagggcacugagccacacagacacagccaugcagauagaaacuggcccuagugcaaucaggauucaguguggccucagugccuguacucuuuguccucugccaggugcuccccuaacuagaccuaugccucccaccaggaacaaacuauuauggccccuaauugggggcggcagggacagccucaacagggucauuucuauuuuauguaguuuacaaagcccuuucucaugcauuaccccgggcaaacccuggugacuauaaucuaauugccacuuuggcuuucuagaagguaaggguccucuuugacccuacaaaauaaacaagucacacuuugaauuaauauaacccaauguccaggggaagccagggcccucucauuagucacucacgugacuagaaugcagccucuggcaucccuuucccacucauuucccccaaaugcaguuguauuaaaaaauaccaaaauaccaccagguuuaguguguggcuugguuggcucucaggaccccaaagccaccccaugaagaggcaugucagccguguguccugacuuuucccaucuggaaacagccugauuuguguucucguugguaugugaguggcuggcucuacagaguccucauuuacagcagaccacaucagaaaguaccuccugacaccagggugcccaggcuguugaagaggagccuggaaggaagccaaggagacagagaaaguuagcauaauucccauucagacaaaccccuuuccuaaagcccacucacacgcaaucagcucguuuucuuagaugcacagagccucaaggaugacugagcucagggcucggcaagcacugcgugcuggagguaaaaugugcagaggcagcucugugucuuuuugggauuggcuuguacuccagucaguccugucuguaaagcacucugucaucgacaaagcuuacuguccaguuacaaaucucagcugauggcacugcccagaccuggagcuggcaugggauuccacuagugagggggcugcagauaaggacacccaagugaccccuucagccugucucugaccuucugugucacccucgggagucuuugggucuggacacugagggaccuggacugaaacaauguuuuccaggcuuugucucugugucccugucacagcguagacccucaaaccaugccuaccuacaccauuauuuauguucuuuuaaacugccucuuucccaaaacuuuuuggauuuuacugaauuuucuuguuuuaagagggaauuguauacugggacugcaauucccuugccauauggcaagcguaugauuggccauaaauagaagcuaacuguaaaaauaaauacaaugaaagcagguuaucauguucuagugagaacaugccugcucaaagcuguggggcagagccuuggcucucuuuguuaaacagggacguuggcaaguguugaauguuaaagcacacacugggugcccaucugagguuuccucuacuucaugaaaaggguuaaagaaagaggcccuccccaugggagaaauacucaauggguguucccagcagacacugaagaccauccacaggggacacagcuuggcagccuuuucuagaaugcugucuacacauuuagugccaccuucacagccuucccaccuugagaacaaacgucucaggcagcuccccccacccuggcgucuucccucgccucugcugggucuuugcaggccaucuguuccugcccucccccucugucucuggcccucugccccugucaucaggucugagcugggugcuuugagcucagcuggaucccccauuacugguuaauggcucucaguguggaccaggaaaccauguggcuuccucugaacugccauuauuuauguagguguuugagauucagcaacuuuaaaaaaaucucuuugcuuuauaagaccagaagaaccagaaauggcacaauguggaaucaggguaaagaugggcugggaauggggggguugguaaguggauccccgcugugauggguggccaccugggaucugcucaaccucuuccuguucuaucucuuguucugucagguuuauuagcuucacaggauugcugugcaaaugagaagacacaguguuuucucuauuagcaaugcccagugaaagcugguuuccuucuugcccuuugguaucacagaagaguccagauaucuuggggguggggggcaaggaggaggcaauuuuuuuucacuccuuccccuccuggcuuagaagaaccacagcaaugaauaacucugcccaggaguccuuagcugccacccccucaggcgugcgcacgcacacacacacacacacacacacacacacacacacacacacacacgagcagcagcagcagcacuaccaccaccaucaccacccugaaagauuucagggagggagcaaaagagggagggagugauggaguccgaggcagcagcuaagcaaauauaacacaggggucuuagaaaccauugcugaauuccuagccagaguuucuccacuguuccugguccccacuggucuagcauccugaugccuuuuccuccuggccaacggccuucccuccccccauggaguugaaaggagaggaaacuggcugguaauucauuuaugcccccuucccucucuccugguagaucauguuucuauaaauaacccuagaaagcuauagcaacagcucaugauaaucguauguauauuuauacuuccagacccuucucuuucaaugccccagagaaaguucucugagaugcacaccugaugagaacuaguuucuacuccccacuaccugugaccucgagaacucuccugucucacgcggugcccaucugugaaaggggacugaggacagcagccuggggcugucucaaaggcagaauaagugagaguccacugugcucuauggcugcugcuguccccuuagucaccucucuuauuuauuagaaacaaauagggggcauuuucaggaugaaaagguuauuguaccugaaguggaguuugaugaccugucugcugucauucuguaaaaaagugaaagcugagaggcuacccaccuguuugcugauuuuacaaacucugcugucuucguucacagugcuguuuaguauauucuugcccugaaccauugcaguaauauccccucuagcuugaugccuccuucucagccugcugaccaccgagcuccuucccaaucccgauuuugcuaucuccaggccucacugccguagucaaagccagcccaggcccucuguccgacgcuugccugcagcagauuucugacaaaugcugagagaaaaacuccuguauucuuacuuauuuuaaagucagaccaggggaggaucugaugagcugauacggaaagaaagaagccuguucgccccucagaaauaauucaacccagcaaaucaugaucaaguaccagcuaugugucuaggcccauggagaagagccucugggagaugaacucaaaccucaacagcucaucacugaagcaggcaggcaggcaggcaggcagccgugaggacagagccaugaagguucugugcaaacuggaaggaucccuguaccguuuacaugcucaccagugguuagccgaacuuugguggcaagucaguugccucuauguagccagauacucccagcuucgugcuaggucuagaaguguuucucugugagcagcuaugugagagagacgcuggggugcccuggaacccuugacaggaggcagggcucucuucaucucuguggagugaaaccuagugugaagggccucaaucaaggccacacccacuccaccuucuuccuuuucuugggcagccaagccuucugacaaacuccauuuuccuggggguuuccuauagggauggaauaagcagcgcccucuagaggcuggggugugugcuacccugcacccaacucacaucagagaccacugagugagggcgauauuuugggaaccaagcaggguuugaugccaccuugagacuguguggcagaaaaguaugugccauccaucaccaagcaccugggagcacagggguugugcugggugcuuugccuuuucuccccugcacacaacccucccuaccccccccacacacacacacacccuccccgcaacacacaccauugagucugccuggagaucagaggguuucaagcaggagacuugcaguguggcugaauugcucuacuagcugugauuagggaaugaccaaacuucuaagucuccuccuuucccugacauuaguuagcauaugauaggaauauuaccaaaauaccgggcuggugucaaacuugaaaaggaaauuucauuuguagugguucuuguuucuagugucgugggcugaguaagacuuggggacacacaacagucuucaggaucacucagauagcaggugcaacgcuggcccagugcgccugaccuuucaacccaaucucuugccccauugggucucuucuuuggucaucuaacagcuuuuguccuccuuucuugacagccccccaccacacccccgaucuuggggaaccuccaaagcagaugagagguuucuuuucuagcccucuugccuggagagcaaagcugccugugcaccaaaccccaggcccuuaucagaacccacugaauagaaguugcugaguugcacuccagugcucuuggcucuaagacguccuguugggcuccuaugugggugacaagaugaugcaugggguuuggcugagcugcuuauuugucugagcuggugacggccuuuauccugaggugaguuaauggcaagggggcuggggccccuuaaggccuggacaauggccuagcaucccaggucaucugaucacucagaggccuggcccuaagucccucccagcacaggaggccucuguccccucugcuucccaucagcuucacucaccagccagaggugcuuccagcccagcaggagaagccuugggauaaagcaucaaagacaacugugauaacaaaggaugcuaggguccugggauaauuugccccagcccaucccgcccauccagcccagggcccacacccagccagcccacacuagauucuagcugcucuuuuugaugcagauuccaguucuaccuuuucuccacacagccagggcccuccagaguccuccccuuccugcuucccugaaccacuuccccagugaaauaaguuccuggccccacuggccuuacuagcugccucaguuacagcagcccucccaacagcuccuucauuagcaucugaauaagauccuauuugaugacugguuugaauauuaggcuuuuuuuuuucaaaauuagaaaacuauugauuaaacuuacagucuguaugcagauuggaagcugagacucgaaccuagccuucucagucuggacuuuccccugauguguuuguucauucacccacucacucauucauccauucauucuacaaagauaucugggauauuuauagagugccagacauugagcuagauccuacccucuaggaggggcuugagcaucauuguccaucaucacuaaggggucaagaagacauacacacacauuacccuauaauauguuaaaauuuuaagguucuaaaguccaauuaaggaggaauuuaggaagauggggaaaaggcaaaugugaaaauaauuauugaccuuggcaucuggcuggcuguuggagaccaugacuggguguuuucagggcacagaggccaaucucacagaagggcagaggacagagggagagcagagacaguuuagauaacagacucuuagagcugguccuguguugcaggcugcuuucuaauuacaaagagaggacggagcccuguauggaacuaauucuagcaaggauccagugcccaaaagagcucgaaggaggagcuggcuggggguaaggccauaaggagcucagggguuccagguugugacucagagguugagugcuugccucgcauaggcaaggcccaggguuccauccagcucugcaagaacaggacaagaagagaaaacaauggaagaauaggacacagaauccacagccgaucacaccacaugugggcucaacaaagaugccaaccggaaagcuagcgagagaacacaucagcccuuccauggugcugggcaggccacagagcaagacgcuggacugugcuuagaaagucgaugccaugacaaaggagaaguguggguauuuggcuagcugugagguaccucuaagaugaagagaaaccaacaaaauacaaccagauuucacccacauuuuggucagaucuuacuacuuuuaagcuguaagagagaauaugggauucuuuagguaugguggaacauugcaggaacauggcuuauuuacaagccugcaacuugcuuucacaaaacuacaagaucuaaauacugcagcagggcaguauauuagccagggccgucuagguaaagaacauagggauguuuugugcugucucgaauuuccucuaggguugagacuuuucagcuaacgguagagguugugcguggguuggagagagacuagaguucaggaacggguucuuugaaacaggugagacagcccuuuuuuguagagaacacccacucgcccaucaccuugucugcugggauaaaggaacucucugaagccuuacagaggauccagagccuaagaguaagaugaaaggagucuggcugggcacagaggggaccucagcaaggcccucagcaaggcgugagagccuguaauagaaaccacauugucagggguguaggcagccccacccaccccgggauuagcuccucucugcugaggcaaggcuggaagaaauuaugugcguucauacuuguuaaacagccuuggcaccagaagugagccccauaacacuagcuuuuacaguggccaggacacaguuaaacccgggucagccccguccccgcacccucucugucagaggucuauggcugcggcauaaaacaguucagcacggguugaaacaugaaaaaccuccagacugcaaaggagaguguucuuuuguaaaguuugcugagggggaaacggguggucauggaaucuuuucugugccuucugcuuucccagucaggccccuagcacacugguuugugccccuccccaccucaagcccagaccacaauccaaucagccucagaagcugcuucguucugcgguugagggugggggagcgguugcuguucgagggaagucuccuuucugaguuggauuccugcagcuguguggccuuggauaaguugauucuccucucugggcuucacccucaauaauauuuagcacauaguugccagcccacacugauauguaguuguuaguuauugagcguucuaugaacacaauauugacuuuuauuuuuuagugugccagaguaugucagaaacagaaauggucaaaguauuuaaguauuuguccagaagaucuugguuuuaucugaaaaguaguccaaaaaaauaaguaugagguuuuccuuguuuguuucuuuguuuguuuguuauuuuguuaguuuuacauugauuuccucauccauguuugcgcaugcguguguauccuauggaugagaaccagguuaugaggcuuggucacaagcauguuuacugacugacugaucucucugguucucaaaguacaauucucaguagaagauaaaucauauggaaaauuucacagagagagagagagagagagagagagagagagagagagucuggcuuucuccuuucaagacauuuugucucgggaaagcaggaaaagcuuugaagagucacaggucuagauucaagcccagcuuuaccacuuacugauggaacggccugaacagaucgguaaacccccgagucucagaagcuuccguugugccacagagcgugacacugucagcccaguaagagagggguggugaccaugagagacucuagcucagacguuugacaaacagagccaccauuagucccaaaucugagagagauugaaaguccccugagagccaggccugucucuccggagugggcaaccgcagggcuaagcacacaggcagagagcuaacauccaaagcucugcccacagccugccaacccugugaugaaaaugagcagggauugcuacucuucuggaggugcugaggugaacccuucaagccccgggggaguugaaggacuugggggacacugagcagaagaagaaacuuccauuugucacuccaaagcaagguggcugccucacaccggcccuagggaaccgauucuccuaagccaacccuaccccugguuuuuuuggaguguaggcuucaggcuccgcaaggagguucagagcacaguggaguuggguguccuguucauuucagcagcaugaggccugagagcuagauggcuugggaacagguuuggcuauugaauccaaagcgugacaaccucagccacuucgcucgguuagcacuucaggcccggcucuccuuuacuacaguucuagaaagucuccggguccucugaaccuccccugccuuaauacuaaagucaccugcucugcuggccucugcgggucaaggcacguggcaacgugaguacguaggagaauaggugugggaagguggucccuaccagcaaguccugguaccacaggcacauuaguaccuuuguauagccagugcccccagaaguuguauguaaacagacacauugugaauaaaauaccuggcaaacaaagugccuacuaccuagaaccuuuuucaaggcugagaaggaaaugggucaguuagcuuuucuggaguuuuugcuuuguuuuguuugugacagggucucacauaccccaggcuggccucaaacuugcuauguagcugaggguggcuuugaacuuccaauccuccugccucuaccuuuagacuggugagauuaccagugugcuugcuccugccaaguucauaggguccuggugcucacgcgcaggguuucaugcuugcugggcaaaacuucuaccaaugggaaccuuauccucagcuccucagacguggcuauucaugauuguaguuuuaauauuauuacggcuccuggauucucgcaucccucaaaccauccuguggccuauccuagcuauccuaucaucagagaucuaaggaaguuuuguaguaagggaaaauauaguuuuggaccugccuugacaguuuccauugcuccagacagaugagaauuuaugaguggcaguuacaugaugucaauuugcugagugugaauuucugcugcuacacggaggaggagcuacgugaggaggacagaugagggugggaaggagacugaguuuguuuccuggcccucugcagguggggucagcauguccaccuagucucugcacuacccaagauaggaaggaguccccugcucacagcuaccccaaaccuucaccauuauaccaggguguccuuucccgcuccgccacgcugcuuccaaaagucaggauacugcuuugggccaucccucaagcuccuggaaaccagccuagaaacuggaauaugaaaucaccaccuuccuucagggccucuccugagccagacugagugaggauugcugcauauuggcagacggaagccaguuuagggcuucucaccugcaauaugcucacuacggauuguugaguucagcucguucuuugaggcuagaacuggaauucuagcuggaugcaauuucuaggccaggaagagagaaucuaaaagacuccucucucccauguucugaaggaaucaauucauacgaugaauggucugguggaacccuaauugcacuccagagaccaccagucuccaagacuuuuaggaguucccuugcaaaggcaggugcuauuguguccagugcugacucuggggccauccagaaaggcuccaguucacugcuuuccccguguguggccacgaagcaguagacacuuucucucccuuaccgaugaccauuguuuuucucgucuguauaaucaggauaauuauucuuauguggggagagaagagaguccuuggcaagagggauucagaaaagaugagcagagcaaaggggacugguaccaaaagcaugggaugagucaacucuuugaagacaggcuaucucauagugccacaaguuugcaccuaggagaggacuguggaaaaucuacccuugcacuaaaggaauaacagcugguagcuuggucuaacaguguccacggugucuccaguguagcuaacugcacucuucugggucuguuuuaaagggccucauccccaaagucucccacuuguagaggaugagaacaaacuacuaacuacaucacacgaguaucacagggaaccagugaagucugugcacaaaagcaugaagccagcacacaguaggagaucagaaaaugcugaagcuuacagaagagaaggcuggauaaagacaggucaggaaugcagucuggguucugucaaaggcagcuccuacccacuucagggacagcuuugugaggugagaaugagucagggcagccuggggagagagucugcucugcauugcaagacaccuaggggugggcuuggaaagcccgucugcccugguucccaugucugcccgccgccuagcaccugcaucuagcaggcuccuuguuggcucccugccagugcuugcaucccugccccccucugcugggaccaagcugccuccaagucacaccugaacccaugucaucaagaccugccuaggacagcccuucccuguuugaacagucuaucuacucccucccucucagccuaacuuggagcugugcaagguaucagcugugauguggaggcccuccugccugucccuccuugcugcccuucaggaccaccuggucccuugcacguguuucccgcuaguaccuuuucuuagagcacgagugcuuucaugugucguucaugguucaucucagcaauuacagagcagaggcucaagugcguuucuaauagcugaagcaaccgaacgacucaaaccccacacuguuugcccaaagccaggcaacuaacaggagacgggccccuaugucaagugccuguuugucucuguaccacucaaguggagagcucuggagacacacuggcguggagugacaugcaacucgaccacuccuaaugcaggauguuuuauucauucucuccguugacaaagugaggcaauuugucaggcucuuuggguaagucuuuggggcacagguccuguggugaagacagcucuuggcuugcacaucgaaaggcuugaguuugcuauuugugguaggccuaggacuagagacaacagcagaaggcagcuguagagauugggguaagugcuuggcuugucagaaagauaaucuccccacaccuggguucuggaaacacaaucuagggcucugggaugcacuuuaaucugucaccaguguguccccacagugaccugcccaagugaauccaagccuguggggcucagauuucaggcccauucucagggcccuugagucccaacaaugccugccuguccucuggaacugcaucucccaagaggaauguuaaugggauggaauaugguggggguggggccuagcugacuuaagucugagccagcggucuagucagucucuugaguuccccuggaagcaucugcuauucuuccauagggucacuuaaacuguccccagaagaagaaccuuucucuucuuuuccugggacagagcaucaacccugcaaugggagagaccuauuuaacuggggcccagucuccaucuugucagggcuuccaguuaaccgaaaggguuucgaaggcaaaaacacugggaacaucaaggguguccaguaacagcaggauaugggcaaaaacacugcuuucuacccaugcagcaguauuuccaggggcuauuuaaaucucagggauuuggucugcuuugguuuuaguagguuuggcuaguugguuuuuuucaaugcugagaauugaguccagggcccuaggcaugccaggcaagcgaucuaccaagcugcaccccagcacuuaaaauucuguauuucauagcaaagguauaaaauuccucuagaagaaacugcguagaaaugggaugcuggacaugaaccuacuuuacuaguuguaugugcauacguauuagaagguccuguagcagaaagaaacguuccuagcuuuuuacaggguacugaggcuaucuaauaggcuuuuguuuuauucuuuguacuuuucuccauacauauugugauaaaaggguccuuagaaaauuaauuucuuagaaagaaauucauuuccccuuuaccaauugacaaccuaaccccugaccuguaagagcugguggccuagcaaaggcacgaaugcauacaagcagauaaugaaaggacuuguuuuguaacaaguggagugacugcacuggcagguugguuaagagcuacugauuguucugggagcucuaaguguguuuacaucuaaucccgccucucugggaagaagguagcuguuaacucccucugcuuauaguuaccacgucuggggcuguggcuguggugaggaucaagggaaagaucgggaaggcuggacacuucuugucgcucagacuguguuaccugggaauucucccaagcaaggaaaucuguuucagagaaugccaugucagagcaaaggagcaggcaugagugcgaauuaacuugccuucccccucacggaggcuggaaagaccaugggugccuucugaaaugagcagucacagguuaaguuuguaugugacucccucaggcagcaagagcccggcauccugggcucggauaugggcaguuccacgguggagagagcaagccugcuucuuagagccagaaacauccaucuuuggagucugaguacugccuggaaaccguuuucucgcccuuugcugggagagaguugcuuuugucauguggagucuggccugggaugggagauggaugugcacagaaauguguuaaccacacacacugugugaacugcauuuaccguacaagucaggccccguuagcccgacaaggugccagaaagccaaggcaacccugcuuuugccaugucugucgucuaccagaugaagaccugcagugcuuggcacaaggcugugcuugcuacagaagagaggaucagaacaggguagucacuuguccaccgcacucucccuccagcucuguccuuccuauucaggcuauucuucaaggaagucaugguaaaucaugagugaguuuuggcugguacauuugcuuuugaauucucccuuuuauuuuugcgucuggguuuucuuguuuuauuuuguuuuguuuuugguuguuguuuuucuucguuuguuuguuuguuuguuugagccguuacuacaaaaugggucaguuuggagaucacugagccuaugccuguuaauccgugcuuaaugccagguuccagaagagauccaaagacacaugagacacagauggggacagcaaggcagaugauucagaggugggaagcgaagagagagagcuaugugcaaauaucugaacauugucacugagggacacuggguaaaauguaucgagaaauucuacacacacacacacacacauauacauacacacacacacacacacacacacacacacacacacacauacacacaccacacaaaaccuuuuggugaaccuaagauuauuuuuacaucaauaaaucuaugcugaaaccuagcaugcguggucauaaacgagaggacagcaggagacaacaguagcccaagaugguuauuauuuugagguguguugggaagcagccucaguaucaggcuggggagccucugcuguauucugggacagugauguugucacagggaaguuguugauuaaaaguggagucagguuuccuuuuagaaagaccacucaguaaucagggcgauggcugcagagaaguuggaauaaucaaaaggaagcaaauaggaggauguguucuaaaugcaccuccugaagagccagcccugcacaguguguucgggugcugcuuggauuaggggcaaacucugggaagaguaaggccaaagagauuucccccugugugacuucucagaggcauugacuuguuagauuaugcucucuauugucucuaagcaggagagaauauaugcaaugcacccccccuuagggagcuacuacugggguacauggacuuaugaaaaggucacccucugaugccauuacuuuuguacuggcugguuugagugucaacuccacacaagcuggaguuaucacagagaaaggagcuucaggugaggaaaugccuccauaagauccagcuauaaggcauuuucucaauuagugaucaagcggggagggcccauugugaguggugccaucucugggcugguagucuuggguucuauaaggaagcaagcugagcaagccagggaaagcaagccaguaaguaacaucccuccauggccucugcaucagcuccugcuuccugaccugcuugagcuccaguccugacuucuguaggugaugaacagcaguguggaaguguaagcugaauaaacccuuuccuccccaacuugcuucuuggucaugauguuuuguccaggaauagaaacccugacuaagacacccaggaucuuguaccauaagcuggcuguguggguagccuuuaggcuccagggaucuucuuguagccacuucuauagcacugggauuauaaccacauaccaccaugcuuggguguuuaugugagaccuggggauggaauucaggugcuuuugcucaaauguugcagauggaacaacuuccccagccccuuauuucauuuguuuguuguuuauuuuuguuugcuuuuuuuuuuuuuuuuuuuuuuuuuuacauuaguacccuccugggaacuucucacaagacuuguauauaguacaacaauacauuucugguauuuguguagcacaaucguucugaaauucugcaaauguaaauaccgucggcucucacugccaaguggagggaggaccaugaacacucugcucuuccuucucccucagaccuccgaggcccaggauuuaggcgcgcccuucaugcacaaagcacucuucugcagguuugugaacaacaguuucggagaugcccugggccacauuuccaaccucauuuuuaaaaaaaaucacaaugaugaaaaauaauuuccgaagaagagaugggguuuugaagggcacuuuaaacggugcuuuucuaauuaagggaucucugcagcugagugaaaauauacagcaguuucuaguucccuugucuccagcuuaggggcuccaucuugagucagacccgcgggcucuaaucagcugggugguaccccucuuccccagcuaccugcucacucccgcacaaugccuccugacaggcaagagcaguggauauugaaaugcucaaguuagugggcacuugcauuuucgugcguugagcuuucuggucuuaccacaucugcuggccuagcauuugcuugauauuaucaaguuagcuaaccucccucaacuucgauuuccugaucuugagaaugagaaagaggaucccugccucagacaaccguguagaauaauaguucgaggcacauagacugcacuauccacuagucucuaagagaugaccgucuuccagggacuagcaagccccauuccccagugccuccaaacugcauaucaagagaacacagguacaucuacacagcugccauuagccuaauaaagcuacucauuaccgaguuaauugcacccuuuaagauuuuuauuuauuuucucucuuucacuuuccuuucaauaaaaauacuuaacuuggcaauaauaauaagcaguaaacaacccuguaaggaagccauuauugcucccaauuuauaaaugaggaaaacagggcucagagugaagcuauauuaagaccucguauuuucuggcucccaaguucauuuucuugagauugcaccaggaaugacaagauccucaugucacccacacuccaacuuaacuaacaguugugggcaugugcagggcgccagacauuaagacacauuccagcccuccaggaacucaccuccuagcugaaggagaugaacugcccacaugaaacuugcaaggcagcccuauaacaccucauuugucccucacuggcgaaugagcuguuagguuaaguggauuuuacagauggaaucacagaacuuuaacucagaggagccuuagagauagcaccggaugcacaacuucacugucucaagggagcaagcgaugccuucaggccacugggugacugguucagagggucuguccaaccacagucgauuuuagacgagaauucagcuccuauaacucccuggacaggauuuuaaaaacauauuaacaauuuucuugaggcauguauuucuuuggaacguggaaguaugaacuucuuugccagagggaugguuccuaucuaaaccuauuugcacauguguuaguguaugugucagacucuauguuagugcaccgugcaaggacacagcgaugccucugaacuuucugaagaagguauggaagucuguccuguguguuucuguggaccagauaucugccucuugcccaagcuccuuagcucuuguucugcauucaguaucauuuuucuguuuuuuuccuauacacacacacacaccaccaccaccaccaccaacaacaacaacaacaucaacaacaacacacacacauacuagacauacacaccacacacauacacaucacacacacacacauauaccacacacaguuacuccauacacacauacacccacacacgcacacacacacacaaaguggaacaaagcaugcuaacuauguaauuaaacacauuugcuuggcucauuagcuucaaacaaaguaucuuauuuuucugaguccauuccucaccuguaaagugggcagaguacaacagcucuacucacagagcagaggcccagggaguuaaaagguuccuagggcuuaauagauguuuaguucccaccuuccccuuccugcuuuccaaggggucaagaaacucuucaaagucacguguuuccucacucacaaagugcacacagauacacaaacaaaaccagaauaacacaauccccucuacacuguaaaucaaaaguuucuugccccccccccccacccccugccacaaaccaaagcaaaauaauccacauggaauaugucugguuucuuccucccaagagaauuaaagcaggcuuuaacacaaagcauaauucauaucaucuccugaucuugggccguagcaccucaugaaaacuauuaacacaucucccaccgccuacuuuaugaacucauauaaaagcagaucaggugagcgcucucaagguaguggcuggaucccugaaguaugugaaaucugaccucaugugaggcaguugugugcuagucacucugggaaguaggcagagcucaugggaugugccggagcgguccccacugcaccaaagacucacucacagcaugaguggagaggagccccuaguucuucuaguucaacccccaaaugguaaagaaauuauggaauggguaaaagggucuggguagaaguccccgaugggacuuugugcugaggguccuccagcggugucccucuguuuguucccuuuuccagggcuggauucaccaugaggaccagugcuuccgucacuggcaaaaguccugcccugugccaugucguaguuaagacgguccuuuuauuacuuuuagaaguaguuuucagagacauaagggaggucuaaucuuuacugugccugcugcuaggagcccgaugagcagaucucccuuuccuaugaagggauuauaaacuccagccugcagucgguagauggaaauagauugaguaaggucccugaccucuucccaagcacagccagggugaggggaacucacauuugugucucuucuggucacagauaggugcuccuacccugaacuacaggaacagaggucuggguacccuggaccagacccagaagugucccugacacuucagaagccagcugggguuaucacccucugcauccuugcuuccucaguagcuccuuggucucccugcugccucuaagacuuaaaucgaaugaauccacagcaacacucuuuggguguugcaaaaucucaucugccuuuaccagggucgagaguuuggagaguauucgcaugucuugccuggggcuugaauaaaaguaacaaggagcacaggccaacaaagaaagcaaaugugggcagccaaccuuguaaccucagcuaaucuuuaauugugccuuaauugaaggcuaugaaguagauacaggaagaggaauaauaauauguugagucuauucagcauguuaacccccccaaaccuauauuauaauaguaauugcugaugcuuuacugcaccccaccuagguacagggacuggguaacuucuuuguaauaucuuucuuuucuuucucccucugcuucugaggagaguaggguccuuucaaucagaaaaggaaaacaagucucacuuguccagaggagaagcacugagcagcccccacucccagagucaggcuccgccguggcccacugcagccccgauuuauacgaguacugccugcagcaggcacuugugcccugagauugguugccaacuuccuuaugcucuagucuucgcaggacaccccacucaccucuuuaggacauucaauggcaacuguauugaaacccaagcccagugacuuugugauguuugucguaccaucucccuugugcaaaagaggaaacuaggauguagaagauuucuagacuuagcuuggucagccagucccccagugaggcagcugggcauuggugauauuuauucugccauuuucuuagaacacauccgggauucugccccccacccgcgugugcgagccccccccccccacuagccugucauugccaaaccuggccugaugagcuucauggucauguggaacuggccuaagaccucccagagcuggagccuccacaacucaggagaguguuuuucuugguccauuugcuuuguagguuguucauuucacuuugccacaauuguggguuuuguuaaguucaagcaguuggguuggccaucuccaugucuguuaaguucaucugauuagcucuucuuccaagugccaggcagucuacuaggugucagcauuacuccagaauuuuugucauaaccauagaggcagacugaccuugaacuucugauccuccugccuccaccucucaaguaaagagauuacaggugagcgccauuacacagugccuggaaugaaacucaggacuuccugcauuccuggugaacacuuucaacuuaaccacaucccuagcuccuaacaucauuucuagcugaagugcaggggucuuguuaaccugcuuagggucacauagcuaaucgggagcgucugguuuaagaagcaaaacuuucccauugcaaaugaugaugacuuuaccccuuuagcagcaucaggacccgaagcuagucaccacacacugaugggggacaauaacccuaacucccuggguguuuugucaagauuaaauaagaugacauuuugccaaaagccuguggauacuggcaaaugccuuuucuuuccuugaggucuccacggccaguacuucucacuagauacaucugaugcaagugcaggcaucguucccccgcugcaucucuuuuauauuauuucauaguggagaaaggcagagcucuaggcugugugcuuuaaaaugggacagcccagcucacacauagucacuuccuacagcaccucccuccaaggcuuuggguguccuuugucaugcagcagugcugcuggugguauucaguguuagcaugccuuuuaaaaaggcuggcuuugggcuagggacaugcuuuaucugguaaaaaugcuugcugcauaaauaggaggacuugaauuaagauuccagcaauaacauaaaagcuggacuuggugaugugucaugccuguaaucccagcaccuggcaggaaaggaagaaauaggcuugcuggggcuuccuguccagccaguccggcuaaucagugcaguucagggagagauccugucuugaauaauaaggaaaauccauagaagaagacaccugauaucaucagccucuggccuccaaacaugcauuauggacaugggcagucauaguguguguguguguguguguguguguguguguguguguguguguguguguuuacacaguaaaagagagauaaugaggaaucuugcagacuauacuuggaaggugcgggcagagugcuaaucaccguguacuguguaaccuuccuugugauuggugggcagagagaacccauauaacacuccagcacuuugagagcuucuggguaagugcccugaccucccuaaaagggagcaugaaugggcucugggaggauugcuagcagccaucacaaggaugaagugaaauuucaaauuacauuagcuguuugcuuaaggaacaacagaugaggcccuguggauucuuaaauccuguuggcagugcagcagaaggaaaguacaaccauuuggaaccuuccccuggacccuaugcagucugggcugcaaagaugaccuuuuaaugacagcauccugccuccaaacggucagaguguggcaaauuguuugcuaggggccugguuuuaaucauugcuucaaucagaagaaagggcucagauccacaucauucuagggugggguguucuucuagcuaggugucagggugauauuuaucacauuugagaguuuuugguuuuguuuuguuuguuuguuuguuuguuuguuugaggacccacaguggcccaugaacagaauuucaucuucugaaggauucuugcacuagacucagagaccugaagucauugucaaaaauacacauacccaaaagaaaaauaacucuuagcucuguguaaaagaaaggacaagugucucaaagcacauaucuaugaaugcuaagaucaaccugaaagccacugcccucauuauaugacagcugacuaguugcagggaaagauauuuguuggagccacacauagguuuuaaauaaaguaaugucaucaaagcagcuuccagaaguuugaucaauuaguuucuuucucauuuaagaaucuuaacuaucauuucaccauauuaaaacuauacgauguauaccuauaauaaauguguucaucguaucaauaugaaaaaguaggcagaguauagaaauuaacugaugucacaagcuuuguguuuguuuauuuuaaauauuaauguuguuugcuuuugaaauuuuuguuuguguguauaugugaguaucuuuguguaugugcacauguguaugcagguauggaggcuagaagacacugucagaguuggagguauuugugaacugccaaauuugggugcugggauuugaacucugguccucaugguuaagcaguaggagauuaaacaggauacuagauucucacaucauaggcaguccuagaacuuccuuccugggcauugccagcucagcgggcucuucucuaguucuggaagcaaaucccucucuauaaggcucuccucauaaaauugaaauccacucaggacagaggcucauagcuguuccacuuugucuaaguuuaauccugugagcagcccacaaauguacuuguguuccccaguucauaaucaaaauuuaauuagaagaaccuuugcugguaaaauagauggcagagaagccuuuguuuucaauguuugguggcuuuuuaaaaagcacuuuuuuuguacccaaaugacaaagucuggggguagugaacuuuugacauaaggaaaauaaauccuucaaaagaaaaucuacggccacuugaggcuuggccucgccccagcaggaauuuaggaacaguuauaacuggaccccccuuaccagcucccucauggguccaaauccuuggcuuaaugcuugcauuuccauaauaaaagccaccaucucucauuucaucacuaacuucccaggaacccuuuaaagacccaggcagcgccauuguaggaggauuucccuggguccuucucugcccucccucuuguccccucugaaccuguggguuuuuccaagggagagauuaaagcaguagcaaggagcuguuuaauuaaacucucccccucccgucuccaaaguugcuggagacuuuuuuuuuuuuuugacuucuccuuggcaaugccuaaucacuguaauuuagcagauucuguaauuacucaccacacacggaagcaguuugauggcuguuucuuuguccugccuauuccaaccucaacugacagcugaguucacccugugaaugucuaaaacagccuggugggaggcagugaggugcaaauucgccagugagcuuugaaagagucuggguuauaaguaaaagggcuaaaggcauggacuagcccuuugugcagauccuaggagggugguuaguacuugcugaauuuuuguaucuguacauuuagaauaaaagucuacuugcaggacaguugagagcaaaggggaagaaacguggcccuggcuguggggcacccagggcccacuccaccauguucuugccugaaccugagaccuacagcgaaggaagcccacuccagccucagaugcucagucuccauuguacaccugagcaaagagggaccagacgggcucugacaauugcuuggggauccaguucuaugucaagaccgacucuugcuaggauucuguccugugcagaaggccucuccuuagccccuaccuaguuaugacauaauuauaggcuagacuuaauaccauuaauugugaaggaaaggauauucgaaaaguuaugcaauauaugcagucacacagccaggaaaugggaaacgugaucuuucauacauggacgugauugcaaagcuacauuuguaaccuccacacuuguggcuucuaaaauauaguucuuuucugguuuucuuucuauuguacuuuuaaaaacaaauagguuguuuuuguauaguauauucugaugaugguuuucccucccucagcucuucccagauccucugcacuucaccuauccaaggccacacccuuucuuucucuuucucauuagaauacaaacgggcaucuaaaaaauaagauaaaauaaaaacaaacaaaccagaauaggacaaacacaauaaacaaacagacaacagaaaugagacaaagaaaaagcacaagaaacacacccggauacugaaacccacacauccauacacagagaaaacauguaaaacuuaaaucagaaaccauaauauauaagcaaaagauauauaaggggggaagccuaaauaaagcauugugagaugaaaauaaauuaauuccuccaaaaauaccauugaguuuguuuuguguuggucaucuaucucugggcauggccugcccuugagugugauuuguauaccuagggagacucugcuggagaaauaaguuuuccuuucugggugguuaucaauuggaaauagauucuggguuagggaugggucuugugccuucuucuccucucagcacugggaccuuaucuggcuuagaccugugcaggcccuguguguacugccacagucucuaugaguuuagaagcugcagaauaguacauuaagaaagaccauggccccacgccuucugcuuacaggggcaaccuggagcagaguagccaugaugaugguagcuuuggaaaaaguagugacacccuucacccugcaaggggaaucuguguauggauggaaggaccaaugggagaugggagacugggauuuggaggcucccuuauagaagaccuggggacauuggaaaaacagacuuagaagaggcauguccuucugccaucaggagguuggaaugggagccuuacagucuccaggggauuguagcagauagauggauggaaaggggcagugaguaugguauucuuggcacucuuuucuccuucccaacacugccccaucaccuccuaaaccauggucuaacccaggugaaaugucccagcauuugggaggcagagguaggaaaaucauaaguucaagaucaucuugagcuauacaaguucaagguuagccuggauuacaggugaccuucucaaaagaaagaaaucuauggcccuaaaaaauacuaccagcacugccuaguaaggaagccaaguccaguugguaauaucuccaacuccaggggguaauaaugacccuucaaaugagaaaggaauugccuucccugugccaggcaagcuuuucagaugaacagagaccauauauggagcagcugacacagugaugaggaucugagauagaagcacccccuguagcucuccaguagccauccuuaucacaccuacaaggagacuccucacaggcuguuggcccccuggauggaugauaaccaccuaagcaaaugguccacccugacugaugucaggaccuaccaugcuccccauccagagcuugcugaaggagcacacuuguugccacugagcaucagagaagcccagggcuucuaagaaagaccuacaagagacacacuuaaagcaggucuccagcugaaagcgcugcccaggcugaguccucauuccuuaccuugauaucuguauaaacugugcaucuucaacuaugcucuuacuuuucgcccgauuucuguucuuuuaaauugauuaucuuuuaucucuuacaguguauaugaaacaaaugcacuuugcuuguuuuauauuuuaaaaaaaagagacucuuguccgagauggauaggugauaucuaugccugcucaggugccaucuuuguaguagaaucugcacuuugacaugucuccuggucugaaggacaccauuagugagggugacagagaucuugcacacaucauguacauuuucaaagcaaagagcccuuuaacuuaacaggagcacaugagugccagucauguacaugucugggacaugagcagccagccucugcguggaugggacacccaucccuccucgguuuggagugaaagcuccuauaacagaaaccccaggcucauucagccuucuauucuaaccucauuccuucaggagggcuuuaauuuugaucuguuucaacuuuucucccguugccacguuuugcggaucuuaucauauuccccggugcccgccugauugccuaugguagaagaccgcggaagugguggcagggaggcaaccacuuuccuuacagauguuguuuguuuuuuucuaauauaaagguaauacaucaccaguucuuuccuucaaaacuaaauggggaauaaauugccauucaauccguguagacaaagcaaauagagcacuaaaaaaagggggcacgggacagcgaggaaauggcuucaacauuaaaucaauccccauucuggucgccgcaaugcacauaagcagauaauucaucagaaacaagcuccggucccacagcgaaauaauccacuguugucgagggaauuucagcauccugcucccacguggacggcaggccaguuacucacuaaauaucagugcacggugagcaaggaugacuuuaaugguaagaagugaaccaaggcuucuggugacugucagggcuuuacaagaagcaucaaaaacggacaaaguuacacaggcuuuacgcuuuggucuuccagccuguggaaugaccuccugccaggccccuuagaccuucaaacucacaucauagauggguuccacgugaucucccaaucacucguguucacugcaggauuagaaaguguuauguucaucuguaaaccgccacccuacaccucuguuugugugagugguucucaaccuuccuaauacugcgacauuuuaauacagguccucauguugugguaacccccaaccauuaaacuauuuuuguugcuacuuuauaauacuaauuuuucugcuguuaugaaucauaauuuuaauaucuguucuuucugguaguuuuaggugacuccugugaaaaggcccuucaauacccaugaggggggucacgacccacagguuaagaaccacgggcucagcgugucugugacguagcaugacaccugguguugaagugcaaguucucuaacuuagaacagcuuuuuccuugugguuauuuguaaaugaaagugaacuguacccaaaacuuuagaaguuacauuucuaucaaaggcuuccaaugacaaagaaaagcccuugacucagccccccucccugggccucuuuccacaggagcugucaauuuuggcccccaucuuuguagucugugccaucuaccuguguagguuucucaguugccugcuucuguugcuguuucuucauuuaucagcuauaaacauuuuucguugauuuuuguauaagggaggauucccacaccaccuggucccuugcuguucuucuucccacaaugccucauaauuaguauaaucagcuuugguuaaauaaacagucacugguuacgugauugugauuaugugguacauggaauuuuugguucugguuuucauuuuuuuuuccuucuaagccaagcagcaggcuauugcuugugcgcaccuucauuuuucuuugaguuacuaauuucaguucuuucugagaaauucccauggccucagugugaccaggacagggugcuuaaugcaagggauuggugacagaugagacugugaaaagaaccaaaucuuaauggaccuugaaugucaggcagagaggccugcacuuaaaggugauaaggucccagggaaaggcuucaggcagggacaugccuuucuggaacauuccuuuaauagcuuuguacaaguaccauaugggaacucucaaagugacaggaaaguguugugagagcaucugcaguguaaccaugucuccagcacaacugcugccaucuuuaagaaacacccacacugguggggggugggggagguaugucuguugagcugcuaacaggccccaucuaucucccuguaccggccuuauguacggcucauagggugaagauccuaucugaguaugcuaucuggucacaaagcaguucauagaacaagcaaaaggaaaacaguuuuucccuccucccauccacucuaauuuuuuuuaaaguaaaaauaacucaaguaugaguggugugaguuuguucauugcccaucaccaaugaauuagaacugauucucuauccuaaaauuuaacucauaauugaaaccauacauuuucauugcuacuuuuuuuuuuuuugaggaagauuggacaguuucaagagacugaaguuaaaauauagaguaagaauucagauuuggaaaguuacacaaauagaaauggaaaacuaggauugguacugguaguggaagugacuuuucuguugagccagcagcucacuacguaacucagucuggccuugaacuugagauguugcagcugcuccccucccaagugcuaggaucacaagcaugcaccacugcaugugccaccacuguuaguuuuuuugcaaaauuuggcccuagcuagcucagacuauuccacaaacuuugcaguuggcguucauuaggaagcaagcccuacuguaguaagugauuggggaagauccagauuuccaaaggagcaggccucugacuuccucuacaaugugagcaugacuuaauugguuuuucuagucuuuagguuccauugauauaguuauauguuguguuuuguggaaagaacagaguuuuauuuuaucauaaagauuucugccgccuucccuguaguugggaaaguuagcucauuaccagcuuaucaccaggggauucaguggcagcagcuauccacuggguucagacacugucaccaucccaguaccuucaaugacacagucccugccaugcaccgagcacuguccaagcaucgucucagaauagcuucccuuggucuccaaugcugucuuauaaaaugugauuacucacccucauuguccagucagugagagaaaaugaggcuugccagagcuguaauguaaguagguggcaagcuggaguucaaaugaagugaagcccacguugucagcucagagacuuuuagcuguaaccagcagcagcagcaccaaguuuugaggcauguuauauuaugucaaaggaggccgggagauuggguagguugaggguuaguugcuuaaguaagagaugaaauugugaagggaccaggcacucuccauugcuuguuuccccuuguagcuggaagauggcuauuaguaacaguauagcccauuuaaugaugaacaaagacuggcuucauaucuauugauuuaaaaaaacaaacaaacaaaaaaaaaaaaacaaccaaacaaccaaccaaacaacaacaacaacaacaaaaaccaaaggguaucuucaagaagccaucuuugagucucuuuguuccaaacuaggucacaugcucauuucuguaccauucauugacccaggagauggagucaccuugcucucucucaaacauugucagccguggccauacccccaacagucuuacuccucucugucaaauggaaggaugggagucagauggcaaagucuucuuuccgcauccagaacugcccacauaauucauuugguccagcguacauuggaaguguagggccccuaaucaaaacuuauuuggcaaauuucaagaugaugacagcauauggaaucaagaaugagacccucugauuggacagcucuugagugacuguaaagaagacacacuggccuuaaccacuugcuucuugcuucaccauguuugauugguaacccugugccuacucugugauuuguucagugcccggcagaccacaggugccagggggaaggagaggagacacagguguagcugaacuguugucuccagucuucuccagucuggggaaaugguggcuaggaugguggacacuggugaccucuucccaauucugagaacaguccugaaacaucccaccucucuugugagccuccuagugaaaucuuuguauuuugagcuuggaacguuuuauuuauuuucuuauguuggucuuuggggcuauaaugcccacugaaauaugucauacuuucgggacaaugcuccucuggauugcaaagguggccagggugucuacacuugucaccugcauuuacuucucaucugcguucaccaucugagguggugacuggccuuucgaagggauguucagaaaugucagccacaccgucgguguucuuuuccaacuugggaaagugguccucaauauguugguaaugauugcagugguuuuugucucacacugagaacuauguggacucuagggagagccagagauuuaaagaaauguuuugacaagaugaccuaguuggagacacugggcaaaaacacaggaagaguuaaguaacaagcccugucaccauaaagacaucaggagggcagugcuuaauuaaauuaauugccucugaguggugcaaaccacauucccucuauuuucugcuugccugccucugcucacacugucccugcguauuauccauugucccuaucauuuagcuguguccaucuucaagaccucuagggacugucucugaggccuugaacaaaguguccugcagugugcuugcugcaagcugccaucugcuagugguuuguugcuucucuuagguccucucuucaaaucugacaagagccuaucaguccauuccagcccaaucgcacuggacaugcacccagggucuuacugauuuccaugcugucugcaguuauggcucauagcccgaaaccugaccugugagagaaccuuggcaccugaacggccucucucucuacuccuguuuccuggccuuguacauaauaggugcuagugucugacuggccucugccuugagaaaaugggaaagaacuaugacuuuggagggucccagaguucccaugauccucgggaagucugagaucccagcugaaagaugcagcucucggacuggagaaaggccagaagaguggugugagcuguuagccucacaccaggcuccccagagcugcugccucucuucuugccuuggccuuccaccuacaauuaccagucuuccccaucagucugcugggacaacacaguuccccugggagucugccugcaaugcuuuuccugcacugacuacagcccagcacagaugagcucagacaaggcaaauauggagggccagggaagagugucuguaauuauagcgcagaccucaagugugugcgaaggaggcgggcagacaaucuucacagaggcuuugacauuuagaaaucuuccucagugccacauuugaguccuugagagggaggaacagagauguuauuucugaaguuccuucaggcaggcgcaguucccaugguuuggacaugauugcuccucuauggccuucccugcccagaccucagguccugccuauccagaugcaggacagaccugggcaucuggaccaucccucucuaguccucugaauacaaggcugcaaguggugaccauugcguuuugugucagacuucacaaaacuggcuguccccagcuucagugggucgccccagagaggacauacuuagugcuggguuugaaucuacuuccuccuggguagccugcagcuugccauucauuucugcaagcaugaguuuccuccugugugaaauaggaugaauggcuuuagaucuucacagugcaaugauguggaauggaaaacuucaauguaaaguuuuaaccaccaugcuugccuggcacacaggagacucagugcucgcucaugagaaagggggauagcaccaagagguguucccugggugaccugacccaaagaaggauucugagcacauacacagaucccaacaucuuuuuuguauuuggaaggccucugccugauuugcaugggcaguuaagagaauggagacauaaaaaggguuuuggucauauuuuauuugaugucuuccuuucuggggcgaugccuaauguguaucagcuggcugcguuugccuaauuuuagucauuagauuaaggagggaugagguaguuuguccuuggggauuaaaaaaaaaaucgaugggaguaagugugauuaguuacagugugccugaguuauacagcaggagcugaggauguacaaaaagugcagaauuccagcgaggaugggagaggggcucagaaggacccacccucagcuagaggguuguuacaggcagugauggcagcugcgagagggagagucauuuuucuuuggggauguggccacuguuguugccuguucacuaguggauggcuccacacccaugcacuuuugggcaccacugauuaaacucaauggguuauaaaagugacagcugaagcugaaguugggaaagcaggaggaauuggaagagaggagugggggguguggagaagauugaaauacauugugcacacguaugaaaguaucagaguaaauaacaaauauuacauuaaaaaaaaaaagcacagaucaugucaccaugacccacacacuguccugcccugucuccaagccccaaagcacagcuguucugguucugcacugguccugcccuggccacuuagaaggagacacccuauccuuacuugguauccgcaggucauuacaggacauuugcuuugugaaguggaaauggacauacuuuauuguaaggaccacaugcgcaugaaauuggcuuaaauguuaaugaagucugagacuguucauuguuccuguucacuuguucacacgccauuuguaucuacuauguggcaagugucagacggggcacaaguggcaugacggugaaugggagcuaucucaggggacccucaaaccuauaaggggcuuuccuggauacaggaguuaguguguagcuguguaagggcaggcacuugugacuucaggaccauggucacaacgcacgauugaccuucaaaagauagagcugagucuaucugcaggaugcggaagggcaugggugugucauuucaguaucagaagugaguuucaaccucaggaaaugaggagggaaucugggaaagacacuagggucacacacccaagccagaaggaugagggugcucacuggcugccuuauuccaccagauucacuggucaccaguagggauaggaugcugcaguccagaaguuaccuaaagggaaagaaauggcagauaagcaaagacgcuaugcaguagacacuugaggggcaaaggcauggugagaagacauagucucacucaaguaaauucucccugauuugcagauggacagcauuucucccauucccccucagacgagcuaggcacuuaaagauaacccacaccaaccucuggaccuuacaaaccacaucugcccagccaccguguuaugagcaaugucuacuguugcaaaaggccccacccaacgugcagccaucauccuacacagcacuguuagggcuucugaguagcagugaugaaguuaccccauugcaugcugggugaugugcauugacagucaaggcaugggguaugagcaucaaaaacacagacuacaaggcuggacaccuaaguuuagauccugucucagccagcaaaccuggcuuugggcaaccuacaaaaucuucucuguuuuuguuucuucugcuacaaaaugggacucuaagacauagucaccccacaggguuguuacacagauuggaguaacauguacagaucaguuacuugucucauugcuaagacaaugcaaccugaggaaagauuuauuuuggaucaugguuucaagaggaguaucagucccucauggcagggaagcauccgucaguggcaaaagcagccugggacuuguucagccuuuaucaaaucagaaaguggggaguucuggccucugcagaaccagaaauuaaggccagccccuaaaaauacauuuucguacuuuugcuaaauaauuccaaagaaucuuccaccuuccaaaaugguacugccagccgaguaccaagaauucaagcuugucccacuagagucucuguucccccugaaacaugaacacagucuugacuauccacaacuuauacugguguuuugcucuucugaaccccaaugcaauggcucauuaagcucugcacacagcauucuccggcuucuuuagccuacaguuccuaacgcuaaaggucuaaaagcugugugaucaguuuccccacagugacuccaccccaaguacuaauuuucuaccuuaguuacuuuucuuguugcuaugauaauauacuugacagaaacaacuggaggagggggauugauuuugcugacaguuucaaaggguaucaauccuuuauugcauugauggcacggcuucuggaguggauuauguccucgcccauaggaccuuaugguaugacuuguuuacaucuugguagauuaggaagcagaggcuuaaacuugagccagaaagagauagcacuuucaaagugcgcccacaaugacccacuucuacugaggucacugucccaaagaucucaccuccuucaacagcugagccucccucacaacagcugagccucccucacaguaaggcuacaggagaacaguucacauucaacccuaaccauaugcacagagcaaaggaagcagccagauuaaaugcuuccaucuuucucuucuucucaaaaccaaaagaaaacauacagaacggcauucaggugugagucuagguugaggaacacgccucaaguccacguggggcccugacuucucaggaugccaggccuggauagccacgcugucuccucagcggcugucuugguguugguugcaaauguugacaagaggcauuuuucuaggccaccuugggcggcauaaauuaggcagagcucugaucacuguggcgaugaauauaacuguuugauuaaggugcugugccggcugcguuauuuguuucgcaaaccucagcugagcugauuggauuucuuucucuuccgauuuuuaacauaaguagauuuugaaauuggagaaauaaaauauuccacagccaaaaggaaagaauccucuuggggaaugagcccaggugcacacuuucugaaucaaaaucggguuagcagaaucagugaccuugcugauucggggaaacagggacucaaaaaagaccugugauguggccagucuggagagagagagagagagagagagagagagagagagagagagagagcugcuggauacagagucaugguacucacaugcccugagacccuacucuggguccucauuccuuuuuagccaaucugucaccuuggaugccguggcuaucaaagggcaaagaccuggcaucacuucccggagcuguguguaccagagcgcagcacugaagagaccacucucaaauacaagugaaaacaaugccauuuacaggguccccucccaccugccaggggaagggaacaggaacgguaagugugggaggaguauccuugcccucgccaggacaggcaggugaaacuaaaggcgugugcaguccugccugugcacugaguagcaauggagcaagagcacacuucucccgugugugccucagucucucccucuggaauguaaugauaaauauaguuaaaacuggcgggcagaugugaugggucaugcacucauuuuccuagcuuucugugaacgcugcccccugggacuuaguauuuccauguuucacaucaggaagaugccacaagaugagcucggucacuuguguggguucacagcuauuucuguccugggccagccuccuaacacacagcucuguguuccuccugcugccuuaaaggcacuggauaccaauggugcuugacagugcccuaccuuuugauacuuugaggccguuauugguauuagugauacauuucugugaccugggggcagaauuguacacuuugcagaaggcuacaagaggacaagaauguuuccuguuuccgguaugacuggccuucuggacacuaauaccugcccacaauauccugaacaaguaucagaaagcaagcccacacaugauguguagugaaucauaaaaaguaccucucuggccuggguaacuagcugaaugcuuuuggccuuuucucccagguauguuggguccuaaaggagaaaggugucuaccacgugagcaggaugccaccagacuugauuggguuggaugguugggccucaagguuucgcaucuagcuguguaaagacuggggugguuccugggucggccucugaacccaggcuugaagagucucugucuaugggcuuugacaacugguuaaacuacagaaccaugcagggcuccagguucccagucuuuaaagcaaaaauaaugucuguuucuuggugguguucuuguuaggacuguuccuuugggggaggcccacggcaucacgggcuucagcacuggagugcugauggcaacugucaggagguaggaggguuuuugguacuccaggcagugugauccucucuuuacacuugacccgauauucuccaaacugcacaggggacacagcugguaacugagguggcuguaaacacuuuauguuuucacaagcagcuggagacaguaugaaaaagaaauaaagacaugguucucagagcuccugcaggcaacagccuguguuguagaaacagaccuuagugcugaaggucagggcaguuuaucaggucauguuuccgaauucucuucacccagagagcacccucaagaggaaaauucacaucugucauguucccuucucucccuccccuuuacuuccaucaguaaauucugaagaaauggcuuuaucugugauaaacucuggcacacccaagcgauagcaacaggcugguuaaaaggaugugagauccuagggcaggcucgugcgguacaugagcaccaugguuagggcugaacagccuuggguucaaaccuccuccccccuccuacauacugggcacuucaaaaaccuuuugugggccuccuuccucccauuaaacugugugcucaugugcucugagaauaugucaaugacuuagagaauuaugguggcuugaagaaccugaaggaagagccucuaccucaaacuagggagagggcaucacagagggcuuccuggaguagacagcuucuaauuagagucagccuggugaugaagggaauauggccauccaaucagaauagcauuugcaaagcuguaacugacacagcuuugugaggcaucuaagauggucuugcccuugccaucuuucauggagaggguggagaguguggguacuauccugcagugauggagcucaggcugcagggugagggcuucuauccaggggucaguggagucacccacagacuugaaagcagguaaucgcaugacccaguuugcugguuuuuuuuuaaacaaacagauuuauucauuuauuuauuuuauguaaguacauuguagcugucuucagacacuccagaagagggagucagaucaccuuacggaugguugugagccaccaugugguugcugggauuugaacuccggaccuucagaagagcagccgggugcucuuacccacugagccaucucgccagccccguuugcugguucuuaagcuggacugcuguugacuucaacuuccuggacugguccugacuuaucugucaaaugcuccacggagacaauccacuccucuauugagggaagcagggcugcucauccugacaucuucuuucuaggacauucugugagaggagcaaggggaagccucuaggaaucagacuaucaaagccuggcagagucuaacuaccucuguugaauggagcaaucgcauuuuccucauagacaaauuaaggcccguccaaagucaugaaugaguuagucgcuuaaaagggaaguucuucagucuagagcuccgcuacaggggcuguaauugggcauuuaacuuccuggcagguagacuugguggacauaagccacggggcuuggaaagcuaguccuaagcucuuggcaggcuccuacacacacacacacacacacacacacacacacacacacacacacacuuucuuaaaacccucucauuuucaggcugauaggagggaucccccuucuguccccaugggacccucccaaucucaggaagccagggaaccaguaaauagcccgggggggggggucacccuccaaugucugagaugaccccucuucugugaacuuccacuagccacgccacgccuaucaaccccggcugacaguugcuugugcucauuuguagugcuuuuaugcacucuauggaauauguaucuguuccaagacaucauacuccugcugaacacacacacacacacacacacacacacacgcaaucacuccugucuuaccauaucaacuauggcccuuuguugauuuaggccuugaccugacuguuuaugggucagaccauuuuugaaaaggcuauggaggugagagugacaggaaggaaagcucacuugacagccacaaaguucucccagaacaaauuccgcccugagguagacauagauuuaaaggaaugcauacacccagaaaugaugcccccccgcccaccguccccguccccgccaccaccaaugcuucuggcuuuagcuggccuuuuucaacaagucuauuacaacuuuacagcagaaagccugucuaacccaccucuguccccagcaucaguacuuagguccugagggaagcuugcaggagacguggaagcaggaagaagggaaggagggagcaggcuauguuucucuuuuauuuauuuauuuauuuauuuauuuauuuauuuauuuuuuuugguauccagccauacaguacaucccacacacagcaugcugggaguaucuuuugcaaccagaugccaaugagcaaacaucucagguucagucuugcauccuagaauuagagacgucucccucuacuuccuuuuuuuuaucaguccaagaaauugguacauuaggugccuuacucaaggucacagagccauuuagcugcugacagggacaaaagucauguauagguggguauuuacugaacgauaguuaccccauucagaugggagucuaccaaccuagccacacuuagaaaacauggguugugacgaccuuagcuuagcuugucaauuacuagcacucuggggguagagaacauugcuaauugugugucucuuuaucugauggucuugggacacugcuugcuuagagagagcagggucuuccacccuaccccauccugaguccugauccagcaggguauccauugcuggacaggaacugcagguccauuuaauggccugaggcuuuuacuucguuauuauuacuaccauugacuuuaaaaauauggaagucagagugauuccucugaacaccaguaaaaccaccaccagacuccagauuuuucuuuuugugaccacucacuagaauucugcuccaggcauucagguccccacaccaucuuggcuguuuugagccacaggcuuugcucacagcagccgcuggccugaauauccugugccucccuguugaccacauugggcagaagcacccaauuccagcccuuguucuuccucgaaguuuccuagacaacugcaucugcaugcuugguaaccuggagaaacguggggaccacgacgugagugcacugcacuggacugagcagaggcaucuucccucagucagcuuuccucugugucaagcauucuagugaccucacagugagccaaaccuauugaaagucagcucaggggcaggacauucucaggcaugcagucagagacagagaaugaucugcaaccaagaguggaacaaacaggaaaaucauacaguagcugucuacccgacuucugccacuguggggcaugcuucugggacaaaccauacgcauuugccagcuucccuggcuguguccugccagcacagcuaccaggacucugggaaacaccccuuccucauuucuagcccccuaagagggaagcacugugccauacaguggggcuuugacauguacugcccugcuguucuaaccuguaaugcacccauugucauagucuggguguuuccucugccucacauaaaugagagagcgaagcaaccaucuugcaaccugaaggcucuguguuccucccagcaugaaaaguucugcaggggcuaccccacccccagguccuucccucucccuauguucaacuagugugucagacaaaauaccauugagaauuccuguacacuggccauuaagggacgccagugaaagugaacaacagacauugcauacagggagaaagugaaugaacagaaaacauacccaagagcggcccuucacccucugcucacaccacggcuugcuuuuagauuggaauccauucuagauagaaacgugauacuaaugauagcucucucuaacuguagcacgggacuuugcaguuugccagcuacuaccguguaccucugacaggugacaaaguuaaaacucaagucaaauaaauuguccgugacaccacagcuuaaaggaggccgaccugagaucagaagcggggcugucagaugccgccgugaacuguggugacaaagaacucucuggucugucuaaauuggucuugcaggccaagguucauuagcuaagcacccggcgccucugcaucaccaucccacgagucagugguggucgauggcauuuuaauggaagccaaauaauucuuucuguuggcaugcucgggcaacuagaguuuuuguguuuuaugauaauuaaauaccaucaucuuucagagacggcgaucuucagggcccaauuaaugacugcagugcacaguagggucaucauuaacucugaagcaaagagagcuuugggcaccugucugugguuuggcaagaguuggcacguuuggagcaccugaccuggcacucuuucuugaagcuaucuuugaugucuuuaggucucugugcuugggucucacgacugagccaaagcuaugaaaguuuaugcuuuuuuuguuuuuuucucaugagaguggccuacuccacugcaaaccauuuccuaggaaggcacccugccauugcucuggggcacgcuugugccucuacuucccacccacuuccacauccuccaccagccuccaagcuuccgccaguguuaacguggccauagcuccagcuccuaccuucccagggacaacccuguuuucuagucuuucacauccaggcagccagcaccugggccugcuucacuauccaugccccacccccaaccucuaccauccacacuguugauucagagugcaucuagcaccaugcucucugaggccucugacaccaugcacacuccuaauucucagccuggagugaccacugugacacaggccaugugucaccucucaugcuuucuuucugaaccccaagagcuaaagaccucaaacugccacucucuaugccucugggugcuccgggggcuggaguacaaagugauaaggaugauagccaucaacacuugucggguccucccuguauagcagacauuguugggugcacuuagccuguccugauccacuugauggacacaagggaaggauuucacacuccagguuugaugccagucugcccaaguucaaauucuggcucugucgauuaauaguuuucuaagugugagcaagugcuuucugugaggacuaacaauagucucuucuuuucggagcuguuacaggauuuccgaaguaaagcacuuagugucugucacuuaguaagcccucaaucugugugaacuaguauguaugauaaccucacgcacaguucaugucccuaggugcugucuaacuagauggaccaucuccaauuugaccaugucugugaccauguucucuaccuuuaguuggcgucucuaucacauacacauuuucuaagugagugagcagcugaaggcuugaagaaguagcaaccugcccugaugucacaucaccugucagaggccaaagcuguucugugacacuccugggcugcgcccugugcucuuucaaccagccaccaccugaaacugacacaucagggaugggguguaucuuuauaugagggccgaucggucccugaaccaagcagagggcucccccagggccucccgugagcccaggagagagagauugguaucgguccucacuugcucugagaggcucgucuaaggcaucaaggacccuuucccuuucaaacccugaagucuuagguacauagcucggaggguccaggccaggcauucuggucacuuuucugaucuguguugaacuccaggcgcuuuucuggcuucugggagccagaagauuggucccagugaaauccaucagccacagggaaagggcgcugccugcugccugcugcccuucugugcaguauuucccuauucuuccuuugcauuucuuuuuuuuucuuuuuucuuuuuucuuuuuuuagaacuucuguguaaaaugcugaagucaucuccauggugacauuuagugcuauuuaugguuuauucauucaugugccuuuaucauuauuguggacuagcagcuaugguuugcaggaaugggauguagagccaugacagggcacuugucuugcacagaugaggcccuggguuuaguccccagggcaggaaagaaaauagcauauaguugaaaugcuguaugccaggcacugugcugagcaccucacaugcggcaucucauuugaaucucaaaacacccuuauaugguagguauuuucucuagaaagaaaucuccagaaaacugcaacucugaaggucagugacuugauggauaucauagagguuuuaaaaaaaugcuacauuaaauuuuuuacauuuauuuauggguguguguauaugugugaaugcauguguguauguguguauguacauguauauguguguguguauguauauauauauauauauauauauauaugugcaugcgccugucugugcgugugugugugugaaagcaugcaugaaaagagcagucaggaaacaccuugccagacccacagucacagcuuguaaguggaagaaacaaaacuugaccucagagcugugggacaccaaggcccaguaccuuucugucauccauggcucuguucagcacucacaggaaccucucuaugccuucugagagucagcagagacaccaguguucaagguuucugcacauauaaaauaagagaagauacuggagaacccugacaacugugugugcgugcguguguuuauggcagaggcagggagaucccuuugaguuuaaaguccaucugguuuacauaguucagugguccucagucuuccuaaugcugcaacccuguaacacaguucuucauguuguggugacccccaaccauauaauuacuuaguugcuacuucauaacuggaauuuuguuacugugaugaaucauaauguagacgucugauaugcaggauaucugauacaccaccccagugaaagggucauuugacccccaaagggguuaugaccccgcagguugagaaccucggacauaguuuugagagcuacguaggaguccugucucaaauggaaagugcugcuggaggagcgcugggcacagcaaauggcccccagccacguuuacuuucuccaucaaaggcugcuuguucacugagagaggcguggauacucgaccugcccaggucagauugacuuccauggucucaccucuccccucaagggacaacugugcuaacucucuucugaccgaggacuucagcaucuucagggcacagugggcuucauccacacucgauggucucuggggacccuccuuuccugcacugauguuucagucccuugaaccaccuccaccauuccugaccuuugggggucgcguggcuggagaagguauuguaguggagcugaugagagaagaggcugggaggcaggaguaccucagagcccaacccagacuuugcacuacagguagcaucuuggaauguguccccuuuggauagauuaucaaucauguccuucucccuucuacuucuaaccuacucccccaguuucccaccacauuuacuuuguaucucguuaccauaaaaggucaagacugauauaucuuccauuaauauauuuugguccugucgacugccaauuugguaucauuguaguacuauaaucucaggaacaaaugcccuuccuauuucacagauaugaaaacugaggcucaaagagguucagugacuuguccaggguuguauguuuacuaaaugguagaauccuagacuggauucuaacuuccugacuucuucccaaucauacagccuugugagaguagcuuaggugaaggggaaauauucacucccaggccugccaucauuacagcgaaguuugcuuuauuucuuugcaaagagaaucugcuuuaccacauucccauaggaacucacauuauccacuccaagaccagcuuuuugguuugguuugguuugguuugguuugguuugguuugguuugguuugguuugguuuuaacacauguugcucuggguaacugaaaggacuaaauaaaauauuuaucucagucuucucaucuguauggggcacagaacaucauuuggcacacagugugugcucaguaaguguacugguggguuuuaugcacccagacacagcauggcucacugugcucaaaagcccuccucauagcccuccuugccccaaggcaggcugcucuccaccgucauggggcacgugcuucguacagacagagcucugcccuagcccuguguuuuuagguuugucagacucucagcuaacuguucauugcacuuauuuaucuuguuaauuuccuuuacuaugcaccauuuauaggaccagugauucucacacugaaccaugcaucccucacccaggggcucuguaaagucagauuccugggucccuaccccaggguucuuguggcucagggugccagaccuuccaucucaaacacacucacucucaagugaggaagccacuggugagagacugggcucuaaagacccaaacccuaaacaugugacagaucaaaggugaaguuguuggucggaauaauguugcugauauugacaacuggagucuuacgugcucaagccugcucucccucucaaaaaauucuuuccuauuacucuccuaaagucuauguucaguggggugggaguuuuuauuuuguuuauuggcccagcacaugcagagaacaggaguucggagcuaucugugaaccucugauuugauugaaugaauuacuaugugauuugcuaguacuggacacacucauucucuccccuguagucuguuugucccccaggggccucacccagccaguagcccacugaccaugacugcuuguuuccuagaucaucccagcagccugcagaaccacccucggcuccggacgccuccuccaccacugccccacgcccauacccccaaccagcaccacgcggccuccaucaacuccuugaacaggggcaacuucaccccaaggagcaaccccagcccagcacccacagaccacucacucucuggggagcccccagcaggcagcgcccaggagccaacccaugcccaggacaacuggcuacucaacaguaacaucccacuggaaaccaggugggucccaguggacugaggcugggugggcaugggugggcuaggugggcagagggcagaccagcuggacacuaugguccauuggugaccagaccagcagggaacaugucucuaccacauaucuguucauugaagcugguaugaaguaccuggccucuggcugcuauucuccaaugguagaaggagagagcucugggaggcuaggauuuuagaacccaccagggcugagguucagugcuagccugcugcuuacuaaagguauguguuguuccaauugauagacucacaaacaucaccugccuugucuaggcaauggcaaugaagcuagcuggguaaggcuucuucuauaaaagcaggcaagaggugugcaaaggaguggaacaagguaggcacucaguuccgcuuuggcuggguccucaacagccagcagugcacaauuucacugcccuguaccuagcauaagaccaacuggacuuauauagcuauuuucagccacaugagaccuguaauuuuaacuuuaacccaccaucuucauccuccggcuuuucuacccauuacauugcaauauaaugucuuaggggcuccaggaauucacgguaguacucauuaucauuaaauacucaccgguuaccuacuaugcgcuacaauaucugagagaacaguugcuugcgaaagauugucauggcagaggaagcugagggacaugcuaugcuuucauuacugugagguccccagugacacaacgcuugccacagcaugggugggagcuuauaauaugaacacacaaguauaaaaaguaaagaugggacaaauaggugacucacuaugcuuaacugagacuuggguggggaaacggcacagcuucccaauggcuccagagccaugugacugagauaaagagagucagaaguccugaggauacagaggggaagaugaggaagcccaauagagcaguucuacuugacagguuauccccaaauauuguccugcccauacccaggagaagcucguaaguaacacacacacacacacacacacacacacacacacacacacacacucacacacacacacacacuucccucaauauuaagcagaguccaugcuggaaucuaagcaaaugugcagauaccauagcagcugguaggaugaccaagagggauugcauuucauccugguagaaaaagcaagucuaucagaaggauggagagagcaggcuucuguagaccugcucauuucuuauaccucuuguaccucugccaauccccaagauuaacugaguccuucagggaggagccuggaccuucuugugcccccuagagcuggaguaagcccuacaugagcaucuguaguucuuguguguggagccaugugccgaaggucccccaaccucugauccacuucuuugacuggcuguagcaucaugcgcuuaauugauuucauagggacugucugauuaauaacccaucaggcuccugucagaugcaggggaagccugaacagaaggcugucagaccucugcucugccucagcucuucacaggccuaguccgggagccuggagccuuuuucccccucuucaaacugaauuugggaaauagccuauguaaccucaggaaugagggcuacccagcaaucuccaggccaacccuacugugguuccccaaaugagacacaaugccuucugaugaggcagagcaaccucagaacgucacuugaccugccugagccucuuugcuuuauuuguaaaaugagggcuggagaguuugaauaggaagucuucucuguuguugggugccuugaucucagauguauauaagacaaagcccacugcuaugcaagaagcuucuagagggaggcagaccucugaagggaaggugggcacuaaugaugaugcuugagaggagcaaacagaaaagguaucauuuuaugugcuugagagcauccauagccaugccaggcacucuuggagaccucccugggagcuuccgaauguuauccagacuaguucccacauacagccucuuaaucccccucccaacucucccacaaauaguuauguuugagguccccaagacuacuccagguuuggcaaaaagggcucaugacagucugucgugaguauggcucugaguucacuguggugacaaaacguguggcaaauugguaaagaaaagguguguagggugaagucaggggcuucaaaccaggcccaaguuuccagaggcuucaccucauaguaucacccagaagagacacacccugaucccucagugaaagcugccaggccggaggcacagccucugacuagaacauacuuaagucacauccucuuggaaggaaaacauacaugcaucauugaguuaaauauguaguuuguacacaguggagcaaucaccuguuaucgguucacacgggaaacccuccugaaguccauguucccagaugccagcuggggggcagucuuagcuacagccuuucacaguagucugcacccuaacucuuuccugcauaaguacucucguuagaacacacacaccacucaugcacacucacauacacacauacucauacacacauucacacacauaccacacaccacacacauacauucacacauaccacacacacacacacacacacacacacacacacaaguacacgcaccacuuuccauugauagaggaaggacagggaggaucugaaucauaaaacacuaaguuacuugccuuagaucccacagccagcaugggaaggcuagaacauugagcuaucugaccucaauucccccaccccucaccccccacccacaugacuuaaaguugucuucuugggccagauguggugggacaagcacucagaagccuaaggcggaaggauggugagugugaggcacauagugagacccugucucaagaauaaguaacaagugaagugacuucccaaggcauccauuggcaggcguugccagcagagaaaauacucagcucaagagaagcgagacacaggcacagagccagaaaggaggaggagcggaggaagaugguaaauagcugggugaaguuaggaggacagagaucuccugagaaugacagauagaagugagcagcagaggggcucaggacauugaaaaggggucccacccuuccuguggucauuaggucagaaucccagaaguuggucaauagcuguucacagcuuuuaaguaguggcauuaugagguuggccuuucagaggaucgcuguggucuggaagaucuaggucaugguuguuguugugguugugguggugguggugauggugguggugguggugguggugguggugguuguuguugucuccuuuccccaucccugucucugagcaccaggugcaucucugacuccuugugagcuuggcugagucacugacaccugcacacugugagaugucagcugcacacuuaggguaugauucccgcuguccuacacuacugggagauggcaaucagaugugacgguggcuaucccagggcuuuguggacugaaacacaauccagcacacuggcuuauguaagcagacuggcuguugggugggaccauccuaaagaccuauuucucuuaaaggucuggggacuucccuucccaaaaccacacauuuuucccucucaagguaaacuccuccugcucuggaugauaccaguagcccuggaagcuccugcuucaggaugcucagggacucaucuguguguaaaggggaccaaaucccuccccaauccuagaauaacacagcccuugccagccaaacccagugcagcuagggccaaagucaaggacaccggcuuugaaccccauuccugucuuuuccuuuccaugugacccugagaagucucaccaagccucagguucuaggucuguaaacugagguaaaaguacuacccacacacaagaagaucaugccuaaucauaagucaaaccuccauaccugagcugucagcauacgugggcagggagccacgcaggacuaugaccccaagugggcacaagagcuuguguuuccaugaaaaaacuccaggaaccuuuuauuucucauaggaguuagacaucuaaaguauugguggggguaggacauuuagggguuucuugagcugggaguuaggacaccugugacucagucucugcucugccaccacacugacuuguauggauuuaggcucaggauacaugucuccauggucucugcucugccaccgcacugacuugcauggguuuaagaucagggcacaugucuccauggucuacaugaugaaugcccagguuggcaugcuaucagaagcacuuccaggagauccaucacuguguagcuugagaaauccuucauccugcuccacugccugccuguccucuuguccucuggcucugggcuuuuaagggacaguugucaguucucuccccauuuaaacauguuucuauucuauuuuaaauuguaaaaguuaaaacagggcuggacguuaagagacggcucagucagucacuuacuuuccaauugugaagacauggaugugauccccagaacccgaauaaaaauucgggaugugauagcacucacuauaaucccacuaugagacaugaaucccuggggcuuacuggccagccagccuagccuaauuagccagugagagauccugucuuaaagaaagaaaaagaugaaugauucccaagguuauccuccaaccuucaugugcacuagcgcacauuaacaucacaugugaacaugcacacaugaacaugcauagacacagauuuaaaguaaaaauauuuuuaucuaggcacuugaaauauccuaucauuaacauuuugaucuuauuuuuuggcccuuuaaacacacacacacacacacacacacacacacacacacacacauacacacacacacacuuauuuguuuauuuuuguugaggugcaggcuagacucuugaauauaggcugcugucaaacucccaaggguucccagaaacaggcugugcaggaaggcagcagaacucugcucagguccucugagccaacucuguggggucucugcauggugggugauguaggaugaagagagaccaaaaaauccuucuuaaaacaagagacuaaaggagauaauaaaggagauaauaauacccuccaccggcugcugucucuaggcacugacugugugucugccauaugccaggcaggccccuccugcaugcccugaacccagcaacacaaaggucagaucuguuuagugagugcaugcauguacugggcaauccucuccucugggcacauagcaacaagcuggacauaaaggacaccugccuugcagaauuggaauuauaagaggaagaaacauauugugcagacaguguucuccaacaucacucugugaaugugugugugugguguguguguguauggugugugguguguguguguguguguguguguguguguggugugugguguguguguguguguguguguguguguguguguguguguguauguguguguacuaaaccaaugcaaaagggucagugaagaguggcuggggauaaagaaggggagcuguggaucuguaagaagucauagcucuggagggagguaugauccaagggaauauuuacagaacaauucaggcuuagcuuguuugagaggagcaaggaagccaagugugucuguagccagaaguaugacuucggaggagcaauccaaaccagggcucauacgaucugugggacuggucaggccuggggaggguuaggggcagagagaggaucuguauauuucacgugugaucacccuuggauagauucucagagugaugcagauggggccuaaauuccgaauccgccuugucucucaggccucccaucagcagcgccaccugccuagaguaaugaaguuuucaaccccugcacaccucccaggcacuguaggagccucauggcagaaaauccugguaguggugggcucagguugugcuuugugacccuccacagagcacagcgcacuagcgccucauuaucaaugucccagcuacaaaccagugucacuucgcuugccgcugucacugggauguugggaucuccagauggugcuuucucuuagguugaggaggugacaggcaaaagucaggcuauguagaguucuggagcagaagcucugagcucugggcacuaaccaaucccgcgccaggacaaacucugccaccuguucaccaugugauaugaccucagaaaagcugcuccucuguugcaaggggagaugacagagcucuggccugauaagcaugggggugagggguaaaugugagucacucacagagcucuagaagagcagaccgugagugauggcuacaggauagggugacuguugcauuuagcaucaucccaacugaccccacggcaaccauacuguuaucaugcccaguguauaggaaggaugaguaagggaaguuaagaucuguacccaaagucacacaccaggaagguggcauaaaaacaaaaacaaaaacaaaaaacaaaaaaaaaacccaaaccuuacaccugaauauuuuguguuaaggcaugguaagaggcacaagggcuccuuggcaguacuggaaccuggagcuggcuugcugccauuucuccucccucuaguaugucuuaucgugaggccgcaacaguccugaaacuagcuggaggggggaauccagggcacucgagggugaauggcaucaccuagcagguacaggugaggcccauaagggcaaggguggcugucuucauucugggguauagucaggugaaugcauaaguacuguaaugccaccacagacaccuucccugucuucagggaacugucuuccuuacugaucagucacugcccuggucucacacacagcugagggauggugagacccuaaccaggguccacaucaacagggacuuaggaaaacuacagcuucugggccccaucccagucccuggggcucugcugggccccaucucaguacaccaacuaacugagucccuggggcucugcugggucugggcaguuugcaacucuccagaaugcagggccacaagagcucuuggucuucagagaagccaaguggauuucccagauguugcguuaauaaguauggaaugagucagguagaggggagcauugggcuuuggauccagagaucaagugcaaauccuugcuuccagccuugcuucuggugcccuuggcgagucccaagagaacauccacaucccaguaucauccucuacuguacugggaucacccuggccuccuugcauagcaucuguuuugaaaauagauauaaugugcccagcccacuacuggggcaccugccgguccugcucagugagaacuguagguggauguccacagcuuccagccacgcggguuuguauggagagugcucccuccgaaugcucugugccagguggaucccucgcacaugcggcuuugcacacugaccugcugccuggaaccuuugucccugcuggucucaugcacagcugcacccaacagccacucucauuuguuucucuacuguccccuccauggaugcaugacucauugcuucauucaugucuccaugugugcguagaaaccuaggcaagcagccauuccuagggacauugcaggacaaccucauugagauggacauucucagcgccucccgccaugauggggcuuacagugacggguagguggcaccccuccccgugcuccucugugugugugcucucccugucgcuccugcacuugcaugcagaccccugagaccuuucccugggaacgccucggggaagugaugccauguugcaugcacauccccaaguccauguucaacuugcaaguguguccuugagauaucccaucccccaccccagcauauuaacagcagucucguuaauaugcagcucucggcaucucaucggcugccuucgccauccuggaaaccaucucacaaaacaauuuuuuuuuucuuuaacacagcacaggcccaugucuuauguggccuugaguguguacgcuguggucugaaugucuucuaccccaggggcgguggguuuguccuaagauugcagggcugugugggauaagucaugcaguccacccaagcuuugcacgaguccccccaaggccaugguucaggccacacugggcaggaucuuucaacaccuccuuuggccacaaccaugcgcuuugaccguacucugcuguuuucaagacugcagcugggcuacaggaugggcuugauagccuguccuccacacagcuaucacaugggcucugccuacagcagccaggccccuaaggcugugagggcauucauacuagccauccauucaugggcagaacuuaguagugagcucuuggcuucuaccccaguaaaauccauuuaaaaagaagggcuuccaaugccuuaucaacguucacuggaaugcagguauuagaguaauaggaaaaaaaaagucccaguggccuccaggagacuuucaggacuuuagacauccuccuaagcuacuauaauggcuuuagaaaacagaguuuauaucacaagacccagccccuacccccagcuccacuguucccaggaaaaggacuucagggcaaccucuguugagugggcagugucuucggccucggguggguauucuuguggguagcaccgagugcucugugggaacgugucuucuugugccccauuugugcucuggucugugacucuuccugacccugucaccugcccuguggugauucucuucuuuucucucucucuccaggcuccucugcaugcuccuucugcgccucuauccugcagguuggccugggagccugguuagcuggcagacccugacaccuucccaccucucuccauccacaggcacuuccucuucaagcccggaggcaccuccccgcucuucugcaccacauccccaggguacccccuaacgucuagcaccguguacucgcccccaccccggccccugccccgcagcaccuucucccgaccagccuuuaaccucaagaagccuuccaaguacugcaacuggaagugugcagcgcugagcgccauccucaucucagcuacgcucgucauccugcucgcauacuuuguggguaagcauuuccuccucccccacagcuccccauggcucccauuuggccaggggccaccaaucgaagcagcuagggccgccaaaggcccuguaccagcaccacagucauagugcauaggcuguaucaagaugccuugcacuggucuggccuguguccacaccauaacggcagcucuuccaggcucuccgcucucuccucugaggcugaaccggcaaggaauauuaggaucugccuugcauguguugguucucuagaacugaggcacaaggcaaugaggacucugagauaguggucugggacaugaguguccuagaucagagccgcuaagaugaaauaacaacuuaggaggacugggcgguaggucggccucuccuguuguuccaugugacaagggugagagacagggagguagagaauucuaugggaaaaaagaaacgaccaggaaagcuccaggugaguguuaggcagggugguuauagaaacugccagaaacuuccaugauuaugaaaccacaucugaagcuaaggaaauccugcaugagaaccagcaggucccagugaguggagagcuggcugagggagaagcaaaggcccggagccacacugccugggaauuuucuaccuaaccccaggguaccuaagaaagaccucaguccugugacuucuaguccuggccagcacguuggauucuauuuggcauucuuuggacacauuucuagcaaaaucugguuucccacuucugauuccccuuuuuuggucuucuccugggacagagacuaaucuaaggagcugugaacucagugaggauucucugaccucugggauaauaagccucuuaaaaaaauaaggcaccuaaaguggguuuguuuuagcucuuggugagcugacgguaggucauggaagccugagaaagccaugaaucuagguuaaggaguucagagagaguucuggaaucaaauaggauuguuuucaguauaagcuaguaagugaaaauagagcugacuagcagaggccaaagaaaggcagaauacuucccucugccaagaagaacccucuagcaagcuaucaccagagaggcaaagggagccugucuugagaggcauuaccgugcuaucaugagugauuaacagaaccugugccaugacuucuuugggcaauggaaauauguuuuggacacggaugggguucaggggaugaugugaacuguaaggucucucaugaucaccuuggagcaaacagaaaggacaccuuacuguauggacaaucgaagaaccauugaagagcuacauaucaauauuuguaggccacagcuagguuguaagccacagugaugccagagcuauuagaaagugguuacaaagaacugcucaggaaaaucugauggcuucaacuuaacuaaaugacaguaugggcguggcaagaaaggagguggauguaagauaacguuaggagaauuuaugacuccaauuagaggaagucaguccacuaguagcaugcccuggcuaagaguaaaugcaugcuucugauaagcagaaggcuggacuauagcaaccacaccuagaaagauaccaaagaggcaagccuaggcauucugcucgucauguagauagaccuagcaagagcuugggaagaaccucaguaccagacagcccuaaacuuuacucucagcucucccacacggcaacuggugacccccugacagcucccugaugauuucccucaagggugccuacgaggcuggaguuaagcacggcaggugaaugcacuguagguauggggaccagccauccuuuucuucaagggcuggacauggcaacccugguaccuggucucuuccagcugaugagggcuggaaugggcaugugugcugggccaucuugcuuggccauaauuacagacugugaugacuaacuuguaaggaacuaucaauuauuaaaaaucaaauuaauuguuucagccaagcacaaauauccuuaacaaagacucuuuuccagcagaccaacugaucuaaucaacaggcaaaaaaggcacagauauuuaauuagaauuuugaugaaaaauuguguuuaauuucaaguauaaucaauuauuaauuacaguaaugaaugagucugacuggguuuacuaauuaacucauuuaaaaauuaugaauaaccuuuucauuuguaauuauuuucuacagccuaucaaauuccagauaagaauugcaucaccuugccagcagagggggagacagaugcaaagggcaggaagacauguugcuucugcuaauaccugcucagggcagccauaucuggguggugauucugacagaucuauuugacauucagccucugaggugggaacugugcugagaaacgagcagccagugaccuuuacguuucagacauauuuacugguauuuucaugggaaaauagaggaauuggaguuaagacuccauggagacuugccuuugggccaucugcuccuacuuuccucagaaagccuuauauggcuaagguagacucuccacgccccagggaggaccuugucagggucaugugacgucuucaaagagggaaguggagcucucuugcuguuuacuucagacagguaaccaugcagagacaggcagccacgcggaugugcucacccuacuugaccccucuuguuacuguuuucagauccucacuggucuccauuugguuaccuuaccuuuccuuuucuagagaagucugcuugcagagcaacauggagacgcaagcagcugaugcuguguagacgaugcuuuauucucauagcaccaugaucauucuuagaacauuuugaguagaacaaauauacaacaugcaguguagaaaaaugucagugcccacugucugucauucccaacaucacuugcuguuagugccgagucuuccucgugcccccuuuugcccuaaacaccucacuuguauuuuuccaucaaaaucuccuaacuccaguggguuaggaccccauuugcagaugaagacccugucuggggcccacaaagcuuaagugacucacucacugucccaugaugucacauuagggaugugagucacccaaccacagguauucugacacuuuugaaaauauacuuugacucuuuccagcucagucuuuccccucaugcuguagcuuuccaaucucgauauucuguuguaucggaaaaccaaaaccaaaaccaaaacaaaacaccaaacuuuaaaugugguccuggcauugggccaaacccagugcugcuucucucugaaccuucauaaugauucuauggaaucaguguuguuuuuuuguucauggagaaucuaaagcucaugacaacuuuccaggaucccacugguaguaaaugaccuagccaccauucauccaagacuugggaucucuaagagcaugugugccucuagguguggugcugcagguccuaggcuugaauggaucguucugagcugauggaugccuccuucaggucccaccugugaucuuuauucacaggguaagcguggcucugguucuuagccucuuggaaaccuagcuucccaucucuguauuguucuuauagugggcacggaugccaugauuagcccaucucacagaagagguaaccaugagugacaaauggcccucaagagccuggcuucugaaauuagaccuguagcuuuaagaccucagcuccucaccuacaagcuuugccucuuuaguuucuauguuuguaaaaugaaggcccaagugguuguaucacagaguugucauaaaauucaaggaagaaaguuuauacaggguaccuaaccugcccuaugcgcacacacacacacacacacacacacacacacacacacacacacacuugcacucacucaugcauacaugcucauacacgcacaccuaucacagaguggacacccaguggaaguugcagauuguuaauacuucuguugugaccccaaggcagagaguaucuacaucuuuaucuuuugagagaaaaccugguccaauccugucuugcugcagccugccagcuucccagccugcauuagucacuagagcagccgagaaagcaaacagggcguaugucagagcacauuuguagggaugucuaguuuuuccaggagagcagccacaaaagggaacagucaucuaaaaugcccccaccccgugucuuuucuccaaguaggacaaaaguuaauuuugcuucacugacaguuagcuguauccacacgaagcugacagcuucuuucacuucugaacacgguguaaaaggcaguagaugagcugcagauugcaaucuugaggaugcuucaagcaccuaucuggccagagagccugggaaagagggauggagaaaggcuuuccauuuaaauaaaagccccagagcacccuagguucuucuggcucuucuauaccaagucuaagcccacccuaaaggguggggugaguucacuguaaugucucuaugcaagcauggugcuccucugguaguauaagccacugaggcuuguuucuaccucugcauacuagagcgaguaauagaguugccgcagcuaggcuaagaagcacaauggucaaggagacauugcuugcugguggccuuggaagaaugccauuacagcuccuugaacgucaauuaucucagccugagguuugauggauagagaugaucccauucagcucuuucccgugaacaaucccuugccuagaggaauuguaccagaaaauccagagccuguggugucacaaacaugagcuguagccaccucugggagggacaguccuacaaccucagaagccgugauggaucuuuugguuaauuaggucauguuuucaccucucccagaaacugagugaguugcaaaaacuaaacaaacccuggcucaaaguaacaauaguuuaguuuguaagugagaauguugccaagcuuaaucgcuguucuucaagaggccguuugagccauuugagagagcuuugcuugguggaacauuauugcgguucugggucuggcagagccugagucacgcaguuuugggcgccaucuggaaaguguugguagagcugcacuugggugaugagagucguuugcagagaauguggcuccuaaagaucugacaccuuacuauuuguuaguuacucuucucaucgauauggcagaauaccugacgauagcaauugaggaaggaaagguugauccaggcucauaauuuaagaagggauacaguucaucauggcacagaaggcauaacgacaaaaacauggggcagaugguuacaucuucgacauaaucagaaagcagacagugagcagcaggaagugggaucaggcuauguacccucaagccccacccccaaugacccacuuccuuuagcaaggguccaacucuuaaagguccguagccucucaagacagugccaccagcuggggaucaaguguucaaaauaguuuugggagacauuccucauucagacugugaacugcccuucagugaagcagccaugccacaggaagggacaguagacaucucauccuaagagcugcaguacacauuuuccauggccaaguaucuuguccagagcccagcacaagguagcugugcucacaauggcuuuauugaaauuaagggccuuacacaacgcuuaagucugcuauggguagccuacauagaaagguauaggccaaagcaugguaacagaaauguucauuucaccuccugggauucggguacaaauaagauggacacgagaagacuaggaaaagcauuaggcuuggaagcuaggguaaucauagcuccuccucuauuccuuauccacaucuggcagccuccggucucaggugucauuuguuucaugagcacaggccugcuacacuuggggccuggguguuauuagugagcagcuaggcucauuuuuuuucuccuuccucuucaaacucacaucaagccuuuuggacagaagccauagguuuaacuuuauagcccaaagagugcggggcagggaggggaggccuccagagagccugcucucucacaaggaggaagaagugaugaagauacgggguccuacacugaagccuuucucucuaggauugaugcuucacacccuucugugggaguugcaaacagcaagacaucuauggguuagacucucuucaacugaccucagacaaauaucuuccagcuccccaaaggaaagcuuagagacugucaagucaaaaacgcuguuuuagacagcaagcacucacucuguguaguuccagaggacagagucaggcauggggcguaaaaaaugguaggagcagcuuaggagaugguccacuggguauaagcauggggauuggaauuuggauccccaacauccacagaaaaaauccuggcguaguugcacacuugccuguagcccuagugcuguggggaggaggagccagagggaucucugagacuugcuggccaucagccuaccuccaugguugguuagagacucagucucaaagaaggaaggugggcagaaguagaacaugacucuggcaucuggacuaggaggagggggaagugcccagacccuguaggcccacagucuugucuguaucaucccuccacagagacuagcccugccguccagacaagaccuugccuucauuaagcucucacuuuccuacuuguaaggcaggaauaaaaaugaacaaacaagaaacuggcugaaaucaugacucacacaacauguuucagcucagcaugaaagaaagucuugcagccugcagagcugccccacaauagaacaguuuggggggugaucuuccuggcaguaaaauuaccaagcaguagguuguucugcuugcuugcuuaucuguguguuugauuguucauuuguucuuaauuggagaauaauguaauaaagaagcuagaugcaaaagcaagugcuuugagucacagagcagcacggcucugaacuaaugucacugggucuugauauuuccccaagcaugggugauuaucagagacuggaggccaggcugcugcuuaggaagcguggucuucagcagcaggauggugguggucaggaggcagggggauuuaugucuuaaucucacuuucucucaucccuccugucucuuguugauggaacacaagcagcagacagagccccagggagccacauagaggaaccucauaggacauagagcagguggaagagaauuccaggguggauggacagaaucagccucccauguuuuaggauucucucccacagcgaugcacaagggcugcgacuacuaaccucagguccuaacacuagcacagagauaccacugucacccagaaacgucucccucauccucacacccacucagacucaacgcccuugcuucuuaaaucaguuguugcaauaugaugagcaccuagaacacuuugccaccuugugagcucugacaggcaggagaccugucaccaccaaugugagccaagcacagcacauuucugucguucuagaaaagucccccugucuucauggucagcucccuuccccgcucucagaucucuggaagccccccuucccuucucaguccaggcacuauuugugaaaaguaugguaaagauggcauuaauuuacagcuuuaaaaucaguaauuaccuaaaauaaugccccagcucuaaguguugaagugcugagaaaacauuaagguaugcuuuaguaucuccagcuccuggagcagcagagacuugucuauggaggugcaguuccucuggcacugucugucugucugucacuugguuugguuugguuucuguuuaucaucagccagaacuuuacccaguagccuggcuggcuagcucggaaguuccaaggacccgcucauuuccacgcucgcaagugcuaggauuacaaguguguaccgugaauggauuuuuuuuucuuuuuuugaaacaugaguucuaaggaugggacucugagagucucuuggaguuucugugugcugucccugacuuuccuuaggugcagcagccaccgcuuuaggauagcagggucuuuucacagguugauauucuuuaucucacaggucauucucgugguguauguguuccccagcaucacacaacucucuuccuugucagggucacuagcucuauuacauuccugccaugacaacaacugccauccucauuuguuguauauaugucacuuucaugauauucucaugucccugcuguuuccuucuuccugccuccauaaugggauugcuggguaaucaguuacagacaggucggugcuauaggauaggacugaauccagggccccacucggguauccaguuuccucacuguugguaaacauggagauuugugugaaaucuugggucacugauaucagugaaaaauguaggucacaggugacucugagacccaaaguagauagcagaucuucauucuagaggguucuaugugccaccuauucucccucucucuuuguuuucaagacuuucauccaagccaggcauggauauauacuauauacaugguaguauaguauauaccuauauccauacccauacaaauacauauacauauacacauacauauacauacauauaguauaucucacauauauaguauacuacuauaaucccuguaaccaggaggcugguguaagacagugaguuuaaaagcagccugagcuacauagccagacauugucucaacaaacucaaauuaaaaacaucucuacuuaaaugucauuauucaaggaagaguuugacacucacacuaggccagcaacuuaguuauaugucuuccuguagccuguggucauguccacagucacaucuaaauuacugugacacugaauggugacucaaucucccccacugggcugcaugcaccauggagggacaaacuguucccaucaagcugggcugucaacacaaccucuuauguccagguccagcaugugucuggccaguuucuuggcagaaagauagaaggaaaaacacugaggcuagaaccagcagacaccacauggggugggagggacaaagaaggaaagacuagagguuccaaagcuuuucauacaucuaagacccaaagucuagaucccaugagagugaaaaaugccugcuggaaauggggaugggggagggaccagaagagugaggaccagagguggcucugugggaccugcgggauccaugccuuagucuguuccugguuacugugcaauuuuaugcagaaacccugcucuugaugaaccucuuucucccgaccugcggaugcaguuagcaagcuauucuggggauaaagugacuugcuggcacauaguacuuacuuguaauagcaaggacagucugucuccugucaccauagcagacaggacacauugaaucuaugggcaaugcagcuccugaguauggaaaugucccaaggaagacagacucaaguuuauggguacauucacuuuuaauaacagcaacccagacaaucaagccacguggagaggcaacauggcaauggugagcaggaggcagccauagcugcaucucaggaugcuccugcaaacccccacccccaccccaaugaaugcagaaaagcuguggucuuacagauuucuagaguucuuagaaagaauuuuuccuucagucuuguuuuuguuccagagucgcuacuguguggucacauaauuuaaguccacuuaaacgggagagacuggucucauugguggccuuucuuucacuuuguggcaucuguaaugguaaagucaguccuaucagggugucacauaggaugcuggacagggcuuggaaggagagaucagcugcucuucacucgggcagcagagaagaaugagggagagaggggagcagugguuguaagcacacugcuuuucuuccacucuguuuucuuaucucaguaaaacaggaaggccauauacagucuucccuucuaaggacagcaauacaaucuuccagucaaaguggacuucugguccauuggaccugcaucccaggacccugcuuuuaaaguuuuaaagucaguauugauuucuuuccuuccuuccuuccuuccuuccuuccuuccuuccucccucccucccucccucccucccuccccccccucucucucuccaugugguguguguguguguguguguguguguguguguguguguguguguguguuugaggggguaugcacacauauguauagguaugugagcacauggaggccagaagacagccuuauucuuccucaggcaccauccaucuuuuuuugagauagcauuucucacuggucuaggacucaucaaagagacuagguugguacccagcaagcuggagcugcccaucuccaucugcucagugcugaaaugacaagagguagcugccuggaguuugguuugguuuggguuuuugguugguugguugguugguuuguguguguguguguguguguguguguguguguguguguguggugugguguguguguggugugugugugugugugugugugugugugugugugugugugugugugugaguucuaggaaucaaacuccaaaaacuugugcuuccaagcaagcacuuugaugagucaucucccagccuuucucuuugguaauuuagcaguugauaucuaagagguguuuugagccauggaugagauagcaucugugaaaagucuagucuagcccaaggcaccccagggcuuugagggcauucagaucucacucuccugcagcuggguguccagaaacuuaagccucuccgguuccauacccuaggacugucucuggcuuuugguaaucugggauuaguaagcuggucauccaacacucagugaggaguagcacugacccauccgcuucacugcauccuccugggcugugaucgacagagcuggaugugcuguuuaaugucaugagucauccagggguuucuagagagccagaugugcuagacacuccuggcaacaggggguggcuguugaugcucuuguacuagacuuugaaccucaucucugugggaccacccaccccuccacccaggagacacuaauccauuccagucaggaaguucagcuaaaacuuccagaagagguggagcuugcuaaucaagggagacauugagagagaagauauaaauggauuucuggagggaggcaggggauggccggccgauagaaacaucagccauuuguggagggggguguugacguguucuuuucuguguuuaccuugcugggccucaaucucuuacaccaaaggacucuggguauaaaagucaaggugacugcuggugaaucccauugaccgccccaguggaggagaagccaacuaggcaaaugcaucaucagccuugccuuugugagaggccugucaggugaucaccuucuacagcauuccuugcccaaguauaguuagcagagacauuugcugagguggaaauaaagugguuaaaucacucauucaacugugacagucaguagucuggagaguugggucuagaaaacaggacucauaacuccauagaguucacuucugaggacacccccaaugccucacuccugaguacacagaccacaaggaacaguugccuuccuguguggggauuucucauaagccauucccagacaccucagaguguugagccugaugagacagccagcagcagugcucaggagcugugaguacaccacgugaccacacggcuggagguacagcuccuaaugaugcuuguggguuuugcguuugaccuucucaacaaucccaaccagucacgagcuaggcaccgguuuaucgucacuuccaauuuucagagggaaaugaguccuaccuaccuugcuaagggagggagacggcuggugcucuuuucccaggcugccaucuuccaucuggugucuggacuuggcugagggugggaggacuugggcucucucaucucaccugagcuguauagaggggacuuccuggaagaagagaagagcugcauuuauuauggaaugagccagagugagucugugugucguagggaaggugguuugaaggcaugcuuuauaaccucaguuuuucagaauugagcaaaucgggguaugagggcaggagcgcugggagcuguugggaggccaugagacugacccaccacaaguucagcacugaggacucugacccuguugcuucccaagcuuagcaucaccaaaaccaccuucuccuaugaagaaaggucuuccuguuaguauauggcaggaggcugaaucuugaugccccuuuaucagagugaagguuuuguucacagccuccggggaaguaggggaaggggaacaaaugccaggaucauucauuguguucugguccccaugcuaucacacgucccuaauguuauccauccauuggauaacauuuccauaggaugcuacagucaaaccuuccaugggaggcugcagugaggcccugcuccucuguucugugugucucagucagugugugucucuuuaugggugcacacaguugcauacaacugugcgugcagcaagaauguuaagaggagacagaauguaagaggggacaggccuucagugaaaauuugggaguaaauaccauuuuccuuuucugacaacugcagagucuccuuugccaucuagugucuccuaacuagccucuaaggcauaagaucuacugaguccaucaguguuugcacaggcaccuaaaugugugggucugagacccuguugacaguuucacauggaaaauuuucuguccaucuguguacuaaacauagacuguaucacauuagaauaucugagugcuuucauuucauuaaccgcuaagcaaugugauaaugacuguuuucaauaaaauuuaaagaacccucaugaaauuuaaucuguacaagcagccagaggacagguuuugaucauguugauugaugcaggggagaguaaccaagggucagagugguugcaugacuaaccugcuguugcccaacuaguaaagggcagagcugggggccuggcucuguccacggugccacugcaccgagcaugaaucuggcagggaagagggaaaggaaguacaaauguauaccauaagggcagugcuggggagaagugcaaagcaacagguaagcgccagggaagaggucccauuugccuggaaaaagccucaagggaagggaugauauuggaaguaagccuuaaaaaaauagucaaauuguugggugaugguggcaaugcaggccucuaaucgaaacaguugggaggcagaggcagguggaucucugugaguuugaggccagccugaucuacaaaauacauagaaaaaccuugucuuggaaaaccaaaagaagaagcgggcgaagagucgucuaaaaguugauaagguaguaggcauuccaggcaaagaccaaaagcaugaauuuuggcuggacggguaugcugagggacauggaaucgacacaaagcagggagacuccuuuaugcagggagaagcaacagagcuuaucagacaugauauuacacaugcauugaaagcccuccuaaaacccaaucuuucugaagagugcccguucucagggaacuauggccagcaaaaguugagcaauuaaaguucauauaaugaaaggacgaacccauuuucccaccaccuuuaucauuuccagauacuacaugcuuggggaacucugugggguuuguucauuuauucauccauuuuuaauuuuugcuuuuuaagacagggucacagguagcacaggcuggccaggaauuuucugugucuagacacugacauggcauugggcugggcuuaaagccagcagcugugguucuaaccaucgcagucaucuucacuuuccuggucaucauccuuaugaugccugcacuugccucaaauucccuaaucaaagacggaaccaaacacagggaucaguguguucagagaacaacaggaccucacaucugucgaauucacagaaggggacaggaaggcaagaaaccaggaagaucccaagggugggaaugccugggggcaggagcccggagagucucaggauaagagaggacaucaaaggcuguccugugagguuucucagcccucauucacaaacguucccccuugcaaagaaacaccacaagucgauaaucuguguggcagcauccagggcaaguugucugaccucauugcugucaaaagcaaauguuccagugggaaaagcccucuacuaauaauaggugcccaaauuaaaacuccucaagagaugguggggaccacuuccuaauugacguugaucauaggaaaagcaaaggagaagucacgugguucaugugccugaggaaaucaggacauggaagcaucauuccuggggacccaacuaaagcauaucguccgggagacauggacgugaaacauagcaacagccaucuucucucuaggcaccaggacuagccaaccccauuguuuuaauuccaccacauuggauauuugcugaagguguaggauggguguccauagagugacaggcaguagcuugcaugcagucuugcuuuagguagauucgcaaucaaguguugcagcucggaugcauuagugcagagaggaaucuauccuaggagauguugaaagcagccucucacccccugaggaaaugacaagcgguuucccagacuucaaugcugcccagagggcaaggcugcccgcccccagcugaguggugugaauaggcaggcugucccuggguuucucugaucccaaggucauuagugaagccuugaccauaaggcacagacaggcccucaccaggcuucagcauguucucucuguaggguaacucacugccugcuuguucccucagcaguggucuuaugaagccacuuuuguucgaauugagauuaaauaagggaggggggcugucugggcugugcuuccguggcaacagcgagagcagagcugagggcccagagucccuggggcucugucugaggccauggcaaugcuuuaguaaauggugcaauuguaaacaauuaggagccugcuuucuuagagcuacagaauuuaauuaauaacugugucuagcucugcuuugagacaccuauaaauggguucuauacaacaccauucuauaaaccggguuauaacaauaucugccuuuaaaaggguuguuuaagugacauguggaagugacuucuccaauauuauaccaugcacaagagaacaguucucacaagggagagcugcuauuauuuuaauaacaauccuuacaauaucuguguccgcccugcuucacaucucuggugcugucugggaggggaaacagcagguuucucagccuuggugggcuuacugcccauacuuuggcaccaggcuggacuccuucuauuugggaagugcagccugguggcacaacaagaucuaaggaugacucuccgucucccacaggauuucuuugugacuucugggcacaguuuuuuguuuuuuuguuuuuguuuuuguuuuguuuuuuucuaauagagcucaaagcuauaaucugaagaugugcauuugggucuugcauccagauccucccacaaaugcacuggccgaggcugagucuccucagcuguucuuugaaggagcuaguaggucucugaagcaaaacacucaguauagcaaccuuccccacuuuuaaacaagaucucagaccucuuaacucccgaaguccacauagauccuuauuuuacuucuucaucacgaacccugauguaccgcaaaaacagucaggaugauguuagcaacacugaaguauacaccacacccaccuaacuaccaucuaccuacuugaagguagguacaggugccuuggcauagauggugccaccuuauguauaaggaaacuauagcugcagaaagggaaguuaugaagcuagcacaucaucccuagagaagcagccacagaggccaggcuggccacagccauacaucauugacauugcuccacuguacagucagcaguuuugacagcugacaaggacaagccagaugacgagucugaggcaggauggaagggggaagagagcaggccagucccuagucuaggaaagcauggaagagggcucaguugagccugauggggaggagauuuccuagcccauugcugcaguaagaauccugugcaaauuaaguuucccugcuuccuuuucucuuuagcuugccuccaccagcucucugugccuuccaauuaaaugggcauccauauugacccugggcgcacauguuugccacacaaaaguggccuucuccccuguucuacacaguggggggggggaugucccaugaugcaacaguccauucuguagaagaagugcauuugugaaugagggacuguagcccugauugcugcagucauguucuagugggaggcaggaggaagcgcaguauauuuacuugauuuaaaauuagccccacguagccaccggugggauccugucaggcugcuuuauagcgauucuacccuuaaaagcuguuuuaucuguuggacaaauaacucucauuccgugcccagagucugucaacucaugggaacaagagagugccugcaucuuaaagggacccacagauggugugacagggagucaugaggaauauggagaaagaaagaaaaacaggacuggcaacagaacuggcuuaauuucucaguaagugcaggagcuaagggcagcaaggcauccagaggcagagguuaugacagcugucauuuaucaagcuccuacugugugcuaggcacugcucugagacaauuccauguguucucucauuugauccuuugggauggguguuguaaguaagcuucauuuugaagagaggaagcugagaaugagugaggcugagaccuuuugcccaaacucaggagaccaguaaaugagcaugcucugugccuugggcagacugcacucugcucgugacuacaaucuaacaugcaugccauuuugaucaugaaagucagcauaaaaaagaaagccccuugaagugucccaaagagcaacucuagcugugcuugcagcaaagcuuuguguuggauuccuuuuuuuuuuuuuuuuaauguuagccacuguaacucaucagaagggcaauaacugagagccugcacuuugaaacuaagaucuggacucaaaugcagcuccaucacuuaccugugugucuuuggagaucacagagccuucugagcuuccgucaccuuuagucccaucuugccuaggaccucucuucauauguaaaacagcacuaacacgcguuuggaaaccacagaacaaaaugcauccacaagccuaacagugauucaagcaugguguccucuuaaucuauuucuuuguugauuuuucauaugcauauacagaaaugcguacagaagcacagucaggagaaaaaaaaugcaguuuuaugccccauucccuuccccaacacuacaucccaaagaccuucauuguggcuaucauagauguuugcauagggguucccauggauacagugccuguaccuuagccaguguccuguguccggugcccagguugcuuucugguacuucaccugcuacauugccacacuccucucugugucacugguagcguuauagaagcagggauaugaagugaaaaaugaaaaguugcuguucuugugggaucuuaccuuuucgucauuguuggugcugaugcaaaagaucaguaaggacuaguuuauucugagccaaagcuggugagccuggccugggaauagacucagauggcucuggugacauguuccauucuagaugcaguuaaagggaaucuuuauagccaccaaacaaaaggaagucauacuucagugcguuggccagacacuuuggugaggacagcagauugguuacagccacgcgugguaauuuguagaggccucagcugcucucugguaacuucgcuucgguguugguggaagccaguggucugguuaacaggcuauauuccaaagauuuaccugacagaugaaagagcaaaucgcucacagcagcuaguaauggcuauuagggagacuaaagucagcccaacguaauuauagcucuagaucugcaacauuccaacucuccccagucauggaguucuguucagcugagcuaaagaaccuuuaguacacucuggccuuuucagggacucuugcuuuguccugagauugucauuuuuccccauccuuggaagucugaacaccagugacuuuauuuuaacaaacaaaaaaguccuaaaucugaauacuaaaacggaaaaaucagguggccaaucacgugaccaugguuccuacuuuugagauuuaaaaugcuacuuaguaagccuggagagaugacucagaugucaagaacacuggccacuucuccagaggucugagguugcauucccagcacccacguuaaagcucacaacugucuguaacuccaguugcagggcauccgaugccuuuuccuggccucugguggcacaaggccugcgagcgaugcacagacccauaugcagccaaacuacccaaaugcuacuuggaccagcaguuccucaaaguuauaacccucucuacucccuccccagcauacaugcaagugggugucuacacagaguugcgagccuccccccuaccucgugacagcagaaacuccccucuccuaggcuggcuuaauggcuuuguuaauugccuuuccuguguugggugcuagggugccuucagugagucugaacaucaauggagccuuuuuuuuuuuucaaaugucaggacaaaacuugcacuuucugagccaucgcucaugucucacugggcaggaaaaggcgacaggaaaaugucagccccaggaucagauggaccagagcuggggcgauugaacuuucccacccuggcuuuuggcuuucagaagucauuaacauuucaaugugggugauccugugaacccugcuacuucugcacagccucucucugaacucuucaagcaucuugucaccuuuucauugaauuacaaguagucuaaugggaaaaccacacuucuuaucuaggucacccuugguauacuugaacagggauuugcaccuuaguuauaaauacacagugcaggguauaauuuacauaauccugcagugugcauuggugggugguuccucuucauucuucaaagaaugaagaguacaauaaacgauuuauguuauuugaauggucuccucuaucccuagugggcugggagaaccauuuauauuuuuggcuuuuauuauuauuguuaacccaugaucucuacuuucagaacauuugaccaaacaguguucaccacuugauaccgcuucaaaggcggguuacuguaggacagagaugaguggccucauaaacccccagccuccaauucacauuucagucuuuauuuuguggguagcuuuauguugcuucuuuuuucuucaacugaaagugagacauagaaagaagaagagcuugaagcuuguucacccuuaagccagcucugcugucuggucuugguagcucaccauaacuucuuucaguaacucaaaggucacuuuagcccagcuuucauuucaguaccauuauauacguucuucacuaaugcugcccagaccaccguuuacacaagcgugagacuggaugauaucuauaauguguuggccaugggccacucuuucgaaggauacuguuguuaccugaaugacugucaggaaucagguggugacugaagcuuauggauuccaaagaccaaauuccucacugagcaugugugugugugcacgcguguguaagucuaucugucugucugucugucugucucugugcaugugucugugucuuugugucugucugucugucugugucuuuguguguaucuggugugugucugugugucuguguuugugugucccuugaagagaacacagacuaucucucuucuucucucuuccccaagucuucacccaagaccguaaaacucaccaggcaguacagugauggagcuaagcacuucuuagcaugacuucuauuuggagcaccagacaucaggcuaaagauccuauucauuuuggcuucaagauacuauugcugacugguccuuugcuuccucuaaucucaugucuguaauucuugccuuccaaagaccgcaauggauuuuacuagcaugcacuagucaugcaugauaaugggcuucaucaugacauuugcaugcaugcauguauauaauacacuuugaucacauuugcccuccacuguucuuaagugcccccccaacuccuacucuucacuuuccuuuuucuagcuaguuccccuuuaacuuucauguccuuucccccacuaauuuguaacccagacaguuugauuauuagucuugcauacacauaggugagagguuacuuacaggagugugaacaucuuaccagaggcuacaccacagcagaaaauguuucucucuccaccaguagccaccaauugucuauaaaucuucaggguaggguggagcccuuaaagccaccccccagcacccucccuucaugucaggguaucaaucaguuccauccugugcaggcaaucacaguagcuguugagugcaagaguacaaaggccaugucauacccaggagaaagcauucuacaauauuccaaccaguccuccagcuccuggguucuugucuucugagccuuggagagagugauaaagaugucuccuguauagcugggcauuuaacagucacuuauucccagcacucuggcuagauaaugagucucugcaguuaauucuaugcacuguuuaaagaagugucucuaacgaaagcugccagcagugcuaaucuacaaggguugucauaauuguucagaaggcaauuugacaggcacgucauguccauuuagcaaggcagcaguaguacuuucccaacccaggccuauguccucucuggccccgggccucuuaugagauuuacggugcagauacgaauucccuccugacuaugggaauuccagucagaaagugguugguuaccccucgaacagacuugcuacuauugcaucaguggguaccucuugccuguuagguugguagcaaaguaucagcaagguauuucucagcuccaucuggauggcguugauccuuuucccuaucaccauaguccuccauugucacuucaggguggccuggggaguuucugagggaauacaucacaagugguuuuaaguggagcuuugcuuucagaggggccuuuuccacaggucacggagacuaccugucacucucgcagcuaugugagccgcuccaaggaggcagagcagaaagaaugagaugucaacauuuaacuauauacuuccagccccuuccccaacuguaaacugccuuacccuauuaacuuccccugggacccuggacuugggaaucagauucaucucugagacucuaaccccaccccgccaaccaaauacuguccuagcaggguuuuuuggguuuuuuuguuuuuguuuuguuuuauuuuguuuuguuuuuuuaaggaaaggcuugcuuuuguauuuucuuaaaauuaagagagagcucugacaauaaaaauguuucuuuucacagagcugggaacauucuauucauucuggaauuaguuaauucuugugaccuuuuaacaagacagcacuuggcacucuuagauaagauaauugacucuaaugggggaagaugcgcugcucauuuaaugguguacaucugaguuguguguaguucaaggaaguucuccauuaccuucggaguugccaauauauagauuaaaacaguaggaagguaaguagagaugugagcuaauucaaccuaggaaacaguggcuucgcuccuugaaggccgacuaacuguuuucuaucgccaucaucacucagaaguggaaagcaggcuaaagcacaguacugcugacuaaaaaguugcucagucagugggagcugcuauuaucaaccagucuaaugucugggaaaauacaguacuuaugugcacuuggcaaaguaccuuggcacauaguaucccacugauaauaugguaugcuaagucucagugucaagggcuuaagucaagggcuccauugacuugguauauagcacccucugauauagcaccccucugacaugauacugcucucgcaugcuccucugacacuuaucccucugacaugguauacaccucugauauagcaucccucugacaugauacuacucucgcauguuccucugacaguaccacuuauaacuacccccacuggcauggucuauaucucugauacagggccccuccgcuaugguauuccucugauaugguauacugcuucuacaguaccccuguuggcacaguacacaccucugguacaguacucucuggcacaguaccaccccacuguuucaguacuaaaagcacugguggaauaugugucugcauuucucagagaagacuacugcagcuaggaaacagaaauuaguguucagaaucuuuucuuaccucuggucccacaucacagacaccaaagcaaagcaaaaggucacuuucucacuaucacaaaaacacaaccuccaggcugaagcagccaugaccccauguccccauguccccagcuugauuugaauauguccuggagucacagaauaugcugcguuugccaggugccuuuaccauguuucguggccuaaaaagacuguuguagguccucaaauccaccaccugugaacuuauccauaacacaacaaccuguuucucagcauccugugggagaguccuaguuccaucugcagacgugaagcccuuggagacugucugaugugcaggcaggggcgucuucauaugucagccuggugccuugugagauagaacggauaagaggaggcagcagacgcagggugugagcuuucaggucugggcagaugugaguucuagaucagccucugcuucuucuuguccacugaacuuuguacaugucaguugcucccuuaccuucaaguaaucaucuacaacaucuggcgacaaaaaauuuaccuuuuuuuaggguuguuaugaaagccaaaguauacauuguucugauaguuuugacacaguauguagcacauaguaaaacaucucaauccuugucuuauaaauaucagaauuuuaacuaacuuccuaguuuucuuauuaaucuauacuaacaccugauacuuuuuaacccucucaaaauugugucuaguggguugacaugagaauuagaaagaaugcauucauauuaccagauauacacaguagguaguaagucuaaugccauagaccuuccuaucucuguagauuggcccugccuuccuuugagccucuucaggcacccccuccucuacaccaggaccuucuguguagacaucccaauccaucugucuucacucuugaccauguacucuggcugucugaaucaauacuaacucucuagaguaugccacagagagccucuaaaaaauaggaucaucaaggagaggaagggguacugugcagagcauggugugggauccaggaagaugagugcuggcuacaugugggagaaccaggccacauccuggauguggcgaaugcagaccacugaacagguucaagucuuguuucauuuuggagaggauuuggggguuggguuggguuuugggguguauguguguguguaauguggcacugugugagugccagcacaugaaugccacaagacucaaguggacaucagaggacaauuuuuagggguuuguucucuccucccgcuuuguuaagcagaguuucuuuaguugcguuugccaccaugcacacccccagcacauagugagcagcuuuugauaacguaagggacugaacucagggcaucagguuuaugugacaggugcuuugcuuuacugagucaucuuuguggcccuuguuuuuuguuuuugugaauggggucucaccaaaacggaacagacuggcuugcuagcuuuauagaucccacagccugccuccucggccucccccccugcugggguuacagaugugugccaccaugcccgcaucaagagcucaguauugauuuccaaagugaaguccagagagcagucacgcaccgauuacaaauccuuguggaaacagcauucacggcuugaaugcacacuguauacuucacacagcguucccucuuugcuaucucguggcacaaaauaaagaugugcagaaugucgcccucccaccccagcccuguaucaccugcuucccucacaguguuaugacugucuuucauauccuuccgacacucaguacaauguaaagccaaagguaguaugucaaaugcauucuucggcagguuaugguuuuucuuccagaaaagaaaaaaaaagauaaaaaucuuccucagucuauuuaugaucaaugcuauuguguuguauggcuagauccuaccuagcuucuucucaauggaccaguuuaugaaauuucacuauuaaaauaauguuguagugaguaaccuuguagguacaucguuuauuagauaugugaguauaucuggaggagaaguuuccagaauugggaccuugaagucuuaggguaaagggugaauauauuuucaauuuuauggcuuuuuauuacagacucauaugugcucacaccagcaaagugugcgggcaccugccuccccuccucugccaacacaguauauuuucagcccuuuuuaucuuugccaaaccauaugugaaaacuaauauuucagaguuugacuuagauuucuuucacagugagugauguuaagagccuuuuuguaugauuaagggccuuugguauuuccuauucuguaaccugucuguucauauccuaggcccauuuuucuaccgcacuguuagacuuuacucauuuguagguauuauucuuacauuaaggaaauaauccuuugugucauacaaauuauaguucuccuuccuagauuguuauuugucuuuuaaacaaaaaaggucaagaccuccugaaacugugauuuuuccugaucaucccuaacaucaccagacugugaaccccucgaggcaagguccaaaaccuugauuaucacugugucucgagcccucuggcagggccugguacucuaagagaucucugugguugaacugaacugagggucuguguuccccaccccagacccccucuccuuguggcuugggaguuccauuuccaccuccagcagaaacagaugacuuuuuccauugcucacuacagccaugcaccuguuuggccuaaacuggcaccugcagccgauggaggggcagaugcagauguaugagaucacggaggacacagccagcagcuggccugugccaacggacgucucccuguaucccucagggggcacuggcuuagagaccccugacaggaaaggcaaaggagccgcagaagguaggguugcugcguuguccguguugugaguccucugugucugccuuugaacggaggaggccuccaccaugcacgcaucugugccugacucacagcucaugcuucuuccauccuccacaccccaugccggcugcaguccaccugugucuucaucccagauccgggucagcgggacccauggugcucugccgcaucucauuucaugccuucgaggaugcuuucagggcauucacauggccagccagccaucuuuguauggggucagggggagcacuucugggaaacccugugggaucaagaggcacgcgugggagugggacaugguaggggauggugugucccaggugaaagacucuuagacugcauguuucgauggaaacauuucagaugauugccgacccagugaccaagucacuaguaucucugacccagcuuccucaucugcaguaguaacaacaauuacuguguacucacaguguuugcaucagaacuuacuaccaucauuucaccacacacuuuacccucacaacccugugaaauggguauaauuagcuauguccauucuagaugcaaacacaaaugaucacaugaagugacuugacccagaggaugucagaacugaguauaugaacucaggucugggaccucagggcucucacaaccccccuccccauuaguuuccccacuugaucuauccccauggugacagggccucaaaggugauacagaugugaaauucaguugcacaaugaggcaaagccauuuccauccauccaugauagaaaugguggugacauucuguguuuggccuucuuaagugggaauccauggacccagauuuugaacaucucaauggucuuuauucauagauauaacuucccucacugucauccaagaaugguucaggcucaccaaaauuggaacgauguagcauauuggaguggggguuggguuggggggcacuggugaaaucaggaacugcugacugugaucucagcuuaagcaaaccaccacacacacuccccccucccccacccccagccaaucauucuaggcuguacuuucacuuccuguggcucaaucagaaagcacugagcuguggguucucuauagggugcauugccauuugcaaguccuacaggugaaacuuguacaagaaagauucacuauagggcaaccuggcacucuucagggaucugacaaaaguggcacuauccauggguccugcuaauggcuugcaauacucacaccaguacauauugucuagugccaucagugaagacccauagaggaacaucugucuuuagaucagccugugaaaacacacuuaaaccaucuuuauccuuagaggaauuggcaaaggaucuccuguaacacaguguauuuucuucccaccaugaaucucaaacggacauuccuucagcggaguuaagucuaucugaaaucuugcacucuaaugaaauuaguuuguggguuguuuggguucuguuuaguuuuuccggaggaggagggggugcagauaagagacaacacaaaaauuacacugccuuauuggcuuauuuuaauuggggaauuuuugcuuaaagggauuaucgguuauuacugaugcaaauggaaauccuguugcuaagccccuuaaauggagggcgguacuggaaagcagucagcaccagaaaugauugcugagccugaaaagcagaggaggaagcuuccuauagucucugggagaccacauuguuccccccaccuuuccaccccaaucaaaccaaugucugcucaguuucuguuuuuaauugugaugauaaaacucugcuuccuuagacuuuaucucaguagugaaauucuuaacccgacugugagggcacauuucuggccccuucugaugguaucaggggaaagaauugauuacagaauuaagauuagcaucccuacaucaugaucaugggaaaagcaauaugaugugauuacgagagaaaaaaaagguaguggugggcuugaaugugccuuggagacacacugcccaaaugugguucucaacccagccuugcauuucuuguguuaacucauucuaguuacuucuucuguuuggccuuaguuuccucaucuguaaaacaaggaugauaguggcuuccuugagaguacagcagggaggagccacuuguagacaguggucgucaguccagccaagaccucucaucuugucuaccuaguccaggagcauuccacuucagagccaaagauccuagagauuuauacucauuaacauuuacccucaugggucuuccuaagguuugggguauuugaaaaauauuuuaaaguaugcuuuuuaaguuauaaaaauuagauagaugauaaucccaguacugugucucucgugucugugagaauaacauuaaacuauaauuguugcccuauuuuucaaaauggcuguaacaauuccaggcucauuaugggacagaaaccaaauguggcagcuuccugaagcaacaccccacgaccuugugcucgcauuaauggggaaggaggaauggcuacauaagcaagccuuucugaugguugacuuggcgggcuagggauagcgcuuucuuuuugcaauggaauaagaauugcuuaucaguuugaaccauacaaauugcugcacacaggcucagcugggcucuccaaaauggaacagcuuauuuugauagccaaauaaauuucaaacaguugcuaaggaaacuaagggauucuuugugcaaucuauugcauugagaauaacaaaaagaaaaaaaaauagguaaggggauugucaguugauuagaaauuuagaaccuggauagauggaucugcucaggagaguggagacugugauugggaugcagggcaauuccaguucuuccaaaucucccacauuugauggagccauccagccauuucagcaauucauugagagauuucuuuuaugggcgugauugcauacuugcacagcguugcucuaggaagccugaaucuaaauuuacaaagauaaagauggcuaucaauggaaucugugcugugaaacugaaucaugcuguuggaagggguagggucuaaacuaagcuucuuguaccauuuggugaggccuagagguaucuaguagagcuaugguaugcuucucgugacugucuuuagacccuagcuacucugaguccuguuuaaagcuuccuaaugaauaaaaaugaccaacuuccaaacccugacauuccacaaaguucuuaacuggaccuuggaucuagcuggcuaaaucuugacuuucacccugugaaccccacuggaaucacugcucuuugagaaggucccugcaccccaacaccaccaagagugucucuccagauuuuuaauucaccucucauguauuuaauccccugagaagucauagacuaagagguaaagagguuucucaagugacuucaucucugacuggcuucuuaagcauucagagccuccucaguguagagauguucuuagugucaugagacucgacugagcucauguaaaugagggcccuuaacacagcugggacucauuaaccucuaucucacuacugugucuccuacuaauaccuguuaucuuccagaauguacaugaagagcagaauuucauacacagacuuuucucucuaccagucucuugccucuuccccuucccuuuccuccacugguggacuacacuuugcagugggacauuuuauauuccaguccucacacuuugugcucagaauuaaaaacaaggaaucuuaugaucuggaaagacaaaggcagguaggggucucucucucucucucucucucucucucucucucucucucucucucgcucucucucucucucucucuuucucuuucucucucucuuucagcccugccuagccccagcccuggcaaucucaggcaucuuucccaugagcucaaggugguaaaugcuauuuacucuuuccucucagccaccaguccacaccaauugguccagugugaagagagcauuucucucccaccuugggccacauccuugaggugcaaugaaagaaaaaaccccucugucacuuuugucacuuuauuagggcaagugcuacaugcacgcacacgcacacacacacacacacacacacacacacacacacacacacccuugccuaagaacccugcugaguucuggagggggcgguaucucuggacccauccugcccuguaaagaugccuuccacacuaugcuuccucuuugcuggggagaaaaggagccuuguuggcuaaagugagggaggaguuuuccauuauuuauucugauacaggagacaugugaguguagacaguucuccaguccccuuggcuccgacuccucccuacucucaggaaagcaacccuuggaauuagcaggguaugcuucuuucucagcccuuccuaggcauaaaagguucagagggugcuaugcuuuuguuugacacaccccuuuaguucugccucccugggagaacuuggagcugaggcuauacaacuuucuacugcacuauagaaggguuacaguccugggcacccacagaucagauaaaaaaggaaugggaauaauucgcucccaucuuaaugcuuugugauuugggccccugucuuugaagucccaugacucacaauguggagguuugugugucuucauuuucaagguagaagucuggaacgcauuccacccauaaggaauuaaaugcagagucucuccuguguuaaugauagaauauccgugguacuuuuacugacagcgugcauuuuaacuuuuuuuuuuguuguuggcacauuuuuaauuaaaauaacauuuaaugguuugaagcuaaaaaccugauguuucugccuaggaguuuauaagggaaugauaacauauggagaaguuuaacauuuaaauugaauuuuauuauuuaaaacaguaaaauauuuuaugacuacaacaaugcccugccaaacuccauuucagcgucaaacaugcuuuguaaggagucuugcaaagcugagagcggggugggggaagacgcuguaauuuccccucuccaaaugcuuuuuauaaaaaguuccacaaauguguuuucuuugcaaaugauucuuguucucuuagaacauuuuggagcaucucaacccacauaaaaacccuuagacccaggacgcccagugggggcuuacuacugacaaauacaguggagccuguugacuugauuuggguuuuucaggguccuaagggugguccuuccaaggccccugccccuccuccucacucauaagaaggcuaaugucuggcagaaaguuagggcuuaucccuugcacaugcguguguguuuaauuacuacgaagaggaagucugguaagucgccuuccuuccuggggcuuggugccccccccccacacacacacaccagaagcagucacugcugagcacccuccacccuugugguacagggcugagggcuggguuaaauuucuaaguaugcuauagauuucauagcuugagaaguuucuuuaaccauuuuaauacacacuuuaaaaaaggggauacccauucccuacuagaacacaacagcguuuucggacauguuuccucccuucuuaaaagccuuccuuuucaucuuugucagucuauagccugguuucaaacccaacccuccacucacauaugaagcuucugauuuucacaugaaauaaaauaaaauaccucccuccauucccaucgugccucccgcuacaggguuggaaguugaaugacaaugccuuacucccucuguccuuucuacguuaucauacacacacgcacacacacacacacacacacacacacucacaaaaucacaaaaguauucucaugugaccaccgauuauuuuggggaucaaaacauacuuuaacaagcuguggcguuaugcaguaaacagguggcccuuugggacccauacggcuuuggaagaaugaguaguuuuagcagaacaauuugagcguuacgggggagaaacuucuagacugucuuacuccaguggaagaagggagcaggguagggagccggcugcagaccucucgggugagaggcagaguggaguccuggcuguugggaugcuguuuucuuguuguguguggcuaaccagaacgcucuugucuucccuucccugugucucgguaggaaagccaaguaguuuauuuccagaggacaguuuuauagauucuggagaaaucgauguggggagacgggcuucccagaagauuccgccuggaacguucuggagaucucagguguucauagaccacccuguacaccugaaguucaaugugucucuggggaaagcagcucugguuggcauuuauggcagaaaaggccuuccuccuucccauacucagguaacuagacuccacccccugagggaccucuugaucuuaacccaggccugaagugcagccagcuccuaaagccugaaggaaauuucauguuacuguauaggcuacucauccauuggccacuagcauccugccuuccagaagagugaggcuaggucucuggaucuuuuucagagaacucuaggacacuucacaacugccuuuccacuacuacaccaucuccaaaauccuagucaauaugacccagagaggaaaccacauacugugcaugaauccucuugccguaggcaaugcaagcuuggguccacaauuuauccuuuccuugaaaguuuugucaucaauaaagugggaaauaauaguaacugcccugcagaauucucauaacaaggaacacucauagaacccuuagccuaggagcuggcucaaaauaaacaguacuuucuuugccucuugcauccccaccuuucuucaggauugcauauuuguuuggauacauauaccagaaacaaagaacuuaaccaaguagcugggaguuuaguucgggaacaauacagaugcuuagcaugcuggacacugaauccucucugacaccaaaagagaggcagagggaaggaaaagaaagacauaggaugaggaggagucaugugucagagagaacagaggccuaugcaaaacacacccccugugugugugcaugugcacaaauacuagcuuuggagcuaaagucaucaaaacuguaaauguccaucauccauucucauuuuagcuccaguauuagccaaaggucaggucacagaacaauagaugagccuggucccuagugaccacagagccacuacacaguccuggacuuuauaguaucaguauuuuuguucaaaguaggcuaaauaucuuccaucuacuaaaaucuaacuagguagcuacuuggagugaggcggcaggacuucacccucccgauguucacacugcauggugggcucuccuggagcuucacaccaacagccuuggaccaauccgugcuaguguuccauugauggaauguugagcuaauccaguucagcccaugacuaacccaacccuacucaguguuccauucccacuccaaauucccaagauucccaucuguacuuacaugaaccuccagugaccacaaaguagcuagguuguuucuacugaaguaccugccacuaaaguaaacaaacaugucuaucuuaauguauacaugaucaaguaaaggcuugcaugccccaaaauuaaaacaaagcaagacaaugaauaaucaauucugccacguucacaaacgaguuagaagaauauuaccaugacaacuguagauguagggaggacuuguuuggucuucccuuccccuuuagacgccacaggagaagccgugcaugaagcuuggaagguggaagugucaguuuguugcuaacuuuacucccuuugugcuuuaguuugacuuuguggagcuccuggauggaagaaggcuccuaacccaagaggcaaggagccuggaggguccucagcgccaaucacggggcccuguucccccauccagccaugagaccgguuucauccaguaucuggauucaggaaucuggcaccuggccuuuuacaaugauggaaaagaaucugaagugguuucauuucucaccaccgccauugguaagcagcuacccucucuauuagugucuuuggguaacaggaagguuguguggacuaagcuggugcugacaagggauuagaauugaauaugauuggaauuggaauugaguaucuuuagcucuugcugagcaugcaaggucaucccaaguggacuugcuggauaagguccucgaaccaccagcugccuuucaagagcuaggaugcaaaccucacauucagauaggaauccuggauggcaaaccacacagaagucacgcgucccucauuggcacuugccucccaccugcuuuaaggucucacuuaguucaauuugcugacuugccauuugggucugguuugcuuuggguuugucuuuuacuucugaaaccagcagaugaugcacauaagagaagaaaauaaugacuugaagagagagugaaauggcagagauaggggcuggcagagcagguugcaguugcacugggguuucaccgagaauagaacucuccuguucucugacacagagcauguccugauaucuagaacuuagccagaacauagcuccauggccuggggcucuuggacaggagcauugccuagugaaggcuuuagagugcaucuuggcugggagucucucucacaagggaaaugguguuaaaugaacauuucuugacuuaguacuaaguuuccagcauucuucaaagauccucauucucucucuaaucagcaguaguuauuuucagcccauuuccuucuuauuuguaguuuugccuuuaguauugaggcagagcgaaccuuucuguuaaauggagcaugguuaauacacuucuguuauauucugccuuaauauuuugccuugguggcaaaaaagcagagguggcauccaacaacugauguugaugaaggaaauggcccucuguguuguucuugacuagaaguguagucugucgucacgauacaccuugaaucuccaugggcaaugccacuugguugguaaggaauaagcaagagcgugaccuuuuccugcccagguuugcuuuaacaggaaccuaggcagcucaagucuugucagcugccauacuauugguuucucucuugcaguucugucuguaugguguagggaaaaacuggcuuaguccagaagcccucccguguacuugacuuuuaacaucauacagauucuuauucuuuuccauacauugguuucuugagauuguggaaucugggucugaagagauagcucagcaguuaagagcacuagaugcuuuuccagaaggcucaacaccuacaugguggcucaccacugucuguaacuccaguucuaagggacccaacacccucacacggacauauaugcaggcaaaauacugaugcacagauaauaaaaauaaauaaauuugcuagguggcggcagcacguguguuuaaucccagcacgugggaaguagaggcaggcugaucucugaguuugaagcuagccugguccacagaggaauucugggacagccagggcuauucagagaaacccugucuugaaaaacaaauuaauuacuugauuaguuuaaaaaacauuuuggaaucugaagcugugucuuaguagcuauugcugaccugggggccaacauugcugcucucaaucccugccauuagaggcuggaggcuggccucagaaacgacuagguugucacuucucagguucugcuggcagcagucacuacacauuuucuuucuugcuaugguggcuuuaauuuaaagacacaguuaucacgucccacagcauccgaguucccuagucucccagccugacuccaucuaggcacaguucacaaggaggcacacagcacugggcccacacagagcugggaguauuuacagucagauuucugucuuaauagcugagugcaaauaggaaagguuguuaauuuaaauuccccaagaaagccauuuuaauuaggguaugcaucuuaaaacaguaaggaaauagugggauggauguuccuuugccgagccuuggcuugucagagcaugcuaaacuguucuguuauaaugaagaccacggucuugcuuuuugcccugguuccucucaccuagaugaccaaagcugucccuuaacccuuuccuguaugcuagagcagauaggcuugcucaugcuuccuauauaucaaugcaccgaagaacgaucugagugucuggguaaaaugcagaauguaccccagcaggccugagggagcagcacccaguggaacccacgcuaaggugccuguuuuaagccgaaaggacuucuagccaugguccuucucaaaugccgcuggacaaaggaaucagcugaugcaaauagaaguuuggauuccuugcccauucuucagaaacccugagucugaggacagaucauagagcccaggguucucuuggucaacaaggcucugaaaacacccuccaagcaacuaacuucugcccccccccuucuccugugguuccauguuacuucugugauugucagacgcaggccagcccugccuggaaaauuuuucuugaguggucauuugcaguccacguuaugaacguuagaaaaaagagcaaagagagccugguacccacugagccacugcacaucccagagagagggaagcagucccuucgagagaggagggugcccccucccuccucuuccauuuucucucgcugccuuucugaccugucugccucccuucaagcuacagugauuguuuaaugaacacuguuuucuuucuuuuaauacaaaaacagacugcuucugauguugcuauuaaucccucuuucccgagaguccccaggauugagucccagcuguccgugaucguuaccugugagcugugagcuguaauuugucuuggcagguuaauuaaaaguuuaggccuugcuuuagcaaagucauuauggucccaauauacaauuauaacucuuggguuugcuuaacacacaaaguggaauaugacccuccuuucauuacaugcugaaacacagaucgagaauuuaagaagaccugagaugucagaauucagcguauuuaugucugcuuguaauuaaguaacaggggaaauaauugugucuaacgaaugguugcauuguguauguuuuugcuuuuccccccauuuaauguaaaccagcugauaacucccuaaaucaaauggguuuaucuuuugccuuggaaaaaauaucuaaaagcccuuuccaaacuggauauacaaguauuuccauacagaaaccugauguugacauaauucucacaaaacuggaccuaugccacaaaugugcaugaguaugcacgaacgcaugcaugcacauacacguguguacacucccaccgaaaccaagcuaguuuagaauaaaauauggcaucugcuuucagaaauaauagccuuccccuagcauagggagauuuagaaccagaaaggacuguuucuccccgacucccucaagguggcagcccugcugaccacaaguguuaaggaugucacaggaucccaccugcauggcaaggcauaccaggccagcuaaaggcuaacucaccucuuacaguuugcaaaggauuuuuauauucaucuguugagacuuauacuaacucuggaaggagacaacccuccuacccacugcaaaugaggaaggugagaucuggggaugcugcaagaaaagcuagaugugaucucacgccggccccucuggaagauuuaggcuuucccucuuuuuagcacgggggccuccucaccugggucaaaccuuuguucaagguuuuagauuuaauuuguuuuccacauauucauugguucacuuacucaucaaauaucugaaguacauguagcaugcacugggaaccaugcuuuguccuacauaacugacaacagccuuagacaagaaugugcaugugugugugcaugugugugugugugugugugugugugugucugugagagagagagagagagagagagagagagagagagaacagauaucaaaaaauaauguuggauguuguuccuccgacaaggucuuccugcgcuaacaccccacccccaccccguuuagguuaggcuaauuagccaucaagcccagcccugggauucugaauacgcuacacccaagcuuuuuuuuuuuuuuuuuuuuuuuuuaagauuuauuuauuuauuauauguaaguacauuguagcugucuucagacacuccagaagagggaaucagaucucguuacagaugguugugagccaccaugugguugcugggauuugaacucuggaccuucggaagagcaguugggugcucuuacccacugagccaucucaccagccccacccaagcuuuuuuaugcaaguucugggaguugaacucagauucuggucccugcaagauaaacacuucacucacugaugugucuccccagcuuugaaagagauguuuucccuucaauuuaacuuuauagaugaagaagcugagguuccgagggcuuagaugacuugcccaauguuauaagcaaagccagaaugggaacuugaauucuaaauucccuuggguccccacugugcaagagacucccuauuugucauggauaugauuuaauauuuuauuucuguuuguguucuaugaaucauaacuuuucccuuguuagcuugccuccaauuaucaguaagaaccuuacaucgauccaggaaguuuucuugagaagucauuaaaaagacuauggugaaaaaaaaaucuuacaguaucuaaaacuuuaaaaaugagaauaccuuucccuggguggcuugcugcccugaggccugacagguuagcagcuugguauuuugggucuccagcuagcaacuuauccuucccuuuggguucgugccaaagcauaaaaggacagaucaaccugacaccgcagcgaggcaagccaagcugccaaauaacagagguggccuacgauuuagaaacucaggagaaacgagaaccgcuguuagaaaucacuagccaugggaguuuuuaugaggaacaugcgcuggccuuccuggugcuaauugaaagggcuggucugcuuguuuauuuuugggcagccacuggaaaucagucuguucuauguccaggcauuggaagugguucaacuccuuucuuuccuucuuccaucuuuucuccucacuuucauccauuaucuaaccuugcuuuuuuuuuuuuuuuuuuuuuuuuaccccaugcugaguaccuggagaaaguagcuaggaguuuggauugauggagauggcguucauaugguaaccuccucuaagacaaagaaaagagcaaggaaggccauucugggaggcacagaucaaagggccaagagacaggaauggggaaggguauguccugcugagugguuccagaggcucuuuggcuagaggaacauuuaaucugguccuuaaggcguguguggcuuagucauauuuaaagaaaauagagggcuaguggguuugcucaagagguaaagcauuugcuaccaacccucaugaccugaguuugaucccugagacccacacagugcaaagagaaaacugacucccacgagcuguccucugaucucuauauguucaguauggugccugcauaugcucaggagacagcacacacuacauaaaaacuuacuugaaaagauagauacucauuaacgaagaagaauagaaaguaagugguaagccaucuauuccaaguuguggguauggcaagagcuacagguaggugguuagaaaccuaggaccuggcugagaaacugggcagaagugagucacccaggaaagccuugaaugguaccccaaggaggaagcuaacugcaccaacuaagcauggaaauaggauucuguacauacaaauaaaaugauuagaaccagaagccuuccuucugaguccuacaucgagagccauuuguuuauaugguccagggagguugcugugguuggaggcugugaucuggggcaagggacaucagaggugacagaaggacuguuguaguggcacuaaccguguguucccuggauuuccucuaguuuauugcuuuuuguugcaaggaacacuagguucuugcaccuauauuuuugccucucuacuucaucguaaucaggucccuccaugauuauccaaaguuugcuagaccauagugauucuuucuuccccuugcucugaucaggcaccagccuuugaguguguucacaaggaucuggugauaaaguaguuuguaugaaaaccagcuggugcacuucaaagaagaaaccaagaaagcugauugaaaauucauucugucuguaguaggcuugucuuugcccacccccgucuccuucccuuugaguucuacugucaaggagaaagugagcagugaaaaagcuggcucucuugauacuaaacuagccuucugguaacuggcauugguacuuugcgguauuucuaauggaauuacuccuuuggaacagugccccaugaauuugccuccccagauacagugauucagucagaguauugguaucgugggaugaaaucguaggucaauggacagcucaagucagcuuguuggagaucguggcccaacucuguuuggaggaagagcugggaguaucagaacgcuucacuacugacugaaaaacuagccccacaguagcuuccccuacuccccaaaggcccggcuccccauugcccuauuccugcugcugcucugggugucuuaucacagacaucuggguguucugaaagcucaaagacaggaaagaaaggguaauggaaggaugccaguggcuguccagcagcaguagggucugccugugugggaaggacguaggcauguggcuagugugugaagagcaagaaccaaccguacucaggugccauuucaggggcauugaugucuuccugucacugcuaccccagaugguccagcaguuuggugguuacaucggggacaaggcuccgucuacucuguacucugccagucuuacucugggauuuuguuuucucucuuucuuucuuucuuccuuucuuucuuucuuucuuucuuucuuucuuucuuucuuuuuagauuuauuuauuauuauauguaaguacacuguagcuaucuucagauacuccagaagagggcaucagaucucauuacggauaguugugacccaccaugugguugcugggauuugaacucaggaccuucagaagagcagucagugcucuuaacugcugagccauuuuuccagcccugggauuuuguuuucauaguugcugccucaugggcauaagguagcugcuacacacacacauacacacacacacacacauauauauauauacaacauacauacauaauacauauaugcaaacacacacacacaaacacacacauauauacaaauacacacauauauacaaauacacacacauauacauauacacacauacauguacaaaacacacauacauacacaaacacauauacauaaauacauauauacauacuuacacacacauaugcaaacacacauacauacauauauacacacacaaauacacucacacauauauacaaacacacauauacaaacacacacacauauacaaacaaacagacagacacacgcuuuccuaaaguaagaggcaagccugagaaugccaugagcuaaagccaggacucaucuuccuuucaaucaggaauaaaaaaagauagaggaaaagaagaaagaggaagagguaagaaagcaggacuuccccccaaaccuuguagcuuagcaucccuuccguuaagguguguuuucuggacacucggcccuguaagauugucuggaaugagguucauuuuccuggcugagcaagcguccccaaccugagccugcccccuuacccccagcugaaagacacgcucuuccuucucuacucuccaauccgaugaaguuacccaugggagaggguuuuuucaguagugguuugaucuuugcaacugauggcugggcuuucuguuaucucuucucgcugucaguuacuaaaagcugcuucucuagucuacaagagaugccaguacaucagccaugagagcugucaguaccuuuccucuuucccuucauggugauacugacaaaacguacagccuuuugccuuguaaccccuugugcguauacacuagcuccaggaugaggggcucugcugguacuggcacuggugguggcuagcgaagggggugagaaauaaaagggcagugggacugugccuggagagaugcugugguccagaggaagaacagaggcuugaaucucagccagagaugagaugaauucuagcugccaugugcaggaaucauggggguuuugucuaagagguguggguuuuuuuccuaagucucaggcucaccaaacacuccuauaaaaaccuacaccaggaccccacaaugcugugaaaacaucaauaucuucuuauuuauuuucgucuuuauucauuugcugaguuaucuacacggguaagugcuggagacuuagcagcgaauaaaacaagccuuacccucaaagaaccuacaaucaagagggaaaacugacccuuucaugaguaauuacaccauaacgaggucugcaggaacagagaggcccgugggaguucuugugggcauggaaaggagggcuguccccacugccaagguuguaggaggagcugugaggaacaaagggccacugugaggagcgcugaguaugcuggaaagcacuguguaaauauuuucagcaacucagggccagagcagagguggaaacccagaagaguauaguaguguuuggaggacaugugugggggaugucccaagaccccaguaguuuucugaaucaguagauaacaacaaacucuguaugccuucguguguguguguuugugugugugugugugugugugugugugugugagagagagagagacuaugauagaguuuaauguauaaauuaggcaaugguaauuagcaauaacuacuagagugcuuacaaaagugugcugcaauuaaaguuauugaaagugaucccucucagaacauauuuuaauagauagaagauuuugaaugucuucaucacaaauagaagauuaaugauaugauggauaugugaauuaucuuuguuuaaauacugcacacuauguggacagaacaaagcauuaguauuauauuuugcuauuuuacauugugugugugugugugugugugugugugugugugugugugugugugugaauacauuuguaaaagcaucuccuacucugugcugacuauccucgguugaagaugagugauuggugccacagaaaacaguuuuauaaaaggggaagaaagcugucaccaggaaaaggaaagggagaagaugaggaugcuggcuugcugcggcugccaugacgaaaugcacaggcugaggucuuacauucuuuucuugcugauguggaaagaauugggugcuggcagaauuuguuucugugaggucuuucuugcuggcuuugacuuccuggggcucuuugccugcauaagcacacagaaggccaacggaaugucaccuuguccugagcuugaugccaccuuguccugagcuuauaagacaccuguccugucagacuaaggcccccaaugauacccugacuugaccuuuauugccuccuccuaggccuuccagucccuaucuccaaguaaauccagucauguuggggauaugaacuugggaggggaacacaguucaguccaugacaaggaaaaacuggagacuuaaugagaaacaacugcuugacagacagagaaaaugaccagaaagggccuuugcaacacccaaaagcagauuacaaaauaaggauucuuccacaaugcaaaauaaagcucacacuauugaaaugacuagguauauauuaaauauccagucgcuggggggcugcagccggaauccagguccacaugguccuacuaucugcacuguucuucauuuccuacugauugacacacccaguguaucuaggaaucugggagugaaaagaaaaauaagaugagaaugugugcacccagagaagaaaaugaagucaaggccaaccgggaggggcugugucgaccagcugggaagucuuauuuugaagacaguagggaguauaagguguuuuuuuaggucaaacuguggcacccaauguguccucguggaccuuagacaguggcauauacagagaugcuggauucucagacugacaaagggagaccaacugaaggcugacuguggagccagaaggguugggagaggagagggcccggccuggagcacugccuauaccuuuuccuaaaggagaggaugagcguuacagugucauaggcuguuuucuugaccccuugcauuuuagcguuaaggagaagcacaaaauuuuuaucuucaauauugaaaagaccugaguuucaugcccagagcccauauuaaaaaaaaaaaaaaaaagacaaaagucagaguugguggcaugcauuuauaaucccagcacaggggcagcagaggcagcaggucccugggggcugccuggccaucaagccuagccuaggccauuggcagacccuaccucauaaaacaagguggaagacacuugaggaaugaaagccagggcugucuucuggcuuccauauggauaaacacaaacacauggggggggggggggagaagcgggaagagcugaauggauggaugaaugaaugaaugaaugaaugaaugaaugaaauuugcuaggaggaagagcuaugaagauguucuccauguuagauuugagcugcuaucagacucucagaauggauauuaguugcuggcagguaccaguaaguaggcagcuaaaaaugacaguuuggagauagugcugaacuggagagggaguuccaagagaccucagcaugagggugagaagaggagggaggggaggaaggggagaaguggaggggggaggggagggggcaggguagaauagguaagaaguuagaauuggaaguggggcgggguuaaagauggaagccccaccaaggacagaagacaucugaagagcuugaaguggggaaaguuagggagaacaacuucacgaaagcugcuggaguuggucaauagggaggccucagagggcacccuccgugggagcaguuucuaccccuggugcagggugcaggcagaagcagggucaccacaaguucaggagggaaggaggcagaauggaaacaguuccuucuagacagagcaggcucagagaugauaggcauuaccugaggaggaggcagguugacuggaaagguuuauguaaggugaggggagcccugaggguguugucaguaaugggaaggaagccaggaacgaaagcuggagacccaggaggugaguaauagaagugggggaggcacaggcagaggaugagcggaugagcgcugagcaggcuuggggggggggcgggcagcacaugaggugcugagggaaaaacaggccuaagggugcagaggaggaagauaacagguuggagcuuaucgcugggugacaacccuuucuaguaaggacagccacucugcuugcauccccuucugugugaaaacugccucagugcugaucagcucucaugcaaaggaccaguagagaccccugggcacagaaacuaggaagugcaugcgaguggaugcguuugugcgcagugugcuacuuauuagcaguguggccauggacaagcuguggaacccaccagcuccuagucuccucaucugaaaacugaugguguuagcacccacccaccaccugaggggaaugaugaagagaaacugauauuuguaaaaugcucagaggcaugcccagcaccugagaguguggaguuauuauugggauaguccccagugcugccugcgcucaccagaaaucugagguuggugacaggcagcagcaguuacuauauccucuuacagaugaagagaccaaguuccgagaaaacaacaaacuugccccccuccccccaagcagcauuaggcaggaacagagguacgauuucaacugagauucucagaucuauauaccagccccacccuuugccaaugagcgaacaucccuuccccccccccuccccgucucccucccacugcaugaggaagauaucuaggcuauacugagcucaaggcucucuaauacuuccccaugccacagaguugaguaccaaggaccaccgcuuggggugauggcuccuucagaaucaagcuauaguucagugguggcaacuuugacaaaggcuugagcuggcuccuagugccuaaccagaguucuagaccuucagcgucagugacaggaucacgaggguuaugggaagggcaguagaaaaagugagagccagaacugcccggacaucuguuuucaguuugagcugcugccucuuccugccuuuaucggagcacacucauguuccgggcuaauggaagcacaguuuguuucaguccugguucauauuacaugucagcuugccuuuuuauuuccaucaggugucauaggucaaaagaaucccuuugggguguaagagauggacugcguaguuugaaaauaugagacguggccauaugcaccaaagcaggagggccagcguagugucugccacaaauggcacuugcauuucacaggccuauuaaugcaaggcguuccuuagacagcuugcgucugggauauugauugucuuccuuuuaagggguagaagaagaaaguacaaucuguugagcuuuuccuagugccaaccauuacccugagcguaguggaagaacgucaacucgcuugacuucucaugagcuuguguggucacaauuaguacccuauauuuccaaaaucggaagcuccaggauccuaacccagcaacaucugguugagguugagacucuugcaaauuucagacacuuuuugagggcacuguguccuguacugagagcuggcuucugugugcaaugaguaaugacagcacuucugaugacaauaucgagucacaaaaauacugaaaauagaaagaguggggcaaacagcagcgucaagaacaaggccaauagccaggccuacaccuuuaaucccagcacucgggaggcagaggcagguggauuucugaguucgaggccagccugguccacaaagugaguuccaggacagccaggacuauacagagaaacccugucucaaaaacaaacaaacaaacaaaaagaacaaggccaacguuaaauuucuaguuuaaauaucaaaaagauuccuuaaaaucacuagcaaaaugugauguaucuacuaguagcuguuguuucagaugcuuuggccaauauagggaacaagaaaaauaagagacugaggccaggacacaaaguauccacaaaguauggacacaaaguaguauuuuugugaguguuguguuuauauuuguaaaaugcauaugugucugugcgugcgcacacacauauacacacacaucacuauuugaaaaaaaaaaagcuacuauuuaauaaggaacccaaauuuguaacugagguacagugaacuuuccuaaagucaaaguauuuccaaaauaccugaaagaccacuuggacaauauacuaaaaauauccuacucaagaaaauuaauaaauacuacugugucaucuuaaugagaacuauguaagaccuaugcgauaaaacugcaagguuucacugagcaaugcaaaauagaacaugaauaaugaggacauauugcguguuccuaggcuagcaaaguugaaauauucugagaugacaaucuguagguuugacagaaugcccaagaggaaccuaaagagaacuguagagaucuggcagaauggcuuaaagcuugucuagaguaguagacagaugaaacauagaugagcuauccagaggaagaagagugguaguccauguuaaagaucucaccacaucauaaaucuacaguaauuaaaagagaauagcagccaagcagguuagauggcauaaagcugcagagaaauauuaccaaugaugcaauaaugcgguuuaaaaaaaaaaaaaaaacaacacucacaaaagcaggagucucaagugaguagaggaaaggcgguuuagucaauagauaucaaugggaaaucaggagcuuaagccaguggcucuggagugcuaaggaggggaagggauauggcugauggacacaaaguaguuuuguaacccaaaguauuggccuacuauggacacaaaguaguuuuguaacccacaguauuggcccacuauuuacaagauagauuuuuuuuuccagaaaacucucucuuuguggcuuuccucaugaaaauaggggcuguagaugucacuccguuguuacaaugauuaucuggcaugccugaaacccugguucaguccccaacacuaccuaaccagguguggucugguagcucuugccuguaagaccaacauucaggagguagaggcuuuaagaauguaacggcccaagcuggacagugguggcacacgccuuuaaucccagcacuugggaggcagaggcaggcagauuucugaguuugaggccagccuggucuacagagugaguuccaggacagccagaacuacacagagaaacccuaucucaaaaacaaaaacaaacaaacaaacagacuguaauggcccccaucaucaugaagguguaagagaguacuucaacucuuaccauaggggccccgauugucucucuucagagcacccugcucuucagucuggugguaagagcucucagagccccuaccauuauacuaccugucucugcccauggcaucaacuccuuuucuaaccacuaccgucuaucccagugucccucuggugucccucuggaaccuuucaaagguaugaggaucagaaauucaaggccauccucaccugcacagcgaguucaaggccagccagagauaaaggaggcccugacucaaacaaaacaaaacaggagcugaagagauggcuagucaguuaaggugcucacuccucuggcaaaggacccacguuagcuucccaguaaccagggcagcucauccauauaacuccagcuccuggggacccauagacaccuauaagcaugcgcgcgcgcgcgcgcgugcacgcgcgcacacacacacacacacacacacacacacaccaaaaucuuauaaaggaaaaaacaacaaacaaaaacaaaaaugacacaaacugcuaacuucucugccuggucuccagaagaauuugaacuuuccaccuugaauauagacuuuaguucuuuaugccaaaaauauuccagagaaacaaaagaaagaaaugcuucacaguuaaaccuaaagggagaaaaacaaacacccacccaucucugccucagagaagggcuuuaagcuuuaacauuuauugagaagcugggagugguggcauaugcaugucuuugaucccagcacuggagggugggucagagguagguggaucucugaaaguucaaggccagcuuggucuacagagugaauuauagggcagccagggggcuggugagauggcacagugguuaagaguccuaacugcucuuccgaaggucccaaguucaaaucccagccaccacaugguggcucacacaaccauccauaacggaaucuucuggagugucugaaaacccccacaguguauuuacauauaauaaguaaaucuuuaaacaacaacaacaaaaaaauuguagggcagucagggcuacacggagaaacccugucuugaaaaaccacaaauacauuugcguauacauauauuauagcucauauacuaggaaauggacauuuuauuuuaagaaaauggcuacaguguauguauagaagaauuaaugauuugagagaaagauauaucaaguauguuuccccuuaauaguaauuaaguacaaacuuaaauaauggaguaucaaccucuuuuaaccuugugagcuagagucacuccaaaaaaauaccacuccaccaaggcugugguauaacuccgccugcauuguuacucauuacauuguaaaucacuacagcccuuugggaaaacaaguuggcuguuuguaucaaaccauaaaaguugugaaugucagaggcucaugaaggaauaaacccauaaucagaaaaguugcaugcuuaccacagccuuguuuacaaaugugaaauuuugguaacauuccaaaggcccaguaacagaaagcauugagguagaucaugcuacaucugcuugcuaaacauuaaauggccauuaaaauuuuuuaugaaaagucuaaaauacagggaaaugcuuuaaauauuuggcuccagaaauagggcauaggugugauguuuccaguauaaaccucucuauugauaaggauugaggaaguccaacuugaacucacaucugucaagcccgagagagcaacacuguugcuuucccuacugcaugcucccugcuguggagaccaaguuacugcaucaagugguuggucaggcaggaugcagacacaguaucuaugaggauugaaaccuccaacaauuaggguuuucuuaaaguccuuucucuucaccuuuaacacgacugaucaagugaccauucagaggcccggggaaaagaccuguggcccauuaauaugggcacaccugucucuugagcucucugcagcaccucugucucugucugccgugugugugugugugugugugugugugugugugugugugugugugugugcgcgcgcucguagauauuuuaaauacuuuucuuggugucaguugucccgguuguuucuuaaugaauugcauuaaggaaaagcccaguucccagaagcacaccuucuuucuaaaccagcuuugccugaggugaaaggagagcccccagguggucucuagagcccugcgccugcuguuaccgaacacggaagaaggcuuaguggggauucgcuuuacaaaagugaaucuauuucagagaaucccaagcugugaaaaccugagccuaccuuucuguuuccugcaucacccaugccccaaaccggcuagaacugucugcggugcccagcucacaugacaguaagaaucccuugcguuguucugagcacacggcuuacugaacacagugacauccuguuuucauuuuuguuuuaaucuucacaacacaggaaaguaggacggugcugggauuauugucuguauuucauagacggagcaguuaagguucagaaaagcuaaggcucuuagccgaaagcuuuuugacagccauggucacaucaggugcccgugugagaagagguuuuuuuuuuuuuuuuuuuuuuuuuuuuuuuuuuuuuuuuggaugcuaugcucuuccucgcuuuacuccuagcucagucauugucagcaggcagucacucagugugugucccuugucuccuccuaugugucccacauucugcucuagcuaagcucccuguugugaacugcacccuggaggaucucaaagucuaccaaggaagacaagcuuuguucaggaauguguugcaaugacccagagaggggucagccuggggucuagggcuaugcuaagcaagagaugcuaacccaaucagaaugggggugaggcauggcaccugggcucagacuuccagacgcugagcugagcggguaggugaguggagaggguagagaaaagggcuccaaacagaugccuaaggcugcccaacuucucauaggugaaaggagagucaggauggagaaugaggaugggagacuacaguggucgaagugucagaaaacaugccacguguaaagcugaggaaagagaggacuucagaacaggggggccaaacgcucgugccgaaugcaacagaguccccuaugauaugagccaugguuugaaaacaaacguguaguaaacacacaaggaugaaggaaggaggcaagcgccugcccgacgugucagcagacuuuugugaagcagagguuggcuagaguugggggcacauggugggucaaacaaacagugagaagcggaguccagauaacuucuggaaggggacagggggcgggcgggggugggggggagacagcaaaggcagggagaagacacagcugggaugagagacacagcuaugauucaggggccauugcaagcagucuucuagcuuucuuaccucacacauacaggaaucuaaggcaucuuagaaagaucagggaggcuucaucucuggcagcaggccuagcagggcaggggagaaucacccacagaaaacgggaaguuaguguaagcuaaaugcugaaaauaacauuuguagacccuguuuuugacagccaaacacaugucuucugucugaggaaggagauuauuagaaaaacaaauuauaugagggagugaaaagccccugucgauggugcccgugcgggauuauccccacaaugcaacagucccucugcgcagugagucagcgacugacaggguggcuuuuguucuuaucccgaaacaugaacaggccaggagauuauugggcaucugaguaaaccuuccugcacgugagaaaaagacuaagcaaauaggagaagaagagaaauaaaaagaaugagacagaaacaauaaaauaaagcaagaggggcaagcuccagugacggagacgucaaaggagaagaggcaagaacccaucaagauaguggagaaaagaucucacgcuuaugcguggccucaaaaggcuguucagagaggagaccucuuuacaacagccagcacucaauuuaccuaaaacagcuccuuccagccugcagcuuaaacuguaggaagucucuccugacccugguuucuagcuggcugcccucccuggccuccuuguaucugcauggggagccaaauauucuagcgucuuuuggcuuuaacugggaugccguagaaagcguccccugggugcgugugagaagaaggcugucaggaauggcacucuccaaacaagagcagaacaagagcaaagcagagagcugcacggcaaaccuucagauggccggggcaguagccaccauagcaugagcacucuaaggcaucugcggcugaguacuggggaaugccugccagggccuggagagcagagugacagaaggcccugcaggcacugacacagagguacugccucucugggaucugauagcagcaggaggaaucuguccccugcagugcccgguccauugcuuucuguucucaauacccacaaacccaacaugacuccuaaucacccccaguuuaaauaaacagugagaaagccacagcugucucuggccuuccuaggugcauguagcccuggccacuggugcccaccccuaccuguagagauagaacagcuccaguuauaauaauaauaauaauaauaauaauaauaauaauaauaauaauuucucucaucaugaacagcagcaugaagacauucauggagaacaguuaacagggcacaagggcaggggcaggaaguaagagauuucaugagauaggcccaguggauuagacccuugaaagccaucuuucacaggaauaggaaguugugucuaugaaauaucugucggugcccgagaggucagagcuguagggaagagagaacugagcagccauagugugggcccaucccagugugauguguguccugcagguggaagaaacacgaucucccaugacucaguugugucuuaaaacauauaagccaucucuuuguggagacgacagugugggagcauuaauugcugcuuucccaggcccgcagccaggcucgcucuccccuggagucauaaagccuacacaccugcacgcacacacaguguguugggggcccugaugaagggcagagagcugaggucagccaacagucagcuacaaagaaggguccguggccacuagccgcagcuggucaguuacugaucuaggagcgaugcuuaggucaggaacuuuacacuuacuugaauuugcaguaaaaauacugaaguacugaaaaaaccaagguguggagcagaaaagugacccacucaagguuacccguggguggcaccauggaauuagaggcccagggucuugcucuaaagcccacuaacuuuccacuguacugcauagauuuggcucggcacaaacaugugguuuugcuuuguuugacuuaguuuccuuuaugucccaccacugaagcggccgcagcaaucccuccugagggcugugugugcuguauccucucuacuccacaacugcccagaagauauucagugagaaacccagaauucagagcagcuaguagugagagucagagcugggauuccagucagggcucaucugauggcaucagccaaguucagccuuaaacuggagugcucucuguaugagcaaccaaaugaugcuagagacagggcucugccugaagagcuguggaaugacuagagaaucagcaaagaggcuggggaccuuugcugaccccugggugcuuugggcaaguggaagcaacaaagggcuaaaggaaggcuggcccaccagaggcaauggcaggaugcccaaggcugcucuuuacccaggcacacaaagugcucaccgcagaagcuagagcugcccccaacuucuuccuggauacaaaauagacaguccugccauguagaaggccagccugucaccaggcaggucacaagacaaccuuccucuggaagcaagaccaguaucugaacuacagcccaggacaacagcagcuuaaaguccugcuacugucagaggucaaaaguaaccagaagguucucuacacuuucccagagcagcggcuccuucucaguuccuugugagauguguagcgauuguguuugccaugcggcggugucugccuugaggcagagagaaugagcugucuagguagcugggaaagcuauagaauauugaacauaaaccuauaagcacacggccaugaucucuaauaggauuugguauugagcagaggucuggcuuggccccuggccuauagcuauagauccaaauuauuauacugaguguuaccuaguaauaaguaagaaugauuguucaaaucacugugcgacugaccaacacacauuauaauuauuguaaagaaaaguccaccagaggcagagaaucccgccauccugcuaauuaauuucauguguaauguccuaacagaaguaauucaaggacacaauucauggaaaccauguugacagcuccuacugaaauagaggacugagacccuucugccacgugguuaguuacugcugucuugagagaaaaagguugguuccaugucuagccagauauaauugguccagaggaacagggcugacagugaagccacugguuuggggaaaaguuggcagacugaaaccuuaaaaacaagaagugaacaaggaaucaaggagucuaggccccacagaaaggccauuugcccacgaggucaagacaccagaagacgucaccuaucauuaugcucugcugcuuacaauuuaacaagcacugcuucaggacaaaucauggggcggcagagaaguggggguggaccccugccuucgcagggauuugucgucuacacgggugaaccucggagcuuguaagugacagcacaauagagaccuaagacaagcagaggaugauguacacugacaucaggggacgaggagagccuagccuuucuagaggacaucucaaugcuucagggaagggacaugguauaaauuagguccgggggcuagaguagugcuuggugaucaagagcauuugcugauuuuccagaggaccuggguuuaguucccagcacacacuuuagguggcucaccacugcuauaaccccagcucguaggaucugucacccucuucuagccucugagaaagcccacgcaaguguaacuacgugagauuaaacucacucagacagacacaugcacacguaaauaaacguaaaucuuuuguuguuguuguuguuguuguuguugauccuuuauuuauuuuaugcaugacugcucugcugcauguacacgcaugccagaagagggcacuaguccuuuuauagauggucaugaaccaccgcaugggugcugggaauugaacucaggaccucuaaaggagcagccgcugagccaucuuuaaaauaaaucuuuaaaaaggaauaaacuuagugugagcuaagccaagcaaagacgggauugauagggacuuuuaucagugcuggcuguuccugagaaggcgagugaccucaggaggcaggacuauagggaauaccuggucugcagcgugaugagggcaccaggcagaccguugaggcaaagagaugugcuugaguugauuuugugcggggacuggggagugaacccaggccucaagcaugcugaacacauacucuauagcagagcuagaccccaguccaaacaagguuguguaggaagggcagugggccuugcccugccuaguguuuccuaaaauguagcucucgagauucuguuagaacucaggcuguuucagaaaucaugguuuacuggcuauaauuaggaauagcaagucauuguuucauagugauauuaaauuuucuguuuuaaauaaauuugcuucagaaaaucaacaauucaaagaaaugcucagugaaggauagggcagaugguaugugacugcagcacccaagcaagcagcugugggaggcacuggccccguggccuuugagaaacuugggaccagguaggugacaccagacugggaaacuugagagugcccgugguugaccacagggccuggaccagccauaaacgcaaucagacuucuaccguaucucacugcuucuaguuuuaaaacaaaagccagcauuaagauuuuucccucagaaaucuccucguuggaaaauccuggcaccugauucaaauuuugaaaaacauuguacaauguguccauaggggucccauuggugacgccugcuccagauggugagaaagagacucaacuccagacugacagcucugccugcuacagcagggcugagugaaaauggggagggggcuagagagcgaaggccaggcagaaccgagccagagguaaugcagagguaguggacagcccuaccuuuuaagcaagggauucaguugguuaguuuugggggaauuuuuguuguguguauguguguguuccugugugcacauaagaggagguaggaauguggguuuaccuucccuccuugauggagacaaggucuccuugcugaagccaaacuagcugguccuagagauucuugggauucucuugucugugccucccacucccccaguggagcaucaugggaguuacagacacuugugccagcgugucuggcuugggggguggggugggcaggggggcugaacucagagcaucagguuugcccagcaagcacucuuucccauugaggcuccagagccacccaagcaaagguggguuuuaaaucccgugccaauuaguuguauggaucuuccaacauaacuuuacugaccucagggaagagggagaugugguuuucugugugagcuauaagcagcagagaguggcuuggugccuaaccuaggauaaaugauuggagaauaacuaguaacuccccacucccccaccccacuacacacacacacacacacacacacacacacacacacacacacacacaccucugagucuguuucuguuccugcauuccccguccuggaauaauucaacacaaagugaugcucauuagaugaaaaucucgagccagcagcugagcuuuuaaaaagaugaguucuuaaguaauuugucccaaagaugggcuugacaugaaguuggcagaaugauuagcaggucauugcgugggagcaccaaaaaaagaaaaaaauuaaaaaaauccuggaucuggcucuuggcccccauugagcugcuuagcauuucaaaaggcaaucuacucuggaagcuacucccauggcagauccuggaggugggggagcaggcccuccucuuuggaacugggccacaaguucucuugcauccuuguguagcuagcauccucccgccacuuccggccuguuuucacacgccuggguauaaagugcaguccuugcaggucuuaggcaucagcaccaccugggcuccuaccucuugaccuuugaccuaugacacugaacgcuuaagggguagagcccaggaccucuauguauuaacaaaaagcauugagguggcugacacacaccaaagacugaaaauggcugcacucucgcacucacguaggaacaggcugauauuccuaaggaccucuguaccaggcauacauuuggcauuaggugaguggucaccaaggaguaaacuaacauuuggauguagugaggacgaugaggguguuugcagagaggauuuccuaaugggcaagacugcccugaacauggguggcuccaagccauaauugggggggggggauuaagggaaaaggagagauccagauuucaggugcgagugcucucucucucucucucucucucucucucucucucucucucucucucucuucuggcugccaugauuugaauuguuuugcucacucccucacuaaagauggaaugcuuccuaaaaccaugagccacaauaaacaguucaaagcagaaaacaaacaaacaaacaaacuacccaacacaccuaagugcuuccggagaacaagaaccaggcuuggggguuccuggaaguauucuucugauuagucugauaucugauuggagaaugaguggaucucuguugugucuauauggaauauaccugugagugcuuccugcugccuuuggagccuggaaugauagaacuguuguaaauggucaaaaccccaaacugucuccccuuggaauuuaccaggcugugcaugucuucuaggcagucuugauucgguaacuaagcugaguuuagagguaacaacagugacauuggcaguugugcaggauuccccuuauggaauggggaguagaauaagccaaguuaaauacuagucuagcgcuuggcuucuggaauucaagcaaguucucugcauauucucuucuauaaaaugggggaguguacacuucccuuuucuuaugcgugagggaugcaccugcauauccuauauaagaaaacaggacccuguccucccucuggcuucuuccucagagcuucacccauauacuucccucagcugacagccuggcacccuggacuaacaacacuccuuuuaacuggguccccccuuagccaucauggccuuucuguguccucucuucccauauauuuuuccuuuucugauuuuguuuguuugguugguuugguuugguuuucaugagacagggugucuuguuacccucaaacuuacuauguacccaaggauggcuucgaacuucuggucuuccugccucuaccucccaaaugcuacaauucauucuuaucuuuaaaccucugcacucuccaccaaauaccacauuuccaaucuuuaaaauacauucucaguuuuagacgacauacagucauugcccacuagggcuacaguggaacauggccaugcacggacacaaugugugaucauugucaucagucucucugucgcuccagacacucauaguuucuuugacaaauguugagugcagucaaaguccuuucugccagcuguuuugaaauauaaaauuaauuguugccaaccacaguugccuugucaggccagcaaauguugagaguuacccauccuuucuagucggucccuuguaguucggcuaugaaaaagcaagaaccugauugauccagcagacuacagacugaguccugguagacugagacccagagcaggguucagcuugugaaugggcucuccuugcaugagaugcuuggccuaggccugacaacucuaggcagaggaaggaugaugucaagcagcaugugccugcugcuuuggaaaaauuuugaacgaagcauugguugccagaagcaccugugggugaaagaucccaggaaggaaagcccucucuaaacacugacaauucauguccccuacagaucccuugucccauugcccuggucagucuugucagcacuuggccugccucucaggaucucuuuagcauaugcucucaaucaaagcaggaaagcacacaugucguuuucuuuagggaacauuauggaaccagagugauuagccugcccaugccaccugagaaagccauugccaacaaggccaggaacaaaggccaggcucaucgagaggcagccagugagugcagaguuccaguggauuguagagcugcccugaaagaagcaaauguccuuuccacccucaaacuacaaacaucaggauggcuuucucggccuuuucauugacuuguauaguguccaaaguagugccaucuggauuugacucacagggucucaaaggcuagacuuaacaaaccaucucagcugucaccuucucuagaacaccuccuaagccagagaaaagacuugcugagccaauucaauaaaugcuggaaauuaaaagaaagggccugagacaggaagaggcuuggucaagguuacuaaaaacucugauggcaggaagagagcccaaguuucuugcucuguccaagcguguuccuuguacaaugguucaugccauaaguuucaggcuuuauccuuaaucccucauucaaaggaucccacucgucauuaguauauccuucccuuaaauauaucuagagauugaaaauguuugaccuuguucuagcuucuuucuguugcuauaauaaaggccaugacaaaaagcaacauagggaggaaugggcuuauuggccuacagguuacaucacugauggggagccgaccaccuacucaggguuggagcuaaccacagcgagcugaccucucuugaaucaaucacuaaucaagaaagugucccccagcuaugcccacaggccaaugugaugaaggcaaguucucaauuaagguucacucuucccaggugacuaguuugugucacguuggcacaaacuaacaggcacaggccuuaagccauucauuuaguccuuuggcuaucgagcauucagccaaccccagcuuuguaucaaggaugauaucauuuacuaucaauugaaaggugauguguacucaucccgccuucaguccucaguaguuagauauuuucacauaaguagaauacaacccaaucgagcagguaguguucuucucugacacuuacaaagguaguucuuccaaagacucuagagcguccuuccucacuggcuaagucaaagcaagucuccuuccuguuucacguaacguauguuuuuggaacacaggucauacugccugagcccaguucucaaucccuucgagaaccucuuccuugcaauguagcuccugauccacucaucuuccuccuugcuccuccacggucaugccccaguuuaucuuaucucuucaauguggcugccagaugugaacgucugaacucuaaauacaaucugagaaugcagugaagucugacagacugcacugccuucauucugagugcugcccagguagaagagagggucuuucucuacugacugcuuaccuacgcucuccagccuugucacugccuuccuuagucucugacccccauccccuccccauccuucuccccguccuucucccccucucccacaucguguuccugcuuaguugucauacaguaagcauuguugaccaucucgguuuguguuuagcccucaccagacucuuugggagaccagaugugaugucugucuuuaaggaccucaccaucuugcuaauggaauuuguccccccaccucccacucccugcaaagaaauaaugagugaagaaccaagacacauagaauccagggaauaccgucugcuagacguuuuccuccucagagcaucucuguagugguuugguagacuucuggguuugacugaaaacaggucucccagcucaaaugccagcguggagcuggcauccagcccaggcugucacggggcucugucaaauuuuugucauuguguugaccuagacggcugcagacugaagaccuuugaguuccaucaucugcaaagaaagcuggggugccuacagggacugacaccucacaggccacaggacagcuuuccagcaccuggcgccugcccagcgccaauccagaaagcacaggaggaaaguucuuuuagguguuggcacgagugugccagagucggggcuucggggagacgacagguuuaauuugcuuugacagugcuuuccccgggagaaaauucaccccgacaccccgcccccugcacaccaggaacucggcuuguuugcguucucauuuuuaccacggggaguuucuguauguuuugcauguguguguguuuacccccaauaacccacaucuccuuauuuggauucauuagaccaacugaguguuuuguuguaguucacaaauggaagacaugugugaaucuuagagccuaaagaccagcucugcuagguucugggccagccacuuuacaugcacaacauggcccuguuuguuauucucugugauagcucucugggguagaugcuguuacuaaccccacuucacaaauaagguuggagagaugccauuccccaaagacacuuaggucauaagggacagccugguuccaaacuccauguuuggcccaggccauacagcaguucccaggaccugauucacuuaccagagucacagucuuagccaugugaacucgagcuaguaacuuuagcuuccagucuccauuaagucucuaaaauaacugagcaugacaccuauuuuguaauuauuauaaggcuugagucagacugucugguuauguguuuguagguucauuuaaaaggaugaggagagucucucagaguccucccucaaccuggacuuaagguugaguuaaauaguauuguggcuguuuugugucugcuuuugguuguuuuaucauaaacagagcucagucuuugucaggaauagaggcgaugcagcagguguaaaucucacuagcuaaagucaagagcaugucuuaggguccaucuuguucacagcauuagcugucaucaucugaaacggcagccagaagcagucaucagacgauuggaccacugucugggugucaggcagaccucauuuccucagccaaguucucucaaguuucuggcaccuaccuuuacaacuuacggagagacauagaaguaggaagaaaauggaaguaaccacaggcucagacacaucacagagacaacguggaacuaaggaugcagagagauccucuucguccuuggugaaggauccaacacaguucuccuagggucacagggguuugccugcucagacugggaucucaagcaaaugugcccguugugccuauacaugguugauuuggcagaggagaugaccccugcccuuccaucaugauggcucugggaaacaggaggcuccugaguuguucucguuaucuuccagccaauaguucccuuggugagccuggaagagcaagcuuuggggguuuguuuuuguuuuuguuuuucgagaaaagguugcucuguguagcccuggcugucuuggaacucacucuguagaccaggcuggccucgaacucacagggauccuccuaccucugccuccugagugcugggauuaaaaguuuucgccaccacugcccaguggcuuuuggggcuuuagaaaacagaaaaauagaaagaacaaaugcaggcaggacuucuaaagcaucugccuucaaaggacgucagugucacaugugaccuacuucuccuuaacauagccaugucaaggauuuaguuccaguaagaagucaucaguagacagaaugagcccugcagugaaauacccacguccuugugacuaaugcccuccaaaaucuccuugcugggggugaggggaagggacacuuuuucuuuucuuuccucugaaggugcccauuggugucuucagcaauguuguguuccacauccacaggauauucccacucacagcccauguccagaggaaaagcaaggaaaccuuuaagcuucacauuccaagacugaugggagggaaaacaaauuccugaaagucaccauuccuaucagggcccacugcucugacagaaaaacaaaaaagccaaggcagaaaaggccggcauuuuccaguuuacccuacacucaauuaugaaaaucaguuacucacgggcaguugaauucuuaauuccaauucaggcagauuggaaggugcaccgucuacuaagcaaaagcagcuggagugggaacuuuaagcagagcaaaaagaacgcaggggcagagacucgcccagcacugauugggaacauacacaagguuuaugaaaucaaggucacacuucucaagaccccagaguugagcacagagauaucuagguggucaguggagacuugauauccaugggaucuuaaccuuuuuuuuuaaacugcauuuuagaaaaauguguguuucuguuuugucugccuguguauguguacuuuauucaugcagugcccacagaagccagaagagggcaucggaucccuuagaaucagaguuauggauggcuguaagccaucaugugagugcugagaacugaacucagguccucggccagagcaucaaguaaccuuaaccacugagcucucucuccagcuccauauucaugggaucucaggucaagcccagguugcuaaaguuccuuuauauggaagaaauucuauccacauaaacauuuuaucaaaagcaaaauauucuccagauggcucccuucccuuucacauugccaucuucaaauuauuuucuuaaaacucuguuucuuaaaacuaugccuuccccaaaacuaacagcccaggacaaauccuugagaagccaggcuucuguucugucagauuuagccgcugacacuagacugugucccagaaaaaaaaauguguuuuccucacuuuggccacuacggaggacuuuuggcaggugagaagcagguuugaggcuugcagacuucguaaaucagucuugaaaguguaugggagccaucugcaaguggauccugcugaguacagcuaguugucagugucuauuggagggauaccugugccuucagcugagaaggacugagcggaagcauuuuagagcuggaagaccaucgagugaaugcuuccagcgauagcaucaagaguaggcugagacccuucuguggauucgauuccaggguaaauacgcaaaugaauaacguccguuucuaaacuccaagguucauggucaacaacguugaggauaugguguuuccauagugauaaggacuuggucugcuuacgcugccaaaaagucuucucagagauuagggcuuuagaauuagcucuggaagaaggaacagaaguugcaaacagggacagcugcugugggaagaaugaucacagaggagcuaagaaaaggaaggcccaccacgcccauggcccccagccauugcagagcacaaggagacccagaaaccagcccucugccucucugugcugggcuccugcaccagggcuggaggaggcggcccucccacgguacaguguacgguagcuuaaagggaaagucaccuggccuugaacuuuacucagacucuuggauuuuaaaacaaaauucagaauggaauucccugagugacguuuauuuagaaauguauuuaggaagccaguacugauguaaacaccucgggacgugggccuuuccaggcgaagagaugcucagaacccacaagucucacucacucacaacccagacagcucacuuagcccuggagggaggccacauguuggaguggugucucuuacucaaguucaggcaguucuagaauguucuccccucccacuggccccuuugcugccuucacuggugacccugcugucccagaagccugccuugcucagccccuggcuucugcucucgggugaaucccuacaaggccuagagaagaugccucauggacuaaggaucaaacucggggcuucugugagagcggugugugcucuuagccucugagccucccuccagcccugaggaagcccuuuccauccauaccucccguuccucuucugggucccaggcuauugcucaagcccucucccccagucguugcccuuguacaucccagagcacucugcggcauuuauguuuugaugcccucgcauuccaacuaaucucacuauaauuccugcuauuuuagaacaggaagcaguccccgggagucacuugugccaucgccuucaucauagagagcagaaaagcaggguucagagagggaaagaaaguugguuuuggucauacuggaagacuggagcccaauacaugcccccuuauccucagggagaauguuuuuuuucucugccaugcugcugaccaaaugacaagucacuugucacuguucaagucugaaauggcauugucacuuuuauagaugcuuuuauuauuauuauuauuuaguuguucguucugagaauaauuuaaauaauauauguggaggguguguacauaugaaugcaguaccuauaggggccagaagagggcaccagauccuccggagcugcagggacaggcaguuaggagcuugugaguacuaggaaccaagcaguagcccucugaaacgcuacuucaugcucuucaccacugaggcugagccaucucuucaucccccagucuuggucucuugauggacuccugugagcuacggcaaacugauuccucaguucuuuuugcacucccgacucuaacucuucuccucuacauuaacucuuacucucccagcucacucugcgaccuugggaaccgaugcccauccucuagguuucuuuucuguuaagugagcacauugagcuuaguggugauuuggaauccuuuaaccucugaaaguucuagaauucucugcccuucauucguuucccugccucucagggcauugcuucagggcccuggcuucugcugugacgggaguuccugcaggcucuaaagaguauggcaucauggaaggaugcuaaguuuggaggccaaaagccuguguucaaauuuugccucuguaauuaguagcuguggccuccugcaaauuguuuuaucucucuuggcugcguuuucuuucuaaugaaaugggaacaaccauacuuauacuugucagauauggugacaucagagagguuuauggaacuccauggccccaagccgguguucucggcauaauuguaucucuguccuguaucccacauuauugacaaaugacgacuucuguaaauacucuauuuaguaauuagagcaacaaacugcuuaaaauuuuuuuuauuaaaaucuuucugaaauccauugugcuuccuugacaugucacgcagaguauuugucagagggacucggggagucagaggaaguuaacaguccaucuccauggcugggcauggggcugaguggggagagaaggaaaggaauaugugccuuucggcagagcauggauuucucccgcagucagugaggacuauugaagagcucuuauuagcagagucacagcaucagguucaccucacagagaucaaucaggcugucgggugaauaaaucagcgaguggagaaugcuaaacgcucacccacagacugccauagaagagccagccggggaggggggaggggggagggggaggaggagaagaaagggggaggggaggcuggauggauucauggaaaacagagccagaugaaggcucacuugugcgcucaugcgauggaacuacagauaaccaccgcucgcaggucauaccgcuuccucccaacuguguguggcugcagcacugacacauaacaaagaagauccguuugagccgggcaugguggcgcacgccuuuaaucccagcacuugggaggcagaggcaggcagauuucugaguucgaggccagccuggucuacagagugaguuccaggacagccagagcuacacagagaaacccugucucaaaaaacaaaaaacaaaaaacaaaaaaaaagaagaagaagaagauccguuugguuuauaaaugcucggagacugacgaggugacucaguagauagagcgcgugccuaccauacacaaagccuugggucccauccucaguacuucauggaguggguugagguuaugcacgucugugaucccaagauugagacaggaggauccaaacuucaaaguuaucuuccauuacacagcaaauucaaagucacccuggacugcuugaguccugucuuaaaaaaaaagaaagaaagaaagaaagaaagaaagaaagaaagaaagaaagaaagaaagaaagaagaaggaaggaaggaaggaaggaaggaaggaagaaagaaagaaagaaagaaagaaagaaagaaagaaagaaagaaagaaagaaagaaagaaagaaagaaagggaaaggaaaggaaaggaaaggaaaggaaaggaaaggaaaggaaaggaaaggaaaggaaaggaaaagaaaaaacaaaaaguaugugugcauguuugaccccgggcucuguagcaugaagccaucuacacuuucagcucucccucucuucucuuccagaaucaguggauaacugccccagcaacugcuaugguaacggugacugcauuuccgggaccugccacugcuuccuggguuuucugggcccugacuguggccgagguaagcauucacaugagcauagugguaacugcuucccagacccuauggcuagcuggggugcacaucucaaaaggaacuuaggacucacgcugccuccucauguacccaagaaauacuacaagagcaauucuucaguggccugacaaaggcaguuuggcagguagagagagccaaguccugucagucuuuguuauccagcuauggguaacacacauggacaggucaggacuggaaggaccguguuccuuccugggguacugagggaggcaaugagggacccuuugagaaguugauucccucuuuaaagggaccaucagccucugucaagcaccuucuccgcccuuccucucuggccuguggaugggaagcauauggaaccccuuccacuucuacacaacccagacagaaucucagcuaagacaccagcagauccuggaggccuggcauagcuucucacacaccauauauacugcuaaagacagcaacaaauucugagaugaccugaaggcuaccugagaccuacugugugcuuugggccuucauuucuguucuagaaacaugaagaaggaaacaucuugagaucugugguccugagaauuugauauuccccagagaaagcccaaaauggccucuugucuggguuucuccaucucucuacccagaaaccucuggcuuuggguccauuuaggaguuguccugugcucgauacuaggcuuaucccacugcccaggccuggugcucucaggccauucugagagaguaaaccaucuguuauaaaacagcauuagaauaccuggaauagaggcagcaagguuaaguguggcugucuuugcuaggcaggcagaauauccacucagaaagguggagaagaaaugggguagaaccagagucuaaggcuuguggaauucaagaacaaaagucagaaaugauuuccaaggccaagggaauagcauccuacaaaucccuccuaggguguagugcuggagacuccgccuacuuuagcuacuaugaaauaggcuugcccugagacugccaagcugggaagcacagcgauugccugcugaguguucuaaaaagaaaagacaccagguggggcccagcaaaggaagugcagagagagccuagucauuccuucuaaggagaauuaccaucucaucucagacgcaugcacuccagguuaagagucauguauaaaacagccuuauuguauucaccgugagacaggugagcacuuguaccacaaugcaauauagcuuauuuuuagauaguacccuucauagagaugaucccaaaaccuugauacuaagagacagaauggaaagauacuucaaagagcuaaguugggcucagcucuuuuuguuggagggcugugauguaagaggcuggaauggggaccuggaagacaagggaagcagaagccaggguuaaagacaacaguuaguggugaugcagugggggggguggggggggaguggugacaacagagggcuaucaggagagugccgggagaggcaaagcaggcagccaggagccccagauacuaucuuuucuacugauaauaagaaacagauggcaguuuccuuucugaagcuccuggcagccagggcgcuccaucugaaucagaggaggccagagaagccagcagcaccccgugccagcccccagccgcaugccacacaccuucucuuccaaccccagaggugcuuaagcugcaaugaaccaucgcaggggaagugggugauggguacacaggggaguucacuaccaaucaaccggugugaucagccgagcggaggggagaagagaagagacacccaugacagggugcugggaagcgacucacccaggcuuuugguacugucucuucagcauccugucccgugcugugcagugggaacggccaguacaugaagggcaggugccugugccacaguggcuggaagggugccgaaugugacgugccuaccaaccaguguauugacguggccugcagcagucauggcaccugcaucaugggcaccugcaucugcaaccccggcuacaagggcgagagcugcgaggaaggugagauucagccagccugccucuaagguagaggccaaccugcucuguggaauggcuuucaaagacuccugcuuugaaaucugacagagcucugaguccuagcuccaucuccuccauaaagccaggcuaccuuccccagggggccacugugagggcugaacgaaauagcccauaucaagcacuuaguucgguggcugacaccuaguaaaugcuccauaacuguggcucuuauaucaguagcguuauucggggacagccaggcuucggccuccuucacccaggguuuggaaauggaugggcuuuaccguuugcagccgaugggcaauggauacacuugcuaccaccuccuauuuccuaccagccagcaccgaggcuccuuccccaguggggcagagagguuccgaggaaggcuagucuucuaaacccacuuaguaugugacagagagccugcauuuacagcaccauuuucucuuaaaagagagaauguuaacagaccuaaaguaagaagccaggcgggaucaaugucugaaaggcauuuccugucucuguuacuuauagcccuucagugagccacugaguacuggugcagaccuuagcuuuggaggugccgguagcuguugaaggaagauggcagccugcaggacaugaggaucuuccuuaauucccuuuccuuaaaucacgugaggugaagacccugcgcagaagggucuaguaggagagauuccuauuagaacagugggauguuucaccugagcauguccauguggcauucuccagacagaaggacacuggacaguggcccacggcugugggauauuuuuuuucaaagagaaagaaguaacguuuagagcucugauuuacguuauccauuugaaaugaaguguuccuccuccuguucuccuuucugaagagggccaucugggacugaucucuuuuauuauuucucguucucugcuaaaacguguuuguacagucucauguuuauaauaauguuuugggggccuccuuccucccuccuccucccccuccucccugggcuccacggcuaacggguuucccguuuauaaaacaucagcuaacaagcuuacuuuuuuucucucucucuuccuucugaaguuuauagcuccauauuuuuuuuaaagccugagagaaggcaaaggcaggaggcuugaagggggaccaggggaggggcaggagagugcagacucagaucuuuuggagugaaaagugagacuacgcugccuucccaguccugaagggcaucuaguggcuuguguggucacugaagcauggagcauuuggggguugggguaguagggagccuguguuugcagccuggccgugugggcaccguccuccauuaaugagcuaagcuucugcaaggaauuuuggcucugugaaagagaaaagggggacugucugguaugccuucuagaaagaaucuaaaccaaguuagcccaccucccaagcaccuacucccucgcaggccugcugguaccuccugcauuacacauagcucccaggagauaacccauguucaugaggcugucucggugugagggaagaagagaguuuuauccuuggaacuauccugucacccacaggcccaggaggaggcagacccaggccacucaaagccuccuuggcagaaggcuacuguagcacagguaacagcccucaguugaggaucagagcucagggccaauggcauucaucaagucuagcccgggugccaggagcuccuugucccugucacacggaacucugugagcuucccuaugcuucucaggucaccuggaagcauggagaccagauucuuaaagagaaggccucucauuagcucaucuuagucuuuauucuccugagacuaugggguucccuuugcugguuccccggucccucuguguaugaaaggacaggucugcaaugacaaguacacuucaccaaaacugauacccucccaggcugcacucaagcauuggauguguacaggauccacccugagggcacccugggcuccucggaagcagggucagcccaaagcuggggccaggcauucacaggaugggaaaugcuuuccuaggucucuucguaggauuugccaaguuguuugcugucaaguuggaaagcucucugaaccaagggaauugccacaguagucuaaugggcuggaauaauccuucugcgguuccgggaucugaggcccgucaugagaauuuaucacugcuguugucuuuauuauuuuuaauuaccugaauuucagcaggucaugcuuuagccguuguuaaauggugucuggagaccauaagagaagagucauuugccuucguugggccuuauuaaucccccacacuguccuguuuccuucccuguuuugauuuggcuucuauuuuuaaaccacuucauguguuuaugugagcauauaugcgcaaauguauuuuugaaccagucagauuauaagagaaaauagcaagcaaucuagacaggagagagaggaugaaauguaaauuccuucugugcugccuuggaaaaauuauuuaaugaaaauaauagauuaaauagagcuacauaaaaggcuuaauagccaagaguagcacagacaagcuucuaaaugagugacaacuuuugcuacugucauuacugugauuuuagaagcuaguuacucuuggucccuuggccuucucacuuaccacugagauugccaaguaaaauuccuuuuaaaaaugagguggcaaaagagcuggcuccacagucugguccucaaaacaaauaucccagaaugcucucuuucauaaagucucggccccuuugugccugugacucuuuuauacccagaccagguuuccaggucuggguauaaaagucaaauauucuggauuauaaaugaaauuaguuaauacauuugaauguuugaauuauagacaaacacauaguuugcauaagccucacuacucaaaguccugagaggauguaaaaauaacccucuuugaugcuauaguucauauagucucuucugacccucacugucacugcuggcuccuuguagcagucagaaugguagggauucuugacggugucuguuucauaguuagaaagcucagagcuucuauuuaaugaagaauucuaucuuaauacaauaaagcagaaaacaguagaggaaggcacccagcaucuugccagcaucuugcucuuagucgacuuguauauacauacaacacacacagagagagaugugcucacucacacacaugugcacaauugggugcauacacacauacgcauuagaggaaaauccuuucugaucgauuuuaucuguguguccuucugaacccuaguucccccaucugagacuccuccucccucguugcaguuuuugcaaacaugguaggcucugggugccaugcugaugcuuguuggacauuaauacucaguuuaccucacaagccaaagggcagggacuuguagccacauuuuucaggugacgaaacagucuuggagaacugggaacucagguccaccauucacugaaauccuacucuuuacugaaccuguuaccuccccuaguggacagauuaacaguguuguccuucccaagagucucacacugcugucccaauacucacuguaccaucuuccuucccugucacaguggacugcauggaccccacauguuccagcaggggugucugugucagaggcgagugccacugcucugugggauggggaggcaccaacugcgagacacccagggccacaugcuuggaccagugcucaggccacggaaccuuccucccagacacaggacuuugcaacugugacccaagcuggacuggacacgacuguuccauugguaaauaccggggaaaggguuggcgaggguggaggguggguucgacuguuacaauuuaaccuuucagcacugguggggguguggcccuaacugcaaacuccuccugcuguggacucauuuccucuuccuugcccuuacauucuaaucuuugaugccuuuccucuuggugagcagauaauuuaaaaacuuacacccuccccuuguucagccuugggauucuaaacuguguuguacugggcauuucugcauagcucuaaccagaaugaugagagaaugaauucaaggaggaaagauucgugucggaucacaguuuuucagaaaguucuuuccaggauugcuuagggcaugccaucuuuuguagagcaagagccaggagggaggaggcggggauacucacaggguguguccacaguggcaguguugauuacuugccugguuguugugacaaaauacauagucagggagccugaagaagaagugaggacaggcuauaaacccccaggcccacccacaaugacacacuacuuccauuaaggcucuaccucuuagaggccccacaaccugcucaaauagcacaacuagcuaggggcacaggaugcuaacaccugugccuuuggcagacacauucaaaccauagcagugaccugcugccuccagcuguguuccagcucuccaggcuuccagaacaucccaaaguaucaucaccagauaagggcaaagcguguagcauaagagccugugaggaacauucaaugugaaaugauagcaagugucguuuaucaacacugacaguagcgccuaugauuccagauguguuuuacugagacuuaucuagugcaaggccacaagggggccugagagagcuacaagaauaggggucauggggaagcaccugcccugccaggcuguccuuuuagcucuguccuuuccucagaaugaaagaugagcucaguauggauuuuaagguccucugaaaucugccccccaauucuuuucuggcuuagugcuuauacuggacagcaauuaccaugguuaugcuguagcaagugugucuguuaguggauacaaucccaggacucaacauaggccuggccuacuacaccugcuugguaaagacagauggacagaaggauagauaaugaauggacagacaggcagauggauggauggauagauaaugaauggacagacagacggaugaauggauagauggaugggcaggcagacagccacaugauagggcauccgguucuacaaagaauaauacauuaccaaccuucucucuauaagcaccgcccuguuuagacccgcaaaagaggauuaaaugagaacacacuuggacuaccuuguacaguauuguuaccaguaggcuuuauacacaucuaacaagucauuuacucaauacaaaccccuugaaagaaacuaaucagcaucccccuuuccaauucacaccacacuuuagcacaccuacuguguaauggguacgauuuuuagcuagauaugacagagagauaggaaagugcccgcuuggcagugcacgaauucugcgaaguggagaaaggagacuuaccucaaaucacuguccaaccaaccgcuccacacugcaaagcucaaaccagcucauuaugguauagauuaacaguucugaucaugaucaagagagauggcuuugaccuuuuucuaaaaugagacccaugccgcauucaugccuuuagaauaccuugaauuaccuuucgugcugaauggagaauugcuguucaaugcacugucuaaauuggacuuuuaucccuguuugcaaagcucacguaaagacaugauugugagcacagaugugcagagucucaggaauaauucucuuuauauagcucuguuuauugcaauauaauaaaugguccucuuaaagccacgcugccuuguauuguucauuauguggccgaaaagcuaauuuacgaugggucuauaacccgagucuugcacuguuaaaccccaaugaaacuccacagccggggggagguagagauagcuucagcugagcuuucugagugcucuucaguugucugugaauacaaugaugacaaacccgagagaaggggguuagagagauggcucaguaggcaaaugcugugcaagcaugaggauuugaagccaauccccagcacuccuguaaaaugccaggugcuacauuaugaaucuguaaccccagcacugggcggggggagggggcgugggggggggggcuggagagggagggcauagacaggugaaucccaagggcacucuagccagccagugcagcagaaucagugagcuccagguccaguuagaaauugcgucucaaaaacuaaauguugaaagccaucaagggagaaagacaauauugaucucugaccucuguauucauucucaugcuuguguguguguacuaccuccacaccugugcauacacacacacacacacacacacacacacacacacacacacacaggauucauuugaucucauccuccuuagucauagguccauccuuguggcuauagcugaugucagacauguauguggacucaugcagaaagacauaggagaguccugugcuggggagaaacccugaagcagauagaucuggguucaaauccuggccaagcuacuuagucguuauaauuuuagaccaauugcaucaaccuguucuaccaaaauaaauggagacagugugauaagaagcaggcuaaaccuugaacccagggcuggugucugagucucaugguccugacucaccagugugugaaaugagcaauagccacccuaggucuuauuauaggcaugcagaggauucugugcucaccaucaucucuagcuuccaugacucuguguguguguguguguguguguguguguguguguguguguguguguguaugugugaauaugugucuguguaucugaguggguaugugccuguguaucugugaguauguguguuugguuuugugucugugugugagaguguguauguaccucucucucucucucucucucugugugugugugugugugugugugugugugugugugugugugugugugcauaucugugugagugaaugugaguacugucuccuuggcugucacuucagcucuggaagccaguacuucugcuacaggcuacuguauggcaucggcagggcacguaacuuuacuucaguucccuuaucuaaaaauacagagacacuaacaugcaucugcgugagauaugucaccauuaaauuaagucagugugcacacagauagcaauacucaucccacacuaugcacgugauaucucuccguaaccucacuuccaaggguucuuucacugagaggagccauucaaaaacuauuugugaggccaagcaagggaggccucauuuccugaacccacgguagccaagaaguucauguucagggaccucuuuagagagcuguggccucugucugucacagagccauaauggaaaaccuuguugccuagagcagcuucagcaaguggcuuaacccuuucagcccuugguuuucuccuacauucacuuacccuacaggccuggcacagugcuuccugugucauuugugacuccugcuuccugacacaugagguaggcacaaauacugcccagucuucaucaggagauucaggccagugggcuuauccuacacaauccuuguaccauuagagguacggacugcagguugauggguugacaaagauggccacaucugccaccuccuaggagaagaaccugucuccuccgugaugagugucuaguuccaagaacaggauuuaaugaagguagcuuaaaccaacacauccuguaaugaaaugugagcugggaggguccucagcacucucauaggguaucuuauacaaguguuuacuuaggucccugcuugucagcaccuuggcuucuggccccaucucagaaccuucuccuccaauccaggcucauccauguggugcuccuuccugacaagccagacaaggcaacuggagacagagucucagaggcgacaagguccaaucucucaccuucagcacgugugucuuuagcucugggcccaacaguaugucacuggcuaaaucauauugcuggugguaaggggauaugaucucuaccaguuuuauagaacggcuggacuuugggaaggagaaaugucuugcccugcuuagagacagaguuuaaauuaaaucugggcccucuguaccuaacucuucaucuccugccuuagauacucuucccaucaaaaagaggucuccuugccaguaucugccuccuuaugacaagcaguaguauagaaaguuuauuuauaaggccaucucuuucuuugugcucauuucauaccagccacugagcuuuaaguuggccaggauucguaagaucccugcaaagguaauugugauauugagugugauguugaguacaggugaaucuagaauagucaugaaaaugaaccucuggauauaucugugagggaguuucuagaguaggucaacugaggcaggaagacccgcccuaagugugagcccaccacuccauaggcuggauuuccuagacuguguuaaaaggggaaagcugucugaguaccagcaugcauuauguccuguuuccugacugaagauguugugugaccagcuagcuaccucaagucauuguugcuaagcucccauuaacguaauagacugcaccuuuggacuguaagccuaaacaaacccuuccugcccuaaacuacuuuugguagguuauuuugucuuaucaacaauaaauaacaaauauacuaguguuacuguuaauaacacugcuggaugaggaagcacaaagcuaggaaggauuuuaucaguacucacccuguuguuuagugaagggcacuaucacggaccccauuccucuugguuccauacccuccuggacaaggaccugcaucggcuuaccccucccaagcucucucccaggggagcagccuucacacaaagcagguacacaccuggccugugcccgaccucuucucccuguauuuuaccugguuuuucuuuugcucaaaguaaaagggggaggaaauuuaacuucuuuaauacaguucuuaaaauugucaaagcacacuuuucuuucagagucuacaggcuucuaaaaacaauucaggcucuuuggcacuggguaggcaccagcugccccaggccaaguucuucuugggucuugguucccgcucucuccccagagccucgcuccucuuucccccugcucagcaaacuuucucccaucuuaucgccuauaaauggcuuuuauuucagcggaggcugucgcugcguuuuaucccucuguguggcuggcucgcagaagcaguacauggcagagucuugccugcagaaugcucaugcugguaguuuaugauucuugucauuuaauugcacuugaguuucauggaauaacagguggagaugcauuggaaauugaguggcauggguuugaaggcagaaugugccaucaguaaaaucaugugggauugggaauaggaccaggcucuauggucaagccucaaccuacccauuaauacuccuaauaauagcuucccuuacagaacuguuuccaaauauauuugagugcaugugcauaaauugcccaguaugguggcuugcauucaguaugcacuuaauaaggaaacaugagaacuuuuauuugcuaggcauaauuaggucuaaauuaaccaagcaguucuuaaccucaaacaaauucaaguuuaggggagaguuuauaugguccucacauuggagucagucucuucucugaauaguagcuuccuaaacucccuaccagacagcaucacagagcagcuccaggccugcauccaguccagagcuugcacacaguccugacagucuuccccauguguccugugucacagcuaaggauccaagaaccuugcuauccacucagguuccagccaccaugcaugcagucugcuaagaacucuagucagugugcaugaagguuagaaagugaugaacuuggcgaggagaugacccagaaaagucaucaccaaggaaucuccagagccauuagaaggaaggaaacugaacagagacuacuuggcacccaagaaagaaaccacacaugcauccaugaagagccuucuguaagccugguggugaaguuguucuacacucucacuagagaggaggagcgcuggggcagagggcagggagugaagcaggggcacaggcaggguccaauucuacgggcucacugaauaccuuaccaauuuuuggauuagaggccagggauacaggucagugagacacuugguacacgaucgugaggacccaaguucaagcaccaccacacauaaaaagcuaaguguaugcuuccuacauggaagagcacaggccaacacugguuggcugacuuucuugucuagaugaacggucuuauuguacacaaugacuuuuaccuguagcaaauuucaaggaugcugcgcuguuccaaagcugcuaucucacuucacugugucauggaaagaaauggaagcuaaguguuacuucuccuguuuuagagagaaaugaguagaacuauaaagaguucgccacuuuucuccacaucuucuugaguauccacuacauuaggaugugugaaauauuagcuaucuuccacagccuccaaaaugucuuguugguaaaugucuccgugucuucccuuacuacuauguacaacaacuuaaauaaaucaaacaaccugauaguugucagaaaaaaaaaaaaaaagcuaaguguagcagccugcacaugucgccuuagcaccggagaggcagacacagguauguguggggcucucuggccagccuaaccuaauuggcuaagcuaaacuaacccagaucuuagugagaggacuugucuuuaaaaacaaggcggggggggggggggaggcuccugaaaaacgacacacaaaggugaccucugacuuccacacaugcaugcacaugcauggccuaguaccuacuuguauacacacacacacacacacacacacacacacacaccccaucaucaucaucaucaucaucaucaucauauaugcacacaaauccuggauuaaauucuuucaauguaccuggaccauuuucuuugcucuccuaucuaucuggccuagguccuuucugaauuuggauggaaacuuuccagaacccagauucagauucucuaagaucccauucucuucucuucucuucucuucucuucucuucucuucucuucucuucucuucucuucucuucucuucucuucucuucucuccucuccucuccucuccucuccucuccucuccucuccucuccucuccucucuucucuucucuucucuucccucucucucucuuuuuccuuccuuccuuccuuccagagaggaagggaugaagaaagaaaaaugaaagaaaaagagagagaaggaaggagggagaaaaagaaagagagagaaagaaagaaaagaaaagagaaaggaaagucauaaagcauguaaaagaaaauaauaauuggauggauugggcugauaagaagcugaaaagcucuguauuaaaugaagucacaauugacagcaaaaugaaccaaaugcuuuaaaaaaaaaaaaaaagcugaaaguagcauccgaguuaagaaaaauuaaagcuucgaacauagucacugcauuagugcuaaauuuugaaaaugguaauucaacuuuauuuacgaggcaaaauauaauuacauuuaaauuugagggaagagaauuuaauucuuauuaaugacagaaagacggagcgagaugcuuuaaugccagaaaaauugucugauguucauggauggaagagaaaauuagauucggcguugagcauucuccccugguacaagucucauuuguguagccagaauuguucucucucugagaaacauuaccuccucagcccagaaagcacagugccgacagccaauuaaacaucaaaaggaaaucaucgggccgggcuguuucuguauagguauguuacaagacgggaaacucaagguuagaauuucacuggagaaauaauauccauugagacuugacauuucccauacgccuucccaaagccagugacagccuaagacucaaaguucagaauaauaaauaucuaagagauugacauuggcagggaggagagugugauggcagaagcagagaggaguccaccaguugcgugggaaguaacaagagauuuagauagaaagagauggucaguuccuacacuuaaucaaagacuggaaaauugagcccagacaggcacacugcuaaauacugccagaguuaaagguugauaaagcaagagcuggcagcuuuguaauuuagcagaauuucccucgacagcccuggaacauuuucuaucagaacuggagccuuucaguaugcaaaucuaagccccccugcaauuggacuucagagucaggcuucuguuuggaugcucuggcugacacuuuguagcaaaucuccagucagcuuccugaaucaaacugcugcuacuauaacuuguaauuuaaaagaagaaaaaaaaagaaaccuguccuuugaauggaaauguuacauuuuaacagagccccuucccauaugugcuucaugauuuauucaaacaacuauauaagacccugacagggcaggugguacuguucccaggaaaccgggguucaaggaacuugggugaguugcccaaagauacuuuggggaaaccaagauucaaagccaaaauccucuggcucguauuuuucccuuugaacaacacuuucacuggcaacuaccaaggcuugugcuaaagcuggcaagacaaggcagacaucaggaccgugcauugccaaucaguucauguagugccuuugccaugaaccaugcgucuuacucuuguuuccuguagccaugauaaaauacccugacaaaagcaaccuaugagaguaagggcuuauuuuagcucacaguuccagcuccuagugcaucagagcagggaaggcaagacaacaggaauaagaagcagcuaaucacauccuaucaacaggcaagaacagcagggaaagcacacaugccuccccggugcucagcuugcuuucuccuuuucuuuuuauuagauauuuucuuuauuuacauuucaaauguuauucccuuuccuuguuuccccucugaaaacucccuacucccucccccugcucagcaacccacccacccccgcuuccuggcccuggcguuccccuacacuggggcauagagccuucacaggaccaagggucuccucccauugaugaccgacuaggccauccacugcuacauaugcagcuggagccauggaucccuccaaguguacucucugguuggugguuuagucccugggagcucugaggguagugguugguucauauuguugcuccuucuagggauggaggagagaugcucgguggauuaauaguacuugauaugcaagaggacccaaguucaaauccauagcacccacauuaaaaagccaggaauggcugcucaacccuaaaacccuaaaucacuaccagagucagaaacagggcuuccuggccacuaaucuggcucccaguucaccgagagacccucucucagggaaauacgguggagugauaaagcaggauacuuaugcucuccucuggcuuccuuagacucaugcacgagcacacacucacacgugcacguauaucgcacauacacauaccacacauauacaaaugcugguaguaagucggaagaugguguaggaccuguaugaaguuugaaguaccuaggagacaugcagauggcaggcaguaccuaggaaaacuagauagaugaacucaugacuaaguggaggaauuaagccuuuacaaaaggagacuggggcuagaagucuuugaaagauuuaucaccuaucuccuccguuuacuuccuuaggcucucgugcaggaguuugagaugagggguuucgggccccagucaaaauaugcagccugguccuguuccuuggcuucucugcucccugaccuuuccugguaguuuuccugccagugcagacaccauucagaguccuuuucugggcuagguuugaaggccucucuaaucaggaagccagauauccuccaauuaagaugacugucagaggcuuacugcuucuugccacagguacuuugucaggacuugcaaucugaacccuggggaauagguguggagcccugcucugccugugcccuaggucucuagucucugccuggucugggggcucuccaagcucccugagugaggugaaaggccacucgcuuuccacagcucauuagcuuucuaccuucuuggucuauggagcagagccacgaccuggagcacuucugacuggaggguuuuggggaggcgaguggcucaagcuuggccuugauguccagaggagacuaauuacuguagggacagcagaagcucguucuuguaccuuuuuccucucuugguuucuuccagaaaccugcacugagacaaagcaaccaucugcucagcuugcagggaaggaaggcggggcugccaugcucggggaaugauaguuugcuggaaacccaaggagauucucaccccugggagaaaaugaacuguacucuaauaaccgaccaugugccaggcagguggcugguuuugugcuaguuugugcacauggguuccuuggaaaugggucuaauuuuauauuaucuccacaucccgagcuucuaaggcuaucaugaacauagcagaugcuuggcauauuuuugaauuaauuguaaacuucugguagagaguugucauugucaccauccuauaaaugacauagauaaggcucagagguagcagcauucguucccuauagguaggaaguagugaaacacccagcuccuuacaugacugcaggccuucacucugugcaaaggcauagaacuuuggaaaaguauguggcccacuauggcccucuaacuuggcaauacagagauauagcagaagacacauuuucuguaugagacauuagucugauggcaggguccuugaggcacuaccuguagacuaaugacccugagagaauaguccacacagggguguauuggggugccuggaaccuagaugagacuucucccagccaggauugaagaagaaggauccgaggaggagcuggaaacagaaagcacguuuugacuugagccuaugcagauggaccacaggaggcccacugggaagaacccaugcagaagccuagaggagggacaccgaguacaauggcuguucuuuuguagccauuugcaaagaagacucuaugugacugcuuuucugagguagcuaacaaggucuugcucaaguacuggcauauacagcaccguguauauagaaaggcaaggcacuuucuuccuucuugccugccuuccugucuauagcaccgccagaagauuucugaggugccuucucaugcucuaaccacaaaagcugcuccccagaguccucagcucucccuuccuugacucuccauccacuuuaaggggaucuccuggugacaacacgccaccuacaaagcaccuucugccgucccuggcuugcccuccuucaguucccacccaucccuugguccucagucuccuccuggaugccuucuccgccacucacgauuccccuguuucugcaucucucuuucaugcccaccuugcauccuccuggcugccuccuccgccacucacgauuccccguuucugcaucucucuuucaugcccaccuugcaguacccaggcucuccccgagcauucgcugucucuggacacacagcuggcuucugcccucucucaguugccagaucucaucaugggcaagaugggcagccucucugccacacccugcacuuguugcacuccccacacucucagaggggcuaccucaguguccacacaaauucacugccauuccacccggcagagcuucuugccuccuacuuccugagaaccaacaccauugcguaaguccuccuguguuauuccggaugguccuuuacauauccugugccccgcacaucucucugccuguauuucuaugcccaacagagauacugcucacaaggccugucccuccaguuacacuucggauucagugcuugccaacuguucaaagucaccucaguggaauccaauguccuuguucucuuccuagcuucuaaucucccuucacuuggcuaauuucuaggacgcaaacaugauguauuugccauacaaugacuguuuguuccauaaaaggugggaagaauauaaagcaccuuccuuggacuuuauauaacuggcccauaaacccaagauuuugguaucuauaccacauauugccuaauuuuuaugcaacuuuugagaaagcugaggcauagagagaugaagcaacuggaucauaugguuuggguggguggguggugacaugcuaaaugaugaaguagcugaguagacauacagauggucugauguuugggcagacggauagaaaaaaaagcagaagagaaagggcucaguguacugggguuugggcuagggugaggaagcagaagccguuuccaguuucagcagucagguuguuuaacucaggcaaugaucuacuaaacaaguuauauucacaaaacacugucugauugcaucaggggccucacuucaaccugaucccacaguugauggaccaagaaaaccaggcuagacagacaucuuucauucuagccaauaaacgguugagcaaacaacuucaucugcccaagcuguuugcccaacugugguauggaagugaauaacuguccugagguauuaaugaauuaaaggggguaugugugagcaccaccaauaacuugggaacaccgaggacacuuugucucguccucauuuugacucacaugcuggcuagugugacuuaaacucuccaucugccgagaucucaaagacaaguaguuaaacagaaaaugcuaucaggaaacauuaucccucuauggaaauagcuaagaucauuccccuaaccucggguccuaagcaaaauagaaucaucuuuauuaucccaucaaugcucaguagagacuuaugaagacuuccuagaggucacacgggucagacucaguuucuacacccaaggauuuucuaaaccacuuucaccucauuuuucucguuccgugggaguuuucaggcacuugcguagggugcauucucuacccccaguuuuuaucaauguauaucuuuccgaguagacgauacucuaugaggaaauuauucauaaaucucucccauuagggcaaaggcacagccucaccuuccagcuuuuuuuaaugaacaggauugcaaaguaaguccagacaaauuaaaacacaacugugauagaucccaggcuucaucuuggcuuguuugaagauuaguguuuaaugagaggagcuugaggcaaucuuucccugauguccacacuucugggcauaauuacaaauaaccaacucuuacaucuuuucccauccugucaccuguuccucauauguccacuuccuuccaugcccugaaagauggcagguacagagcaggagcuggcaugagggaagaugggccuacaagcauauggacuaagccguucaacaguuacagaguucacagggguuggagauggguguuuaaaaagcuuaucucccaagaguauugagccucuguuugaauguauuugaugguaauuuuuuaauaucauggcccugagaugggguugagcuagcagacaugcgucuccuccaggaagugauuuuaauaucucucuauucauucaaccaaucuuuaugggaaagccauaccgcgccauaccugugccagcgucagagcccaaauagauaaaaccuaggccccucccugcuucuggaaacugcucccguguagcuugauaccauuuugacacaauugugcccaggcucuccaucaguccauccuguucacagucguuuaugucugaguuucuugugugggccauuuucuucaguucugcaauuuacccugugugagcaucuccccauuucagaaacgaagaacaguggcugagaagaguuaaggacuuuuuccaaggguccacagcugggaaguuggguagucacauccgaaaccaagccugucccauugcuuguggaucacaaaagauuucuccuagacccuagggucguccaaauucagacagaaaguuuugguucugaucaaauaagaguccaacagccaugagcaaauguucucuugcauuggcugugaagcaagcaucagcauucccuuuuaucuuuugacguugcuacauuugcccugucucguuuccuuuuuuauuaaaagcuaaguaaauaguacguguuaaauuugucauguucggacuaugccagccauagauucuacacuagggucuuuacuuuggggcaugccaacucauuuaaccugauggacguagguuacauugucugugaugcuggaaugcaacaccuaagggaauggagagcaaggucugucaggcuuagcucuucaagcccacugucaguuuugcacuuaggaaaucacccaugcgagagugaguccugcaacacucccuaaaguggcugaagcucccccaccccacucucauuuagaaagaagaaacuugaggcuuagaaaggagcugugacccacuuucaugacgaccuuuucuauuauguaaauggcauaugagcugucaaagcccauucuagagcauuguccuguuugguucucaccaagcgcucugugaagcuuuaucugcuuuaaugucaaggcagaaucugagaaggaaaaauaaaacaguuccuuuuauuucaagggcaaaaauaauaaauaaaaaguaccgaguggggaauagagacuacagucugaagccacaugguaaaguagcaucucggguuucuacucccaucaugcacugaaggucccuuccacucggucaaacaggcuuuccuguguuaccaucaguuagcaccccauaaacaucaaggucacccgguuugggccccuuccauuaaaauguacaaaagcuuacaaccaagcuuguaaagggccauggaggguccagcaggcaccaggcagcuuuggaggauaggagaacaugcucagcacaaaccaagaagaagguggaaugcuuagguggucagagcaggggcauccuggggaaaucccacuucaucucauagaucccaggacuggaccuggauaugacaaagaaaaaaacccugggaccagaaguggguaggagggguccgcuggaucucugaggaaggucuccccaggacaugcaucuuguuuacucugaggcuccauuuaaagaaaugccugcucugcagaacuccauuguucccaagaugcuaaaauaaggaaaaugcacgagaugccugugagaccuuaccaagcauccucagacucuguagcucucagaagccacaucuccaaggacaguaacaaaauauucuuacuauauuacuguaagaauuagugagaaaccauaugugagugugcuuuggaagguguaaaacgucauagaaguguuaaaucaaauauaccuuucccccacauuaccucauuugaucuaauaccaggccugugagagcagggaaguaagaauuauuacccccauuuuacagaaaugcaaagugagacucagcggguuauauaaugcagugcaguuuauccagucaguaaauggcaaagccacagauaaguccaggguaugucuccuccuuagacccaugguuuuaauccauuguaacuaagcaaagaagugcagacauuaauaacagcuguauaugaauauauacggagcuacauauacuauaugcguauauugaauaaucuucagaaugccaacaucaguuuguacucucuuggggcagguuuguaucuuauuggccuauauauuucagcacuaggcacagggcucaggauaagcaaggaugggagaucacuagaagugaaucauggggauucacugaugcugggaucagucacuaaguccccugugccgugggcuuucagcguucccaccauacaaaggauggaaagaaagcucagaguagccagaggagcaggucaccuggcuggcaagccugaagucugcagucagcacugccuccaaacuaauuaguaacagucugaagugaagcccacauucuguauucauaacuccugcaucuggagauuggaucaacugcagauuggaaacggaaguuguaucuaugaugaauacagauuuuuuuuugucaucauucccuagacaauauugcaaacaaccauaaauacaauuguuuggguaugacacugagguagaaaugguuuaaaguauagcggagguuaagagagcguguugugcucuuuuauacaaggaacuugaacaucuaugaauuuugguauucaaaggguuaauggcucuggacccaaucuccuuuaauaccaaagaugaccuuaccugaagcuaagaccugaaggcccauaggcaacugcaggggaaagccuuccuuuucuucucuuggcccuucugcugcucuuugcccugccgccugaaacccagcugcugccuuggcccccagugcucaugaucacaucucagugcaaacagagggcuguucgcuguuuacuuucauaccaucaauugccacuuggaaaaagugcugggcaaacccaaacuaagucauucuucucucccagagugcucagccagccuccagagugaccaggaagcacagcccuuuggcuguguauaaauagauggaagugucagagauagaaccuaacccaggaccggcagggucaggagccugaagauuauugcucuuugacuuuaggaaagcccaagaugucaucugagggaaaugcuaccccagagggcugcuggauaugucauacugaguuguauagucccaucuucuagagaugcuagacaaacaggcaugcuggacauucagccaggcugagagacauauacaucaacuuuccaugcucaggugccugucacauggagcaccuucaucuaucuauuauuuagugagcaucaauucaggaaaagaggugaucaguggaaggagaggcagccccagguugcugcugaccaaaaaaaucaccuucugauguggggugggaagaagcaagagguuaaccaccagugaauuacaaacaacuucuuagaggaggagaggccuugagccuuguaccugcugguuguacuguguagcagggaggguaucguagcauagaaucugucuuagagcccaaagggacuuuagacauuaucagguucccccagaaguagaugaggaagcccacacccagggagaggaacuaagugacccuggggucccaagaccagugacuaagcaggccaagacuucacaagccuguuugaaugcccagugggaagugagcugccuugcccuccaucuugaauuacuugaggccuucugugcucugcucuucccugaguacucaccaccaucuacagaguagcaguaggcuguucuggagcaaggcuuccugcucacauccuccaaaccaaaaacuguagcuccguggguccaagggaccauccuacauagucccacggugcagaggccccuggauacagcacagauccugucucugucuccagaugacaaccauuucugcccaucugcagcugcuacccugccugccucuggacagccaagaguugccauguguacugcauguagccgugaucuccaugcugagguggcagcuuggugagauaucuguguaggaaaacaaaauagauagcaauucuuacugugcuucuuaaaauguccagcucuuugucuaugaugaugaugaucaucaucaucaucuagguugauaauaaaagucagaaccacugagacucaauuuuuuuuucugguguguguguguguguguguguguguguguguguacgcuugugugcaugugugugaauguguguacucucccuguuuuaucacucucuacuguauucuguuauagacaggaucucucacuaaacccuaagcucaccucuuugacuagacuggcugccugggcaacucuggaacuacaggcacuuguagccaugcccagcuuuaauauggguacagggguuccaagcugagcuuauguggcaagcauuacugugcugucucccagcccuuugccguucccuuggcaaaaguuccuagaacgcgagcaguuucuagaccagcagugccucuuaaaagggagaaauggguggagacagcuugacauuggcucuacuuuagcccaguugcaaagaaauuuaaauuguuggaauuuucacauccguuggaaaacuguuagccaugagucagucaagucuaggccuccaucggggcccuggaaaacaagauccugggguacgugugcugcacaaauuuccucaaaagcaguugcaguuuagaaaucuuuggcucuccguuuucaguaagcaugaagcagcugcuggcuuggagcccaggggacuugugaaucgugcccugugugcuuugcacccacacaaaccagccuuugugaaggacaaggcagccucacucuggccaugagguagccuccucccccagcuguuuacuuuggaacuaaaagcucauuuagauggcgguaggggagagcaugaagcugaaggacagagaauaaacccagcaucacaggauaaacacuguugggggacaacaccgaaaaccccgugaguucucucucugucucucucucucucucugucucucucucucucugccucucucucucuuucucucuccccuccccacaugcuuuccugaccagcuuccacuggagucaaggcugcagggaaacgccaugggguccuugccaggcccacaugcaacuucauuuggcgacagggacucacccucgcuuuguuuucacacauaacugguuuuuaauuaaaucugacuuuuucucacaucuguucagaaggccgguccccuuuggaaguggcaagcacaaaagcagggacagacuggcaguagggaaaagcaaacagaguggagcugcacaauccccccuccccuggugaggaagcucgggcuggcaggccucugccaaaggauuguucuucagggucauuggcuggggagaguacucugccaagccacuggaaucccuaccgcucacagagccuaacuagguggccaagugugacccuuguuccuagcaacaacuggcuuaauaagcuuuuguucucucuccucccacccccgccccuuggcccuucuuucuugcccacagagaucugugccgcugacugugguggccauggcgucugcguaggaggcaccugccgcugugaggaugguuggaugggggccgcaugcgaccaacgggccugccacccacgcugugcagaacacgggaccugccgggacggcaagugcgaaugcagccccggcuggaauggagagcacugcaccaucgguauggcgggcgcacguccuggggcauuuggguugcucucaagacauuuccagggcagccugguucuccuccauugcauguggauuggcaccaaaaguccuuucaucugaugacauuaugacuggcuuuuccuagacaugaguugaguuuaaaugcaccaucugucauuuucagcacacguccucccaguuugcauuccccagguggcaccuagcugguuagcaggucuugcuguuaagccgguccugagcuaaaugcaacacugcucuuugcccaucgaugagucaaagcgccauugccucucucggaaucuguuuccucaccuauaggauggggaggauagugaaagaguuuggcacagaguggcacacgguggaaugcuccaaacaugaagccaucauugcauccccuggcuauguagcuccuaguaguagcaguggcuccugaagaggcuucuaaccuuggcacaaagcucuucuccaggccgcuuaggccacaucugcauuccucuuucccuugccccaggcuuccauccugucugcaucugucuccuuucuccucucugggggcuucuccgcaccagucccugcugaagcagcaccguuggcagcuuuaaaaacaagcugaucacuucuucccgucucucugccuuuccugcuggcuuuguugauuuuaaacacagccagacguuucgcuugguuuauuauccuggaaugaacacucaccaaaagcucuuuauugaaucaacugcuuuguguacucguuuuaacgucuucccuuuccuauuuuucuuucuuucuuuuuuuuuaaagaaaggguuugcaaucagaugguaagcacauggcuuuauaaggcagaauuccaggugccucucagcguagaaacugaccucuugggucucacagaaauggcaagaaaaacccuagcuuuugagagacaaaggaguuuuaagcaaauggugcuaucuugcauccguucuuucuguuucgccauuacuucaugucguuggucccuugcaauaucaccaagucaauaaacagcuauggaacacauuauauuuauuaacaauaauggcuccuaauuuuugaguauuuacgaugugucaagcacugugcccaaggccuuaacugcauuauuuuacacuucuaacaaugcaaagagggauggauuauuuucuuuuuucucagagaccugagaggaaaggucaucuaacuuuuuaaaaacaagaauuagaagcuugauuuuuucccccuuuccagcuguuugcccuacagaccuuacagauggugcccaggugacuaccaggcauccagcuccgguccuguccagaugcccagagcccgggcaguuugucuaguauggcucagaguccucccacuuugcuucagcccacauuccucacauauccccuucagauuggugauacacagcggacuaucucacuaucaucccaucucacuguaugcuaccugacagcuucuguaugaugaugucagccuacuucagggcugccuuggaauucucucagugaaaagugaggcuaguugucugaagggucucugcuuuccucuguguuuuccucucagggcagccuaaccuuucagccucuacccagaaguccauucccauucaaagaaaggaucgugcaccagagaaauggcucacucaguaaaccacuugccuugcaagcccuaggaccugaguucaauccccagagcugaugucaaagccacgugugguggcccaggcaucugaaggcagaggcaggaggaucucugaagcauaguggcuaaccaguguagccuaaccgggcagcuccaugccagugagagaccagcccucacaugaggcagaugguguuccuaaggauagcacccaaagcuuuucuaugauguccaugaugguucccaggccuggcccuacugugugcagaauuaaaggugugcacccccacacccugauccccccccacacacacacacuuuuaaagaaacaaacaguacgaacauaaggagaacauauuuuguuuuccuucccuuacuaauagaguucugaguuugcuuugccaaauucaaaaaaaaaaaaaaugugccucauauaaggcaaggcuucucaccuauauuaaaugcuaggcauggaaggaaacucuccaguggucucacugcgaggauuuaugucagggcuuaugggcaggcuggccuacgucugcaauagcuauucgucagccuaacuuuaaggaggucccacuuauuuuggaaccaagacgccuuaccuuccuuucuaugucuccugccugcucuugcuguuuccuuuaagaacauguucuucucuaguuccagauaguuuuucucucuagauaaaagaaacaucaaaguaaaugcggguagcagaagaggaagauugacagucacaaaagaacaaaugucacaggacacagaagagguugugggcuggucacaguggcucagaugaaaggaccuugggcucgggauucuauucuucauugugugaugagcauuuucuuuguccuuguguaauuucccugcauggcucccuccuccucuugggucucuguuguggccagcugcaccccugugaaaagccccacccccucgagcugaaggaacacguccauccguaaccuuguaugauagaaggggcugggguucaaguuagagaggcaaugauggguccucuuucccuuguugaagugguaagaagaaauccuuuuaaagaugauucccaguaagcaucacgucggggacagaggaggcugaugugggaaguuagagaugcuaaaucuucaguuuuuauuugucuuuaguucacugggccacaaugggucuaauccuguagcugguucccacccugcaauccuguucucuccuaacccagagaugcuaguagcuugacacugaguaguggaagcgagagucagggucgguuuguuuauacacuacugcccuccagaaacaggaagaaguuaccuuacagcaggcaggaaggaagcacuuacagaccaagguaacgcuggguucccuaagccaaguccaccagaacccuucuacccaggugacacuuuccggagcagcuuauaguaguagacuuaacaaguuguccuuuagagaauuuggucucccuugucuuucaaggaagcugcuuauuuuuaucucaaaagaaguuggcuuucugaagaagaggaaaugugucaaugacaucuuccuuaaugacaauauuuuuuauuaucauaagacugcuccacauguaccccuccccccaccccaugccuucuguuaaggaaucacccacuccuagcaccgagagaggguaggucucuggugagacugccauagggaaacugcacaguuguuugggggcaguuuuucucucaguggauucagagugugcggcuacaugacuucaccagcgaugacagaauuccagcccuuuccucuaccacccgaaggacagcauaccuaucaugccagaagugggucaccugaaauuauccccaaaagaagaaggacucuucaauuuuguuuuggucucuucauacaaaugcuuucauuugcaaaugcggcacucauuugcauauauaacacucauuugcauauauggggagcuaagguaagauggaucgacuugguucuguuccucaaguguacgguccauacaccgucaucaaaagcucauuuuuagaugucugucccaggaaugauuuggguccuguaaauccaaggcuugaccuccaaucucucuagaaaagcugaaaacuauuguuaaauuuaagaaggggcuuaauuucuuuuccugucugaaaacgcuaacauucuggaucaauccuauggugaucauuuuacucaccucagugccccucacccacggagccucaaaacaugugugggaaaugccagccucugauuucauuuauaaaauccaaccuugaccccaaagcugugauagcgggagaugccagacgcucaggguuaguuacugaacuucaggagagcuguccagucacauaaauccugacucuuaaacaacagccucuucugggaguaaagaucaaaauagcacgcugaugacgcaacccccugagugaacgaaaccagacuucacgguggagaggaauuuuaaaggaaaccacagaauguucuggagcccuuuguccacuuucgaaugguagcuuucagguuucccuugguaaucacacaagggcucagaagucgcucaggagacaugaugacccucuacuaaccauccucuaaagcucucccaacaagaccugagacaaggacugucaggaaagggagagagggggaaacugcacacaaggauccaccuggaauaaucagaauaggagucucauuccugguaucucucggagacugguaaugguggggaaguggaagaaaauaaaugagauuccuggagucaucucaggguggguaccccugacuauccauucaccaguccugcauccaggggaaaaaaaaaacaacaugaauuuguuggaucuuaaggacaucacaccaguagcugguaucugcaagacagaaguucaggugacucucaucaccuucccgacaccugcugcacugagcgaccucugcuucaucugccuugugaacuagggaugcaaguguuaauugucaagucaagacuccugggggugugagaagaggaagccucaggucuuguucuccaccacccuugauagaggccccauucuccaggggaccauuguaauaaacccuuagaaagcccuguggauguagaccagugaaaaaaaaaaaaaaaccauuuucacauuaguggucccagaagugccagagaccugaggccaccccagaaccuacugucagugacucugugaugccaguuucucuacuuccucagugacugggagauagcaagagcccgagaaacauuugugcaaugccaaggaaaugacugcagccugcaagggaagaugcugcagcugcagcugcugcugcugccgcugccgcuaccuuuaucccaaagcccugagacuuaacccaaagcaaacagacuccaugagcucuugaaccaccuuuaacaaugcaaacuuaugggcuugccaccaucuucucuaaaugcuuuaaugccauagauuucaaauggcaguguuggagaacauucaugucaagauguuuaagcaguuacuguguggacuucugccuuuaucuuuucaguaaacuguauuggacuucaaaaacccagaugucacuuccauucucaauagccaaagauggaagucuuuuccuaguccaagaauucuugaacuugguguaucagcuuuuugauucagcgugauuuaugguguugucauagcgaaggaaccccuuuugauauguggacucgggauuugaaauuuucaauggccacacuucucuccugaaaacccacacucugaauacggccugggaugucucaguugcuucugcuggcuucuguucccaucuguggucggaagaaauuagcaagcauauuuaaaagguauuaaaguauuuguacuaaauaagaucugaauuacuauacagucuuuggaaaugaaaugacauucaaagagaaagaacucucugaagucagccccggcuuucgggagauugucccguggagcuugcauaauccucgguaggcacuauugagucugaagacaaucgaggauauucucuguucggaaaacuccccucaaagcaucagcuacaccgugauggucauguggaucccagugauggggacucacuuacccuagccauuuuggggagagaaaucacagcucaugucacacauucuguccccaaguuuggaguuguuagaagaauguaugauuaggauccucugaaagagcucugcauaucugaaagcuaagaaaucgaccagagccaggacauccuggguguccuugcucucugauagcaaaacuaucaccacacgaggagaugucuacaaaauuuuagacugcuuugcaaauuuagaugcuuguauacaacuaaaagaaacagaugaaccaagaaccagugacauuccucucuuggccagagaccuccugaauauuuuuaagaugggcucuccccguauuucauuuuuucauuugggugguccccauguuugccauuccauggcuuguguauucacuccugcuuagaagccauucuccccaguacccucuuauauccugcugaugaacagacccuacagcaccucucagaauaaagggaaguauaccggcccgguuaaguccccuguucccaacuuuccacuuggcuaagcagcuuccuggugcauauuucaucauaacagcuacugcaaugauacaugaacuaagaacagggucucucaucuaccaguauuuuuggaguaaaucgauagaugauugauacauaaaucaguagacagacagacagacagacagcaauaguaccuaucauuuuucugaagugaggaaaagaauguccuuacaguuuauacaaucauggcuucuagauaaagcuucuccauuauaguucacuccuaucuagagacuuuugauucucaugugggcauugguugcuuuagaagacuucccgcucugucuggccuguaugagaacacgggaaaaagaggcauagugcgacuggagaugggagccucuuccauagcccagaugaggagacugagcaugcugcuggcacaggcugggacuaaagagaccaguccugagcguucagacacagcucuuauguaugcacugaguuuguauaucagagcaaugcuugacacagaucuucacacguagacaagaccuuaaauugucaaguaauucaaauggccucuccacuggaaaaccaagcaugugccauucugucuuuugaguuaagaaguggccagguuuccuuuuccuguucccacuuuucacaguuacauccauuggccucacauuccucauaagaugcaggaaguagggguacaucuuauucagcgcacccaacauucugcauuugagucuguguagacaugucuguucccauauaauuugagacaagcuagcaaugucucaaccuaggauucuaguauguaucagaagugaugcagaaucuguaugccucuaaccucuaauuucucaggauccugucugcccagauaauuugucacucuuaauuccccuugagggagguuggccauugaccuguuuagacaaagggguuaguugugauuuccccuuggaugcuagugaacccgacagagcagacuguggccacuugugcagccuccgggacuuguuucuccuguugcauuccuccacguguuuccuguuuauaugaccgcauuuccgaaugccuggcucccagaaugaguugaccguuccucucggcucuucauggagaaugugcuugcucuccuuccuucuaccccaugucauuuugucuuugguuugguuuuucccaccauggcagaggccugccccaaacacugggcaccacccugacuccccacccuccccuagugucuccuuaacacuuggcaugguuaccuggcaggcaguucugcgcuuccuugguccuaccuuaaauguccugucuuuuaucucccaagcucacuaucuggauaggguaguuaaagguauggucuuccucuauuuuccuguugucuuugugucuguguuugugugugugagcauacaagaagaaaugugcauacaaaauguaaauacacaccguuagcaugacaguguguccacgugcugccacaccccccacuuugucacagaauccauuacuuaaugagagugggguuggggucauggagucauagaccuagaaugucauucuaugcccaagucacuuagcucuaucuguggcauuguguuguaaucccucugucaucccugugcucccccauaccuuucacccccuccaccccaucucaugucacccugcccauuccuuauggccucuggcccaucagaauucagacacugggaacaagccuggguggccugagaaaggacgaagcugaagagcaaguaaagacagcauaaguggagcgcccaccaugugcuagguacccaagcaaggcucugggaacaacaaguaggcugcagucuugagggagugggugcucuauugcuugcugccuguuuucccuuacagagaaggccuggcuuugguaaguuuguucuuugaagaggauccuccaguaacaaagcaauuuguaauauuugaaacacuugcauagcuuaggugaugucuuaagucuccacagagaccccauggcuguaagaauggaggcucagguggagacuugaaaacaaaagaaaacagcacuuccaaaggagaaauaucaugucacagcuuuuaguccuugggucuaaacauaacaccuggcacaguacaugugcuccuugguuagagacauguauucuggaaucagaucuugaaucccaggucacacacuugacagccagggugaccuugggcaggucacuucacuaguacauauuuaucuauaaaaugaacuuggagacaggccugccucacuagaucagcucaaggaugcugugaagcaaugauuagcgagcacuagcacaugggugagaaugucccucaguagguuacaguuacacuguguuguuacuguguucuuauucucucuauucacuuaacagacucugagauagaguuagcaucugacauugcaggaggaaaagauaaauuggcuuuuguaagagagaagaguauuuuucauuauuguuuuuguuugguuuuuguagcuguguuuagacauaccagaauaggauauuuuauugaauuacagauuguugugagccaccauguggucacugggaauugaacucaggaccucuggaagagcagucaguguucuuaaccucugagccaucucucagccccaggauuuuuuuuuuaauaaagaaaaaggguuggaggacuauauugcuauuuuuauuguuacuaugacugaccaccaaaugggaagcaaccuaaggggaaaacaaguuuauuucagcgaacgauuugagcagaugcuaccugucauggugggaguguggcaguaggcacaugaggcagcuaaccacauuacaucagcagucaggaaguagagagcagacaggaagaagagccaggcuccaaaaaccaaugauccuaccuccaaugagcuuccaccuccaaaaggucccaccaccuuccccaacagcuggguaacacauguucaaacauaugagucuaugggggacacuucacauucaaacaaugggccaauaacggacuuaauguuucucagcugagucaaccuugccaauguaaugaaugcauuacuaggacccaucuaaauggguaccaagcaagguuccuugacuuuaauacacuggccuuugcugagaauaaaauaaaaccagcagggagcauauguaucucagcauccuccugggacccaauacacugucaccguccaaauguagacuucauaaugggauuauuauucagugggcuacucccuacugagugacauauuuuuacaaccaugggucuugagaacuguuaauuuuuuucaaaggaaacagauuuaaugcugcuaauuugguugaaaggggaagcugaaauugagggagcuuaguggcuaguccagguaauacuucuggacugcagugaagccaauacuuaggagcuucuucugauagcucacaucccuucucaaaccaccugcucugaucuuuaguccagaaaauaaugccauuagaccuuuaucuggcuuaggucagugaaucagaacuugcuuuaaaagacaaguauuucuuggcaaaaucugagaaagaaccaaaccccacugggcuaaucuucuaggguaaugggcacugauucugauucucagauccacuucagagaccugcgagagccuccuugagacucggcagagcagagccgguauuuugcaguucaaugagaagccugcuuuuguucacuuuccaauugcauugguucagcguaaguaaacacuguucaguggccuggccuccuaagcugccaggaacuguccacguuccacagcagaaauggcucucuuugcaaagugucuacauucucuugcuuccaacgaguaccauaaggcuaaucauuuaggaaggagaucugaccaaacuaggagggggcuugcagaugguggaauuugacuugggcucgaagagagcuacugaagguuuaaagagcaagacagcagacauuugugauuuggaaggcucccaauaggccauuuguuaaaaaggaauuggggaagaauaucaggaacaauaaagucagaaaagugacaccgucuaggugaaaaaagaugcugguccugugcaggaguguaaaugcagcgauguaaagagagaggaugaaacacggggagaaggacguuugguagguaggaggugcgcugcauagccgcuugcuacucugcaagaugcugaacgcuccuggccagaccugauguaggcaagagggauauugagaugaaguggucccuugucacuuaaagggcaccguuucuuuugaaaagcuuagccuuucucuaaaucuuaaaccuacauuauuuuggcuccagcaaaugccuggugugaguccuuccauaggggauuguuaaugucgcucaggcgcucugaauuauugaugaguuucaggguuuguggaauuaaugagcugccgccauggggaaggaugggcagauugcuuuaagaaagucagcaagucacccuggaggaggcuuccuccugcuggcuaacgggggugugaugggcaccacaagccagauguagagucagagugaaccuuacucuacucacaggcgcuccgaggaccccucugaaaccaaagagacagcaaagguccucaggguggaagguccucggucugaagugacugacuguggauaagugucccugggguccccuccccugggcaccucugagcagcacagaguguguguaguaggcagccagaggaauucauaagaacccaagagagguguuguagaagagacaggcuauaauagcaauauuaggggugggggguagguguguuccaaggccaagauggaaaaugcucuacaaaaaucaaaugagcaauucucuuuaguaagguuauuaauucucaguguggugaagaauugaaccauuuucuaacuugcauggcagguaucauugccaucacugucuugaagcaucuagaauaacguagcccacagaccacguccaccucaucacacgguuuuguacguaaagccuuauuagaacgcacugugcuuguaacucagcugcaugccccugcuuuggcacuccgguggcauaacccugugaccauggcaauuuccuaacagcucacaagcugaaauauuugggccuuugcacaacgaauuuugugggguuugaucuagauaacugccuccauuuucuacuuggucuuucuaugagcccuacuuguggucaugacagcaaccuaggcugugugcacccuauguaccgacuucccaauagagagagaaugugacguaaguggagaauucugccacugcuucccaguuugugcaucuuacacgccuuaccuaucaugcugaguucccuaaugccccugugcuguaaguaagaauacagggguucuaaaaaguucauaagaugcuggaucccguguccgcugagucauggagccggccuuuggugcgccuccuaagcuuguacucucacaaauaaaaagguccuuucugcaucuuaugagaugcuguaucuuauggcaaaaucaaagaaucucucaauaucuuuaaagcuuucacacccuucuucuaagaugaaccaugauaugagugguuuaauuaaacacagucccuggccagaugaacaaaaauuuaacugagacuaauuaaaggacaggagaguuuuugccugcugagaccacucgagguacugaucaugguggcuuagucagagcacaggggagccaccuauaugucacccaucgcuccuggcacccauuuuuuuucaguuuucuucuugauaaguuuugaagauggccauucugguagccucccccaccugcucucuauguacuaccaaacuuucuguggucaccacugaguucuaaggacacaggcaaucuuccuuugagaggaaagggcuguggcuguauugacuuguuggcaacuccauugaccagcucgaggaaaaauaaauauuuguuuucuguuggaauaagagucaacuaucaaaagcccuugagccauaauguucuuuaaccuuugugugcugauuuuaauauguauugcuaaaaguccuugaaacaacagucucagguuucuauugauagcugcuccaugagugucuauguguggcaggccugucgguagacagccauguucaucuuuguuguccccuuuaaaaaauaacaagucacagauauggguagcucugcugacagagugcuuaccuggcgcacaugaaccccauaacccucacuacauaaaguggacaugccagcacaccccugugaucucagcacuugggaggcagaguugggaagaucagaagaugaaggacauccucaacuguacagcaagaaugcaguuaaugugagcuacgugagacccugccuuuaaaaaaaaaaaaacagagugaaugaaaggaaaggaaaaacagcccccauaagaggugacagguucauuuugucugguuucacaguagaauauuuaguuuacagccaaauuuauagguguuugcuguucaucauaguauaauaagcuaaguguucuagagaaaaaaguuguuucacacucaagccuucccuggagaccaggcuggagcacagaagagaaggaagccagggguggcauaguuugguagcuguggaacucauaaaagaggguuggcuguuaggaaaguaagggcucaagcgaagggauagaaaggaaaggaguuagaaugaaaaacagaagcuuaagugaacugugaaacagaaaauuucuuaacuguaaaugucuucccuuuuuauugaaugugugugugugugugugugugugugugugugugugugugugugugugcgcgcgugugcgugcgcacacguguaccaaagcgugcaggacuuguacauaccaugacacacacaggugggggggaucagaggacaauuuuuaagaaucaguuuuuucuuuguaccccagguuccugaggucaaacucaggucaugagucuugcccaacaauaguuuuuaccuuugaccuucugcuuuuuaccuuuguaccacaaacuccacagggcuugaaaagguaguaaucaaaacucugugagucuacuugaugagcacuaaaauguagccaccuuaccguacgguccaagcauuguccuguccuuccugaugaggucaucugugucuucucagauggccauggcuguuccuagcccccucauccaagcacuuuguuauccuuugguaguagugugccugcuccucaagaacacagcuugguaucauuuaucucuaugccuguagcuagcccagagaagaugcuuagcaugggacagguggguagcaguuugcaaacagggcagccuguguggaccugccuuuguacuugagaccagcaggaguuugccaagguuguggcaguccccugagcuccucuuauauacagccccuuucaaaguauaauauaaaugcaaugauaauagaaggcccaagcccuuuucucaaaaccaagacaguugucuagaagaaauuaaggccaaauaauugaaaaguuugagguccacuaaaguuguugaccuaguugcaagaacuggaaaaagaaagaaagagagagagagagagagagagagagagagagagagagagaaagaaagaaagcccaagugcgaaggcacacaccuuuaaucccagcacccaggaggcagaggcuggagaaucucuaugaguugugggccaagagacaaggugaccaaccacaggagaaugagccagucucaaggauggauggaggacauuccuggucagauuuuagcaggcuugauccauuaaccgcagcuccaaaaugcuggucacuugugguguucuagaccugccucgacuacuucugaccauacccucaguaagucagucuccuuauuccugagucuuuuguugccuucucugugaggugaagauucuucgugguaccugcccccaaggcuguugagauugauagauuugaaagcaucauacagacaagcagguccggcaugagugcagaggguagcaguuacuguugggcaccggucuuugacucucugcuuugucuugcagagggcuguccuggcuugugcaauggaaauggcagauguacccuggaccugaauggguggcacugugucugccagcugggcuggcgagggacuggcugcgacacauccauggaaacgggcuguggagacggcaaggacaacgacggagguagggcucuggcacccguggacccuggccaguucccccgaguaggagacagagggaaagggguggacacugcuggguuagcagggcaccaacauccauguccagagugagaggaccuuggggcaccaaagacugcauggguggccuaaggaauggguacucucaguaguugcuggauuuugauucaagugaaagugauuggcaucuauuggcaauggagagaaggcacagagaagcauccaguuaacccauugguggccagauugguugccuggccaggguuugaagaggcaguccuccucuguaccucagacacuguguaggcuccuccucuaggggagaagggucauuuacuuugaucaaggucucuccuuugauucuggagaugacccuucucaaagacaccaagggacacuuuccucucacacucucucaucccugugggauaaaaccugccucugcuuugcagauuuuuuuaaguuuuggguaaucaaagcccaagagauggggggagggguuuagucuuauggaauauuuguuaauucagggugaaaacccauguuaauuccaacucuggcuauaacuccccaugccucuguaggcaagguacuagguuucucugagccuuauucuccucaauuaugaaauaagguaguuuguccaugaagguuaaucaagucuuuauaucaggcauaaaauuagcuuucaguuuucuacuguguaaacuugcguuacaacaaccauaguaaauuccacacucccaucuagaagacucugguucuaccaaccucagggaguuccuggaaaaauaaaaaaagucagauagauauguuagaaauuggugaacuagaaacucagcaucauacuuuuuggaaauuuccuaccuagaauguucccacagucucaaacccuauaacggucaaaggucaaguguguaauauuguaauauuguauaaugauauuuuaauauuggcuuucgaaucccagaauagcugcuuuauagcauugauguuuagcugagcuacccuucagucauucuguccacugccgaaauccagaagucagccacccagauaaccucagaugaggacuaugagaauaaucaugaacaagggacccuugugguugggccccgaucucuaggcggagaggcgugucuuccugaaaucccacaguguuggcaugucccuuaaucaugcugaaacuuggcaugucucaucugcccaaaugugacaagucucuuguggaugaccaggcgcagaagcucacaggaaggagcaagccccaaggcugcguguuaauggauuaugcuaagugcuguggcaggguuauguguuaguugugggagcaggaaaauauuuaucaggaagaggaugcuggggcaggaaggaauuuuacugagugaaggugaaggggucuuuuguucucaagagaucucacagaaaagggcagggggaagaaagcaaggguauggagcauccuggucuucagguaagagggagcaaucaggcucugucugugggaaagaggucagcuucccuguuuguaugauacccucagcaucccgcuguguuuugucuguacagcuacaaggccggagauaaacaguaacagucaugaaaaaaaagagagagagagagaacccccaccaggaagucacucucuuccccagaguccagggucuuggcccagcuuucaaacagcuguggaacaucugggcagcuacagaacuaaauguuuuugcgauuuugagagaacacauagucccccacaugcauacauucaagagcaggcuacaaaccagggcuugcucauuccucuccauaaaacagagcaccagacuauacacccugguugccaugcuucagagacagccagcccugggaaaaaaaaacaaaacacaguuuucccagaaaaccuggacccacaguagcaaaagccccaguguuauaggaaaugaucuagacccuagggaaacagagccuucuccagcugcucugagaagugagccagcagaaagaaagaaaaaaaaaaaaaaaaaaaaaaaaagaacaaccagaaaauccccaauugcaggagaacauguaguuuuugaagcauauuauagaaaugaguuuguacguacuuuguggcaaagcuguacaaaagcugugcugugaguuuguucauuugcuccacaaauguucaccgagcaucugcacugcaucaggcccuggcucccagggcuucggaaauaaaucuaacagucucugcccuugcaaaauguauaaucuagaaagaggaaacgggaggugacugugauacuguggguucuugcuguuguagaagagcauccaggcauucagcugauauugucagaugccuggaagggaacuuagaugcagugccaggaagaauccucgcccaugggucaucacgacuggagauacagccaucucgggaggacaugucuuuggcauucgguucucaaaugugaagagagagaggucuuaccuuacuuuggaaucuucuaaguuuauaaguucagugggauuucuauccauugggagaguucagagguucagagcaucccuacuuuguaagguagcauggauaaaauaaacuacaggaccagaagggcccaagauuauccucauuggccuuuuaaucucuuagcccugcccaagcagagacaaucagauuagaagaaauugguguccaaaugacuacaucuaauggaaacaaaaugaaauagucaccuucaugucugcugaggcaggggacucagcauaauaccagaaaguaguucaggguagaaggggaaagggcaagaggcccacugaguucuugaaaugacucagggcuugaaggagaaauuagcagagcuuaauguugaaucuagucuagagggaacuuuaucucccuccuucuccuccccugcaugacauugacaaggaguugggaacccagacaugugaccucauuuauuucauuagagucacacagaaagccaauagcauggcccacacuagaacuccagcugaguuacugcauguggccuuauauacaucuagaaggcugcuucuucccauauagacuucugcucuuccaaaaauguggagauuguugcccagaaaugaagaggcuuugaaaaauugucucagaggcuucuagagccuaggagaacuccagugucauuugacagcuuguagcucagugguggauuuguagggugacauugagaggaacaugguauugaugucccucaccaucuccucggagaaggacacaagagcuuagcuucuauucuacccagaucaugccacuggauaaaacggucugcuaguggcucugaggccuggccugacugcauuacagccuuugcuauacccaaaccucagaccuggcucccuugucaaccaccaagguccuucaagcuaccugagaacucccauuucuuccuccccccuuuaccccccccccaacuuucuaggcuuaaaguaaucuuuuuaaaauucaacuugaauuccaagguucauuaagaaugcuauuccaguguuuuuaaucugugagacaaaaaaaaaaaaaaaauuugcccauaugguugaauugggagaguauuauugguuuguuuugucuucacgugugguugguuguucucugaauugaaaagcagaaagcauccugaauaugacuaggaagcagcuggucuccuaagcuucuguggaguugcucugugccucuugaaugccucagauuucacccaagggagcuggcugcugagugggcccagaggggcaagcacuaggacccugacacuagcuuagcaccaguuucuccgugagucucaguugcagaugauagcuaccuucuucaucucuuacccugugcaaauuccugcaugaaaugcuaucacaugcaucuucucaaaugacacacagugaccauccaugagaauucgucucacccccaucucaaagacggugaaaugguaguuccuccaugcagagugaccgugaacuauggaggugaugccucccuugcagggucacaguaagaacuacagguuugacuuuaaagugccugugauuggucaacauaacacaaagaugaaaagccuggccccuggauucagauuccaggcucuucuuacugugugauguccagugaguuacucaacuuguuauuuguaagugucagcucucuuccugauccuuucugcccgaaaucacagggcauuguguuuaucauaaaauauauauuuauguauaacuauuuuucauugaaauuuugcccucugugaaguuuuuuuucugucuucuugcacauggagguaccauauuuuuuucauucuuugugaaucuugacuauuuuuccaauuuucuuuauuaaaaucugucuugcaugcugggucuggugauucacaccaauaauuaggagacuaaggcaagaagaucauaaguuuaaggcuagcaugggcuaccaaguaagaccuggccuugagaaagaaauguauccuaaacaauuacauauuuguggaauaaaaagucuacaugugcaucauuucacugcuccucccaacacacuuguaggcagaaacauuuacauacaaggaaauggagucuaggagaaaugcaguuaagauaugaagccucacacagcggaucagcaggagagcuagaccaggcaggagcuauaaagaugccagaauaaaagcucugcuggaauuuaagcagucagauccuuuuugauaagguuucucuaagcagcuucaauguguaauaaucucuacugaggcucuuggcaccuugaaagacaaucauggcuggcgaugcccaaauugacagaugcagcccaggagaaauuucaagaaaagggagagcaaaguucccugucuccccuucugccccuaccccccaucucccacugugaggauggagcguucacacaaagcccuacaaucuggucacccuccagacuaucucuaaaccacguuucucaugauaagagacaagaaagaaauugaccuuuaaaaaucuuguguuccaaagagcagauaaagauuucacaaguccuuuugaaagaaggcacagaauccauuauagcaaaugacaaaaacuucucugggauguguacagaaagggggaggggccacacccuucucuccuuccccagggccucccccagggcugcucacagcuuccuguaggacagcuagcucugcggccggacugcacagaacagcaagaugaggcuggcugaugcaagcuggcagaaagacagaugggcucuucccugacuugcacuuaccaguuuaaggagcccuguaagcagccgcaguaaaacugcuuauucuuagcaauccuagucugcuuuuaagcauucucucucuuccaggauauaucccaccccgggcuggggaggaucccuaccugggaggucuucaccaucuccugggcuucccuucuucccagagagagggaugagcucuuccugcguggcuccggccacagcucccaccccccaugggccuggccacacugaucuguuagacuugggagccucacacagugagucaugagguacucagaaaauaccaaaccuuucaaaccacagagucuccaaaauuacagacugauuucuucuuccccaggauuuacucuucuguuccaaagcauggcuucuccuugucauacaugucuucuaaaacuuaucaucucugccuaagaaaauugaguuaugcaggagcauacacauauacaaauguacacacauacaaacauacuuaaauacauauauacauacacacaaauacauaaacacagaaauacauacacacauacauauauauaaagacauacauacauacauacauacauaaauacgcauauauacauacaugcaugcacacagauacacacauauuguggaacaggcauauucauaugcuaccuucaaaaacaaaguuuuuuccuaaaugccagucuuguauaaugcuuuguaaaugaaguuugugggccccauucauuucaaaauaggugucucacuuaaauacgaugguagacaaguugccugcauucacugcucagcaagcauuugccaagcauacaaagcaucagcauaacaggguacaggcaagcagaauuucuggucugguaucagucgcuaacccaccgugcacacagugagcaauuccauaaucccgaaguuucugguaagaguguggcuuaugugauaucuccuuuucaaugauacuaguuugaaagcuccuugagagcucuaguaccuuaccuuucaugugucaccauaguuggcuuuauccaucucaguccucugaggucacucuguacccagaauccugccuggaauguaugcagaggaagagaucagggcuccaucaaauggcuacugguugccaggauaccaggaugcuugcuaacaggaaguaccugucagaagccacuaguaacuuuccuuggcugaguccuuacauaggagcuucucacugccacccccucuacccccauaucaugugaaguagguuucacauugauucauuuaacaggugaaaguaaaagcucggagcuuuugcuggacauuuauuuccagcaaaauacccaaguaggucaucauagcacccuauugaccacaaaauacaacaauuuccuuuuaaaacucagcaaaggagaaaguaggggagacaagggugcccugaaacucagaaauaaaaugaaacugaaagccagggcagcaggcacagagcuaugacacacucauggugacagggguauguucacaguaggacacuacugcugacacuaaacagaaaacugaagagccgagaggcucgauuuaaaguaugugcccgcuagagcaaagggcauggcacggaggcuuuucucagucucagagccaggggacagaagagccaucagugagagacagcgcuuacaccacaaagguccuggucugaucuugcuugccagaguacuaaugccaagcuaagaaccccaccuaagaagccauccuagguaaguggcacccuggcacagcaggcagaagucaccagaaacugugcuaggggaggucaggagguggcugaccacaggcugagguuaacagcuaugccauacaagaggauuaccacucccaagaacuuaauccaacagcaaguauaccauaaauaagcuuuuauaugacuacagauauaaacugauacauaaaaaaaaaaaaacccuaaggauggaacaauccaccaucagggaaggaaaaagagggggcccccauuuaaaaaggcccagagagaccaucugcaaaucucaaaguauugucacuuaaauuaaugacccaagggacaaauuaaacagcagaccagacacaaaugaaggaaaaauaagugaaguagaauagaagucugaggaaauauaucagaaugggacacaaauaaaaaaaggcagaaaugaaaggguugaaaggcaugaaauaggagacggccccuuaagcuuuuaugaguauccugaagaaagggcuaaagagaaauaaaggaacauucccaguuuauaggagaauuuuccagaacucauguaaggcacaaucuuaaaaugccuaaguuaugaugcauggcuuucuauagagcaugcaugcuguaucccaggcuggagacagauugucugucuacaacuuuucuagacaaucuguuuuguugucguaagacacccaaaaggaagccucccaccuggcaguggggcagauucgugagucuaaagaaugaagcagcuuucuuugucugucauuaugcauagcuaaaggucuggagccugagguuugaagacauuaagcagcuuguacagggucacacaaugcaaaguuggauagggugugaccaucuggcuggagagaaaucaccuuaagugccacugagcaucgcacauuagugcauucugugucccuguccuucacuuagaaaacuaguucuugacaggaugacucaaagaaaauuuaauacaccugaaagaacugaguucaaauccuuccucggcuucuuuacaggauaccucuaugaguacucuaugaguagucacuaagucaacuuuaccacuucugaccugcgguuccuucccugugaagugacagugaugacaguggccaccucuuaaaauaaguaguagccaaggucaucacugcucaucacaaaguguuuaccacagugcccagccuggcaucacugucauuugucagcuucaucaaccuggugcagaugagaaccacccucucauuccuggcucaccuucuccacaaauggagaguagacaccccgacaggaaacagucccucccaggugccacgaaggaagcaguguuuauaaaaagguaaaagucuggcuuccaaggacuacuuuggugguaaacaagagcaggcaggagcuaauaaaauuucaaauuagccaugacuuuucacggcccuucaauugugcuagcugauuuaauggucaacguccccgcucgcugggauugaauaauggagcgucucugcagaguuauggaugcagcagcugaagcugucaugcuaacaucaauagcagaaugcaaaucacccucugcuggggcuguaauuauguguuuaagcaacgucugaugggggcagcagggaagugugggaugagaccugcugacucaggaaagggugggugcuuugcuuggcagugcuaccugcaagggagaagacaggccacccaaaauaauacugaggugagaaacacagguggcucugccagguaaacaccccuccccccacacacaccauuuagugaaccauguucuagguucagggucagaaagggaaacuaucccuuauuaacacccacuguauaucccauaccguguuggauuuggggaucuaugcuauacaguuuacugugggauggaaacuuacaugacacucuuauuaggcucauaagaaacauaggaaacuggucaaguaaagcgguuccaugggugaagggacuugucaccaagccuaacaaccugagcuucauccuuaggacuagcaggguggaaggggagaacucacauggacuaucuccuuaugcacacuaugguacaugcuuacacacaaacacacacacacaaacauauaccacacacuguagaauguguagcaauuuuuuuuucaagacaggguuucucuguguagcucuggcuguccuggaacucacucuguagaccaggcuggccucaaacucagaaauccaacugcuccugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccuccucugccucugccucugccucugccucugccucugccucugccucugccucugccucugccucugccucugccucugccucugccucugccucugccuccucugccucugccucugccucugccucugccucugccucugccucugccucugccucugccucugccucugccucugccucugccucugccucugccucugccucugccucugccucugccucugccucugccucugccucugccucugccucccaggugcuaagauuaaagguagugauuuuuaaaagaaagaaagauauaggaagcugagaccagauaguuuaagugacuuguccaagaucacacagugggaauauucacaauugauauuugguccccgguugucuagcucugaaauccagacacuuucacugugcugccugcuaggaggacacacacucuuggguacuauacaggaguugggggaaggacaggggaauauugucagggaugauugucccuaauacacuuaagggggugcugggauucggucaaccaagaagcucagccuuugacuaaagauaaguucccucaaacacugcgcauucugccucuauucuucuaugauauagaaggguagaccagaggugacucagccuaugagaaggcgaggaccuaaggcuagccaauguauaugucaugcccugaggaugcagacugcacacucuaaguccuggaaauagaagugaggcaggugugccagcauuauuuccacauuauuagugaggacagugguacucagauuagaccuggcaaguugucuggggccagucuuacacacagugcugagaugugaacuuuagucuccauccuaaugauucuaccaucacaucauuugaugaauauggcugauugaagauguuauugucuggcauuugcagacuaguacuucauguugucuccugcuucauguguuaauugauugcuuggauuguuguugcugcugcuguuuuuucauuuaacagccauuuaaaacaugucuacuaagugcuaaggauacaacagagauggccaaagcacaucuguauccaggguaguuaaaguuuuccagugucacacagcuaauaaccagucaaaccuagauuugaacccaggcgccacacaccccaucucugccuagaacacacacagaugugacgauggguuuuuccugucccuuaucauggucacuaucuucuaaugucuggguuuguugcccauccuaaauuguuauuugugaacuauaaaaguaccuuucaguaaugaagccaaaaaucuguauucagggguaaucucucucucccucucccucucccucucccucucccucccucucucucucucucucucucucucucucucucucuccauuuuuggaaaauuagaugagcuggaauaguuuaggauccugaagagcuccauccaugugguaaagagaacuccaugcaaaugacaacucaccgaaggcaggguugggccucugaagggcugagggcugcaccugccucaggucacaugaucccauagcugcgagagaugcuacaauuacaggguucuuagcaucccugcuucauccucaccccagagucagguguccaccaggucuuggguuuuaccuacuaagcgucucucaaaaccaccuacugcucguucuccauuguaggcugcuugcacuaagcaggcugcuuugcuuucuauacaugcaaccucagcaccacaauccuuccuggguggccugugaguuuuaacagugcgccccaaaugaagucaccuucuaucucuagacuuuagggguuccuauagccugaggguaaaauuucagcucacuagcacggaccacauggccuagcauggcugucucagccaacacagcagccucauccauugcuccucccugaacaccagcgcuuuagcuuagcaucucugguguucauacuuucucucuccuccgaaaucuccuauaaacucuucccacugacucuucagaggagggaagaacgugcacaccauaugcuuacuuaucaccuauuaauguagcaccuauuaauguagcgucugaaaggcuggagcaaggucugaaguacuuggcucuccuugugcucugaagcagccuaggcuuaugucuguauuuaaaguuggccagugagagaaagaggcaaacauggcuuauugaacauagcuguauaaacaacaugcucugucgcccuugcagauggcuugguggacugcauggacccugacugcugccuccagccucucugucaugucaacccgcugugccuaggcuccccugacccccuggacaucauccaagagacacaggccccuguaucccagcagaaccugaacuccuucuacgaucgaaucaaguuccucgugggcagggacagcacacacagcauccccggggagaaccccuuugacggaggguaaguccauggggcucggcucuaggggcugcucuuguggggagacugaguccauucugggcaugaggagccugagaaggugggugggccucagagguccuaaggaguuugugagagaggcaaagaagcagccuccaguacccacacugacaaaacugcugucaaggccuuccgaauuauuaugagcaaagccgugcuacucccacugggugauagauggagagagcgaaaaaccagaggucugaggggaauuguggaucaauacccacuuugcagucagcucuuucugauccuguggucuccacaugagcugacgggcuuugacacugucugcccucagagcugauggaagaccucacuaaccuggaagcugggaccauggcuacaccccaggccacauguccacacaguuuuuucuuugacaguuguaucaugcguuggauauuuuagcacugagacacacucugugccuggucggguacuaaaaugacagaaccaagcagggcacacugucugccaagugguuacuuacugucuacugggguagaaaaugaauacaguuauaaugugcuuggccaagauguguggcaaggguccuaaggggcacacaggaggugcucuuaggcaggagaaucuaggacuuaggagaaauaacacuuaaagaugagagaccauuaaguaagcaaaugaaagaggagaggcucacaggaaagaggaaagaguucacacaaagacaugaggcaugaggcauggagggauccuggagccaucagauggcucuguguucccuguuccccugucagggcacugaaccaacacaguagccagaaagaaauauuuacaguaguuucucuggcgugucuuccgauauaguguuacgugugcaugucuucaccgugaaucagcauagugacucuggaagucaccaaucacgugccuccauguucaggacuucugugccaaggggucccuauccugaggggaaaugggaagugaugugacugccggaaugaggaaucaguggggcuugaauggagaccagugugaggauggagagaggggucuccugugugggugccuggguggauggugcuguuaucugacaccaggaugaggaccuaaagcagagccagaaggaagcugauggcuuccucuugagcagggaaaggguaagguagggaggcucccgggaggaggugucugcugccugcuggaagucauuaugggaaccuguuaccucacagugcaagcuccaggagcagguguaggaguggauuccucccacugugccccaucaguggcuucuguggucccagguguaaacgggagcacugaaggccuccccucugugcauaguggagcuuggguacagccuuauaacuaaccucaaagcccacccaugcuacccuagcaguccucgcuuugagcacaaggauauggggaaauuaaaggaaagaagcccucugcacccagacagggucagauauacagcagcaaccaacaggccaccccuuuagaggugugggaguuagugcuaaggacauggcucauucugucaagugucugcugaagaacaugagggcuuagguucugacccccaacacacagacacacagacacagacacacagacacaggcacauagacacacacauacacacauacauacacacacacacacacacagacacagacacacacacgcauagauucacacacauaucagaacccacauaaaaccacagaaccacucugcagggugcagagacacacagcuaaaacugaaguuccaagggaagggagucaggcagggacccagagcuugcugaccagccacucuaacugaaauggcaaacuccagguccaaugacagacagacccucucuggaaaaauaaggcagagagcuguagaagaagucacacaaccuaacuucugaccacuccccagccccccaccccacacacaaagauucaugggcacauuagagggcacacucuucaacacaccccaaaagggguagaauggcuuucccacaugcacaaguccagucacaugcuagaguuaggaauagcaagaauaagaggcaaaagugacauuuuaauuuuuauuuauuuauuuauuuugaccagaaaugcugcuuuuguuccuaaacaggaagcugcugcuaucuuauccaacugugugguuuuguguguaugcguguagcccuuccccuggcaugagcucuuuuaaucuacugcagauauaaguaauauucuuaccaaggaaaaccuuacuugcucagccuuucaugaccggcccauauggcaucugauuagggcuacggcuugucaguugccuguagcuguucuguuuaggaagugcccuauuuaugccagccugcugugugccagcaggaacauguguccggggcauccuccugguuacgugcuaggccuguugcuuaagcccugugagaugccauuggaccuucccuggguucucugcacuguuucucuaauacagaaugcucacacagacuugagaagccggugcuaggggaacaugcaaagccaagcuccacuucagcucuuggcucugucaccccuguguacauggaucaaugaaggacuaaauaaagugaggcacgccaggaucugccagcccucuaaccuguguguucuaggaaagucuuacaucucacucauaaagcauuuaguagcugcuuaaggaauguauauggacauaaacugccugagggaugaagagauaaaagggagagaggaagagagagaaggaagaaaguauggaaggaaggagugggcagaugggcacauuacguauuuuucuugguuuuauacugaggauucagguuccagcaggguuagaucaccugccagacaucagacuggagcggaagcuggagaagacagcuugcggauccuugcuuauacaucuguucccuucaguuaaauuucauacacuccaaaggcagaggcuauucaucccuccacacccaugacaccucagcaagggcccguaaugggauauuuguucuacaaaugaauagauaauggaaggcucugaaauguuaguauggaauugcugucuccugacauucucccgagucaugauacccccgcuccuuacucaucuagaugcagaagaaauagccauccaucacgguagauuucccaaacgucccucuguaaaauaagcccaggugacuagucaucagaaacaccaagcagcagaugccuacccgauggccucaaaugggugcagaaguaaaacccuucuuucuuggugccacuggggugauguggaguccgacuccuguaaguguaauagagaagcccagugaguguguccucucugccuuuaccauaagccaugcauacacgaaacagaguaaacauuccacagccgccauagacaagauuaaagguaaaagagcuauaccuggcaggagauuuuauagagagaagguaguguuaucaucaaguuagcacaagccucgcaaucagacagaccuggaccgaagggcagaugcagccuuuucccugcuguguaaccuuguggggggguggggagcggggaggagggggagggaggcucggaccuuaagcuuucggaagucagagguccagucucaucaucugagagacugcgugaauaacgugugugucaggggguugccgggaaaaguaaauggaaagaaguacacagagccucgaccuggagcacccacuacccggaaacaccucugauaauuaccuaacgguaggguaacggaggccauggcuaagugcugccaccuccaccuccuuaaccggaagcaaagcuugagaaucagcugcccuccagaaaagucagguagacauacagagagaaauggguuuagacugucgaaucacuaucugaggauaagagaaggccauguucucaccagccagcugacauugggaucagccagcgaggaauccagugacaucagggugcagcugguggagaggcaggccugccucagugcccauggguaacagcaauaagccugcaucuaacccauauccugacauccuauaugaagagucaggagaguccucaaaggauacguaacucaagaagcuguaugauagaggacacauccuuaugcuucuguauauacccuauguggugccagaagucauggaagagguagggugagcuacagcuccucaggaagugucccgaugggggaaugcaguggugguuggauggcugaggcagaagcacuucagagcagaaugagaaacagcgaaggcuuuccccagcauucuuguuaaaguuagcuagugaugugucaacagauaccuaagagaacaccuuaaaugcagcagguauuuguuuuggcucacgguucugaggugucaguccaauggauaauagagucaauugcagagggccuguggaaaggcagcacaucagggugcaagagagugugacagagcaaagcuguuugccucuuaguaaccaggaguagagugagacucagggagggacuugggacaaagaccccaagaacaugcccuucagugaugcgcuuucucuagcuagggccccgccuccugcaguuuucaccaucccaauaguauaggaaauuauuaugauuccaucaguggauccagccaucaauuaggucagaguccuugugauccagucaucuuuuauugauuagguccaccaacuaaggacugaggcuugggcacauguuucucuuaggaaacaccuccuauccaaaccauaacacaguucacacauagccaagaaccuaacacaauaccuggcuaaaccacauauucagcaauugauuuaaccaggacagugguucugacacucuuauacugcaaguguuaugacuucauaaagugauagagcuaugaauaaccucggggguuccuaaaguggggauacacgcaagccuaggcauuaccauuaccagauuaaguagcauaaacaccauuugccuguugucauaggcaaagaugaugagagacucuugcuauugagacuugagugagagggcaaagagccauugggguuucugauggaagaagggucuccagcuauccagacagaaaagaaagagaauaggacaccaaccaugaaagccagaaucaggcagcugagaaagagauggcagccugaugcucucccagaaucccccagggcagagcaguuucugcuucugaccauacagagucugagcaagaccaagaaggccaagaagcugggugcagggcagcuaccaccucuaugagaaguugcuucuuaccagugcuagacaauuugaaagacuucaggaagauguauugacaaaaugaccacccagaugugugcugaaggcucagcuauuugaauguagguggagacuacauuugaggacccuggcuaggucugagaaacgauaugacauugacaagucuugcugguugucagcucacucagucagcacauagcaguggguaagauguugcaagacucagcugauaggacacgcugagcacagaggggaacacccaaaauaguaagagguaugcaugaagccauaugaaugugugcacauguguguacaugacagaaugugugugacagugugaggaagugugagugugugugaaauguguaugcuuguguguguuuguggaugugugcauggguguguguguguguguguguguguguguguguguguaaccaagauggggaacagaugaguuuccagggucaccagaaaacagaggacuuuaauggagcugggaaauaauuagggugauauucuuggggaggcauggucuaauguuugaggucaagaugggcuuaccaagucaaguaaaggaacgugguuugcacaaagggccugcaggggaagggaacacauggugaggaaggccaggaaggggauggaagggcagggguucagaaaggucacaaacuacauucaagcaucgugucugagucaaggcccaaggucaacuuugagcacaggggaaacaaccagcaugccucucagauuccugcuaagccuuuaaguagaacccaacuuuuucagaaguuuuaaauaugagaguuuacaaaaggauaagguagugggaaaacagaaauggucauauaugugacaucauaugcagguuauuccaaacaaaaaccacacccaagugucagugcuaccaagucacaggugggcauucacuccccaccccagaguccugcccccacuucuguccccaggccucacacaaccaaccaagacccucgaaggggcugagcagugaggaucuucuaaugaacugcagauaaacagcagcuuccugacagcuggccucugaguggauuuauuauugaauuacacuccugcacuuucaaaacaagcugagcugacaggcuaccccaucaguuaccaaaaagggaaggaaaaaaaaaaaaaggaaagaaagacauugaugaauuaccuacuggaagauggaaaaagauaaagauccugcuuccuccaaaaugucagccguaauauauuauucauguugguuuuuaaaaaucccuccccacauugaaaugaauguuuaugaugauaaagcaacaagguggauucaauugaggaugcaggcagcggcgucucacaucauccugacgagcagcuaacaacuccuccucggccacuugaucaucccuuuauugauuucaaaaggaauuaccaucucuguuugcuuugcagcuuaagcaugcuccuccuuguccaucacgggaagcauuagcacaggacgauauggugaugcaaagacuaucuagugcauagagagaagggaccuagaucaaggucugggacaagugagacaagugaccuuggacagaggagacucacucugaaguuucugauugccacuggguuguuuuaaagagucaaugagauaaaauacccagauacuuguauacagaaacaacacaagacauucaccaaugguauguucuuugucaggcauugcuaggaauacuuuccauaagucaugauggguuuaguucuccacucccagcuuccaaaacagcgcagaagggcucaguugguggcuccuucuuuaaaacuugaagaaccaaggcacagcccaaucacuaagccaaaggucauagacuuguaaauaguagaagcaucaguucuucacugcaucaugcguguuccaaguucagcaucuucaguuccucuucagcaagauguugcuacccuccacaucuccaacuggcucuaaccaucucuuuaacauagcacgacacacaaagaggcuucacgcuacagagcacuggcucagaguaaccugggcugggcugggagcccagccuccucuaaaagcaguaugacuauagacacaucucuuacagacuuuggauaaauugugguuggugcugaaaaaaaucucauucaaucaacaggagcugacagaagacaguuuaagguuucguacaagucaggcuuauaaauccacuuaaagcaccuugugaggugaggugauuuacauaaccaccagcagcagcagcagcaacagcagcacagagcugcaaacacuaguaggcagggaaaacguacacuuagaauuugcuaccuagaucccuaaugauuucucccaugcccugaaugccagcuguuuucauuaaauaaccaaaaaggaaagaaguugcagacucucucccuccacuuagcauuuccuuuaccuguuuauacacuauaccucaaacaguaacuuaaaaccuaaugauuucuggcauuuuuguuaauuuuauuuuucaaacaaguuaugcaagcagaagccaagugaacuauccaggggcagaaauugcccaccuugggaagaaguuucagcucucagccuggggucucuaaccacaacccuaucaagaucaaguggcuucagggucucagacacuaccucaccuucuguaagagaagcaucucauaucaugauucaguaaauaauuuauuaaaagcuuaugccacgccaugcauucaaauucuaggacaaacagccccuuggacgauauuuuccuuugccuacugaaaaugaacaucagccaugcucagugcugggaaaaagagcuugagggaaauguggcuagucccauccacguggaguagaauccacuuugggaauaagauugucuuaauugugugacucauuuucuacagaaguauccccgagaggcaggaaugguggccacugcuugguaaaugcuguggcugaaucugaaaggugagcaggcacauuucuaguacacaaggucuguggaagacagcaagaauagcucagaggcaagaacaugcaugcuaugaaccucauuaagaugaaagcccccuggucugaaggcugugugaacuguuugcauagugccagguaaaaaaugaucaaaacucuuugagaaagcacaaguugaagcucuugagaguucuguuggauucuguuuuacacuagaucgagaaaaaccucaggacagauaacggaugaagggauggaggaucagagguggguggcucuccagaaucgccuagauccgagucagaacaaggagcugugacuucccaaccucggcucuuucugcugcuuuccccgaguggcaucgaggucgaggcugcuuuuuuugaucugcucgcuucuguuucgagggagggcuggguagcaauccaucugcugucucuccggcagacucuucucuuuccaaagccuggccucuggccucaggaagcaaucaggcagaucgucuagucaccagcaagggcaccuuguucaggcucugaguguaucguugcgcuaaugccaguauaugugacaccaccccagcuggccuggcaggagcacugccuccuggcaggguucacccagccuaauugcuuguuuugugucccagcugccugacauaugcuaauuccauguguugacacucugauaacagggacaaacacacuaaggcauuucaaaauggcuuuugugagcucuagcaaguaaucaaggacugggauuuauaacucuagcagccagcagugccggcucaucgaagguaccugggauuucugugacuguagacacaugacacaacagucacaguaaggauucguacgugagaaacuaggcuuagccaauuauguucaucucugggugaccuugagcaaauauuuucuccguggguuucaaguucuuagcugcagccccugcuugcucuauauacuaggagugagucagccccaggcaugugagauggcuuuguaaaugugagugguguaauugugggaccaucaaagccacagagagaugcuuuuaaguauagaggagcccagaggaaagggugauuaauuguaacaggaagagcuggugacagcuuuccugaagugcugacagugggagucauucuaaggaugacuaggaaauaauaccuccucucuccaucaucccaagaaagugaccaaggagaaaacaagagccauugucccaguuugcuuucuauugcucuuauaaaacaccauggcugaaagcaacuuggggaggaaaggguuugucugguuuacacguccuggucauagucuaucaugaaugguuuggggacaggacucaaggcaggagcugaagcagagaccaugaaggaaugcugcuugcuugcuuguucuccauggcuugcucaacuugcuuucuuauacaacccgggaucaccugucugcaguggucuggacccucccacaucaaccauuaaucaugaaaaugcccucacagacuugccuguaggccaaucugaaggaagcauauuuucaauugagauucugucuuccaagaugcccccaguucauauccaauuggaaaaaaaaaauaacuaacacaugcaucauacauacauauaggacugggauauagagaaaccccccagagagugacuaggauucucacccuggucagugguucucgccguaacaccaaaccuggccuuuaguaugaggagugacccaggggaaugaaagcaccaacucauuugagcucauuagaacugauuauuaaauauuuagaaauuugguaagcugguugcuaaacagcaaaagcuauucuuccagaggaccuagguuugauuuccaguacccacaugauggcucacaacagucuguaacucuagucccaagggaucccaugcccucuccugaccuccaugugcaccaggcaugcaugugguacacagacaugcauacgggaaaaacacucauauguguaaaauaagauuuucgauuuaaaauuuaaaaacuaagcuauaugaaauugaaacgauauuaaaagguuauaaauaacucaaaaccugucacuuccuaaguauuuuauuauauuuuauaauuaucauugcuuuugaacuugucugagacuaauauaucucugagauagaaauaucacauacucgcauuccauuaugcaccucuucccaacuuuguauccagcagcauacaguugguagcuugaauuuguccaugaugggaguauuuacaccauaggaaaggguaacuaucaaagauugcaaccaccucucucccucgcccucucacuuuccuacucccucucucucgguuucucgucuauccuuaagcauuuaccaacaucucacugguaguaucuguugaauaacugcauagagaaaacaaucgcugggaaaccugccuagcacgcacaucuuuucaaaccucccuugacgaaagcacacggcauggagcauagacagagaccaccacaaagugacuuccccaucuccuuugcuccagggaagcccuaauauuaaacagcguucucuugacaacugaaaacccugguuaaacagaaauagaauggaaguguuuuccucuagggcuugguuucugagccaaaugccugucuugccaugaggccucuguggccugcaggggcugggggagucaacuuaaucuucugcagaauccaaagcaauccacaggagccugcccuaaaauugcaucugcucugguuugccgaauggagacuaaaugauagccaaauggcgcugauuuaauguuucccaacaaccagaaaauccccacaagagagauaaaucagaggaugcuggucugcaugugcacgggguggggguagccagggcagccccaugauggaaaccaccgacagagggcugguuacuauccaggcagaauccaaaaguacuguacaugucagaaggcuggaucauagccaggaucugaggcgcugagaucuguuaguaauucacuggaaggacaaaguuccagcaauacaaaauucaauuguccuccauuaaagaaagccucucucaguaccagcugaguacaauugaugaauaaaucccucccauuaguggaaagauaauuucacauaaauacaucgggagaccuucagaacaggacuggaagucuuugcugagccucaccugauuuacugguuugccauguaauugcauuuagaccaagggccucagaaggaaaacacugacugaauuaguauuagccagacugugcagagugaggugaggugaggugugugguggugguuuggggaugggggugggggagcaaggcauguggugcauuguggauaguuguuguugccuucagaaaggacaagcugacacgagugagaccagcugcuuacaagccugguguuaauugcuuuucucaucaaacagagaaaaguuuaucacuugagggaaguaaggaucugggugucuaauaaagaugggcuagaacuugaggauuuuuuucauuagugcccacaggccuuauuaguagcucuuucauaggccagaaagaagggugggccugaaccgggaaaaugaagagaaggugagcuccuucauuuuugccugagacgggucaucaauggcuguuuccacaguauccugaucucgcagagcacucaccugaaccggcaucuucacucccauucauugcuccuucagacacaccaacagaucuagcaucuagccuagaaauggaagguccgcacuccagacuccugcaaccaccuuccugguagccuugugaaaauauuaguaccucccaaucuccucguuacaaaaacggaaaggauccugacaacuuucuggaugguuccuucagaggcugaucaaauugccuuuggaaccaccagaguuggggaggaauucugucaccauuacaucuagggcgggucuucuuuugguuuguuuccuauuuugagguccuuaggaaaugucaucuaccaaauuauucuacuucugaaacaugugaaaaccaccccucuagaugauugcuaauugcccuguuuauuugcucaguccucuauuuugccccugugacuaaguacucacuaggcacgguccaggcucugcacuacagagaaagccuugccacgcccucacacugccugaugucuggguggagaggagagggaggugcagcuuagcaggauaccaaggccuuggugugcgguuucgagggagcgagaugagaguucugagcaggaacuucacagaaguccucugaagugggcgcugaaggacaagacuguuggaguguguguagagaugacauuuuaggcagaugggagaacauuacacacgcacgggcaccacacauucuccuggaaaaugcaggaaaaacguaugguuuguggucuagaauacaagggacaaaggggagggagcugggagugggaacaaguccccaagcagauacucccaagggggugcuaucaucuauccuucucuucccaaugccagguaaaagcaaguauagccuccauccuguucuccuguguucucacuuccaguaauaaaaccauggcuauuguuacuuaccauaccauuguuacauuguaccuuaccauaccacuguuacauuguaccaagaugaaaaaaaaaaaaaaagaaaacaaaaccaauaacagcaaaaaaagaggugcaaagaacugucacauaccugcacaagcucagagcucuagcaaguagcagaacugggauuugaacccaggccaccugacucuguugucgcaugcuugacuauacccuguuguucccuggagucagccuucuccccucacaguagaugacagcccuagugaaaaacuugaaaacguucccccagagugauucucucaaggacacauugauaccucgagacgugauuuuuuuuuuaaaaaagagauuauuguuuguaugaagugaacacguggggcuccuggauguuagucaugucuagaugaccagucuucuggcuaugacuucuggggcuucccugcagacugugaaaaguaucucauggucuucucucuucucuucccacaggcaugcuugugucauccguggacaagugaugacgucagaugggaccccauugguuggcgugaacaucaguuucaucaauaacccucucuuuggauacacaaucagcaggcaagauggcagguaggagacccuuugugggccagggagaauuaggccugagaguuaggagcuguagucuugcagcauagcugcccuggaucgauuauguggacagagggucagaccuggacccagacagccuauauuuuaacaccccgcucagccaccuacugucuccugaccugcaccugccuccggccucugucccuuugacuguagaugugacaccuucuucucaugaggauuucacauaaacagaggguuccuuauccauauuaugcugcccagugacucguggaaauacucucgugaaucuacuuuauaauggauaagauggcuccuuggaaucuaaccauucgguuucuaccuuucaguugcuuagaaguggcucccauagaagccauuuaggcgauagcagaauucuauccuuuuacuuucccugagaaccaucaacagcauguaguaaagcuaagguuuccuuuaaggaauggcccuagaccuacccccaccgugugacuaaaguaugcuuggacaaauauugccucuucaucugaagcaugauucuaauaccaucuaccucauacacuaggaauggauaggacaguacaguggcuaaggaagcaccuagcuauaguuccugucuaauaaaccauuguuuccugccacacaagaauucacuuccuagugugacacgcaguaaguaaauaaauaguggguauaaaaaaauacuaauuauuacaaguuguugaauaacgaggacagaguaacacaaauauuucagagcaaaagaaggcaagaggaauauuuaggcugucgguggugagacguccucuauuuuuaaugaaaucaggugaugucaguccaucuggcugagcgugggcccauaagguugauuccucacucaguguuagaaauuaugcuccagccugauugauuuuagcaccucuuuaauccaauaucagaugugagcaugucccagccgaggugauaaugaagcaggacucaucuguuuggagacaugugugccucuuagacagcuuggcaagcuugguguacggagucuccccuccuccacggcccugggaagggcacagcuaaaaggggucugugccagucuccagggaguagacuggccaggccaggccacuguucccugcccugaacgguuucugccagaggccccuuagcaaacacccacccaugcaugaaggagcuuccuuucuugauugugucugucuucggguauggauuguacagaaauggcagccgugggaacccuaggccauggguauucuuaguacguuaucgcccacaggggaacagucauccaaacaggagcuuuuggagauuguucuuuuugccacaaaacuuuccacauaaaagagcaaaccaucagucaguaggccccucugggcuugcucagacuaggaccaugaacuacaccacaguaauccuacauguugugaccuuaggaaucaccuauucuuugacaucucugggcuacgauuuccccauuugugcuaugcuggcccuaucuacuguuucuugagggcacugagcaccaggagggaggcuuccugcaucagccucccacacugugacauagaaaaggugcugcuuagagcuugcauuucaaauaaguccucgcccaugcaccaugggccuaaaauguucuuuccaacacagacauaauguaugggaacguuaucacuuguucccauagugugugaaacucccucuguuguacaugaacagggagcaucuggcccacuccacuccuccuuccuuggcucaguuucgcuuaagccugguuuauaggagaggccacaaggcuaaagauagucagcaggugagaaugagugcaugugugcuggaggccuaggcuacaucugacucaccaguacaaucugcgguuucuaggcagcaccaggacacucucaccaguucccuacccacaacuucacacacacacacaccacuugaugucaaauguuaacaguaacucauacacagaaagcaguaacaaagaaaauacucaaaaagauggaaaaugcaagucaugaagaaaaaccaagagaccuagagacaagagaagcgguucaggcucacugacuugaaguguggggucgugcugagcgagaugcccagggaacaaguggcauccugggcuugcccauccaucacuccaacuaauuaguaaccuugccaaaugguuaugaugcucagccuaauuuuauagacggagaaacugaagcuuggaaaggugguauaacucaccuguaaugugagagugguguuugaccaacaagagauaggcuccauuugagaaccaggccuucccucuggggucaaguccauguucacaucuacauuaggguuucccaacgagaugaguaggccuggccuuggccuguugcacucagccccuggcauggccagcugcucuggccugcucauagccuugaagaaacgucuuuucuuguuugucaucucucccucccuauaggcugccucucuugaaccaagcuuuugaguccagccaaacuuguguuuggcuguuaaaaaaccaaauuaauacagacacucauucguuaugugacaggaauaccaccccguaaguguuuccucuagacgguggguguucucuuagagaacauacccugaacucuuagacuacaauaaaugcccacccuugguguuucuccaucaucccuuucugaaggauggugccaucuaacuucuaaacauuaacauaaaaagggcaaugugcaguuaaguauguggaaaacucccgcagaaagaagagucugucuuugggguuugagaaaccauaaucagggucaucuaccaugagcagaauuugccucugggacaggaugguugaauacaagauccuugcaaccucuaaggaagggaagagugaacugggcagccaacgcuaaccaaaguugugugugucaagguaaacgugagauccuguguugaggggucucacaaaccagcgacagagauaaucacuggguugaucugagucgguagcuaaggcaagaagggacuugcgaauuuagcagccauuuaagaagaaaugguagugucucauguauucauucuguaagcuaagugucccuagaaagucaagaaaauggguguccuaggcacuguaacaauuauagugcacugcagcauaaucugucaggagucucugugacacaacagaccccuaagaggaaacaagaauccugcuugagcaaggcuuugucguggcaggcucagcaagcaugcccuaccuagcugggcaugauagcacacaccaaaaaucucauaucuuucgaggcuggagcagaagaauuauuaguugaagaguagccuggucuacacagagaggcucugucucaaaaaauaaacccacaaagcuaaauguaccaccuaagaagacuuuguccaaggagguauuacaguggaagagagcuggcagacaaagcuaccggucuccggucaccauagcagauaaaaaaaaaaagcucaauacaagaacaagaaggagagaagcccagauguguuccaaaaacuaaagucuuaauggccagaauuacucaaagauggaccugcccuccuguggcuacagcaagcucuuggggacucgaucugugcaagugugaaaugaacagccccuugcugguaguucgguagcagggaccagcccuucacauugggagagacaugggaacaugaccacuaaguucauuucugggggcucagcuacuacauggcuucagauuuucuuuuuagaaaaaaaaaaaaaaagcaaacucuaggcuggauucccguacaccaaacacagggcuugaagugacagccaaacacuggucuuggcuaagcagaccuauccugcaggauaugugccacaccuugauuuccagccccuguacccauaaccugagcucuccuagccucugaucauguggcuauagaacagaggcuggccucccuagagggcuggcaacuggcagaaacauuaagguaugcaaaugggaacucacauuccuugacuuucaaaacugaaaggcucacaucaugguuuauaaaggcaaugccagguaagguuuaucugcaugugguagggacugaggugcuagauucccaacaacugcuaguauguuucugggggaguccuaucugggaguaagguacuuagggguaaagcaaggaggauuuuuaucuacaugcucucacacaaaccugaaacaagaggcccaggguagagcugucuggggcagcaaagggccuggagaacacaaagccagaacaagaaucaggagcaugcauuacugcucagaacacccuuaaagagccaugaaccgaaucugggcuacugucucuggaugcuuuguagcaauaaucucauuucagcuggacacuuggguuugcauuucuccuugcacuuacaagauacugugguucuaauuacacaaucucaaacugcuuagcugcuuaggacuucagaacaaccccuuugagagauggacagacgacccaauggagaaaguacuucuguauaagcaugagaaccugaauuuggaucuccaccacccacauaaaagcugggagggagagacauauggaucccaggggcuuacugagcagcuaguccagacaaaacuacaagcuccugguucaauaagagucuugucucagugccuggaccugguagugcaugccuuuaaucccagcacuugggaggcagaagcaggcaaaucucugaguuuaagguuggccuagucuacauagugagcuccagaacagccaggaccauagacagacccuaucucaaaaauaaaaaccaaaaauaaacagaguggggauggaggagaaagcuaugucaaauauaacauacagaagcaacugaagaagacaccuauaccuauaucaaacuaugguccccauacauacacauacacagagagaugcauguguaugugugcaugcacaugcacauacacauacagagagaggggggaggggaaggggagagagggggagggggagagggagagggggaggggaagacggagagggggaggggcgagagggggagggggagaggggagagggggagggaggagggggagggagaggagaggaggcugacugauuuacucauggccacacuauaguucauggcaauaaggauucaaugcagggcucaauaaugcccagggaacacuuauucaaucucauucugcuggcucuuugugggcucuggcugacacaguaacagcaccaggcgcuccacagcagagguucaccagcugcccuggguucugcuaaacagcuccugcugcaguggcuaauuuggcaucuguaaacucucucuggccaaucaucuuguagcaacagcuaaagguuuccagggucauugucacuguuugugacugcaauccggucucugggugucagaguagcacucaccaaguucucagcccuuuccugugacuuucaggaucucgguucucuucaucuuauuucugccguuacugucccccacccacagcuuugaccuggucacaaauggcggcaucuccaucaucuugagauucgaaagggcacccuucaucacacaggagcauacccucuggcuacccugggaucgcuucuuugucauggaaaccaucgucaugagacacgaggagaaugagauccccagcugugaccugagcaacuuugcccgucccaacccuguggucucuccauccccacugacauccuucgccagcuccugugcugagaaaggccccauugucccagaaauccagguacccaggcuccuugacgacaucaggcuauucuuuucuuuuauuugggggcagaagauaaucucacagauaauggcaaaagugaaagugccuguacgggccuggguaagacccuccccccaaagcccacuuuaccaaaucgcaccaugggcauggcaucagaauauaaagacuaucuuucaugcuaaagacuggugcaugccuccagucugccuggcacacuggggcuugcaauaaacuccuuggcucuuccuacccugucucccuguucauucuucuuuguucuucagcuuucagaaucucaccucucuugguauuucugcucuaaguacuuauaauaauaguuucuaugaauaggaauaagccaugggaccccaaguauuaagcauuuuaauaaagaguaaauaagaaaaauguaacaugagguacuuagcacgaugucugauaccuacuaagugcucgauaaauuuuagcuauuauuauugcuaagauuauuuaacacaugcugccuucaugccaauuaaggauugcuuuggaucaaaucuacacacgcaaaugguuuacuucauuaucauuaaagggaaguaaucgagaaaaaauguauuuuaaucugaugaaaauuaagauagauucuuugccuaacaaagccguucugaguuggaucuccuccaucauccccagucugaugucuguaggcagaaaagaaggccagaggaagagggggaaacagcagcacagaagcccagagaagcccaggucaccaggucaccugccugccuagugagaccucagcaaugugcauguuaauggauugcccuggugcggguagaccagagcauuuauacauuuacauuuacauguguguguguguguguguguguguuucacgccuagaugagcaaacacaucucccuggacauccccuguugaguaguuuccagugucaguccccaauaaaaaaacauaaccauuucugaauucucacuguacagaaagcucacuccuucucagagauucaacgccugucuccugucucaguggccaggcugaccuuuuguaugaaaugcuugucaguagagacagagcuugcuggagagaaguaauuuguuagucaacccuggcucggcuccagcuagacauccuuucccaggagcagggacugggcaacaaaugagguucaaggucagacucucuuuacauugcucucugagcugggugccccagugggggcacaaaccuugcuuacuguuagucccaccaaacaccuaaaaaaacaaacucuuugucucccuggucccauugucguugauguuugcaagugcugggauguggagauugagaugggugcauuagcaaagggaaauguuuaugagagcaucaggcuagcacucaagcgcugccgauggcucacccggggguguagccuucuuugccuggaacuauaaacuguggccugggaaggcggcccuagauuaagcccaaucuauagcauuuccuguguuugaaaaagcuucacagacaaaacaucuacacccuucuauagaauaaacagaaugagaagggcucagcuccccuguaaacagaggguaaaaauagccacaucccuugaauggacauguuaggcucaauugacuuaauguucucuucuugagcaagagccuggagcaucgagcugauggcaguccccuguguuugccuuauggugaucaucuggacugcaaugacuggucccuucuucagucuucucugcucaucuggaaggcacugggguugggagccacugugcacugaaaauuccucucuggggacaaacugggacauuggaacaggacuuugucagguucucaagcacggccugaugauguauuuguucagccuaguguggucucuguugacuguccuggaaaggauacauuuaaacuccaucuuacuuuaagaaagcucuagauagaaaccaucaucuaucaggcucugauugcugccuacauuagucuuucuucauggcagcccugcucucagcuccccggguaccagccauacccuguccugccuaaugauggcuaggcacuuugcauauauggccuuacugguauugauccagugaggaaguacagauucccagacuccuugaguuuuccugacugacacagcuaaugaaucaaagcuauacauuguugaguauccuuauguguccucucaggcccauguuaaaauaucuucauuuauguugcacuggagagagguccaaggcucacacaggugaguuuguuagugcagguacaccauguaggaacuggcccuggagaccagggcuaguccuccuucugccucucccauucucuucccgcuccucucccuaccaucuuccugcuauucuuccuccuccucuucacugccuucccuucugcuucuuccugugccuccugaacacccaaaggccacaggccuuggaugucacuucccccaggacccacagugacaucccuacuaugaucugucugcgcuguaggcccugcaagaggaaaucgucaucgcuggcugcaagaugagguugagcuaccugagcagccgcacuccuggcuauaagucuguccugaggaucagucucacacaccccaccauccccuucaaccucaugaagguccaccucaugguggcagucgagggucggcucuucaggaagugguuugccgcagcuccugaccuguccuauuacuucaucugggacaagacagaugucuacaaccagaagguguuuggacucucagaagccuuugguaagucuccccugagcaccugugacacagguuccacacaguggccgagacagagcagaaccgaggaaucccucaugaaugugucuuccuuccuuccuucuuuucuuccuuccuuccuuccaucuuccuuccuuccuuccuuccaucuuccuuccuuccuucuuuccucuuuucaggucaaaaccugcuagggcuuaauguggcugugaaaccucaguagcuauccauagccuagaggauacauugaaaggccugaguaagcaaagcccaagcauggaaagugguuaggaaccagaacaguccucagaaagcacuauggcacugugugaugggcuaagauacacugagugccaggaaagcagacuauacacauguuaucuggccacccugcauccaugcugcugaaaccuaaaauuaaaauaaaggggccaagguugggcuaccuccauauuuucaguuauaagagcuaaagucagaacuuugugcaagaugauuguccuuccaacuucuaaauuagagcagggucccagaagcuucagagagagauagucaguagucaugaucccuagugagacgacugaggagcaauagcccugcaaauuccuucaucucaaaucauagucccagucaguugucuucaccuagccaagacggaaaggaacugagaagccaaguugcacuuaggaagggaagagagaagggaaggaaagggaaaggaguugugggaggcaggaaggaacugugaggaucucuugagccccuacuccaugaaauacuguagauugagcuuacugcgucagacacauuagcaccacaaugaaucccacagccacauccuuuggaggaugcuaagguaccaacuacagugacacccuaaggaugcacagauagauggaagagaauuagauccauccacaucgucauuaggauuugcaucccuacccugugacacaaaggcucucugggaacagaaaugccaucucucaccauucacaacccuucuaucgugucaucuacaaaaauauagccaaggcccuaagccccccccccccccucucagugacaugagcacauuuagggcccacuuugcaguuucagaaggucugugcugugagauuccagcacuagggcucauucugcugagaucaucauugccagagguaaggcuccugacugccacugaaacuugggcacguuguccagccuacuccucuguuaggugguuagcaaucuuuuaaggcaucugugaaacauucagaggcuagccaguuauuagaucuugucucaaccacauggucagauguugccaucuagaaaacagugcccuuucugaggaguuacucggaagagauagcuugcuugucucagcugaugcucaccuaagccugagcuuccacagagaccaagcuuagggaaacucauaauuuuuuaaaucauagaugacugaagacaaucaacuucucaacugaguguuuuucuuuaagcaucucuaugacaucagcuggucuuaguaaacaugauguccgggggagaguaauauuucuggauuggacaugacuagauucucaccugacugaacacuguaucacucucaauugucuacagccacaaauaaggcuucagugaaaaguucauaggauacuauagaguuuggauccuuaaaaugcauauauacacacacccacacauacauaugcacucacauacauguggauauuaccauaacauauacagagcauuuuaaaagauuccuccccagaaucaacucacuugggucuuuuugaacuauuuaacuuuuccuaauaaugugcagucguucuuaaaaaaaaaaaaaaaaaaaaaaaaaaaaaagcuuuuaagccccagcaucacuguguugguauuugguauuucgcaugguucuaguucccaaguagaagcaugauccuuuguauuuguccuauaauagauaggcauaggccuugccuguggggcugaggcucaaagaggacacuuugcucaccugugcacuuugcucuuaugucccuguaguuuccguggguuaugaguaugaauccugcccagaucugauccugugggagaaaaggacagcggugcugcagggcuaugaaauugaugccuccaagcuggggggcuggagucuggauaagcaccaugcccugaacauccagaguggugaguggaaucacggggcuccuugaacuaggcuaagguggccucuccuuuguuauccuguuauccucacacaaaaaagaaaagaaggaagaaaggaaggggggaaugggagaagcauacagugaaaauaugggcuccaaggagauccaucauuuggaggguugucagaaaaugacaggugaaagccuagacaccagagagacauauagaaguacuacauucuuugucaucaaagcaacaauggagagaggcucccuaugcagcaucccaaaaggucuaggauuagcucuaguaucaaguaggagauacucuaagagagcagccaugagugaaggcagugcagcucugaagaagaguuccuggagaggagguccauucucuguaauuugggcugagauggaagaaaaaacucccaaaguucaggcauaagcagcuggaaccuggaguaagagaaguaugacaucaggcuucauccacagugggugucacucauaucuguacguuaagaaacccagucuggccuuggagcaggagccauagugacaauguuguuaucuucugccugguauucccuaggcagggauaguaacaaugaugcuuauuagggauaguagcaauguugcuuauuagagguaguaacaauguagcuuacuagggauagugacaauguagcuuauuagggauaguaacaauguugcuuauuagagauaguaacaauguuccuuucuucggacuagucuaaaauuggaaggaugcuugucaaucccauagcauguuuaaaauagaggugaaaacccuuaucaaaaaauguauaacaaaagacuuguacauuccuaugagucucuaaaacaggagcaaaagacaaggacucagcacaugauaaaguuagaaaaugacaauccagagcugugugguacugauagagaaacugguagagucauggcagaucaggaaguucagaagugacccaugaccaguagcaugggucagaggugaacagaauggucuugaaggagaagcacaaaugucagcaaacaugagaaagaauugcuuaacauucuuugucagcaggacaugaaaacccaaaccuagcaaagucugucuuaccccagucggaauggccagcaucaucaagaucaagucaggaaguggaggauaaggacaguauguucaacauacaguuuauuuuccucagaguuaauauaaagauaagccuuuaaaaauaaaugaaauggagaaaggaaaacaauaauagaaaugguacaggaaagaaaaccauuauacaccauuggcaggaaugugacucaauguuccuauagugcaaaacaguauggaagguccucagacaaccacaugagaggaugccccaaagaauguuacucacccuaccacagagaugccuagccaucauguuuacugcuacacugcucacaauagcuacauuaugaaaccagcuuagcaguccaucaagagaugaauagauaaagaaaaugggucuuauauaauggagucuuauuuagccauaacaaagaacaaaauuacauuauuuacagggaaauggacaggacuaaagaagauaauauuaaguaaaauaagcucaauucaaaugccuuguuuuccuaauaugaggaaucuaauuuuccccucaagugauguagaagcagaaagcuaucuguuuaggaacaaaguggagaucaaggcuagaggggaaagagaaggcaauggacaagaugaaugagaugaaaguacacuguguguauaugaaaauggggaaaacaagaaagucgguuugguucucaguauccaaaauucugaaguaauagacugugaucaagcuaaauuuuguuucucacucauuugcaaacccugggaggcagauuaucuugggcugcaggcucagaauguagggcuccucuguucuccuuguuuguuuguuuguuuuaaauuuguuuauuauuauaauuaagaacgcucuagcugucuucagacauaccagaagagggcgucagaucucauuaugggugguugugagccaccaugugguugcugggaauugaacucaggaccuucagaagagcauucagugcucuuauccucugagccauuuugccaaccccucuguucuccuuguucaugguggcuuuuaccccaacgucacaguccaaggugacuacuuuaacuccagccugcgcauccuugcggauguaggaacuucaucaaggagaaggaaaaggaccacgagccaggcccuucuaguguggggaugcugcccagcaaaugaucucagcauccauacuuaggagccacuggccaaaacucagugacagaugaagcugcuccacggucaugauugcuccaggcauacaugugcccaguuagguguugggaauuauguuagcuacagaagaggaaagggugaaugggccaucuguggauaauggggaaagacuugccuuacacacugugcaaauauagaaacuuccuauucuauagagagaguaucacgugucaugagauacacgcuucagaaacuaauacuagagaauaugcuucaguguauuuaaaaaaaaacuaugccacaccuccacuccacacucugugcaaaauaaauuuaaauaguuuucaacauccaaaugugaaaguacucuaaaauuaauagaagaaaguauaagccaguuuuaaauaucaaggaaggauuacagaaaaaccuaaaaggcacagacuuggauuuagaaaaauaacugguuagacuaaguaaaauuuagauuaaacccauucaauaaaagacaugguuugagcaaagcuagagagagcguggcacacggaaaggagauucuugugaccuauaggaucccagucccacucggguaucauagaaacagggauagcaggagagacaguucaacauacacagaugaaaaaggguagucaggaguggagacaagucaccgaggucauucaaaugagucccuucaucugguuagugggaaacugagaacccagaacagugugaguaguaaaggcacuugaaaucucuacaggcuauaggaucauucugucaacuauaaaaccagguaaaaaccuggguccaugcuacugcgcagacacugugagcuucccuccucuauuucaguaaacguuuaaugguaucuaccguaugucagaugcuaugcuaggcacuggggauauagaaaugaaaacgacaugaacucuacacuugaaauuguguugguggaaagaagggcaaguaagcauguacaaauuuaagaguuugugucgcacacagauucacaccgaguccagggagauguacuagcugcauggucaagagcuacaccuuggggcugaagagagagcucaggcaauaaaguguuggucuuuaaagcacaagccuaaguaaaaaaaaaugccagaaaaaggugggcacuggaaugaaggcccagccaauaagagccuauguucuuguagaagaccuggguucaauucccaguacccacacaauggcucauagacaucuauaauuccaguuccagggaauccaauccccugcccucuucuggccucuacaggcagcaggcacacaugugauacacauacauacaugcaagcagaacauucuuauacauaaaacauaucuuuuaaaauguuaugcauggugaaauaagcuuucaauccaagccccgagaaggagaagacagagcgaucccuggggaucaaugacaagccuaccuagcuuacuuggcaaguuccaggauaugagaggcccugcaucaaaaaauuaguuguccucuggccuccguaugcaccuguauacaccugcacacacaugcgcauguacuacccaugggcacaagugugugcaugcagacaccacacacauacaugaggguggcagaggguagauauauuuugggucugccuacuuccugucuguggggccuuggcuaaacugcuggucuauuccaucugucacaacagugguaacagugccaccucauaggccuagagugagaauucagucaguaaacaguggaggcucucagggaacccuggguuucacugugguaggacaagucucaaagugucuggccacagccgcauauacuuugcuaaaucaagauaacauuggccagccaaaggaaaaaggacccggccucuguucccuuccuuacacgcaucucuccucgucccaggcauccugcacaaagggaauggagagaaccaguuugugucccagcagccaccggucaucggcagcaucaugggcaaugggcgcaggagaaguaucuccugccccagcugcaauggucuugcugauggcaacaagcuccuggcccccguggcccucaccugcggcucugaugggagucucuacgugggagacuucaacuacauccgcagaaucuuccccucuggaaaugucaccaacauccuggagaugagguauguaaggggaucucuucccugugguuccuuguaauggccccuugccaccaugaggcccaacagcccuacccauagggaccagagaaguaggucaggacagaacugcaccugccagacacugggacuuuucacuucccaguuccaucaggcgcugccccuccugugcucugugaggaagacagaguuguccuucauguccagaugaugugggaggcugcugacagcugaaaaugaguccccucugagucaccaaaccuuuucuuuuuucuguauuuaaccaauagaaucaguuacaagggucuuuuuguaaggacaaaggauucacagcaaguaaaugucacccaguuuggcccuguuccuuaguauuccucaggggcaguuaccucugucuggcaaggguugagauaaagugaagcccaaggcugaugcgggcucucuggguggagcagagccacagggagagagacucacuccugaccaugaaugauggagcacagcaacucucagcugggggacagcucuugaguuugcauuuuucccuaugccccugagccagaucucuuuacaaccgaagcccucugaugaggugggcucuaugguuaaagggaaacuucgauucagagacaggggagaccuacucucaauuucagaagaaauuuuggaaaucuuuuuauagcuauccuggagcaaaaaagaaaaaaaagaaaagaaagaaagagagagagagagagagagagagagagagagagggagggagggagggagggagggagggagggaggaaggaaggaaggaaggaaggaaggaaggaaggaaggaaggaaggaagaaagaaggaaaaauccacccauauccugguuuggaauagaagggcauucuccaaaguggauggcagggcaguagggcuccuacuguuaaccaguguggugguucuguaaggcauuaccuauuaucaaccuuugacaaauagggggaaaugaacucagagaauuuaaaguacaugaugcucaaaguccagcaucuagaauggugaacccaaaccuagaagaccgauacacagcccugccacccaccgggcaugagagcuguuccaccuuguaaugauauccucugcuggagaagcaucuuaugcugcuuucacauaaacggaggcaaagcaugcugacuggcugucagacgccacuguccuaagagccaugagcaucccauccccacacgggucaacugcccaugcugugggcaccuaggacguggcacaucaggcggggugagauugacuccaggagaguauucuuuaccccuuuucucuguugugaggugaaugcacaggcgcuggucagucagggaagaaaaaccccuugacuguacuugcuucagucggaugaacagaaugaggcaaaggagcaaaggagcaagggucagcucaauguagcagaaacgcugugugacuuuaaaccaacuuuaaauucagagccucccugaauuuccauauccuccaaauaagacauccuaguuucucucucuucuucccacuacuguugaggaucaggcaagaggggaugaugggaggaauaaacaaaauuagggaagaacucuguauuaucauccugacaucuuccuccagucuuuuccugcugggcuuugucucugugccauacccucccuaauuacccucauucuccagucccaugccacauuuugaguaggcucuugguaagcuccgcacguuuugaagacugucauggagaagcaggcaugcagagacccgaaacagcaagccuguauaucucucugagugcaugucugugcaaagaagagaaucaaccacuccuaucucuucugagcccccgcugaagcagcacacugugucaggccuguccucuucccagagucagcgguauggugcagguggagccgggccuccucugugauauguagcugcuuauaagugaacucacugacaaggaguacccaauauaaaauguaucagugucauggcugcuaagucuguauuuauuacaguguuguacaguaccauugcugucaaguuuucagcugcuaauaaugcuucuaacccugcugcuaacaccucguucuuucuucuauucccugcucuccugucuucugucagaaauaaagauuucagacauagguaagccaaccaguggagaauuuccugcuucuccccuaccuuguugcaugcuguaugguaagccacaccugucaacuucagaugucucaaugacaaaggaacccugugugguuagaagcugauaggagauaauugaugcaauuagaacacccagcuccuaguggugggguagguggcaaagauucgaauuucuuauaccugugguaaagugagacacuuguccuauagucuauagaugugacaggcuggaguaauagggggaaguacuugaguggcaccaccuacuuaauucuuagacuagcacaucaucuagacuguugagugaguuucuggccauggugggaagugccgagaucuucuugcacaggugaagaguaugaaaacagguagguuccagaucucaaagucagagcccuuagaaggccagggaucccugaagaggcucuuccaggcaggacaucacaacggcuucaugcagagaacagacuucacacagagcuguguccgcauguggauuugaaagcugagcaugagcaggcagagccacaggggagacucucagcagccugcauaagacucagaccacaguggugcaugggaugguccuauuaaagaaggcucuaugggauagugagagccaaacacagccugaaccaguagucauuuuuuaauucacucauguauguaaguagguaugaguguguacauguguuauuuaaagcaauaauuccuguguguaguugcugcauagcagagaguuagacagcucacaugaauaccaucuuaugucccaucuacccugugagauagacaucugcgauuauuuccaguuuacagaugaggggaccgaagcuccccagagguauagcccugaaauaauugcuucaucuuuaaacuuucauuuuuaucuugaaguuauuaaaaauuacuguaaggaacaaaaggaccucugcaaauuauucagccuuuucaggcacagagagaaguuccaaaaauugcuauggagagacauguugccagugguuauaauaacugcuacaaucuccauuacauugguuuuguaauuagcauguuacaauuuauuuuaauuaugauaagcaugaugauaagaugcucuuucccccaaaaggggaucugaguccucuuauagccaaugauacauaaaagaagguaaauucaacagagauuggaaccgaaaguaaaaacaaggaagaauaccagugaucaacuuaaacucuaagcgucaggguagccagagcaauccugacaacauaacugauguccugguucacacugucaccaguaggaaggacaggauugccaucuguucacacugaagcccaugucacaugagcguccuauggaugagacugaacugcucagggaccuguccucuccauuucuguauugcagagauaugcuuccuguaugccuuaaauaaaaaccuggcaucuaacacugagucauucaguccauggugacauccgcccagggcauagaaguaguacuggcaggcacagcugggaagucuugcaccguguagauuuucuaguuucaauucucuaucaguugaaaaagucaugauugucugucugucugucugucugucucucucucucucucucucucucucucucucucucuguguguguguguguguguguguguguguguguguguaugugaauauguacagguuuguguggccaugugagcuucugaccuucagcgaucuuuggaaacagccauagaguauggagucaaaaccaagccccuggcuucuuucaacccauugcuuucuuaagugagaaaaauuaaucuauaaaguaaugcagaguggaaagggagacuugcccauuccuaauggggggggggcaagaaaccugaauuucagcuguaaucuuugacugguacugacugauagugacaaauuccuuccucucucugagccucagugccuguacccuuaagugaauacugguuagauuaaagaaguucuaaacguuuaucuucgucaucugucagcugcuucaguuucuuccaauaacagcauuugguuccacgggaaccuuggcccguguguccacccccaggacagaguuaucugucuuugacuuuuucaggcucaugccaccugcuauccuaugcauucccaguagcaagagucccuucagcaucuacugcuguguaccuguucaggaaacaggcauccuuaugucuucuaggguuucgucccuggggacaggaagggcuguuagaagcuuguucugaugcacgaaguuaaccucccucacaccaagcugcacauguuguacuaacucaaagagccccuaacugccauggaaaauagauuagcaaggcagaauuaugucaagaauacacagcuauuauuuaccaacauaaauauucuagagauuucuuagggucgccagacuugggggcuggagauauaacuuagauaguagagugcuuauuuaguauucuugaagaacuggguuaaaaaaaaaaagaaaugaaagaacuggguucgauucuuagcaccacagaaacuggauaggauguuccaguccucgaauccuacuacuuagaagauagaagacugagggacacaaguucaggaucauccuuagcuaccuagaagguucaaggucccuuggaauauauaugaccaugucuuaaaaauuaaaaacaaaaacaaaaaggauggaguugguguuugauccucugccucuccggccccagcacucaccucugccuacuggugggaacaagugaacuaguuccugucagggcagcauccaaaguguuaaacgaggcuccuugcccaaaggagaucuuacucuaggaccaaaggagguuucucccucagaaguagaaaaaagauuaucuuucgccacaggagacucccaaguucuaagucucuacccagagcuuccccacuucuuccuaaagaggaagggcugacuucaacucacuaacuucaggaaugcuuccacagccaagguuauacucccagagcucgaagacagugugcgaccuuggaguucucuguagcaagcuccagaggagggcugugaucuaguucugcaucuaacccugcucaggguccuggccaucgaccaggaaaaugcucccuguccaugaaugguccuagggccucuggggccuuuggggccucugccucaggcuaugcuccaucacaugccuucaggcuuuaugguuugcagcacaucccuaggccuucagaaugaugugccugggaaccaucagcaaugccagguccuacccuauggaacugaaaucuacauuuugguaaugucuucaagaguguccucugcacgcugaaguuugaggcacucugcuccaugcccaagucuggcucuaccuaggacucagagaucucagaggcagagcccagcccccguuagacacgcuuguucgggcuacuucuaauuuccagaugauucugaggcauagaaccaucaaucuaagcucacuagcaauggaugcuuccuguguauccuccagcaacaacaccaaguucauucauucauucacucauucauucauucauucauucucacauaaauucagcagaacuuuucagaacauuuccucugaaucuguguagugggaucauuuaggacuugaagccagucccuauccuaaaagaguucaagauguucauuguaaugguagugguggugguaguuuauuuauacggguguuuugccuguauguaucuguguaccacaugcauacaauacauuuggaggccagagagaauauagcauccccuagggcuggaguuacaguugguuaugagcuaccaugugggugcugagaauugaaucaggcccucugggaggucagccaguguccuuagcugccgaaccauuucuccaguuccaaguucaaggcuguauugaggaaacagacaacucaacagagaagaacccgugaaagugccacagaagagagaucugccacagcucuagugggaacaugaggauagaguguacuauaacagaaaagcgggguggggugggguggggcaggaaugguagcucaggugagggaguacuuagccgaagcucccgggacaggcaagucaaaggggcccuggagcucucuuccauccaugcuuucaaggauugcauggcucccagcagaucaucgggccuucaggaugcagcgcugagguguucagggaaccgaggcagcuguguggggaaauagaauagaccaucgagcgcgaagcacguggagagugaaauccacucugcagcuugggagccugcucaggcacuaucucuguccaucucgguuuucucaaauggaagaagacagucccuacuuaauguguuaguuacggggggaaugaggccaugugugucaagugcagacacagacuaggacagaacccacaucuuucagugucagguacaucccaauccauggcauuagcucugucccaugggcugcuggggcugcagcccaggagguggggguugggggagcagaggaaaccacagauacagugcagcugccagugcuggcuggcacgaggaagaacugugcagcuagggauguaguucaguugguagaaugcuuaacacaaagcccuagguuugaucuccagcacaaauaaagccagauuuacugaugcacaucugcagucccagcacuugggaggcagaaggaggacaauuaagaauucagggcuauccucagcuacauggugaguugagccccugucuaaaacaaacaaacaaacaaacaaacaagugugugugugugugugugugugugugugugugugugugugugaaucugucugucugucugucugugcaucugugugucuaaaggcccaugugugggcagagcagagaccuaaccacuggacagcugacagucacuauuucauugucuuaccccacuuaaauacucaccuucuccauucagagcaagcaguuucccuuccaugcugaccaccauauaagcaugagagaugcaacccuaaguuucauaggaucuagggcaauccugacaaggccaccaucaccuggaauucuccccacuugagaaguuccacgugagugacacuucuccagggcagugcagggcuaugugagcuagaaacucaaggggcuaaucuaaguggacagggcccuccauuguacucccuugggguccucucucugccaagguagauagcaccaguuuaucaugagugaugcacaccgaaaugaaauagucccccgccuccuggcugucacagggaagcugggaggccgggaugcugcagcacgauggagcagaaucuaaggucauuguauuuuauuaagcuaggaucaggguugucugggaagauuaaauuugugccaccuucuaagucccaagggaacguuucacaauaaacaggaugccugugcuauuacugccaaccccaugagaagcagaagccaagcuaagugauuuuaaugcaaauaccaccuauauaagcugaaaauggacaugucaucuauuuaagagaagccacucuaaaggacuggaggcugcaagucagucauuggaaaugcagacuggauaaaaaucuagccguuuccccuuaaaguaugaaaggugguaugaaagucgccaggccuugugcuugguguaagacauacacuaguaugaaccccaggccacagaggaaaaacagccagggaaagguggcagaaaaggucccugaaugggugccuugagaauugauaaaaggaacagagcagaagaguggauagaggcaggaccaaaugcaucaaggggccugguauggguguugcuagcgugggaugucugggaggaaggaagaucugugcuuccucugaaagucgggagaguguuguaaacugaaauauggaaauaaccuggugagguuuggaucugaucagaaaaauggucugaggaagagaauccuggccucauuuguuaggaggcgaugggauagcagucuggggcuggagaggaaacgccagugcaagaguagcaugucauguggaccucagggaaagaaaacaauaagagagccucagucuagacaccuggcucugguccaggagauaccacugaagcaagggauguuucuaaucaugagaagucagggccagacuaagacgccauggcccuaaacacacacacacagagagagaggggguugggguacagauacacacacacacacagagacagagagagguacagauacaaacacacacacagaaaucgguguacccacacaugaaaauacacacaaagauagguguacacacacacaaaacacacacacacacacacacacagagagagagagagagagagagagagagagagagagagagagagagagagagagguauagauacacacacacacacacagagacagagagagguacagauacaaacacacacacagaaaucgguguacccacacacgaaaauacacacaaagauagguguacacacacacaaaacacagagagagagagagagagagagagagagagagagagagagagagagggagagagagagagagagagagagagagagagaaagguauagauacauacacauacacccaacacacacacaaaacacacacacggugccucaaguuucacgugugauaaacaccaguuuauaaaauuaaguuuuucaaaggaccuggauuaaucucuaugcuugauaaauguacaauauugacaugccguuugaauacaauauugacauggucagaccacacacaggagcugaaaauugacaucacagugggcucccagugguaagcccugcaucuaugugcucuagacuuggaagaaguuguaaucagucccccuaaguaguacaaucuguacuuagcaggagaugccuaccugaaagccaucuccaaaggcaagcacaggcaccauuacucagcagcaggcaugauugcugaguaccuccugugugccacgcagcauacuacaugugagacacauguggugucaugugaauggucccaauucuuuuuuuuugauaucauaucuuaauuuuuuauuagauauuuucuucauuuacauuucaaaugcuaucccgaaagucuccuguacccucucccccccccaccccccgcccugcuccucgacucacccacucccgcugcauggcccuggcguuccccuguacuggggcauaugaucuucacaagaaugguccugauucuuaagcaaacacuaacacugcuaucuuguagaugaaggaagcuggaggccccggggcccacguuucagcacccacagaauccagacugaccugguuucaugcccugggcauuuuccaagggaaauaucccuuucacguuucucugugaucugacuucuuucccauuaucagaacccacccagguuuugugacuuucucccagaaacagacucuaucagcgcugcuccucugcuguuucuuuuccuugaguuugcuuccaguuagaaagugauccuaccucucauuucuaccugacugcaggauggagacacccaggcuccugauuaacccacccugaggaaggccuggaaauggggaggacacuggcaacagcuggcagcuuuagccagugucucacugucagucucaagauggaauuggaaguugcuguaaaaaccuuaguuguuuaaagucaagcaccuccacguuccuaucuuggguuagcagucuccuaugacaagauucauugauaaucuuuuauguuggacuagaaagaugacucaguaguuaagaacacuggcuguucuucuagagaaccuagcuucagucuccaguauccacacggcaucucacaucugucuauaauucuguuuccaguggauccgaugccuuugucuggccucugugggcacugcacaguucacauguguacauguaggcaaaacacauaagacaauacacauaagaguaaaaaaguauauguuuagcauuugauguaggcaaucauuagcaagaggccuggugaguuuuuuuuuuuccguauauaguuuguauauaugugugugagagggcacaguguacacagguaggcaucagauaugugaauaugcauauagaaaccaaagaacaaccuuggguaccaccauauacccuuuuuucccuuugagucagucucucaauggcuuagaguucaucaaggaguauaggccaacuggccagugagcuccaggauucucccaucucugccuccuaaacacugugaucacgcagacauggccccacagcuggcagggguugguugguugguugguugauugguuguuguuguuguugaugaugaugaugaugauguggguauugaacucaaguucuggugguugcaagcacuuuacuggcuaauccauguccccaggcuaggcaagggguuuuugcauuaguaauuggaagguaggggucauuaggccaagcucucaggucacccucaaugaagauuagcauccucauuagagcauuuugcuuagauuuaaauggguuggaauucauguuauauauccccaucuaaguauuaaacaggcccaacccuucuuaguucugagaucaaaugagaccuggaauguucgggaugguauggccauagucauguugugcaucucuagcuaugugauggagagaacaaagucucacccuagcccugccucucuugcagucacagcccagcacacaaauacuaccuggcuacagaccccaugaguggggccgucuuccugucugacaccaacagccggcgggucuucaaggucaaguccaccacaguggugaaggaccuggugaagaacuccgaggugguagcagggacuggugaccagugccuccccuuugaugauacccgcugcggagauggugggaaagccacagaagccacgcucacuaaccccagggguaaggcuuugcuuuuaaaacaguagcauguguuugucauuaaaauugugucugucugucugucugccugccggccugccugucugcaugucaguguguuuauauuugauauaagcaauuaucaacaagaggccugggaguguguguguguguguguguguguguguguguguguguuuguguguacacagaggaacugugauaauucugccugcuggaaacaaccccccaguuaacaauaccugucuuuccuccugucuuucucugaguguuugugcacauuagucagugcagucaaacaagaugaaacaucaagcacacucuguuagcaagcugcuuuuaucuaaacgaugccaaaugacuucuccaugacaguaaauagucuccuagcuacucauuuuuaacagcuguguaggauucuaacaaaccaacgcucuaucccuugagcaacucccucccaucggguguacaggcuuucccuccaucauugcuacgcaaagacauuguccugugucuuccuugcauauaagguaaacucaaagagaugagucucuaauuuuucauucaaguauaugccaagugcacagagcuucagaaugcauaacaaagcuuacuguagcagaaucaaugacacuuggaugguaagugcucugauagaagagaggagauacauacccugagaugcaagaaaaaagagcuguccacggaggcucuaagccaggagaaaccugaaugccuggagacugaggaagcuugacagaagagaagccaagagguguccuucagucaggcauuuacuauguagcaagcccuacagccaaggacuuguagccucuaaaccucggggaccuacucaguaaaaucaggguaauaauaucaucugccccuacuuccuaagauuguuuugggggucaaaguugacauauuucacaugcuguccuguaaaacuguuagaaauaauuaaagaggacccgauuucaaggucugguuucaaaucacagcagaagacucuugaaaaaucauauguucaaguacaggcauuguuaucuaguaacugugugauguuaguugccuaaccucucugaaccucguuuuccuccucuguguuacaggauacacacagucauaauccaauucaaaugucaggaauauaaaugucuaggacagacagcuagguacacaguaaacauauccucacaggagauuccuauuaauaucacuaccauguguuagguaaccauguagcauuguauagcaucaugauagacugucuagcuaaguaauggaauggucaggugacaacucugcagguaagcauugugucaccagugguucaacucccugcuagcugugauuccuugguacugacugagcaaugaagaacaagcccaggcuugcauugcagguuuucucugccucuagauggcccuuagaccuccucuucucugccucuagauggcccuuagacuuccccuuggaaccucaguuccccaguuugugaguaaacaggcuaagcuaaaugaucccuaggccccugucagcugcaccauccuacucucuucaaauuaaaaccauuucuugcugagagauuuuucuucucuccuggcaucucuccguuguucugcaugccugugguccccucccucacccacacagauggaguggcaauaccauugcccaaaagccuguaauuaacccagacagaaaugacaagggugcugcaguuugcagucacuuugcaggagggaggagaaaagauguccaucuauuuagcacaacaaaaggagaaaaaaugaaguaauuaaucaggggacagaucacuucuauuagccugcgcagccaacuuuguaaacaagaaacccaauuguucauggagcgcucaucaguccuggcagauggaagagagagacagggcauagccaggcggacaggcggcaggacugacucacguccugcugcuuacgggaggaaauuaauugacauucuaggcaggaccacagcaaagacucccagcccugaggcugccugugcauugguaugaaguccuuuccagcuuccuggucccuuaaagagggauggaaugagugcucugauguggccaucacuaagagggccauggaggccuuauccgauccugauggccuggaagccacagagcauuguuuguuguugcagucagaauggucauaaaugaguauugggagcuaagaacuccaaauaagcugcuacugaguguguguguauauguguguguucuagacacaaucauguguaguguuuguaggaggccauguguacaaucacguuuaggagaccagaaaccagaugucauuccacauuuuugauuuuuauuuucugagacaggaccucucauugacccagaauucauugagccccagaucuaccugucuccaccuccccagugccaggauuguaggagcacucccaugccuaacuucucucagcuccccacuuuaccaacugagcucucucccuagccuccccagucagaagcugucauuccacacagcaacgaggaggccaagagucagaggugacauaauucagccaggagcccccuaacucagcaguguccccuccccaugccucaucuaaccuuucucccauugccuggccagaagacaagagaguguaucaagaucacccuucaugucaccaccucccuccuggaccugucauuucccaugguacuucaugcaguucucacucaguccugugccuucauuucaaaaccuguccacccuucauggguggcagguaccacccagaaauucuaaagacccugccaucuccugggugguaucaccagaagugaggccaagaaaagcccccuaggucguucugaaaugagucccuggccaggaggaaugaccuccugugugggccuucuguaccaccaucccucaaggugcccuucagaaacacaaguuucucaugggguuuucucaagcauccaccuggaggugccaugggcucccugcaaggccucaggccucaggcagaaauuugggcacuaagcaguccuuugauccaaugaguaaguaaacggaugccaaagguccagggacugggccccacagccccagaggagaaagcugucaguaugaaauggcccagcaagugaaaggaugcugaaugacagcugggaccccauugucagggugccuuccucagauccaaagucaacaaacccauucuugaugcagacccgaaagauacuuucagucuguguucuuauaaugaccaaugaaaccgaaauaauaaggguugauaaacuuagaguaugauugucuuggaagaaaagagaaauuguugcuaaaaaggagauccaugacuguuguguuugcaggacuucagaaauaagguuacuuaaauaauucacagagacacuggaaaaugucuuuccuaccucgacuucaaguccuucacaaacccaguucucuugguacccaagugaaagauaggagccucuuguagcagcaaagugggaagaacagagccugcagccuaggacacuggauuuuuauuccugguucauaggacgcucaaagccuuggcaccuucguugcucccuguucaucuguaagagaugacuggagucgcugagagugaggcucaguugguaaagugcuugccugacaugcacagaacccuugguucaauccccgacacugcguaagacugggcauagcugugcacacuuauaaucucagcacugggaaguuagaggugggggguucaaaaguucaaggucauuuucucuaucugaaacuugaggccagccugggcuauaugagauccagucucaaaugauaauaauuuuagaugguguucuuauuuaaaaguaaacaaagguaaguaacaaauaaacuguuaaauaacacagagggaucuugagggacuugggauugcucagugcuacagugcuuuuaguaccagaucccagcagaagaagccggacaugguggugcacgccuuuaaucccagcacucgggaggcagaggcagguggauuucugaguucgaggccagccuggucuacaaagugaguuccaggacagccagggcuauacagagaaacccugucucgaaaaaaccaaaaaaacaaaaaaacaaacaaacaaaaaaaaaucccagcagaaggacagagagcuggacaggaguagauguuaaaucuugaagcuuucuuccguuucacucccucucggauccauugcugaauuccuguuuugccuucuccaucccaggaauuacaguggacaaguuugggcucauuuauuucguggacggcaccaugaucagacguguugaucaaaauggaaucaucuccacuuugcugggcuccaaugaccucaccucggccaggccccucagcugugacuccgucauggagauuucucaggugagaagacauugucuccuggaacccugugugcauguguguucuuccugccucuugucaccuggucgccugaugacuacuccucuuggcacuguucacgccuuugaauggagcccgcuugguucagggccuugguugaguacccagaagaagaaaccacuccaaccccaaugcccugggaguucaccauuagcuaugacaaauguguggcuggaguggggacucagaggacaguagaaaaaaaaaucuucauauggccagcagaccaguaugaauuuaaauucuuaucucugaacuuccucuuuaacaauacaugcagacaccuauauacuuucaauaacauaugcugcauaagacagggacucugccugccuguuaccuccucuacuuuaaccaaagugccugggacacagucagagcucagccaauauuuguugaauacuuguuuggacccuagcuguagauccuuagcuaccaaagccuuggggcauggauuccuguaugguuguacaaugaagugauugacaggcaucugcauggcgagauugcugaaaaacacaugcugugugugagcucaacuuugcucaucccuucagagguggugaauaaaaaaaaagcauccacuuucaguaaggaggagacauggguaccagguuuggacucuggguuugcugaauggcaugaaaggacagaaaagcgauaguaagugcaaagaaagaugucacuaagccucgugugagccugggguugcagcccaguugacagauuagcauucauaagccugggguugcagcucagcuuagcauucauaaggccuugaguucaaucccuaguuccauauaaacuggaaaugauggcacgccccugcaaucccacaucugaaaaauggaaacugggaagccaauggucaaagccauucuuggcuacaugcuaaguucaaagccagccugagauauacaagacucugucucaaagaacauuggaaggucgaaugccaaagcagagggcacuuugaagggaguugagauaggaagugugagcuagagccacugagaggaggugcuccuauugugccaaggaaucugggcuucaguagguagacagcaggaaugagacccaguaacuggcuauccaggguuuccugcauauauccugugaugacuuggcaaggaccaaguccuuaacugccagaaccugggaucagagcuuggccugaguuugaucggugagcauccauccugcugacauuaucagagccuagggcauacaaagaggcugacaggaacccucucucucagccucacucacagcgccuucaucggucacuaacacauaucucugaacuccguucuccaagccccaugaccacccugccggcauucccagcacccacaccccggcccagcccgcgaugcugggcuggugccccccugugccagccucugugaaucuguucucugcugcuugacuuggcaauuuggcaggcuucgacuugcuggcuugagaguuucccuuuccagucugugagcaagcuagaauuacccgggaggaagccgccaaaaccuaaggaugugcagaugaguauuuuugcuucucuaaaugggcccucaaccagccagcacggggcgccgagcgcuuucaauccacacauuggaaaguuguuuagguuuagagagaggcacugccaggcacucacaccaaagacuuggaaggcagcuagcgugucgaaggagagaaaaacacaaaagccacauacugagaaaucacaagguaaaaaucucuacuucugguccuugcuuccuuugucuguauguaaaaauuggauauucccccccaccaccaccaccaccaaacucuuaacacaggcaugucuuuuuccauacacauaggguaggugguguuuguguucagagcucccucuacuaaaaacacccagguuucccugugggaaccgggaaggaaagucacagagagcauggcuagagccuucaaagggaauaaggagagaguuugggggaagacagagaccaaaucccaaaagacacugagagaggcacggaguggaccaacagaagucagggccccguccugggagggaguuuggcucucagcuccgcagguagggccuccacccuguacuuugaagcccgaaugaaaacuugcugugugccuggugcugacuagaaaugaggucagagcugauuacagcuucucuuuucuuauguaguugccaccuuagucccugggguagaauguaggaaacugaggcugagugagaggaaaugccuuuacaagcacccugcgcuggguuucaucaaggauggggaaaugaaucucucuaaugagaucaagaacguaauugccuagcgcagagccgccagcugguaauaggauguaaauauuaguucccugaacgucuacaaagaauuuccugguauauugucucauuugcugcaacuccucaggauaauguugauacucugauuuacauaugggcaaagaagcuugguaucuuaagagaccugagucaggugacccaucagugacuguagaagcaaacaggaagugaggcgcccugcccccgucccucccgcucauuggacacacucauucauuuauuccugugacgaugcaucugugcacauucgccacuccguggcaaagcaguuggcucaaaacaccuucauggagauacagaacacucaggacaacugggcaaaggaguccccuccacaaguccccugagcucaggagccugaggaccacugaaguucucagguccagucccaauguucugacggugggaauugaagcucugacaggaucaucacuaacaggaggaaaaaccagaaagccuggagccgcugagcaccauggccuucuuuccugggcacaccguaacacaaagcaacauggaaaaaaaaaaaaagaaaaaaaaaagaaaugcuaaaaugcaaaaugcucucucguucauuuauucuccucucucuccccaccggacucccucucugcucuuucccacccacccacucaucaggacaccaucuuuucaucauaaugacaagcagaaaggucucugcgaguaaguccccaaggugccacaagaccagagggcauaaaauauuuagcagccaguguugacaagaaauggguuuuaggaaauugaaaauucuccugucacuuuagagcaaacuguguucuugauguagccgaaagcuggcaggaccauaccccagagagcaucagggaauguaugcagcaacccaacuguagcucuggagagucugcaagcuccccuguccugcacauagacaggggcuggggcuggggcugggggaaggacaaaaggcuuaggacagaggagcugaacacugacuauuuuggcccaucuugggaauggcuguuaagcuaagagaacaaccucauuguuguuguuuuuggugguggugguggugguggugguggcggcggcaggguuguuugguuuuguugcguuuuuggaaauagguuuucucuguguagcccuggccauccuggaacuugcucuguagaccagguuggccuugaacucagagauaugccugccucugccucccaagugcugggauuaaaggugugugccaccaccacucagcuuuuuugcauucacuaacaaccacauguacauuacaacaacuuuaacaucauccuugaucccguauggcugccauuguaguaugccuccuuccagcuuuaaucuccucuuugucuauaagcuaacuuauauauuuccccuagccgaugucauucuccugcagcucuguagucugccauuucuacuuagcacggagcaaacacguccccccacgucauugaguaucuaacuagaacagugguccucaacucguggguccaaacccuuguggggguggcauguuagauauccugcauaucagauauuuguauuacaauuuauaacaguaguaaaauuacaguuaugaaguggcaacagaauaaguuuacgguuuggggaucaccaccccaaggaacaaauaauaaagggucaccuuaggaaagcugggaaccaccauccuagaggaucauguuaaacgauuaugcacaguauucuaauuugcaaguaaaguaacugugcuacgauugucuagccaguucucagucguugaccaucugagucaguucuauuugguuugggguuauugcuuugguuauugccauauuacuaacauggucgugauaaauacacuuguagagacuagcaugcuagagcaaauuccuaggagagaaacuuuccgauugcauuauucauauuguuugaggagccccaaauuggaccaaauguaggaagcccagggaugucaaagugaugagucccucaggaagagcuggaaagucagcugcaagacgcccugcucaauguuuccagaccguauguaguguagcuaagccucuuggggagacagucagccaagggcuucccuuagugccaguccuuuccagucugauacauccaacagugcuuugguaaaacauuggucacccagacccugauggcuaccauccccuaggcauucaccacgacuucagccacugucccagccuggcugaagagaaacucggugcaaggcuccaggcuuugagccuaagucccacugcaagugucauuaaccccuuccaggaggacccagucugugaagcccuagagaccccccccccaucuaucaggcuuccugagcgccaguguccacucagucacaugaagguucugccugcaggcagauacaucuucaguagguuuggggcaagcuuaccauugugcauuccugaccagcuccagggagcugccagugcugcugaucugaugagaagaaucgggugugguucccaacccuaaaagcaaccacccaggaaguuguuuuuaaauagguccaauguguggaccaacuacacuggggaucuggcuuaucugacuacucagaguggcauuugagcaucagugcuuucuaaagucuccuucuagugugacuaugaggccaacaugaagagucacgagccuaggaccacaugucaggcagaggcaugggguuuccaccuucauacuccaagccuaacuucauguuaagucaccuucaugcaugggccaugccagcauuccaagaagaucauuucaauccuuugaagaacugccgugucagccuccagacuccauccuccucucccucgcgcuucuguaaccauugucuaaguuugagcacucaacugugucccaagauguaaaauugucaucccuaguuucccaauaugaauauugaagcucagaaaagcaaaguaacuugcccaagguagaaaguggguguagguuaggagcccaagcaugucucugucucaccaacuuccuuuuuaaggcugugauccccuucuucgguuuccguaaggcugggucauacuguauaugaaggcccuuuggacacaauaguggguuauugggaguuugggggugacuagugaugggcaucuuggcaucauuugaguguccgugucuccauugucagguucgccuggaguggcccacagacuuagccaucaacccaauggauaauucucucuauguccucgacaacaaugugguccugcaaaucuccgaaaaccaccagguacgcauugucgcugggaggcccaugcacugccaggucccuggcaucgaccacuuccugcugagcaagguagccauccaugcgacccuggagucagccacugcucuggccguuucacacaauggagucuuguacaucgcugagaccgacgagaaaaagaucaaucgcaucaggcaggucacuacaaguggugagaucucacugguugcuggugcccccaguggcugugacuguaaaaaugaugccaacugugacugcuucucuggagaugaugguuacgccaaggaugcaaagcugaauaccccaucguccuuggcugugugugcugacggggagcucuauguggccgaccugggaaacauccgaauucgauuuauccggaagaacaagccuuuccugaacacucagaacauguacgagcuauccucccccaucgaccaggagcuguaccucuuugauaccaguggcaagcaucuguacacucagagccuacccacaggggacuaccuguacaacuucacuuacacaggggacggggacaucacacauaucaccgacaacaauggcaacauggugaacguccgccgagacucuaccgggaugccucucuggcugguagucccagauggccagguauacuggguaaccaugggcaccaacagcgcacucagaagugugaccacacaaggacacgagcuagccaugaugaccuaccauggcaacucuggccucuuggcaaccaaaagcaaugaaaacggguggacaacguuuuaugaguaaguaucaaguuguauucuacgagaugugguguaugauugaaaaugagugaacugaugacauguguuuuuuauugacuucauuuuaauucaggaguggggguagaaaccaugaucaaugacagguucugcauguuuauauuccaaaugauuucuccugaaagggaaaugggauggugggaaaggcaugaguuuuagacucauguggggcuuccaucccagcuguagguacuauguuacucucucuagaucucaguuuccauaccuguaaaauagguacaguagacaccaagauuaccacaaagacaaugucaaccagaaguacuuaaaguguuaguaucuuuguauaaacagcaaggugacagauaacaggaagaacaacuccacguggguggauucucuacauaacugauguuacugguuuuuuuuuuuuuuuaauuuuuggaugaacuucuggcauucauuauaugucuccuuucucaaacacaugauauaaacaucaccuggucuuucuuucaauaugucaaguucguuaaggaaugauaacaguuacauaucauacugugcuacagaaauaacuuccagaagugggcacacaaaacccuucacccaggaaugagccaaugacuuugaucuaguugcuucuuggcuucugcgucuaauggguuauggcuugaccuuguccucgccacaguguugcagcucucuguucucagguguaauucacaccucaaguaacuacccccugcucuuccugcaagguucacaucucagagcaggguggccaaagagaggcagaguuucagcucauuacaauccuaggcaaauaacucaccucaccuauggauagaagaccaaggugcuauuuuaaugaaugggccuucuaacaucucuuuuucgacuuagacuuuuuuuuaagcuucacuucuuugucauguuccagacaaccgagccugcugaauaugucagcauuccaggcugcaggagcuagcgaagaacuuagucuuguugaacaucagcuaugugcuagaaacagagucauugagcuaaucuucacagcagugggggugauggguaauauuuucucuuguacggaaacagaaacugaggcuaagggaggcucauuugcaggcuagaagaaagugagaacccugcagggaaacaggaguucuaaacacaaguucuagcuugucuggagcuagaguuuuaguucugaguugggcuccagggcccucccaaaccucucccugaaucugcaaaucccaaaugaguuuaaguccuuggaucauaagguuuucucaaauuaaauaaauaucagcucucacggcuguagaacccaaugauggggguaggggcuauaauugauuuuuaaauauaauuuacauuuuaaaaaagccacagcccuaugugcaaaguucacuaguuaaauuccuuucuccaaacaggggccuuguuaauuguuaaaaaaaaaaaaagacaaagauccaggaaaauagcaauuaucuugauuaacuuguugaaauggaaauacacuaaauaauucaauuuuccccauugccugguggaaacuucuuauacauuauuuagccaauacagggguuucuuugucagagcaaaucuguucacgcaauuaguucccaaggucaccccccaaaucccaaacggaaugcuaacacaacaccaccacugucacuccugccacuccugaaaacuaaaaucccuuccuacguguacaccgaaaauggagcccuccucucucuccuccaugcaagccacagccacagccgaugguggguuaacuaugacgccgcuaugcgaguucauguguuugcuuggaugcauuuguacgugcagguacaugugcauauguguauggaggccagagaacaaccucaggcauccucaggaaugcuacccaccuccuuuaaggucucucauuggucuggugcucagagacugagcuagccuggcuggccagcaucaggccacaggagccaauuguccccaccucccaguacugcagauuacaagcccucaccaccaggcccagcauuuuuauguggauucugggagggagaggggggcgcaaauuuagguccucauauuugguaagcacuugaccaaucuggauauacccucagcacccacagcucauaucucaagaaaaagaaacuguuacaauuauauuuuuuaaauagcauuaaaaaucuuuuaaaguccacuuuauauuaaagcacuggaggaauguugaucauuggcauaaaccaaaagaggaggcgccauacauaccauuaaagggagacucacauuuuuuuugagaucccacugugugcaagacucuucccucaaugucuauaacagcucugaggguuuuuguaagccccuggaucugacacaaaaaaauaaguggacaagguugccucagucaguaagaauugucaucugcacauucuuuuuaccuaugaacacacuauggcucagagaaaguacacaauaagcuuccgaucgugcuuaguagguuuagaguaaaauccuacaucccugccuacauccugcuacacuggcccagcauucuaugugcuuccugacuuaccuguauggcagggacuaagucacuggugaguuucuagggauagucuaaaguagggaaucuaugagauaaaauguggcaggugccgugacagcugcugcuguucuuuccaacaacacaaggcacuggcaguuauuagagaggcagcaugcaagggaggcaaugaaagcaacagaaaaaaauguuuuauuagagguggaaaucaggagucaggcaaggagaguggaaucaaauaucaagucugagaggucaggaagaaccaggaaaagagucagguccuaggaguaucuaagauggacuaggaaauggggugcacugcagccccaagcaaagugcuccagcucacacuggaaacaaagugaggguguaagacaccuugccgggcagugguggcgcacuugaaccccaguacuugggaggcagaugcaggcagauuucuggguucaaggccagcuuggucuacagagugaguuccaggacagccaggacuacacagagaaacucucucucagaaaaaaaaaaaaaaaaaaagacaccagcacucacuagacuauagccauggagaugagaauagacuggagcuuucaacgagucuccaccacccagaacuaucacucucuuuagggccauucugagcaucaaaagacuugauaauucucuucucuccaucucuguccugcuguuucucuggcuguccacuuccuuucucuccgaaucucugccccaucucucuaagacuuugucaccucucuuuggaucucugaccugcuuucucucugggucucugaccugcuuucucucugggucucugaccugcuuucucucugggucucugaccugcuuucucucugggucucuguccugcagucucucugggucucugucaccucucucuggggcucuguccugcagucucucuggcucucugucaccucucucuggggcucuguccugcagucucucugggacucuauauucuucucugagagucugcuuucucauuuucuagcuuucugucccccaucucuuauacuuagucccuucuuuccuucucucuaaguaucugucucuguuucucucugccucuaccuuucuuucucucccucuugguuucuguccccuuuugcccccucccugugugugugugugugugugugugugugugugugucugucugucugucugucugucugucugucuucugucuuuguacacuucuuucugagacucuaaaacuacauaaauacacaaacaugcauacauacauacauauauacauacacauauacuuucugaaggugaaauuacuucauaaaugaugaaaccagcuagaaaucauuacaacauucuuaauuaagaaaacucccacauauggaguuuucccaauaagccauuuguugaaguagguuuccccuuaaacaucaugagucagcguaguggagucaaauuccaugcuuauacauauaaaaugcaggaaugcuugugggaugggcuguuccugaaacaaguuuuaaguugguuuuaucaauccucacagcacauuaaauaaaacaucuaauauaaacaguauauacuagagaaacuugucucagagagucugccguuguagagaggcaaggucacucagcccaugucuauugggaauccuucuagaagacugcaaugcaguccuugguucuguggaguggacaccauggcuuucagacucaacuccaagucacacaaaacgugaugggaagaaaaaaagaaagucuugcuaaagccagaugugguaguguauaguuguaaucccauuacucaggcagucugggcugccugcauagugaguuccaagccaacccgugcuacauagugagacacugucucaaagacaaaagcaaagaaggaagcugauaaaauggggauagccccgaaaggacuuucuggguggcagugagcaacaagcucgauguguugcauaaagggaaguggcucuagcugccuacagggcccugggacagcccccacuauaauuaugcucacauuaaauaugugagcccuucacuaauucuuuacauuuauuucugcuuuaaguuuggggcuuugccaccucauaggugcucgguaaauauuuuaugaaugaaauguagauccaggagagcagggagacaaagaaggagcacaugcgcagggaggacauuccauuuaggcccuggcuccagcaucaucugugcaccuggcaggacggagaauucaauucacacaguucaaauagaauguguggcuuucggucugugcuggagagauaggagagcuacaacaagcacuguucccaacuuuacaaugaaaauaagccugacuagagacaaauccaggaguuuuccuugaauucuuucucuaaggucacagggcaagcaacaggcccaaauccaagaagcaaacuccaccuacagaaaagaaccacauuuaagcuuccaguuuacugggugggcacagccagacacuagacgugguaguugagcuacagcuacagaaacuggggugacgggugcucgugucuucuuucaugaucuaccugaccucccuacaaaccacagcagagguucuacacacacacaguagagagaaauuaaggaagugucccccacaacuggcaugauaaaggggcacaacagaugcuacugagaaacacaguacccacuggcuccacccacuccuucgucacccugucuccccuaaggagaaauagaaaauggcagcugugcacccuccuuagacacugugugagaauccauacagcucaugagagacggaaagaaagggaacgugauaacugcagcugagagagaagcaggagcagucuucagcccagagcugcugccuaagaagggccaggagcacagagcagaccacagcccugaaacucagggacccauggaccugucagaacaauagagaaugcucccccaauacccacaacugccuaaaaucccgaagcaaaacaaggggcacaauacaguaggaaaggggauauggaguaagccagcacuggaaggagcugucccucuaagauaccacguaggcaggaucuaaagcugggacagagugacuuggagacagaagaaaauaaauaaauaaauaaauaaauaaauaaauaaauaaauaaauagcaagcucuggcaaagcaguuucccaaucaaaugauugcuagaagagcuuaaugccugugacacaccaagguucaccauagaaauagugaaucucaaagccagccugauuccugaggccauuaccucacacacccucauuaaagaccucacaggaggagacucacgucaucucagacucugcugugcugcacaagaugucacauuuuccaacugaccguguaaaagggcaagaaaaagcaagaaaauguagucgucagacucacauucagaucugacacagauguugaaaacaccuuucagggaauuuagaauaacuguaauuauauuaacagcgcuaauggaaaaggugagccgugggcagaucagauggguauuucagcagagauggggaagaaaaagaaucaaauggaaaugcuagaacugagaagcccagcuacagagaugaagaaugucuuugaagggcccgcagcucuugaugacagcaugacacagccagggaaagaagcuaggucaauagaaauuacccagaccaacacacaaaggagaagagauaaacccacagagcaagagcuauggagaauaucaaauggucaaaugcacauguaauagaauucuagcaaagagaaaauaggcagaagaaauaccugaucaaauaaugaccauguaguauucacaauuaauagcaggacacaguuuuuaaagagcucagaaaguaugaaacgaaauauguaugcacauacauacauacacauacauguagaaacuucuaagugugucauauucaaacuauugaauuguuuguaaaagggaauuuucugaaaauggccuaaagguggguguauuuuacaagaggaaaaagggauaagaaccauagcaaauucucaccagaaacuaugcagacuaaaaacagaagugcaaaaguuaaaaaaaacaaaacaaaacaaauaucuguccacugggagaugauuccuaaaauagcguuuuaaugaagguaccuacaggaacagguaaggauaaggaccacagauaggugcugcgacccaucggcaccaaaggaggagcagccgucacuagccaccuuuaagccuuuuagccuaaggugggcauaaaacaaguugcuggaguggucacuagggggaaagaaaccacccaaaagaagauguugguacagcuguaaaaggacuaggggagaaaaaugaaggaauguguguccugacucgucucuuuccaguguguaccucuuauuugaaccuagugaggcaaaccagcagagaugcccaguccaaagucuauagcugcuagccucccgggggacaaagaauggcaaagaacagcuuuaggaaggagcaaaacucucagaauagacacugacugacuccauggcaugguccguguaaaagggagaaccaggauucuacccuagcuggaccugacuccuaagcaccucccccgacccccaccccaccccagaagacaccuggccucagaacagcaucagugagcuuaugauaagguuugcagaucuuacagaucucgguaauccugaagucuagaauuuguuguugggauuuaaucuugcaguaaauacaaguaagucaugaccgaaaaaugcagaaaguacuccggcuacgacuugacuuaggagugcccagugauguaauauccauuacagugaccugggccaagggaacuacuaucacagccagcuuugaacucuguucacaaaugacacagugaccacaucuuugcuggugacacugguauuuagaacaacuacagaugaaagucauaaaaaucacaccuuuguuauccaaccgaaacaucaggaugagugagaguuguguaccagagacguguuuuggcauuuccucgcucgcugcacguagcgaguggcuagcgaugaaguauguggugugaagaaagccuuccagcacgugugaagacacccuuuagugguccccuucuggaagccgaguucauggcagcuccaugaaucuuuuauguuuucucucaccgugcuguaaagaugcuucagagaacuggcgugaagaaaagucaguggaaggaaaucacagaaagccaaucaucuggccaucuuuaccucccccuucccaauggggaucuggcucugcugcuaagugagcugcagccagagccaagaagaacuugucuugaaaacugccagucuucuugacccacucgagacuuccaaauagaauuguuuuccccuuuagcacagcgauaaacacaaaagguuuuguuguuguuguugcugcugguuguuuguuuaccugaagcugcaucauuuuaauggaaauucugaucaaagaacacaaucuccauggucaggcauaccugguugugaaucuucccaugagcuaugucuuuaggcaagcugaucacccucucccaaccucuaucauugccauuuguaaaaugacgauaacaaucccuacccugaaagaugcuuaugaacgcaaugcaugauacccaaaaggcucugugauuauuagugagcucuucuuuucucauauagaauggaauauaaaguagaaaguugcucuuaauccgcucaaaaaaaucaacaaaaaauaacuaccguucucuuauucagucagugaacccugcgguguagugucucuaugcggugucuucuuuaggcacugagaauauagguaaggucccuguguguauggaucuuacauuccaguacgagaagucggguaaacagauagcaaguauaaugaagugaauacgauacagucacgugguaaaggugguggcagccugucuguuuuggaaacaggaacuuugugugccagcacuacaagggagaaagcauucucuacaacagaaacaacagcccccagcacaacuccugggcucagcauguuuggcacugaagcacagcgaauucaagagaguucagaagagcaauuuccccugcaaagucagaaugagagacaggaaggagucaggucacacagccacccuucacucacauuauuaagcacuccaaguacucggcauucagcagugaucagcaaauccuggccucugggggcugacauuccacugaggaaagacuccuaggacacugaagagccugguaggaaguucagauccacuggaaguacauaauccuuuuggaccucacuuuaucuaugacauaggcauugguguugccacucauggaguggggagcauagccgccaaggcuguacuauggcgccugcgcauaaccacuggcuguggugaggcuuguggguuaggaggaaacaggccugagaucuguccuccaggaucaccccucugucaaagguaaagauaagauccucuagccuacacugugccaucucuucugguuuggaagaaaacauggccagggcucugagaguuuuuguagugcaaagcaggacagucaagccagaguggugacacaucagucaucccagcaccugggacguagccgcaagaggauccgcaguucuauguuguccuucgcugcacagccagcucaaagucagcauaggcuacaggagacaagggggaaaaaaucaaaccaaaccaacaaauaaaaaaggcaugauagucagaaucaaagcaaugucccagcuucacccaaacagcuggggcucagaaaacucuccucccugauuccuaaauccugcugcaguagcucucaggcaguagcucucagcaggucaacgccaugcaaaaggggucccgcagaggaggcccacaaggcagaggucucaggaccaagaggagaaggcuccagcucuuccaacucaaugagaaggagcagcacucagaugggacaaucacauguaucgaucaggaggccggggagcccaucggcaucucccaagcucugggagauacggaaauuaaugacuaggagacaaacauguauacauuggcagcugcaucugauguucauuuaauuaagaugugcaguccuucuaccagaauauggggagaguggaaauggcuggguuugggcggucacauauaaaaugagaaccagaucuugaaggcgcacagccuuuucauuguaucuuccucuggcucgauuuaauuaugcauugccuuccauaauaauuacaauugucugccuucauacaaagccuccuucuauuuggagacuaaagcucaggggagaagccuagggagauugcugaaguaucauuuagugagagcaguugccucuagcuuuguguuuccagcagauguuuaucuugcaccuacugugugccgaggucugcccaguccuacaggaggcaggagugaguggaccauggucucuuucuccccagacccauucuauauccauguauuuguuuagacauuuuacccccaucuccuggcugcuuucuugaugucagucuuaaaugauacuugaguaaggaugaacucgggagccagcacaccugggucacaguaguaacagaugacagaacccaguuggugugaguccgaacucucagccuagcagccugacccacuauggcugccuugaccuggagcacacggagucccaagagggaaccgacucguacaccagcccuuccaaacuaggagaaagcaggagcagggcacuucccuggggcucuuccuggucaugcugagcugcagauauggaaaggacuaggaaagaaagauucagagaagagauucauuuuccugcuagauaucagcuagcuaccagguaaaguuacaucuaggaaaguaugccaaaccuuggacaaggagaaauuagagguucuggaggagacccagccagaaagaagaaggcagagugugcaaagccacagcuggagauagacacacagcuaaccucggcuaccucacucuucuguuuugcucuucguugcugugaucacagcaucaauggucaaaacuaacuuggaagaggaauaggugugaugucacuggguucggagccgauccuaauaccaacacuaaguuuguagcugaagcugaccaugacauguacagucauacuucugucgcuaacgugccaccccuuucuuugauuucuagguaugacaguuuuggucgccugacaaacgugaccuuuccaacuggccaggugagcaguuuccgaagcgauacagacagcucagugcacgugcagguagagaccucaagcaaagaugacgucaccauaaccaccaaccugucugcuucgggugccuucuacacccuguuacaagguaagucagccagggccuggggacuuugagacccagagaugaagaugaccagaggaggaagcuacuacaguagcugcccaagaucaagaaagccucuugcuuugguuuuucucuguucugccaccucauuugcaaacaugccaggcagaggccuauaaauugucucucagaggcuucagagugauuuuucauugucccauccuauuauccucagaacaaaggggagaaaauccauuaguuguuaauccaggugaccuccuacucugcuguuguaauggcucccagauuuaaaaaaaaaauguuagcucacacugguguaagagagacaaaggccaccaguaauuacaccuaauuguggcaggaauuuggguguacagaaguccuuccaggagccagggagacaauuguuccucugccuggacuccaggguuuccccuucugugcagccaucgaaucaucucagauagggauugguguuuuagcuucagaccccugagagugagggagucuugcugugagcccacuauuuugacuguucccaugggaaguagugaccaccggggcagcacccacagcuuuguugaguuuaauaaccuaaaagaaacaccaaugucacuuaggaaagcccugucugacuuuuugucuuucuucccucaucugauacacucccagaucucggcaucuaacagcaaaaggagcucggcucuggauguccaagauccgguucuagcucugccucugucacuaaaugagaccacacacagcccuuggguuucuucuucggggaaagaaagcaugcugaagggguguuggguaguauggaacagucccuggguggaccugaggcaccugugccuacuggaaggggaagucacucuuguucucugagccucaguuucuugaucuuggaaauggggccgcauuagagacucugccacacagaguugccuagacauaucuagagacagcauucauaaagugagcaucaugggccaggcacagagcacugcucagaaacuguuugcuggauuaacugacuaacuaagcgguuggauuuaccacgaggaggcaaauguuugcauguuugcauuauugcuuuuguucccaaacauaguuuuugucuuucaaaaagcuagacagaaaaauaggaguuauuaaagaaaaagagaccaugcccagcaaugucuugcuguaaugaggaguugggacacaggacaguguguaugcucuggcagguuuaucaccaagagaaacuaccaccugcuaagaacccuacccagccuacuaggacagugacuguuaggcugcgugaccuucaacccagcuuauucccucaccaugcacgguuuuucuacccacuuuauacugccaggccugcuuuaauacauuuuuauguucaggcaacuuuuuaaaauucaaaagugcaacacuccucaacuuuaaaaccuaccaccauuuaaucacugcuuucuggaugggggagaauaaaagcccaguguucagcaucaugccuagauuguaagacacccuccaauuccaggaacauuggaauguaaagaggaaaagcacgucccagaauccaggggauccaguaucuacagucugccggguaccaccgcaagcaagcucccugucaauuucacggucguuccaggcucgggugcccggccuguccgucaccucagcagagucuuuguaagaagcucuuucagcuucaucuuaggucugaacagugggaaauaaugagaaguagcugcuaaugaguagcacccuugggcagucacagccagcauuagcugggaccgugugcgaugaaccuccccacaugcuggcccauccaaagucaacaguaauagacguaugugcauuccgggaggagaagcuuuacgagauaaauugacacaggcuuucucacucuacgaauggaagcaaaauacagauugucagugcaugaugcauagcaacgcggaggcagauuuuagaauccccgugagcaauaaaguguggaaagauggagugcaagggagagagaggagaggcccagucugaugucauucuaacaggaagauucaacgaggguuucccaugaaaacuacaucuuuuaaaaaagauguuuucauuuugcauaauguguaugaguucuuagccugcguguguguauauauauauauauauauaugcaccacaugcaugccugaugcccauggaagcaagaaagaggggucagauccccuggaacuggagggacaggugguuaugaguugccaugcgguucugggggaugaacucagguccucuggaagaucagcacugucucaaccgcagauccaucuucccaguccccgccacuauauuuuuauggcuuuacauagccuaagacauacuuaauuuaauccagcaaaugccgaacacauauaauaauaguagugcuagcuauguuuugaacacuuaccagcuaaaagggacuuuuggccacuugugucuaacuccuuucacuuacaguaauaucaauaaugcacuuuuuuugcaauguuauuuguaguugaaaaaacugggacaaauuaacuaucuacuugguauuguuaaauacauuguauuucuaaauaauggaagacugaaguuauuuuuuuguuuuuguuuugguuauuuuguuuguuuuuuuuuuuuuuugcuuuuuaaaacugugggcuuguuuguuuauuuuaaagauuuauuuauuucauguauaugagagcucuaucuguauguucuccugcaugccagaagagggcaucugaucacauuauacaugauugugagcuacuaucuggcgacucacaguugaacuaaggaucucuggaagagaucuuaacugcugagccaucucuccaacccaaaggcuguaguuauuaugaaaaauguuuauuacaaguauuuaacagcaugauaugauacacuggccgaugaaaaaacucuauaguaacuauuuggcucuguaaaugcauuaaaaaauaccauaaaaucuacaaaucuacaacauauuuccaaugguuuugaguacugagcuuauauagucuccagauaccuuccuaguuuucuucaaugauaaaguauuacuuccauauuuagggguaaacacauuuaaacccccacccuagccuccauccucucucuucuuaagcaucuuuucucucuucuccuucagaccaaguccggaacagcuacuacaucggggcugauggcucccugaggcugcuacuagccaauggcauggaaguggcucugcagacugagccacaccugcuggcuggcacugucaaccccacuguaggcaagaggaaugucacacugcccauugauaauggccucaaccugguggaguggcggcagcgcaaggagcaggcucguggccaggucaccgucuuuggacgccgucugcggguaagcggaggaaccuugcagccauuaaucccggugcugggggucggguguguguuuggggcggggagaguguauuuauagaacggggucccauuuuugaaacucuccccaguuucuucaucuaccaaagggagaaccgaggccacaagccacguguaacaaaaggcugugggccauccuuuccguuuugaucuguguaaacauggcuagccuugggaugggcucugaacugaguugccagcuuguauucuacgacugaacucggacaugucagucaccuuaaagccucagggucagucauuaggaaguaaagccaauguugccugcuguuucgacaugcagugucucacacaaagcuuggcgcacaucagggucaguaauggcugcugguguccuuacccgcucgcuacgcugcuuguucuugucacugcuaguauguccccaaguuuauuucaaccacuuaaaaaaugagccacauuugccacucuuucugagucaguugauccuuucuaaugaucaaaaggacugaguauggugucagggagaucacaaguucaaggcuacccuggccuaugugccaagaaacugucugucaggaugaucuuagcauagcugucacuguggaugggaggagccaccuugaagacugguauuuuggagcauuuuucaguguggggcccuugggcaccuugucugcuccccucccguguuucuguagagcuuagccuuggcccaggacucacuacccagcugccuuccucucuagguucaaaaagcaaaguuuaaagggcaaagugcgcuaaagcgggaacuuggugggugagcacuuucauggcaggugauuaagcuuggaaaccagggcugagggaauguagagcugcaguucaguggcugcagauugcccaguaauacaaaugacaaagcagaaggcgagaggcuguacagugggacagccagugccccgggccuggcucucugcccaguaccuguagaccacaggugcucagcaggccgcugccgagccgaagagaacugcagaaacauccucaccgcaacaguggacucuugagucccugccucucacccaaggaaguuucuauacauucccuucuucuacaugggcaaccaaggucaaaagaauaggugauuguuugcgagucacacagcuagguggcuauaaauccugggaaacagaugcagggcagaagcaugguggcuaaugacuuaccuaaccaugaaaaccagagccugggaaaccaagcuuccuuuguacccucaacagccaagaacucuauaacuagcuaguuagcuaauguggaaaccagccuccuacuaaguuccuguggaaggcugggcuagcucuuuguucccugccaccaucuggggucucacuaaacucaucugcauucucaagagccccuccuacacuucugaggcagugugccaaaggggaaguuugaccuagguuggauuccugcugggccucguguguagccuccagcaacuccucggagucuaagcuuccucugcagaugcaagaggaugauguaugcguucaaagcaccucgcccagagcugcagaccccaggugcucaguaaagggcagugauuagugcuauuaggaguuucucuccaccgugugaacaggaccugaaguuucucaggcuuuaauuggucccucucccagccggagauagaugauacccuaguccgguggccacaucuccugcuuccucccaaaauaaauggccaccaacaguggcaguuuguggaaugagaauguuagccgggugugccuccccauaauggagcucauuuuuuauacagcugggaauuuuuuuuuaauaaagaaagauguaaaauaaucucauugccgccucugccgagcacaggaagcauaaggugcuucccccagugaacuguucaauucaguuucauuaauuuuugucacaaagguacagaucuccuucuucacugggauccuugggggugggggugggaggugcuguccauguggcaccaacacuggugggauaggaggaucucccaaaggugcucccagaaggcucccaccauuguugacagcaugucccccuuuucacaugcccucucugcgaagaacaugguuugagcuuccaacgccucugauuuuucacgggaaucaucugccacacgguuuuugcuucugcaauuguguuugauuacccuggggaaggcaagcuuauuauaaccaggccauucacagcuaaagccgccucggcaucaucauuauaaauccuuauuuucggggccuuggcauuuguauggggagagugggagaagacacacacaucucuccuuccucuaagacugaccgugaucaugugcagucauuuaguggaaauaauuacagccaucuauccgaugccuucuaugcaccuaguuaguaguccacugaggcuuuacucacaaaucuagguguauacaccggaagaaagugagucucugagaaguaaaggcacuugaccaaggucacacaggaaagcuagucacaaaguugagguugacauuucaaccuuaauccugacaccugccuauacccaaacccucuucuaaauauacagaucccuaaaggaucuuuuauucccucaggccacacaugccauuuuacauugugugaccuaauuaucugcuuuccccuugggucaucuugguugucaaacuugcugaaugacaaguagaagaggcagcaaaggugcccccugugcccuguagggccaacucccuucccuacccccagccggaugcuuugaaaaacuuacuaacauuuggggacagccuaugccgaaaggucaaauccaaaggcuccaaagcauauuucuuuauuaaaacauggagcaagagaccuggggaaauggcucaaucaguuaagugcuugaaggucugaguuuauuccccugaaaccauuugggggagggagaccagacauggugacauguuuguaauccuagcucuggaaaggcagagaagauagaucccuggggcucacugggcagccagccuagcuuaaacaggaaguuccaggucccuguguauccccauauauacaugugugcucauauaaacacauacaaagcuccugcuuucagcuaccuucaugagggccuauaauucugacucaaaagggaaacugaguuggugguggccucacagaccagagggagaugacugagggggguccugguccuggaggcaaaaggaaaguacucuagaguuaggacuaguuccaacaggacuacaaaagaaaccacagggaaugagaacacuccuaucucucagcaaccucugaggagaaacaagaggggauggcucagaagacagcaggugaccuagaaaccuugccugugggcaaaugcaggggagaaccaaagaguagcaaguauagaggcccgggaaugcuaagacuugcucagaaaaccaucaaguaucugcuucacucaugaaagcaaaacccacacuuggucauacaugagccacagaucuguagcuuccaugagcuugguuaucuugaaauccaacacagcauguugucuggcacagagcugaugggugagguguugauuugcugggcuugcuugguagcucucuuuuugggauagaguuaagagggaucugacuuccccauugaaacaacacaugauaaaaaucgucuucaucagccaacgaacccaugugcucauccaucacucauguugacuuuauucuuacaacaggccuaugaagcuggcuucauuuuuuucuuauaguacagauaaggaaacuucaaagcacuaacagauggcaaggugagguuugaugcccacaaccugugcugcuuucuguucucgagagcucaacacaguugguuggucaucagagccaaauucucaguguccacaucuacagucucucuuucuuaucccuuccccagguucacaaccgaaaccucuugucuuuggacuuugaccgugucacacgcacagagaagaucuacgaugaccaucgcaaguucacccuucggauccuauaugaccaggcagggaggcccagccucuggucaccuagcagcaggcugaaugguguuaaugugaccuacuccccuggaggucacauugcuggaauccaaaggggcaucaugucugagagaauggaauaugaucaggcagggcgcaucacaucccggaucuuugcagacgggaaaauguggagcuacacguacuuagagaaggcaggugucugucugucucccuucaucacuggucuugccauauagaagcuugaucacuguggguauaguuuuuaagacagguaccacuacacuacccagguguacuugaacuccuggccucaacugacgcuccuguccuggccuccugaacaguugaagucauucacuacuacaccugccuuugucauugcuccccacagccaagccuagaccgcuaagcucaguaggauaaaucugacuguuguaguuucugaaaguggagguacacaucuuucaaaaggaaagaggguccuggggguaucuggauggauaauagguuuaaugugcugagaaggaguuccuaagccagggaaacacgaaagucuuguugauggagaagagcaggucccacccuaacugguccgagggugcugacccaggacaagauucugcucccaagaugaucacacauacugccaauuccccacagaggaccaagcagaagccugggggucacagaucugagguagagcaggcuuaauccaguggggucagaucugagguagagcaggcuuaauccuauggggucagaucugagguagagcaggcuuaaucccauggggucagaucugagguagagcaggcuuaauccuguggggucagaucugagguagagcaggcuuaaucccauggggucagaucugagguagagcaggcuuaauccaguggggucagaucugagguagagcaggcuuaaucccaugcugcuagaacugggugugggucucauaaaucccuuccacuuugaguuagaauucauuucacccagaaacuaggaauaaaaaaugaucuagaucauaaaacauguuuggguaaaauuucuuaaaaguaccuaaauucagaaguugggggugggggugggcauggucguuuggauagcuagaucuagccuaguuaugugaugacuaguugucuagauccagacucuucacuuuguuucuugucccacucaacaguugagggucccaggcucugcuugucucugcguaugcuagagagcaauguacuguuauagggcuacaagacagaugauggaggucgucccaugcccugaaaagccacuccuggagagggcagacacuggcgcaaugagagcacuuauagaacaagguugucccuuaccauuccagccugcccuaucccacagugggcccaugacuugcuaccacauaaaaagugaggagaagucuaaagugcccuucccaaacauggucuauauguuauaggcacagggaagccucagaugcuguuuaggcuuugagggcaucaggcuguguuuuagagugucccuucuuucuugaauagaaauaccaaggucagaagucuggaucagggaaggccguagggaugcagaacaccacuuuucuaagccuuccguuucuuuccuuuaaguuguggguacuugggcucucauuccuucucccaccuccuucaucuaugauuuucuucucccuccaguccauggugcuucaucuccacagccagaggcaguacaucuucgaguuugacaagaaugaccgccucucuucugugaccaugcccaacguagcccggcagacgcuggagaccauccgcucagugggcuacuacaggaacaucuaccagcccccggaaggcaacgccucagucauucaggacuucacugaggauggacaccuguuacauaccuucuacuugggcaccggccgccgggugauuuacaaguauggcaaguugucaaagcuggccgagacucuguaugacaccacuaagguaagcuucaccuacgacgagaccgcagggaugcugaagacugucaaccuacagaaugagggcuucaccugcacuauccgcuaccgucagauugggccccugauugaucggcagaucuuccguuucacggaagaaggcauggucaaugcccguuuugauuacaacuaugacaacaguuuccgugugacuagcaugcaggcugugaucaaugagaccccacugcccauugaccucuaccgcuaugaugaugugucagggaagacagagcaguuugggaaguuuggugucaucuacuacgacaucaaccagaucauuaccacagccgucaugacccacaccaagcacuuugaugcuuauggcaggaugaaggaaguacaguaugagauuuuccggucacucauguacuggaugacuguucaguaugauaacaugggacggguagugaagaaggagcugaaggugggacccuaugccaacacuacccgcuacuccuaugaguaugaugcugauggccagcugcagacagucuccaucaaugacaagccacucuggcgcuacagcuaugaccucaaugggaaccuacacuugcugagcccugggaacagcgcacggcucacaccacuacgguaugaccuccgugaccgcaucacuaggcugggugauguacaguacaagauggaugaggauggcuuccugaggcagcgggguggggaugucuucgaguacaauucagccgggcugcucaucaaagccuacaaccgggcuaguggguggagugucagguaccgauacgaugggcugggacgccgaguauccagcaagagcagccacagccaccaccugcaguucuucuacgcagaccugaccaaccccaccaaggucacccaccucuacaaccacuccagcucugagauuacaucccucuacuaugaucugcaaggacaccucuuugccauggagcugagcaguggcgaugaguuuuacauagcuugugacaacaucgggaccccgcuugcugucuucaguggaacuggcuugaugauuaagcagauccuauacacggccuauggggagaucuacauggacacaaaccccaacuuccagaucaucaucggcuaccacggcggccucuaugauccacucaccaagcuuguccacaugggccgacgggauuaugaugugcuggcuggacgcuggacaagcccagaccaugaacucuggaaacgccugaguagcaacagcaucgugccuuuucaucucuacauguuuaagaacaacaaccccaucagcaacucucaggacaucaagugcuucaugacaggugaggauugagguauacccgaggucaggaccuaccccauugcuccuugagaaaacugguauggggucaugggggacacuggcuaucucuaaagacaucaucucccaaagucuaugaaaagaaacacuaguuuggagacuauucugaaaauaaugaccaccauuaucgccuuuguuuuuuuuuuuagaaaacuuuuccuuuucauuuauuuucucuauccugacuauaguuuucccucccuccucuaucccuagucuuuccucccuaccucuucuuuucgccccauaaucacccuaccuucaccuccccucagaaaagagcaggccuuccagggacaucaaccaaauacugcgaaacaaacugcagugacaccaggcacaucacauugaggcugaugagccaaccaguaagaggaaaagggucccaaaggcaggcaagagagcuagaaacagucccugcucccucuauuaguaaaucccacaagaacacggagcuacacaaccauaacagaggacaaagucggaccuauucaggaucccuggucuucaugagcccacuugaguccuggucaguugauucugugggcccuguucuugugguaggacggccauucuuaauuuuucauacuacacuucaguuuaugaaggcucuaagagacucuguaguaaaaaaaaaaaaaaaaagugcucuuugguuuacuuaccuacguuucuaaauuauuucuccauaaaauccuaaugccucacuagaaacagccuuuagaaugcucucuggaaguuucugaaauggaaaucaagcuggguaugagaauauggguuaaggugugucuaaaauaaaaucagauuuuuugacuuaugaugauggaaaguacagauuuuuuugaggcagacagagcuaagggaauggaccagccauuucuuaacugugacauauuauuuuacugcuccaaaguuuuaguuuccugggcuuaguuuaauagaauaccacagucuguauggugguucacacuguuaucccagcacugagaaggcagaggcagaggcagaggcagaggcagaggcagagaggcagagaggcagagagagaggcagagaggcagagaggcagagaggcagagaggcagagagagaggcaggagaggcaggagaggcaggagaggcaggagaggcaggaagagaggcagaggaggcacagagaggcagagaggcagagaggcagacaggcugacaggcugacaggcagacaggcagacaggcagacaggcagacaggcagacaggcagacaggcagacaggcagacaggcagacaggcagaggcagagaggcagaggcagaggcagaggcaagcaggggucucuaugaggucaaggcuagccuaaucuauauaaugaguuccaggccagccagggcuauauaguaagacccugacccugucucaagauaaauaaaauaguuagaauaccuacuaauaauucuguuuggauaaauguuuauauguuaugcuagagcaacuauuagaaaccuaaaaacuaaaacagauaagccaagggugugguggagauauaggggucaggagagaguucuaggccaguuugggcuguugaagauccuguuguuuuuuuguuuguuuguuuguuuuuuguuguuguuguuguuguuuaaaaauugaaucagacacaaauagacaucauuaauaagucagcaaucaaagauaaacuagaagauuaagaaaacacccagaguucaguugguagaguacuuucuaacaugcacaaagcccuggguuaaauuccaacauucaggagguugagucugggugaucaagaguucuacaucaucuuugacugcuuagugagucugaggcuagccugggauaugugauaccaccacaucucaaaauguguaugugguagugguggugguggugguguguacaugcauaccauacauauuauauguaugcauguauguauguauguaugauauguauguucauacacacacauccauaccaccaccaccaacggugacgugagauacacauaccuaacauagcucaugcugguucccuuucugcccuuuugcuuuaaagggaaagucaccuuucauuccucugaaaccaacuugaguauagagugucucaaggguccugcagaccucucagacugcuaccgucccucagcaggcgacacagggagagcucugugggauccaaauaaagccagccagguccuugugagaauuuacacugagaaaaccugcuaaccucgugaucgagccauucacccccuuuuugcaacuguucccuucaccccaccccucccgguuccagacaugagaauacagaaauuauucccgcccuccagaauuccucacuaucagaggaaaugcacacucugguccaucgugaggggccaugaggaagauuugcacagauggccauuaaaucacagaaggcuagcaaccggcucugcccacaggguucugggaagccuucagggaguagcggcugauccucgaggcuggcuccuguauagguugcaucaaguaguagggagaaaggcauucuggagagaggggucaacauucacaaaacuggaaacagggcauuguggcuagcucacagaugcuauagcugaaagcaauaggagaauucccuuuuuuccaggggaaaaagcaucuagguuguucuauuaagaggaagagucccagucaaggacuagaaggagaccaaggugguacacagaugucauggaagcauaccugggaccugggggguaaacacauauauuuugacagcguugccagccuuuaccaugcucaacuuggcugcuagcacuacagagccuugacagacuaggaugacauuuccauuacaucugucugcacaaagcacgcccccugccucacccuccaguggguuuccugugagacauuuuggcauguuacuauagcuggggagaaaaaaaauacuguaauaggaaauguaauuuuccauaaaaaaauuguuaaagcuugccaaaaauuacugcccucccccucuuccuuuguacacaaccauaugcauauagucuccuuccagaacagcacuggcgugauuaaacacucccugccgagcacucgcagauacggucuccuuuaagccuggcaacagcucugugagaucacgacagacaauuaucugcauucuacagaugagacacgugagacccuggaggaccaagggucugcaaagagucacacgggacagggcucucugguuucagaacauuucccgugauaaucacccagccucuaaauccugcuuucuaacacagcucucaacuauccaaggggcaccuuacauuuucaguuuguguuucauuucccagacaguuaaauccagcaaauaucauauugguuaucccuucucugugccagacccacgcuaaggauccaaaagggaagaaggcuuggcgccugccuucauggaacacaugcccccuuucacaaauguccuugacugugagcccaccuuaagaaaaagaguuguggagcuagaaacguagcucagucuguagggugcuuguuagcaugugugaaguccuggacuccauccccagcaccaaauaaaguagguguuguguuugcauuccuguaaccuccguauuccagagguggaggcugggggaugggaaguucaaggucacucuugccuacacagccugaauaggaggugagaaccuaccucgaaaaagaaaaaaaaaaucuauuuuauaucacuauaaaacacuaaaaccaaagguuugcacagcaguccuuaaguuugguaucuauauauuuuuccagucuaguguauuccacuucaacaaaaauacuggucaugaccccaaaauugauuuuaccuacgaaguggauccuguggcacaugaaaaagauauuugccaucuaaacaaucaagcuuucagaacaucagaaaugcuuugcaguggcuaaugugauucugcugacucucacuauaccucaccuuuuaccuucucugugggcuaaccguauccucaaacauacucaaagguccugagguguacuccgccuagguaggccugggucaugagacaauggagcaauuaccaggauugaagaggacagaaugcacugauuggaugauccuggaucacaugguccaacagagaaagagugcagaauuggaucauggggaggcgacccuaaaauguccaccaugggucugugucacacaucaucgugcugagucuuggccugagacuugcgcuugggggaaacccacacagacagcgaaguucaggauugauaaaguaacccuuccacaaagacacugggaagccagccuuagaaccuguggugucagacuucagaauacuuagcaguuuugggguuuuuguuuuuguuuauucuaauacauucugugaagaacaaaggcaugcgcuggugaaagggcuucauaucgcuuguguuuuauuccuccccugcggcagcagugccuuuugggacugacagguaacucacggagcuuuucaagaggaaggaagcacuugccccugagguuguaagaguacaauucccagcucuucugaaaagccugguaggaaagcuagcuaauaaauagaucucugacauuuuccugaaagacaugauagcaaagcuuccgccuucugucuuccaucacucauaggucaagcccagcccucuccugugcccccugcuuuccuagggacugagcgcuauuccagauaaccacaaaaucccuaugcacauucucagccucaagcaaaagggcuuugugagguguucucuccguguguguguguguguguguguguguguguguguguucuguuuguuuuaauuucccaaagaucugugugcagagaauccuaggaugaaagacuccuggaaacucaagugagaaaagggccauggacaaaagccuuccaagccucuguuauaaauuaaaaaacagggaucuugggauacauaaugacagaaacacacacacacacacacacacacacacacacacacacacacacauacacacacacaccgugagcuaguaccugaucuggauauuauacacuaaauccaauguuuuaggggcaagcuuggaacugcuucugcuacagaguagaaguuaagauucuccaaguucacuguugguacccugagaagccagcauguggguuuguguggccuuaacugccacacucuuucccuuccuguuuacaaucuggaucuucgcagcaaggcugagugaggaguuaaaccuggguccuaguggaggggccuaggacaaccaaaaaccaaccaaccaaccaaccaaccaaccaaucaaccaaauaaggcaaggucaaaugugagcugccuagaugggagagauacaugggucacaggaguaucaugaacacaacuguugacacccacaaaucauucccucucagcagcuuccagagggggccacuuccuccuuggccuaggucaucaaugggaccucccagcagagauguguuucuguuggaaagaaacaaaaggcaccuggcuccgaggcaggccuuaaaaccuuguacaccaccaccaccccacucuaguuuucugagucuccuuuguggcccaccucaacccccaugcaaggucauggcuuuugguuucucuauuugguugguuaccuagauggucuguugucauccucgguuuugcuuugcuuucuuuugagauagauuucaccguaaccuaggcuagccauaaacucaccauguagcuaaggauagccuucaacuucugcuccuccugccuccaccuccugggugcuggaauuucaggcaucauucugcggaguucucaggacugaacccaggucuucaugcacucuggacaagcacucuaccaacccaggaucauagacuucugguuccauucuucauugagucaaaugcccaccgaaaaaccuuaucuauaacucgcaacuccaaggaaugugauuaauaagcuuagaagcaggcaggcuaaggcacugggaggucgagugacuuccuugugcugucagaaaagacaaacaggaaagcccuuugaucugaaccaaccagcaccaugcccagaagcgcuuuggccugaggcuacaaaaaggguggggaaaggaggggcagcuuguuucuuaagugaauuuuuuucuuuucagagucagccauuaaaauccuuucuuggaucugacugaccuuugcaaggguuuccuacugcugacggggcugggggugggccugggagagcugcauccucugggagggcacuaccucuggguaagcagaugaggggugagagucaugaagacaucuggaagcuugggcgcugccuaggcuucaucucucuuggaucuacccccuugaggaggacucugggcaugcaccuggcagagggauugcugggacccagcagcacaguuggcuuuaagaccaaccaggacauuauuuccauaaaguguagcagucagcucugucaccuuccccuuguggccccugguuauuggcuugcuuacuccccaagcuuauuucugcuucucuccacccagaugucaacagcuggcuccucaccuuuggauuccagcugcacaacgugauaccuggcuaucccaagccagacacagaugccauggaacccuccuacgagcucguacacacacagaugaaaacucaggaaugggacaacagcaagguaaugcuccacaugacagccacacauuggcuguucugacccugacgcaggggccccaccaauugugcaggaacaccaagccagggauggaaacugagggaugcagugccuucaugaucccuaccagacaacuuucaacagacagaaaacuauggcuaggcaggccccaaggacccaacuguagcagcacauggacacccacaggcugcaugaaagaguuuuucauaauccaccguguucagaguacaacaaaaaauaaccagccuuugucacuaugcgggcaaaagcccugagagaaaaggaguguucugaaugcagaugggauucuuuuuugagcacccgaugaacuuggcuuugaguaacauucuacuuacguuagcucacaaauaugccaggcuguuauucuucucauuguacaggauuaaugcuugcaaccauucaaacccagguuuguccauuucgugucaucuggcugagcgugacuagcagggccauaagaggggggaaaaaaaguuacauuuucuuaucucccuuuuaugaccuaauuucaaagacucugaauuauauggcugggaaaaaaauuuuauaacaaucucgucacaccugcugaucacuucacguauugcucaugccaaccucagccuccauucauaaauucuguaucuggauucuguguccagcccgguacuguggcccaugaaaugcaaggguggguuagcagaaaccaagccuaggggaugccagcucagagacaguaaacuccggggagcggccccaaugucacauggcccgauccugugcuuggaaacccagccaccccgguucuuuuccucccccuccugcuccuccuaccucgguacacacaccuccacucuuuugagagagacauugcguucgugugcgucccucucugaaccuggagcucacagauucagacaagcuggccaaaagguccaguggucugccuuuaccugucuccacagcccugauguuacagccaugugccuccaugcucggcuccuuaccuggguauuuggggaccugagcugagguccuucugcuuguggguaagcuaacugagccagucccccaguaccaugucccuauuucuuguuccaggcuaaauccauuaggcucauccgagcuaccuccucccagacuugcagaugagucugcucagguggugugcucuguuccaccuucguuuucuuucuuauuccuucacuagauucuaaaucccaacaggcuaaguuacagguuaagggucucagucaguguccagcaugcagacuagcacauuguaggugcuuuagugacucagugacugaaccauguaaacagcucauuucauaaagaggcuaggcucagggaaauuuacuuaaagguguucugcugaaaaaugacagaaggugacaaugaaccuaagucugccuggccacagagcccauccucuuucugcccuagccugucccagacccgaccccagccccugguccagaugucccagcauuugcuguccccaagcaaauuccagccacacaguacuuccucccccuccagguuucugcuguacucuccagaguccccuucccuggcugccuguuugccaaccucgccugucaaugaauuauugauuucugcccuuggcaagcauuggagaucuuuguuguugaguacuccagcuuuugugaaacucuaggaaauaauuguucacagacaggguucuauuaauuauaaagaggacuuaauuucaaugggaggcugaugggucuauuucuaaagccugugccccgauuugcugaugaagccuggagcccugagcacagcuucccugugcugccugagagugggaggggcagacagauggcacaccaaccaacgggguccaaccugaccccgcagcagccaagcuggggguacuugaggaggcccaaggaggcacuguggggcagaaauccuccuugaaguguggauaaugggagggcagagugguagaacaagcaagagacuuaagacaauucauggcuuuucuaaugucaugcauuucuuggaacccugccuuuucccucucuucuccaccuucugagcuuuguuugcaucucacuccuacagcugcccuugacccugaccccuagagucacacagaccuggcuuugaauacuaacauggagugaguggugggacuguaggcugggaaugagcuguguagccuuaauuuccuuagaaguaagcuugaagcugagugcagugacucacgccuuuagucccagcagaggcagaaguaaguggaucucucagaguucaaggccaaccugguauaacauacugaguuccaggccagccagggcuacauacucuguuuguuuguuugucuguuuguuugaaaugaacugaaauaauaacaguaucuauuauagggaucaagcaggguguuaaaugguaauucuugaguugaagaucaaugaauguuaccguaucuauuagcugugaaguguuuuggaccaccaguccuuacacuuagcugcaguauugucaugugugucugggccuaugaaaccaugaguucuuugagggcaaagacaauguccaguucauucuguaucuccacugcucagcaaggugccuggccagaguagcugcucccugcuguggcucugaauagaaggguguggggaugaaggguggcuggauguugugaggaucagcaccguggagacggauguuauaagcuaaugugucccugcagauuugacuucacuguuuaaacugauucucugcacucuugggguuugccucccuuuugucuuacacucucccuuucucuuuuucaugccccccccaucagucuauccucgggguacagugugaaguucagaagcaacucaaggcuuucguuaccuuagaacgcuuugaccagcucuacggcucgaccaucaccagcugccaacaggccccugagacaaagaaguuugccuccagugguuccaucuuuggcaagggggucaaguuugccuugaaagauggucgagugaccacugacaucaucaguguggccaaugaggaugggcggaggaucgcagccaucuugaacaaugcucacuaucuagagaaccuucacuucaccauugaugggguggacacccacuacuuugugaaaccaggaccuucggaaggugaccuggccauccugggccucaguggggggcggagaacccuggagaauggggucaacgucacugugucccagaucaacaccgugcucaguggcaggacuagacgcuacacugacauccagcugcaguacagggcgcugugccugaacacccgcuacgggacaacaguggaugaggaaaaggugcgggugcuggagcuggccaggcagagagcugugcgccaggcuugggcccgagagcagcagagacugcgggaaggggaagagggccugcgggccuggacagauggggaaaagcagcaggugcugaacacggggcgggugcaaggcuacgacggcuucuuugugaccucggucgagcaguacccagaacugucagacagcgccaacaauauccacuucaugagacaaagcgagaugggccgaaggugacagaaagggccaaggccuggacuucuugccaaagacagcuacucuucuguggccguauuccugacuguguuguacuuaacaaaaaacaaacaaaaaaacacaaaaaaacagaaacaaaaaaacaaaaacuucuuuuuaacaagugcagaaaacagaacagaaagauauuuguugcauuguuaauucaugcaacauccuuuuuuuuuuuuuuaaagaaagaaaaacacaaauuuggccuucacacuuuuuuuuuuuugcaaagaauggaaggguuuuuuuguuuuguuuuguuuuguuuuguuuuguuuucuguagugugaucaugaugauaauuucauugucuuuuguucccuuuuucuccuugaggaauuuucccugucguugaggauacauuucuccucucuugggggagcgcaucuccuuggguguguccacauccgccccuagguacccagugugaugugagacacgagugucugugcuaacuugucucguguguaacccuuucuucucuggcuggaguugggcaggagugaggggucacagagucacaggcccggugggaccuugggagcucugguuaggcucccacagaaguggugaguugcuauucaccauguuuugugccuccugaggaccuacaucaugcucuggaaauuuccaugaugcuguucagcaccuuuucaagccaccccaaacuccugucugagcuuuauauuuugaugcuaaaugaacccacccaccccccuuuuacaaaucucuaguguagcugucagugccgccccccacccauaaugagauagagaaagugugucucccaggcccauucccuagucuggacuaugagccccauccuuuccaagaggggaaagcacccaggaugcugugaguuguugauccuccaugaugccccucgcucaucuccuccucucucccaaagucaguugugagaaccagcagugcgcagcaagcccccaacguucccaaagggaagucgagggaacccuguccccauggcuuuggguuaucuucccuccagugcucggaugccaccacugaugauugggaguguggcaagagaugccuuugauccuggaaagauguauaaaagaacaagucagccaaagacaggagucaacaaaggcaugagccaagcacccuagccagguccuggagucuccucugccuccccuguucaggcuauucccugaaggcuaggccuucaggaauuuccuucuguggaauucuucauuaaagaaccccaggcaggagugguuuuguuuuuguuuuuaaauaagaagaaagagcucuuugguuuggccuagcagggucauacaaccccacugagaucagggauggcggugccagagcugguacccauggacccagaaggccaggcuagcauuguuccugugaagaccuguguacauggcauuuggacgagaguaggcauaggcgcagccagugcuggaggaccggccagagggagccagcaggccggggaaguguggcgggcagaggacuguaacaagagcuaggagcucacuggaggauuccuuuccugcuuugucugccuagauaccauuguuauuggcacucccagugucugggagacuggggaagccaaaugcuuccuuuugagccgggcuucuuagaaaaugggacuuuuauggguuacauuuacauuaaguguggaaaaugaauuccgagucuaagcuauuccccgugggaaccuuguuggacugauaaagcucauggcaccuuuauagccuuacagagucuuaagaauaugacaugaguuaaugaaaccaagaaggucucuuaccgcaggagaaucggagcaguguguaguucugccuggcagagagagguguccaaagcguguugggggaggggagaucucgccuuauguugucccacugggauaagaggauguguuucguuaagugcucuuccugauuccaaaaaaagaaaaaagaaaaaaaaaauccgucacgcuguugcaaccgugugccacagccugcucuauccacugguugcucauugccucuggaucaaagcucugcugggucagauuugaugcccucucaggcccacaguaccuagcgcgagcuguaaugcagacccccuucugguaugaucauucuugggugggauagaaaauaguuugaccugaaacacauggguuuuucuguauccagaagacauaugccccucaaaauguacguuugcuguaaggguccugugggcagaguuguccugugaguuggccuaguugaucugucccauacuggcugccugacauuggcugagauccgccggggucauuuacuuauaagacagagagacagcaugugacccaagggaccaucuccuuguagcuguccagccugugacuuccuccucuguugucucccucccucaaagacuauauuuuuaggcaucagugaauaccaugagauaugggguauucuucuuuaaaaggaaugaucccauauucuuccuggacugccaccccagagaggaaacaggcaagcaucccugagcuguauaggaccucagcuguaggccagacagugccaugugccucccuugacacugaugcuguccucccugaacuaugaccuuggcuccuuucaguuggauuccaccucccagguguguuuaaaggcacaggccacaguuccuuucgcccauuuaggagacuuuaaauauaaaaugccauccuggacagcucccgcucuuucgacacucauuacaucuauccacuugagagagugaccgggucuuccucacugguggaaguuugugauucugaugggaguuagcuucugaaccucuaaggauugcuuuugcauaguucccaccuucuccacccuccacaacugccaauuagucccccagccucagccccuccuccaagaccuuaaacaagacuuuauuaguuucugaccucgucuuuuauacccugagacccccuuuauggucaucucccaggcaggcaucacuagaugguauuguggugauauugacuccauaguaaaccacacuuuagccuuuaacacuuggcucagagccacugguggaaaacuagcccaagguccacaccagugccugacucuacugaaggaugcugggcuugaaagaaacccuaggaagcuaaagggagacugcugaggcuggacaagugccugaaaauaagagggauugcauggggaggggggcagaugaugaagaagagccgaguaagcugaguaaacuggcuuuauaggcuugaggcaagggaagaagaagaaagggccuuacaacugugacuuaagugacugccuuuauagagaagguuuucagugugacaucuuagaacacaucuuugccauuugcaguccuuguguuucugcuggccaugugauguggugagagcagugacauugggcuuuguacccggggagaugagcuggcuggcuuccagcagagggcugggcuuugggguuaaaucacccauuacacaaagaugaguguguccuucaucccucacaucaacugcuuagcccagguuaugccgauucugggguaggaggauucaccucccauggggucccagucucuccucucucccgggaucuucaucaggacuaaaagcccuccacgagaggcacaccguccccagcuaggucaaaaccauugucuauauuuugugagaggggacggaaguaaaaaaugaacucugugguucaagaccuuuuuauuuagccuucccaaaacagcaaacucauuuuaaagacucauugcucaggugacugaaacuuuauccucuccaacccaucauucucaaaaaccagccuuguguacuugacugcccggaacaguggcgggcuaugcgguuucacgguguuguggaagaucaaagguggggaagcauggggugggaacccuguguuguguuucagaggccucgguggggcccuguguuguacuucuuacccucuggggaaugccaaaggcgugagacugggcuacuuccuagucccuaagaaaaaugugauugauucuaagggcugaugguucagggcugacugcccgugggcaggcucggcuguccccgcagaagcugacccacagaugucuggugguucccagcagcucuaauccacucaucaccagaaccccacuguucuaaaugugcccgucauucugaggacuucugaacccgcagcucuggcaaaggacgauaaugagcugccucuggaugaccaacacuggagacucuggccuuaccauguggaaauaguuuuccugaagucuggaacuaauuuugagaaguuuuuuucucaacacuuuuguguuucuaacacuguauucuugacuguguaaauaccaacaaggcuguaaauaaaugcagauguagauaccuucuagaaaaaaggggggaaagcauaaaaacaaaaccagaagugaucccguguagccuucguugacaaauaaaagacuauuuuguguuuaaag

SEQ ID NO: 3944 - RNA, 5873 nt, Mus musculus
agagugaccucagaggacugagauggauaaagccaacuauggugacacaugaaagguaagguacuagagcucucaaggagcuuucaaacuaguaucauugaaaaggagauaucacauaagccacacucuuaccagaaacuucgggauuauggaauugcucacugugugcacgguggguuagcgacugauaccagaccagaaauucugcuugccuguacccuguuaugcugaugcuuuguaugcuuggcaaaugcuugcugagcagugaaugcaggcaacuugucuaccaucguauuuaagugagacaccuauuuugaaaugaauggggcccacaaacuucauuuacaaagcauuauacaagacuggcauuuaggaaaaaacuuuguuuuugaagguagcauaugaauaugccuguuccacaauauguguguaucugugugcaugcauguauguauauaugcguauuuauguauguauguauguauguaugucuuuauauauauguauguguguauguauuucuguguuuauguauuuguguguauguauauauguauuuaaguauguuuguauguguguacauuuguauauguguaugcuccugcauaacucaauuuucuuaggcagagaugauaaguuuuagaagacauguaugacaaggagaagccaugcuuuggaacagaagaguaaauccuggggaagaagaaaucagucuguaauuuuggagacucugugguuugaaagguuugguauuuucugaguaccucaugacucacugugugaggcucccaagucuaacagaucaguguggccaggcccauggggggugggagcuguggccggagccacgcaggaagagcucaucccucucucugggaagaagggaagcccaggagauggugaagaccucccagguagggauccuccccagcccggggugggauauauccuggaagagagagaaugcuuaaaagcagacuaggauugcuaagaauaagcaguuuuacugcggcugcuuacagggcuccuuaaacugguaagugcaagucagggaagagcccaucugucuuucugccagcuugcaucagccagccucaucuugcuguucugugcaguccggccgcagagcuagcuguccuacaggaagcugugagcagcccugggggaggcccuggggaaggagagaaggguguggccccucccccuuucuguacacaucccagagaaguuuuugucauuugcuauaauggauucugugccuucuuucaaaaggacuugugaaaucuuuaucugcucuuuggaacacaagauuuuuaaaggucaauuucuuucuugucucuuaucaugagaaacgugguuuagagauagucuggagggugaccagauuguagggcuuugugugaacgcuccauccucacagugggagaugggggguaggggcagaaggggagacagggaacuuugcucucccuuuucuugaaauuucuccugggcugcaucugucaauuugggcaucgccagccaugauugucuuucaaggugccaagagccucaguagagauuauuacacauugaagcugcuuagagaaaccuuaucaaaaaggaucugacugcuuaaauuccagcagagcuuuuauucuggcaucuuuauagcuccugccuggucuagcucuccugcugauccgcugugugaggcuucauaucuuaacugcauuucuccuagacuccauuuccuuguauguaaauguuucugccuacaaguguguugggaggagcagugaaaugaugcacauguagacuuuuuauuccacaaauauguaauuguuuaggauacauuucuuucucaaggccaggucuuacuugguagcccaugcuagccuuaaacuuaugaucuucuugccuuagucuccuaauuauuggugugaaucaccagacccagcaugcaagacagauuuuaauaaagaaaauuggaaaaauagucaagauucacaaagaaugaaaaaaauaugguaccuccaugugcaagaagacagaaaaaaaacuucacagagggcaaaauuucaaugaaaaauaguuauacauaaauauauauuuuaugauaaacacaaugcccugugauuucgggcagaaaggaucaggaagagagcugacacuuacaaauaacaaguugaguaacucacuggacaucacacaguaagaagagccuggaaucugaauccaggggccaggcuuuucaucuuuguguuauguugaccaaucacaggcacuuuaaagucaaaccuguaguucuuacugugacccugcaagggaggcaucaccuccauaguucacggucacucugcauggaggaacuaccauuucaccgucuuugagaugggggugagacgaauucucauggauggucacugugugucauuugagaagaugcaugugauagcauuucaugcaggaauuugcacaggguaagagaugaagaagguagcuaucaucugcaacugagacucacggagaaacuggugcuaagcuagugucaggguccuagugcuugccccucugggcccacucagcagccagcucccuugggugaaaucugaggcauucaagaggcacagagcaacuccacagaagcuuaggagaccagcugcuuccuagucauauucaggaugcuuucugcuuuucaauucagagaacaaccaaccacacgugaagacaaaacaaaccaauaauacucucccaauucaaccauaugggcaaauuuuuuuuuuuuuuuugucucacagauuaaaaacacuggaauagcauucuuaaugaaccuuggaauucaaguugaauuuuaaaaagauuacuuuaagccuagaaaguugggggggggguaaaggggggaggaagaaaugggaguucucagguagcuugaaggaccuuggugguugacaagggagccaggucugagguuuggguauagcaaaggcuguaaugcagucaggccaggccucagagccacuagcagaccguuuuauccaguggcaugaucuggguagaauagaagcuaagcucuuguguccuucuccgaggagauggugagggacaucaauaccauguuccucucaaugucacccuacaaauccaccacugagcuacaagcugucaaaugacacuggaguucuccuaggcucuagaagccucugagacaauuuuucaaagccucuucauuucugggcaacaaucuccacauuuuuggaagagcagaagucuauaugggaagaagcagccuucuagauguauauaaggccacaugcaguaacucagcuggaguucuagugugggccaugcuauuggcuuucugugugacucuaaugaaauaaaugaggucacaugucuggguucccaacuccuugucaaugucaugcaggggaggagaaggagggagauaaaguucccucuagacuagauucaacauuaagcucugcuaauuucuccuucaagcccugagucauuucaagaacucagugggccucuugcccuuuccccuucuacccugaacuacuuucugguauuaugcugaguccccugccucagcagacaugaaggugacuauuucauuuuguuuccauuagauguagucauuuggacaccaauuucuucuaaucugauugucucugcuugggcagggcuaagagauuaaaaggccaaugaggauaaucuugggcccuucugguccuguaguuuauuuuauccaugcuaccuuacaaaguagggaugcucugaaccucugaacucucccaauggauagaaaucccacugaacuuauaaacuuagaagauuccaaaguaagguaagaccucucucucuucacauuugagaaccgaaugccaaagacauguccucccgagauggcuguaucuccagucgugaugacccaugggcgaggauucuuccuggcacugcaucuaaguucccuuccaggcaucugacaauaucagcugaaugccuggaugcucuucuacaacagcaagaacccacaguaucacagucaccucccguuuccucuuucuagauuauacauuuugcaagggcagagacuguuagauuuauuuccgaagcccugggagccagggccugaugcagugcagaugcucggugaacauuuguggagcaaaugaacaaacucacagcacagcuuuuguacagcuuugccacaaaguacguacaaacucauuucuauaauaugcuucaaaaacuacauguucuccugcaauuggggauuuucugguuguucuuuuuuuuuuuuuuuuuuuuuuuuucuuucuuucugcuggcucacuucucagagcagcuggagaaggcucuguuucccuagggucuagaucauuuccuauaacacuggggcuuuugcuacuguggguccagguuuucugggaaaacuguguuuuguuuuuuuuucccagggcuggcugucucugaagcauggcaaccaggguguauagucuggugcucuguuuuauggagaggaaugagcaagcccugguuuguagccugcucuugaauguaugcaugugggggacuauguguucucucaaaaucgcaaaaacauuuaguucuguagcugcccagauguuccacagcuguuugaaagcugggccaagacccuggacucuggggaagagagugacuuccugguggggguucucucucucucucuuuuuuuucaugacuguuacuguuuaucuccggccuuguagcuguacagacaaaacacagcgggaugcugaggguaucauacaaacagggaagcugaccucuuucccacagacagagccugauugcucccucuuaccugaagaccaggaugcuccauacccuugcuuucuucccccugcccuuuucugugagaucucuugagaacaaaagaccccuucaccuucacucaguaaaauuccuuccugccccagcauccucuuccugauaaauauuuuccugcucccacaacuaacacauaacccugccacagcacuuagcauaauccauuaacacgcagccuuggggcuugcuccuuccugugagcuucugcgccuggucauccacaagagacuugucacauuugggcagaugagacaugccaaguuucagcaugauuaagggacaugccaacacugugggauuucaggaagacacgccucuccgccuagagaucggggcccaaccacaagggucccuuguucaugauuauucucauaguccucaucugagguuaucuggguggcugacuucuggauuucggcaguggacagaaugacugaaggguagcucagcuaaacaucaaugcuauaaagcagcuauucugggauucgaaagccaauauuaaaauaucauuauacaauauuacaauauuacacacuugaccuuugaccguuauaggguuugagacugugggaacauucuagguaggaaauuuccaaaaaguaugaugcugaguuucuaguucaccaauuucuaacauaucuaucugacuuuuuuuauuuuuccaggaacucccugagguugguagaaccagagucuucuagaugggaguguggaauuuacuaugguuguuguaacgcaaguuuacacaguagaaaacugaaagcuaauuuuaugccugauauaaagacuugauuaaccuucauggacaaacuaccuuauuucauaauugaggagaauaaggcucagagaaaccuaguaccuugccuacagaggcauggggaguuauagccagaguuggaauuaacauggguuuucacccugaauuaacaaauauuccauaagacuaaaccccuccccccaucucuugggcuuugauuacccaaaacuuaaaaaaaucugcaaagcagaggcag

SEQ ID NO: 3945 - RNA, 7812 nt, Mus musculus
cggaaccucgcgugcagagguugcuaaggcugagcgcacagggaagcuuuugggugcugcaccgccguacgcaaugcccuucagccuagagcgcggaggaggacgguagcucggucacggcguuuggagucguuguuuuuccuauaguuggagucgaggucaaaccucucguggaaccugccucaagaugaugaacggccggccgggccaugagcccuuaaaauucuugccggacgaggcccggagccugcccccgcccaagcugaacgacccgcggcuugucuacaugggcuuguugggcuacugcacgggccugauggacaacaugcugcggaugcgaccggugaugagagcaggugagggcugcgggcgaucccgcucggacgaggagcugcaggguugcccgcugaggucaucugugcucuacgaggccuuccugccuagcugggggcgccuggcucucccagggcgugcauccccucucggguucucagcgccaagaguagccacauugaagaaaaccaagugcagugcaauggggacuucuaaaccccacgguuaagucugcgaaggacucaagaagggcuccucacaguucgcguuguacuucgugcuaaacgguugcccagcccauuucucucagacgugagaaaguauuguacugacgagagcacgagacccaagcagaguuaaagcaccuugcccacggucuaguuaaagagaggagcuuguguuguguuggugugugcuuagaaccagagcuucucagaguuggagugcauagaaauaauauacaguuaaaauauugguuugauucauaaggucuggggagaggacuaauguggacaaaacuccagacgcuacuacugcccuuauucuggaauaggagacugucaauaaacuagcaagcuguauauucuaguuugucacuggcuucuggucacgauugagaauagcuuagcuuacacaauguagcugugcuaagaacuguagaauuccaaagauacauguagaagcaaacuaacugucuuuguuauaguuauucuuuauauggggggggggguagaggggagauaacaaccugaauuaguucucucuccaauaccgugucagcccuggggauugaacuccccaagucagacuugguggcaaaugucuuuaucaugucacuagaugugaacuuaacuuugaauaucaagcaagaguuaaaagaacuucguaugucuggggguggggguggggugugcaaggcguucugaaagugggugaauuugauuacuuagcugcaagauuacagugauaaggcugcagaggcuaucagacgagggcaguuuauucucuggguggggaagacaugaaaacuuuugagaacugaggaaguucaguggugagggucaguuuugucagcaaucuaaaccaucaguuggcgccaaggaccacagcacaagaaugcuaaugaaaugguuccagccacuaggacucaucccagcuaaucgucuguguuagacaugaaggucagcauccaugacauccuagggucacuggucacuaguccucaaauacuauuggaagccaauaugucuuggaaaugcucguucucucucucucugucucucuguguguguguguguguguguguguguguguguguguguguacacucacacacacgugcacgugugugucugaucaugccuaagcuugucguuugggaacuacaugguuuuauuucauuguuuccugccugugucacucuggcgagucaugugucaaucugccagucuccucaucuaccaagugagaauccuuguguauucguugugacgguucagugaguucuguggauuagguacacaacacacaaaaggugcugagugaggggaacugacuggacuucucugccagaccuugggguuguacauccugaguaugggagaagaacugaccuuuagaagccagucagccagaaauacaaaucauuguguugcuggucuuggagugguagaugcaugcuuugauagagauggcaugauggcacuuugagagggugaaagcgguacaaaugugaggaagaauguucugcaggugguacagacaggcugcaauguggacugugcuauuuaguaccgccuuauugcuuccagggccuggagaagggcauaugcuuugugccaggcaugguggugcaugccuuuaaucccagcacuagggaggcagaggcaggcagaucucuuuucguuuguuuugccuggucuacagugugaguuccaggccagccagguuauacagugagugagacccuuucuccacaaaaaagaagagcgugugcuuuggggugugaugcugugucuccccaacuagugauuuaauuccaaggaaacucgauguuucuguaagaaaugaaguaauuuuagacagcagucaggacgagagucagaauuccuugagcauccuuacugcucuggacauagccgugcuggagccuguuuccucuacaguauuuccugaacacauacuguguuggucuaacucaguguucuuaagccuucucuacuuacagcauauuucugucaguacauuuuuauguaacccccaguauauaggaguuuuuuguuguuuuguuuguuuguauuuuguuuguauuugagacaaaaaucucaauauguagacuaggcuguuguggaacucagaggaauccuccugccucugccucccacguguugagauuaaacuugcucaccaccauggcuggcuauauuuuaaauagauauauaaagcaacauuuacugaaaguaaaucauaaugcaguuuauuuuaaaacaguuuuuuuuuagucagucauaaguuuucugcauuagauuucucaucacugugauaggauaucuggauaaagcugccaaaagaaaggaaaggcuugcuuuaaaggauucagaagaaaauguagcagcugggccuaguggcucacaccuuuaguccuugcacucuggagacaagacaggcauuucuaugaguuugaggccagccugggcuacauagugaguuccaggauagccagggcuacaugaugauaccuugucuaggaaaaaaacgaaugaggaagugccaugggugcgcacacgcacgcacacacacacacagagagagagagacagagagagagagagagagagagagagagagagagagagagagagagagagagaacuugagcauuuccaagacauauuggcuuccaauaguauuugaggacuagugaccaaugacccuaggaugucauggauguugaccuucaugucuaacacagaugauuagcugggaugaguccuaguggcagaguaacacaagagagugcuaaaucugcauguagucuuucaaaucgagcaucagacuuauauagucauuacagaagaaaacauggaaguuaggugauacaucagccaagauacauugagguugucaucugaugcacaaugacucuuuacacaaaacugagaaaugcauacauaaagacuagcaggaaccaggcagugguuacaacugagauaaaaaggggcccuauggcuaucauaagaaccagcugugaggauuuugcacccuagucacaauucuagucuauuguauaacccaccaccaggggucccuuaguaagcaccuaauuaugcuauuccucugggccuugugaaaacuugcacuuggggaguucugcucuugcuaaccuuuucaugaauaauacaguacucuaguuccuccuuaaaccacaacccaccuuuccuagaccauuguaaaucccugcauaugggaguaacucggcuguaauucugaguaccuguggggaaccuccaggagaccaauuaccaugaaauuuuuugccccaggacauuuugugccucaggaccucagccaagcuuuuggacuugucacacagacucuacuggagugggugugacaaggaagaaaaagaaaggggaggagggguagucacccuauggggguggcucacaucugaacagaucaggaaacauagaugggacaggacuuggggucagguuauaagaccucuggcccucaaaaccagagacccagguagagccaaccuccuaaagcuccacagccucccaaaauagggucaccaacugggaaccaaaugcuugaguggaggacauuucacauuuaaaccaugauguacaguaacgagugugacccauguuucuuggagacuugagggaguggcagaggaagugaauggugggcuuuggacugaagccuuggagaguacuuagcauucuacagauagugauggaauauuuuagcagugaaguaaacuuauaccagucuuuuuuaaguuuguagaaaauacuaaauaaaaugucuucuuauucuauuccugucaucuguguuuuaaaacccuggcugauaacuccuucaaguuaguugguuauaaagucuaaaauuaaauguuuguugauuuuuagcgugacaaugguaaugcacuguauguaaauggcauaauggcuuccauguuuagguucaucaauaaaggaaagaaagggaaagugguuguggagggaaaucccagagagaaggaagcugaggggaugggaaccuggagaacagcuaagcuaugccguuagaguguggggaccuacagcaugugugagucuucugcugagacuugggggucacgguagagccuggucuuuguguagcucggucgcucaguggagggcacgggacacugcucagagaaccaguuuggggaauuaguggcugcagcucuagacugaagaauaucguguagggauggagagauggcucagcgauuugauuuccaguauucacaugauggcucacaaaugccuguagcuugaguuccagaggguccaauggggaguugggccugcacaggcuuuuacauguggugcacauaaguauauacuucacucucacacacacauaaaauaaaaauaaauauuuuuaagagacuaucuuacuuuuauugcuuuuucacauuuuccagaccaccuuuauauacauuuuaucuugguuuguauauuacuagaacgagaaagauagaguagguauguuguuguuguuuguuugagacaggguuucucuguguagcuuuggcuguccuggaacuuggucuguaaaccaggauagccuugaccucacagagacccaccugccucugacucccaaguucugguauuugccaccacuacccaucauguauuuucucuuuguagagauaguaaauuuacuugcccaaaggcuucauuacuuuaauaaauauacauuagguguuaaaugcugauugguauagccagaugaacuagauguugcuugcccuaaugguagagacaggaacaaauuaugguacaacuuauaaaugaguucaccuuguggacuccacaaaauaggaaaccauuguagagguauugauaucggaagcuauagcaugauggugcaguugcugggcacagcaguaaccagcauguugguggguuuuugucuaaaaacuguuuuauuggguuuuacuauaucugccuccuuccaacccuuauucuacccuaaucccuuccaacccaccaacaccacuuaggagugaaaacaaagguuagagaguguggaccccuauaggcuacuuccugcugcuaaugggcaugggguucccugggacaaguccaguuuuuguugucggauauccagcaguccagcaacugggcaauccaucaauagcgagugcagcagcaggagggagcagcagcugccacagacccuuuuggggcucuugcauuuuacccucuccugaguccccagaauuaaaacuaucugcagcugucaaaaaucacgccccccagagcacaaggcagucguaguuaacagcuguggacaaucugaagcagcccauaccccacaccugggguucaaacaaaaacauaacucaggguguuuguuuguuuguuuguuuuguuuucugagacaggguuucucuuguagcccuggcuguccuggaacucacuuuguagaccaggcuggccucgaacucagaaauccaccugccucugccucccaagugcugggauuaaaggcaugcgccaccacgcccggcuaacucaggguuuuuaagaaaccacaauucaaaauuuccagagucaaaauuuccaucuucuccaaaagguauuugaaauaucuuaccaagaaauaaccuuaagaagaauaaucuccgugauuggcuacauguggucgcaucugacaaggagacuuacgaacuucguuauuuccagauuagucaagaugaagaugguucagagucuggggacuaauuggccuuugcuuguaauacaaugaaaguauucuaaagaaauauaaaauuggacuuuaugagaaaauaaaagucauuucacucuauuaaaaaaaaaaaagaaaccacaauucucaccacaccuguacaugauauuucacggagaacguuagggugagggauaaagggugagcagaaagccggaucagagcagguggcucuggccuggaagggguacacucgcuguaggggggaaagagucugggacucggggucugagugugggaaaggcuguaaaaugaaagcgugcucaacucaguggugaacagcacugcucuucugagauggagaaaggugcagagaggcaagaccugaagugcaagucccagccuaggcucuguggacccuggggggggggggaggagggggaggggagggguucuuuuuuguuuguuuuguaaagaacauuagcaagaauaccauaagaagcugggauguaacauaaacguaauucucugugcacucugacugaugguuugcuuuggguuuuguaauuccagguuugcaccgccagcuucuguucguuacguccuuugucuuugcuggauacuuuuauuuaaaacgucaaaacuauuuguaugcugugaaggaccaugacauguuugguuauauaaaauuacacccagaagauuuuccugaaaaagguaucucguguuaauugaaaaugaaaaaccgcuuguuuacuuugucucauucucccugguuaagggcucagguacuggcugcuugcguggccucaaacauguucuucuggagccuuuuauaagaacacauccauucagaggccccgccucggccuaccguagcgcuggggccugagccagcauggauuaggggagacacggcauucggcaggucuccaucaguaagaugagucccgauggccuuucucuuucaguauagcccuauuuauuuacuuaagccaucaccaugguuauuacuuuauguguuuggaugcgugccugcaugugcgucuguauacaguguauauacuugaggaggccagaagagaaugucguaucccuuggaaguggagucacagacaguuguggcagccacagacacucugggaguggaacuggaagagugcacccugacccuagccuuuauuuguuuauguuuugaaugcugaagccuaagcccagggccucagacacucagcacauguucugccccucagccacaucccuagcccaagaaauagaauuuuuaaaguauaacuuuaaaaugaauauuuuaugauucuuucacagagaagaaaaccuaugcugaaauucuugagccauuccauccagugcguugaaguuuucaaaaggcuuguuccuguuccucuucaccacaaccugaauauuuucugaguuuuaugggauuuucugugacagugaaguuuagguuaagauguuaacacuguuauuaaaauaguuauuacaaaucaucuguuccuuucc

SEQ ID NO: 3946 - RNA, 1194 nt, Mus musculus
ugguaaaaauauucaguaaacuaggaauauucagggaccauuuucaaccuuauuaauuuagcaauaucuaggaaagccugagauuuaacauauuaauggugaagauugaugccuucacccuaaagucaggagcaagacaucuauaucuccucaacuauaccaauuguauuuaacaccagcguggaggagggucuagccaagacaaccggaauagaaagaaaauguauccaaauuaguauggcauauauguuuuuaugcaccauuuuaagugacagucuuauacauaacaaaucuuaagaaauaagaaaaaauuuuaaauaaacaaaauuuuuaauuaauaaguaaguuuauaggauucuaaauaaaaccucaaaaaucaaguguauuucaacauauuaacaaucuaaaugugaaauuaagaagaaauucuauuaggggagguagcuucaccuauaaccuuagucacucagaaggcauaaacaacauagccagauaccaucccaaaaagggaaaaaucuuuacaauaccauccaaaacaauaaaauaauaaaaaacuaaguaaaaauguaaagaaccaugaaugagggcucuuuauauaucuguaaucacuugugaagcuagccaggaagaugaguucagagccagccaagguacacaaaaauaacaacaaaaacaaaaaacacaaacaaaaacaagacuacagaaaauaaaacacugcaaagaaauuuacuuugguauauguggaaacauaguccauauuuauauagaugaaagacauucuuuuuucugauacuaggaucaaacccagagucgacauguuaacuuacucuaccacugaguuacauccauggaagacuuaaugcugacgaaaugacaguacucuguauugaacuguauuacagacuccauucagcaugcuguccaagacuucaggguacaggucugccacaggauacuuacuguggacuaaacugcauucuccacacuuccuauguuaaaaucccaacuuccaccaugaguauauuugaagagugcaccuuuagaagguaacuaaggcuaagugaggucaugaguguaagccauaaugucauaggauagacggcuuuauaggaagagggauagagagaguucccugucuccagaacugugagaaauaaguuuuuaaauaauauaaaaauuaauauuuuguuguag

SEQ ID NO: 3947 - RNA, 3968 nt, Mus musculus
acuucuauuaaaauccauuaauagucacacaaccaacagaauuaaaugagaaccgcugauauauuuaauaaguauaauuuccauuuuaaacaucucaacacuuuaaggauaagcccuuugcuucaagaauaggcgguuuuuaaaucaauauaacauagcugacacuaaaauaugaaguuauaccuuaguuucuguuacaguugugaaaguucaggcacagcccuagcccuguacagcuguagcacuugugacucgccuugccuggcacaucugaagccuucagcauugcuucagugugugcuuuugcccugauauucggguuuucugucccaguguugucuguugccggcaauagacaugcuguaucugcugcuggcucaaggaauuucacuuuucuuuaagauuaagcauuauauguagucaguguacaguaaaccacuuuuuauuauuauuauuauugaaagcuggcauuagacuugugucauaaaagccucuggauacuuuaugcuccuacuuuuuguuccuugacagauacacucuuaaaucuucucuccuggccuuuaaauuuuagugcugauuuuuuuuuuuucaguuauuugauuuugguuucacuuuaguuccauagaacuuaaguguuaauguuugcuuugauuguagcagugaacuuacauuuguguaacaauaaaacaaugaaagcagccacugcagagccagcuguggcuucauuuugacauaguguugugcuagaaggacagggcgggcuuacauucacaggcagugaaggacucaaaggcaccacuuacuugcauaacuuccuuucuagcugucguguuacuugaaaaucagcuaaggaaguuuuucacugucuagaacaggcaggauuccuacuacugugugguaagugguucuuccuacacucucagaaggcuucaguccugcaaucagguaaagccacugugguguagaaaauguccuaugugccugucucuaccucugcacacaccagcucuugcaaccaccuaucaauucuauucaucauuuacacagaugauuagaaguaguaaauggguagcuaacucaacagcgugcagaaugugacguaacuucuuauucuucugcuauggaaacccacaguaauuuuuuauagcaaagacugaguauuccacuuagcaaaugccccacugacuuggguuucaaaaaccacuuaugcuaccugaucuuacuacacuugagugucaccuucauaaagagugucucccuucuaacuuuacauucucauuagaccaacuggcuauaaagaguaauccaggcagcuaauauauagcaauucuuaguauccagcuacuucugcuuggcuuuuuuguugucucuguucaugcuggagaucgaauccagggccucaugcauacuggguaaguguuuuaacgcugggcuacaacucuugcccugcuuaguguucagauucagucccucagagucuguuaucucucagaaacccuuacuuggaagauguucucaaugagguuucuguugcugcugucaaaauaaauguucuguaucaaaaauucugauaaaaucauuaagaacuggagaauggaaaggaaaacaggcauguagacuaucuucaaucuugauagauucagauuuauaauagauuuuuagaguuuuccccuuuaauauuuucagugacccccccuccuaccuuuugacauacaaauguugaacuuguaucaaagggcucccagugucagacuccuagccuacagcauaugcauuaaggggggauacaguguaauauuccaaguguuuaguuugcgauuucaguaaggugugagagguagccagauuuuuacaguuccagaacuuagaauugaaacaguguaugaaagugacacugauggguuuguccacgcugugccgauacagugcuuguuguagaguguaacugcagagucguguguuugcaacaacacacaugccacacugaggugguuuccuucacuucuuccacuuggucaaggguacagagugagaggauaaaaaguugcauuaagaauaaauucauguuuacugguaacucauuuuuuaaaaagugaucugccaaagaacccagaacuucagauacuagugaaaaauuguuguggggaaaagauuuaaaaaagauguuauuacuuuucacuuucuaguugauaggacuuaucccacauaauaaacauugaagccaagugcauauauuaagaaaaauguggacacuuacuugcuuguuuaaauagggaguuauaauuauggagaaugugucaguaauuguaaugugggaugaguggaguucccuuugugacaagaauaccguuuagccucguugguaggcaugagguguuagcccucacuaguucuucuaccagaagacagaaaacaccgaacagaucuguaacucucagaaaaugcugugacuucacugccagcugucacaguggagcgggucuuuaguucagggugguaucugagcuuuagaacagaugcucaacgauauuucuuacgaggaaaugugugcauacacacauucuggguaaccacaaggaugcugaauucaucaugaacugaguuacuaaauguauaaggcaaaugauugugacaaaauuaugaauaugauucaacgauagguuuaaagaaaaaaacaguuuuucuugaugguuugacauucucaagacguuucugguucucuuagcagagaaugccaagaccacauguaugcuguaaucuacauaguccuuguuuguuaauaugauccauuagugaacucucagaacaaaauucauuccuauuuuauccgcuauucccagagaaacccuggaaguggcaagcaagcuagcugcuguuuuauuuccucacuguucuuauccugauccugaaaggaaaacaaaacaaaacaaacaaaaaaaaaaaaaccuuuguucucauccaguuuuagacuggauuaucguuaugcuuccauuuaauuuccaaauauuuugcuccaacuuaaaugagguaacuuuuucuuuugagugccaagguuugcuagauaacuggcuacacaacacugaggacaagcuauucccauguaaacagucauaagcgaaaaugagguagcguugguggcgggccacguuagacuguacacucagcccuuguugcucauacagacccucucagaagcugauuaauuagaacagaggucuaauuccccacuccuggucaugcacacagcucccugcccuaucucacauuuauaccacuuugcucuaggagaccguucuggcacacucaccauagggguuucaguucguggagguguucugaucuuaauaauguuuuagauacaucuaucccauacacaagcuaugugauagaauguaacaaauuaccagugagaagggauuuauuaagcucuagauauuuugaaugagagaaaaacuaaggaacuauauuugggggaggguuguuuuguuuuuuuguuuuuugccaaacuggcacaagcuagaacaugugcaaaaggcugaauaagcucccuguucuuuuugccacuggaugauggaagaaugagcuugucuagguauauauuuucuugacuuucaccaguuucagaaggagucuaauuuaaacauuugggguuuguuugaucuguauuuauugcauccuggccauaggccgggggccugcauguuauguuuaugaacagcuagaacacagccauguggaacuuaauggcucaagaucuucuaaauaauuuaacuuauuuuguauguugcaaaaaagaaaaaaaaaguuuauuuugcuugagagucacauuuuuuuauaacuguacagcuuuuaagggaugggagguggggaaauacccuaaaauaggauguagauuuuuacaguuguguuuaugcuagaacaucuaugggagcauuauguaauuaaaccucaaaauuguuuaaaaccuu

SEQ ID NO: 3948 - RNA, 3968 nt, Mus musculus
aagguuuuaaacaauuuugagguuuaauuacauaaugcucccauagauguucuagcauaaacacaacuguaaaaaucuacauccuauuuuaggguauuuccccaccucccaucccuuaaaagcuguacaguuauaaaaaaaugugacucucaagcaaaauaaacuuuuuuuuucuuuuuugcaacauacaaaauaaguuaaauuauuuagaagaucuugagccauuaaguuccacauggcuguguucuagcuguucauaaacauaacaugcaggcccccggccuauggccaggaugcaauaaauacagaucaaacaaaccccaaauguuuaaauuagacuccuucugaaacuggugaaagucaagaaaauauauaccuagacaagcucauucuuccaucauccaguggcaaaaagaacagggagcuuauucagccuuuugcacauguucuagcuugugccaguuuggcaaaaaacaaaaaaacaaaacaacccucccccaaauauaguuccuuaguuuuucucucauucaaaauaucuagagcuuaauaaaucccuucucacugguaauuuguuacauucuaucacauagcuuguguaugggauagauguaucuaaaacauuauuaagaucagaacaccuccacgaacugaaaccccuauggugagugugccagaacggucuccuagagcaaagugguauaaaugugagauagggcagggagcugugugcaugaccaggaguggggaauuagaccucuguucuaauuaaucagcuucugagagggucuguaugagcaacaagggcugaguguacagucuaacguggcccgccaccaacgcuaccucauuuucgcuuaugacuguuuacaugggaauagcuuguccucaguguuguguagccaguuaucuagcaaaccuuggcacucaaaagaaaaaguuaccucauuuaaguuggagcaaaauauuuggaaauuaaauggaagcauaacgauaauccagucuaaaacuggaugagaacaaagguuuuuuuuuuuuuguuuguuuuguuuuguuuuccuuucaggaucaggauaagaacagugaggaaauaaaacagcagcuagcuugcuugccacuuccaggguuucucugggaauagcggauaaaauaggaaugaauuuuguucugagaguucacuaauggaucauauuaacaaacaaggacuauguagauuacagcauacauguggucuuggcauucucugcuaagagaaccagaaacgucuugagaaugucaaaccaucaagaaaaacuguuuuuuucuuuaaaccuaucguugaaucauauucauaauuuugucacaaucauuugccuuauacauuuaguaacucaguucaugaugaauucagcauccuugugguuacccagaauguguguaugcacacauuuccucguaagaaauaucguugagcaucuguucuaaagcucagauaccacccugaacuaaagacccgcuccacugugacagcuggcagugaagucacagcauuuucugagaguuacagaucuguucgguguuuucugucuucugguagaagaacuagugagggcuaacaccucaugccuaccaacgaggcuaaacgguauucuugucacaaagggaacuccacucaucccacauuacaauuacugacacauucuccauaauuauaacucccuauuuaaacaagcaaguaaguguccacauuuuucuuaauauaugcacuuggcuucaauguuuauuaugugggauaaguccuaucaacuagaaagugaaaaguaauaacaucuuuuuuaaaucuuuuccccacaacaauuuuucacuaguaucugaaguucuggguucuuuggcagaucacuuuuuaaaaaaugaguuaccaguaaacaugaauuuauucuuaaugcaacuuuuuauccucucacucuguacccuugaccaaguggaagaagugaaggaaaccaccucaguguggcauguguguuguugcaaacacacgacucugcaguuacacucuacaacaagcacuguaucggcacagcguggacaaacccaucagugucacuuucauacacuguuucaauucuaaguucuggaacuguaaaaaucuggcuaccucucacaccuuacugaaaucgcaaacuaaacacuuggaauauuacacuguauccccccuuaaugcauaugcuguaggcuaggagucugacacugggagcccuuugauacaaguucaacauuuguaugucaaaagguaggagggggggucacugaaaauauuaaaggggaaaacucuaaaaaucuauuauaaaucugaaucuaucaagauugaagauagucuacaugccuguuuuccuuuccauucuccaguucuuaaugauuuuaucagaauuuuugauacagaacauuuauuuugacagcagcaacagaaaccucauugagaacaucuuccaaguaaggguuucugagagauaacagacucugagggacugaaucugaacacuaagcagggcaagaguuguagcccagcguuaaaacacuuacccaguaugcaugaggcccuggauucgaucuccagcaugaacagagacaacaaaaaagccaagcagaaguagcuggauacuaagaauugcuauauauuagcugccuggauuacucuuuauagccaguuggucuaaugagaauguaaaguuagaagggagacacucuuuaugaaggugacacucaaguguaguaagaucagguagcauaagugguuuuugaaacccaagucaguggggcauuugcuaaguggaauacucagucuuugcuauaaaaaauuacuguggguuuccauagcagaagaauaagaaguuacgucacauucugcacgcuguugaguuagcuacccauuuacuacuucuaaucaucuguguaaaugaugaauagaauugauaggugguugcaagagcuggugugugcagagguagagacaggcacauaggacauuuucuacaccacaguggcuuuaccugauugcaggacugaagccuucugagaguguaggaagaaccacuuaccacacaguaguaggaauccugccuguucuagacagugaaaaacuuccuuagcugauuuucaaguaacacgacagcuagaaaggaaguuaugcaaguaaguggugccuuugaguccuucacugccugugaauguaagcccgcccuguccuucuagcacaacacuaugucaaaaugaagccacagcuggcucugcaguggcugcuuucauuguuuuauuguuacacaaauguaaguucacugcuacaaucaaagcaaacauuaacacuuaaguucuauggaacuaaagugaaaccaaaaucaaauaacugaaaaaaaaaaaaucagcacuaaaauuuaaaggccaggagagaagauuuaagaguguaucugucaaggaacaaaaaguaggagcauaaaguauccagaggcuuuuaugacacaagucuaaugccagcuuucaauaauaauaauaauaaaaagugguuuacuguacacugacuacauauaaugcuuaaucuuaaagaaaagugaaauuccuugagccagcagcagauacagcaugucuauugccggcaacagacaacacugggacagaaaacccgaauaucagggcaaaagcacacacugaagcaaugcugaaggcuucagaugugccaggcaaggcgagucacaagugcuacagcuguacagggcuagggcugugccugaacuuucacaacuguaacagaaacuaagguauaacuucauauuuuagugucagcuauguuauauugauuuaaaaaccgccuauucuugaagcaaagggcuuauccuuaaaguguugagauguuuaaaauggaaauuauacuuauuaaauauaucagcgguucucauuuaauucuguugguugugugacuauuaauggauuuuaauagaagu

SEQ ID NO: 3949 - RNA, 124343 nt, Mus musculus
agcccuuacccuaauucucagaccucuaaccccaagacaaacagaagaguagaugucuggguccgacgugacgugagaucagacaguuuucacacuuucagcucuuggugacgagcccagggaugccaagaugcuuuauauucaaggggccacccgcauuccacucugacuucacauuaaccaucugacagagcauccacauuucagggaaaaggccgcuucaaagagggagaccgcgacagcucacagcagacgcccgggcccaaugacgucacgcggcagccaggugauucccuagccucuggcgucaagugcugaugacgucaucccggcgccccaccucgcccccuggccguguuggccugguucacgugggucuguccggcgcuccccgcccccucccaccugcggggggcggaggccgggcagagggggcgggcccgaacgaaggaggcguggcuugggcggggucguagggcgcggcggccgccagcccggcuacauacaauagcaaggcugcgaccggggccgaagguaccgccgcacggugggcacuccucgccgcugcccuacaccuccccgucccacugcaccucuaggcugcgcggaguccuguccgcuaucaccggcuuuucgcagucgccggugcccccucagagcccgcgcucuccacaguguccucagggaaggcuccccuuagcgagcgcaccccgcccccucauagucccggcgcgccucccgcuccccgcggcccgcagcggcccgcccuccagaccccgggccugaaggaacccggcgcgagcggcgagaggagaacgcggggcgcccgccggcucacacucccgcgcucucucuccggguuuggcggccgccaggaggaggaagaggaggaggaggagaagaagaaggaggaggaguggagcgagcgcagaaggugagagcuggccucccgcgacagugcuccccgcaucacggcggccgggcgagggcgcggggcuggggaaggcgcucggagggggcggggaguugggggggcggaccggggcgccaggugagccgaggcgggcgccgccccgcgaggccgaccgcucccuucgggccaacaaaggcccccaugugucagcuccuaugcgaccgcggguucccgaagucggggcgcuggggagccccgagggcgggcgcuggggcuggggagggcccacaggucccggucucgguuccggacugacucccuccggaacuucgggguccugagacgcuaaaacuggcccgcgacgcagaugcuaagugaagcaaugaggguuuauucuccguggucggucccggcuugggaaucacuuuucagguucaucgccuuguaaaauagacggguagcaaaugaccccaccuucaccccaggaauacuccguaacuugggaaguuccucacagacuuagaacgagaaucagguuuuuuuuuuuuuuuuuuuuuuccccacgcccauuuuuagucuauuucaaaggcagaguucuuccaaccaucacuaucuuggaucuuuuaaagguaaacgauacuguguuuuuggaagaauacuugacaguuauugagugccuuuaaaaaauaucuuguauccuguuucuuauguuaaaccccuuggauaaucaccuuauccuuuacgauauuuccagaacugugaaagguaaaagaagagguuauuaaucaaguuaguacuucuaucuuaagaaucguucuugagaaaaaccuuuguccccuaugucuaagggucucucaacucugucaggaggaaaacuggaguucagcgguacagagaugccucauuaggcauuaccuccuuccaauaugaccuugaauugaucacacccagccuuaaaguucuuagaguuugcuuuuaaaguucagaaaugagcagcuagcuagcaaucaucugcucagcuuucgggauuccacugaagaauccucuccaccuuggagucuuugcuggcauccauucugcuuccuuccugacacaacagucuucuccccacuggggcucccagaggcccacagagauuucuucugucugcacuuguaacgcauucuacuuggaaaucuuauguucacauguacacaaaccaucucaacuagaagccaccucucaaagaguuuuggcaacucggacucugacauuuccugaagcuuauucuagucuuaaccugcuaagugaacucauggcuuggccugaucaauuuacuuauuuauucaucuguuuauccaauauuacugcuacaaucugaagugcuacaguguuucaagcugccugcuaaagucugugcugauuucaaguacaucaauacagcuggucuuugcucacaagaccaagagcucaaaguuuagugggugagguagacuuguaaacaaugaagguccucugggggacuccaguuguacagagaauggugcgcaguaauuaagguugcuggaccuguccuacaaguccuggccacagcaaguccguagggaaaguggcccuucaucuguaagaguuuacuugauaaaaagcuuauccaguucaacuccauguauauuuucugaguaccuguuuugaggucuuuugcuagguuugcaggaagcuguguaccuugaggggucuuuguaaaacaaaaccuggucuaucagugcuuccuccccucccaccccccuuuucacaguugaaggauuaccuucaaacuuuuuagugugaaauaagaaacuccuggagagcugaccauugccuacuuuugcauccuuaaacuuucuggguucuguccuccgccuccucuucucuucucuuuuccgaauugcugcuuugccuggagugcugcuuccuaccuguuauuugccuguggagaauucuuuauuggaccucugagaaauaguuccuccucuucccucuuccaucucugggaaugaguuacucuuccaucuucuggcucaggagucuagaauuuuuguaguacuccuuuaguaaucaguugcaauuaaauuugagucuucaucuuugagcuuuagccccuucuuuccuucuuuccuuccuuuuuuaugguacuagggaucaggugcucuacugcugagcuauauccccagcccuuggaugucuuacacugagcauuuuuaaauuuugagacaaaaaccaaccuuggacucauucuguagcucaggcaaugaauuugugauucucuuuuagcuuccuaacugggagaccacuaaguucaguggccugugaaucuuuuaucuuuccuuuccguuccuuuccuuuccuuuucuuuucuuuccuuuuuaaaaauuuuuuucuuugacauguugaagaaugaaacuagcccccccccccccuuuuuacguuuuccuuauuuauuguguugugagugcaugcauccgagguguagcuuaugcaaagucaccuuuugggaauucucuuuccuggcgaucagacuaaggucaucaggcuuggcaggaagcaucuuuucuugaugaaccaucuugucagcccuauauauuauuaaauuuccacuuccuuauugugugugugugcgugugugugugcgugcgugcgugcgugugugugugcgugcgugcgugcguguuaguggaaauuuuguggaggucagaggacagcuuucaggagaugauucauucucucuuuucacagugaguuucagggguggaacugauuagguauguucauuaaagcaagggcuuuuuuuuuuuuuuuuuuuaaccuguugaccaaucucauuagcucuacuuuauauuuugagacaggaccuuccuaaguugcucaggcaugccuugagcuuggaauccuucuuugucuagcuucugaguagcugggguuacaggccugugccacuaggccugucuuuaugaauuacuugaggucaagauauguuuggauaucgugucuaguaauguuccugguacuugaguacauugaaugaauaaguacuuugaguaaguaugugaaugagugaaagaguccuguaaagcccaugagcuaggucaccuaaucuuuuggauggaacaauuaguuguuaaaagugugauccuugcaccagcagugucagcauaaucuggguauuugacaguagauuaaugagucucaucccaaaccuacaaaaaacaaauuaagguuggagcccaggcgacucugcuuuauuaggcucuccaaaugauccugaugcuuauuaagguugagaaaucgauacagaguuaaaggaucuguauuuuuuuuuuuguaaagucagcacuccauccucccuucugccucauuuccucccccuaucccguuucuuccuuaucuuuucuuccuuauuuuauccugacauucccuucuguucacacccccucccuccaaucuaucucuugcggcuagagugaaagaugcuugagggcugggagauuuuucuguucaaguucauugcuauaagcucacugccuagaagagugacuaaccacaacuagcacagacauucacauauuugcuagaugaauaauaugccuuaguccuacuuacugccagcugcuacacugggguuuuguugaagagaacuuugagugaagaguaaucacauucccauuugcagauccaggagacucuuaacauuuuggggauucauuuuugcuuuagucagcuuaguuaccuuccuucccucccuguguuuauuuacuuuuuauuuauuuuuauuuuuuuagaauuaauugagacaaggggucuugcuacguagcucugacuggccuuaaacuuguaccagcuuccugucucaacuucuugagugcugagguuacaggcauaugccuggcuuugcugucuuuuuaccauagaaaaaaaucuacagggcuccccaacuuauaauauuguuuuagccaugaccugaaaacugcugaaauccuaggccagaauucuuucuugagaauuugcagcuugguuuuccaaguguaaaugagcacacagacuuuugagucuuaacuugaaacugucucuuccagaucaccugugguuuucaguaaagguucuuuuucuaguaaaggcuuacuugauucuacacaauuucucuuccuucugaagcucuaagagugcuuuauuuguuuuccuucccccaccccuuccuuuuuuucccuuugaggcaggguuuuucuuggcuaucugggaacucacucuguagaccaggcugaccucaaacucagguuugccagccucugccuccugagugcaugugccacuacacuucauguuccuccuccuccuccucucccuccucuuccuccuccuccuccuccuccucuuccuccuccuccuuccuguguguguauaugcauguauauacauuuucuuguguguaaugcagguaugugguguucacuuauguagagccagaagucacuguugagugucuucuucaauugcuucucuaccuuauuuuuugagacuugggucucucauugacuugaaguuuaagggcucaguuagacugacuggcaguaacccuaggcauacucuugacucugccuccccagggcugggcuuguauguguacuacugcucccagauuguuacauaagugcuggggaucugaacugaaguccacaugguuguaugaagcacuuuacugagccaucuccuuagcccaguguuuuugucaacuuucuuauuagucuuacacagcaugcccaguuuucuccuuuccuaacauccuucugggaaacuuggcuucauuuauuuauccuuuaccauauaaacaguaauuaaguucaucucuacuaugcaccaggcuuuuugcuggggcagauacucaucuauauaggguauggcuuaagcccuuaaggaaauguuaaaaugaacagauagagggguuugauuguaaaggugagagaaagcugccuuugugcaucccuuccuccacucccaaauuauggauagguuguuaaguauuuuaguaaacauacuucaaaaagucauuuugaagcugggagagguggcagguguuuuuauauuauaguaagugggaggaggguuucuuuccagcccuuagaauagccaugauugauaauugcugguauacuagagauaaagaagcagagguuuguagugguaaaagaaacaagcuuguuuaaauguuugcugucuguaaaugacaagucucaauuccaguccauaucuaucugaucccagcagccaugggcuguuuucaguuucuaggcugcuugaauuuuuacucaugggggcauaggaauauuuuacaaauaacuauauugcucuuggaguuucacaucauuuacuguuaacuauucaugugggaaaaagauccuucgagggugucauuuucuucaguuuucacaguggcucuguauucccauuuuaugaguuaggagaccaagccugauagaaguguugguuugcuaaaagagcacaucagcagcacgugccugaguguugaccgaagcacauuugaaauucuaggucuagugcuuuacauuugccacuacuagagugacuuuugagcucuaucuagauucuagaauacuagaaacauccuuuuagguugcuuccuaauuucaguuucuuaucccuaagaaacuccuaacuaaagaacaguuugagcuagagaaaaaaaaauugcugaugaaguucuuaaugagagcagcuagaauauaguauuucuuuccccugccucauauucaaagccguuucucaggaguaacuuucucuucugccucacccucuuuuuuuuuuuuuuuaauuauuuuuucacguuucuguuuuugagaucaugaauguuuauaaugacccucuagauuauccuuugugggagggcuguaacucaguuuguagaaugcuugccuagauguaugaaaaccuagguuugauucccagcaccacaugaagccaaguaugauguuguaugucuguaauucagcacuucauagguagugacaggagguucaaggucagggucaucuuuggcuauguaugaguuugaaggucgcagccucauaaucagagacccugucacaaccaaccaaccagccagacagccagccaaucaaccaaccagucuacuuauucccuuguaaagugucuuguaguaguaccucauuucuaugauuuauucuuuuuauaaggcagaucacuguguuuuaaaauaguuuuuucuuuguuuuaaaaguacuuauuuuuaguuuauauguguguuuugccggcaagugcaccacaggugugccuggugccugaagaaggccagaaaaggauugagauucccuagaauuagagucacagccuccugugagcuccuguguggguguagggaccuaacccagguuagguucuuccacaagugcucuuaaccucugagccaucucuccagccccucauuaaugugauuuugugggguauugauuaauucucuaaaauugauccaaguccauuaugucuugucucuuauucauggagucaggguuaaguaauuugcauguagccuugggaaaccauucuuacuuauggagcuuucuucauucuuucccuuucuguuucuagcccucucagguuucccuuuccccuucagacugaguaaaguccaaguugggguggaaagaauguuuguucucuuucuagacucugccuuuugaaucuuuuguuaugauaaaggaccaguguauguguugcuucuacaucuucugucugugcauacuggaucuucacccccuucugugucugugcauacuguaucuucacccucuucugucugugcauacuggaucuucacccucuucugucugugcacacuggaucuucacccucuucugucugugcauacuguaucuucacccucuucugugucugugcauacuguaucuucacccucuucugucugugcauacuguaucuucacccucuucugucugugcauacuggaucuucacccucuucugucugugcauacuggaucuucacccucuucugugucugugcauacugaucuucacccucuucugugucugugcauacugaucuucacccucuucugugucuguguauacuggaucuucacccucuucugucugcccucuucugugucugugcauacugaucuucacccucuucugugucuguguauacuggaucuucacccucuucugucugugcauacuggaucuucacccucuucugucugugcauacugaucuucacccucuucugucugugcauacuguaucuucacccucuucugucuguguauacuguaucuucacccucuucugucuguguauacuggaucuucacccucuucugucugugcacacuggaucuucacccucuucugucugugcauacuggaucuucacccucuucugugucugugcauacuguaucuucacccucuucugucugugcauacuguaucuucacccucuucugucugugcauacuuuuucuucacccucuucugucugugcauacugcaucuucacccucuucugugucugugcauacuggaucuucacccucuucugugucugugcauacuguaucuucacccucuucugucugugcauacuggaucuucacccucuucucucugugcauacuguaucuucacccucuucugucuguguauacuguaucuucacccucuucugucuguguauacuggaucuucacccucuucugucugugcacacuggaucuucacccucuucugucugugcauacuguaucuucacccucuucugucuguguauacuguaucuucacccucuucugucugugcacacuggaucuucacccucuucugucugugcauacuggaucuucacccucuucugucugugcauacuguaucuucacccucuucugucugugcauacuguaucuucacccucuucugucugugcauacuggaucuucacccucuucugugucugugcauacuguaucuucacccucuucugucugugcauacuggaucuucacccucuucugucugugcauacuguaucuucacccucuucugucuguguauacuguaucuucacccucuucugucugugcauacuggaucuucaggcucaguuuuuuauuuccaccugguucccacaacgcugagguuuaugucuuucugauugaaaccguugccuucuuaguucuuuguguguugugacauuucuuucacuuccaggggaaggaauugcguauaaaaaggagagcaccaaauuugaacuuacagaaaaagcagcuuagauauuuacuuaaaucuuucuuuguuuaaaaagagaagaaacuaacucacacaguuguuaaauuaauguuugugaaagugacuuacaagauguugauguguaaauuguuaaaguaauaaaauaacuuacaguuuauauguugguagagguucuuuauugauuauguuugaauuacuucucaagauuaauaaaagcacaguugccuuagguuuacuuuaacucaguauguguauguauaucuguguguguguguguguguguguauguauaucuguguguguguguguguauguauaucuguguguguguguauguguguguguguauguuuuaaagguagaguuuaauccuagcacuugggaggcagaggcagguggauuucugaguucgaggccagccucuauagaguaaguuacaggacagccagggcuacacagagaaacccugucuggaaaaaccuaaaaaaaaaaaaaaaaaaaaaaaaaaagauaggguuuaaugugguccaugguggcaucuagcaguguggcagagaugacuuugaauuuuugaucauucugccucuaccuacugacugugauaauaugccuuauuuaguuaaaugucuauagaugauucuaauacacaaacgugguugcaaaaguaauauccucuguaaaugucuuguuauauaaaagugaaugauuuauugcuauucgaaguucacucauuugcaaaucauuauguacaaggcauugucuaggggaaaacauaacuguauacagacaauuacuuucuauugagacagaaauuacacaugaagauauguacaggugcugugugaugugggaagggaaucuacuccacuuguaauggggaggcuuggcuguguuaaaggacaugacacugcagaugaggucugaaauauggacagagguuaauacuacaggaacuguggaaagggaagaggaaggaccuuccugaaaaagcagcuaggaggaucagaaacuaaaaaccuuuuuuuuugcugaguacugaguaguuuaauauguguagaggauagggcguagggaauggugagaacagaaagaaggacccagaugaugaaacaccuuuuguauaauaaauacacaaaguacuuuuacuauaauaugacuucccuuuauucuuugaacaguccucuggauuagugaggacaggugcuguuuuauuuucacuuuauagaagagaaaacagggagguuaauugaaugaccuagggcuauagauggcauagcuaagauuugaagccagaucaguauagcuuugagcucgugccucuuuuauugcaccauugcugaccuaaaccuuuauagaguuugaggaucaggcaagcauuaagguuuguauucuuuguaaguuacaaagugcuuaacuaguauuagcucuuaauugggaguuugugguuggcacuuucugucugugauuuauuuuacuucauuuuauuuugagacaagaguuucauguauccacagucuuacugcuuucaacucccaaguacugggauuauuagcauaaguuuaaaguucaccugauuuauauucuaugggcauuucuuagacuucuccuuaaucuccagacucuuuccuccccuucagaguugcuaaccaggagccaauaaccaaaaauaaggccagcuaauuaauuacucuuccaauuuuaguguauuuacuuaagcuccccaauuuugaauguuuguuuauuuguuaaauuuguuuauuuccuuuuuugaguacuugagagauggagacagguggcuaucugugagcuuaaggucagacugguauacaauuuccaggucagcuagggcuacacagagacccuguguuaaaaaacaaaacaaacaaauuuuuuuuuuucagaaugggguguaagugccgagagauuuuguauaguucuacaaauucuugauucuuccuaucacuuggagaauuacuauuuuguuauauuuuuucuuucauuuaauuucacuuagaauuagaugauuaucccagaaucugagggguucguuuugucacaguaauuuuuucuuuaguuuugguaauugagccuagggccucaagcacuuacuguaccacugagcuguccucccugcuucucaguagacuuugcuugaauaauguuaccuauaaaguaguaacauaaaaggaaacaaaaagccaaguagguagaguggagaaauccauaaugauauacuuuucaaaguccaaguuucuucagcaauuuuacucucucacgcaugcacuuguaaaggcauacauauguguauagacaggaauacagauguucaugagcuccuguuaugccacacaaagcuuuuccugggagccacaacucaugucuccuuaccccagauagggauccuacauagacggaacaaaauacagacaccaccaaaguccaacuugaagaaccaaugaguucuggggguuacugugggguacaggaccaaggaaagagcacucugacccugaccugaccccaagcccaggacaugggccaaauaacaaacaauagucuucuggcuugacccagagcuuccgacuguuucauauuuuccccucaagcucauggcccuuguuccaaaaacccuauaaaagccuucuccuuccagccucugccaucucuguguccagucagaggcagcagccauucuggcuuucuccccaauaaaucucuuuugugagguuuguuucuuauggugugguuuugugauagucccuggcuccugauuuccaagaugcccaugugcuggaaaaaaccuuaguuauuuacaggaguaugggugaaaggguacuuacagaagcaguaaugacucaaaaacagcagcaguaccgaggcccaccccagcgugggugacagcucacaacaaagcuggggaaccugaagcagccugcaggcagcucagcagguuguugaguguccuuucugagggauucugcucugaacuccuuucagacagcucugcuggcuucugcuucucucaggcagcuagccucagaggcuuuuuugcagaucagcuuucuuuugcugcucagcuuccuuuugucugaggggacucucagcuuuuauugcuuacucaagcagggaggagccuaguaaaucuagucaauuucagggacuuccagaaucuauuuuaaaccuuuugguuuucuugcaggaugaaauguuucaaucuuggagaaaaugcuuacacacagcuuccauaugccuaaccuauuacuuauauaguauuuugaagaauuucaaaauaaguuguaaacaauauuauuauucuaccauuauacacuuucaguauacauaucaauuguuuucacagaaacauacucauuugcuauucugugguuuuauuugguuaguacccuauuggaaccuaagcuccaaagacuugucucuuuaaaggauggcuauuuaaagagaaugagguacuguuuuguuuguuuuuugagacagggucuuauguagcuuagacugcuuugaacugguuguguagccaaagaugaccuugaacuccaagauccuuaugucuccaccucucaagugccagaauuacagcaggagcuugacuuuucuugaaaauauuaaauagguuucccugucuguuaacuguugugcuugagccugguauacaguaggcauucaguaacauuucaguaacacugaguaaaugaaaguggagccagcauauacuguagcccaugugacuucucgaguaagaacauuaguuauuuuuuuccagcucaacaaacauaaaaaaauucuuguguauuucucucccuuggagccccucccacucuugagaauucuuucuuuuuuuuuuaaagauuuauuuauuuauuauauguaaguacacuguagcugucuucagacacuccagaagagggagucagaucuuguuacagaugguugugagccaccaugugguugcugggauuugaaccccggaccuucagaagagcagucgggugcucuuacccacugagccaucucaccagcccgagaauucuuucuugcuucuucuuaauaaguguguauucacagugcuaaaaaaaaaaaaagguuauuuuaauacccgucugaaagaugacguguugcuaaauagauaaccauuuaguacaaauaucucugaaaugaggaaaagucgaaggcucuccugaugacauuuaagagggaaaauuucaaguucaccucuggcuauuuggccauucugaauauuucuucauuucauuugaauugaggaauuacauauaguugaggccuuuguaggcucguugaccaucuagguggcaggguuuguuugguauuuuguuguuguuguuguuuuuugcuuuuuuuucuugugugcacauaugcuagaugugaaacuacauuugcggcuucaaaauuggaaguuuuuuuaaauuaguauuuucaaguuucuuuucucuuugacaagguaucucuauguauuucagucuggccuugcagucucuauccuccugccuuagcuucuagaaugcugggauuacagccagucagcaccacaccuggguuaauguuauuuaacuuucuuccauuaaaauaacaacucuggggcuggagcaaugguucagcaguaaagagcauugccugcucuuucagagaacagggguccaauucccagcacccacauggcaguucacaacuguaacucaaguuccaguagauccaacaccuuuuuacagacaugcauggagcuaaaaaaacaaaaacaaaaacaaaaacaaugcacaucaaaacaaacaaacaaacaaucacucaaacaagaaccccuacuaaacagcagcaacaacaaacagaucuggggcugagggccuaguauaaguaaaacucagaguucuguccucagaaccacaaaacaaaacaaaguccaaauggaacacuaaacaacccuaccaaaaagccuagagcucuguuuuccaagcuaugucuugguaguuuggaaauuuaaguaguuugaagcaaaauccagauacggagugggauggggaggcagaggaaggugaaacucaggaguuugaggccaaccaguuuuacauagugaaaucuugucuccccucucccccuaaaaggguccagauaagguuuucauaagguuguuuuauugaugucucaucauuuccaaguuuccuuuuguauuaauacuuuugcguuacugugaugaaacaccauggccgaggcaaauuuuagaagaaaguuuauuuggguuuacaguuaagaggguuagaguccaugcuggugggguggaggcaguaggcaugguaaacaggagcaagaagcugagaagucaaaucuagaaccauaaguuugaagcagauagagcaaagugcaaaucacagucuuuuaacucucaaagccugauucagugacauacgucuuccaacaaggccacaucuccuaugaguucccaaacagcacuaccaaauggggccaagcagucaaauggggaacauuuuucauucaaaucaaaccucucaaucccuuuugucaucaguucaauuuauuugaagaaacaacauuguucuauagaguuauucacuucauauuuuguauccuauuguuuaaacagguuccuugguccuauauauuuauuuauuuuaaagacuaauuuaauuuaauuuuauguaaguauuuugccugcauguaugucuaugcaccacauaugugucugguaccagaggagggcgaaagaaggcaccgcauuuccugggacuugaguuaucgaugaguaugaaccucucgagcacauccuuuuauuucuuacaaaucuauagcaggauauuaacaggccaacucugcuuuccgcucucuuuucccuauucucucucuucuuuuucuuuccuccucccucuucccucuccuucccuuuuuucuaaccagaaccucacgacuguuagacaagagcuauagcacugaguuacaaccccagaaaccuggucagauucaggcuuguuuuguuuugaaccaguauugguguguucuuucaucaaaggcucuugagucuuucugugaugcuaauagcuguagaauuccuuuuuccuucuuaauuacuggaccuuuucagccuuugccauucuuguuaaauuccuuccuuuaaagagucucuugggcuggcaaaauggcuuaaaagaggcuccuugacaagccugaagacacacauaaacucaaauaaguaaauaaauaaaauaucauuuaaaaguagucuuccuuugcuggguguuacugaauauauguacacagcuacuugaaagacugaggcagggagauugcuugagcccaaacauuggaggccuguuuuaguauuauuguuagauauauagaauaguucaauuguuuaaaaaaauuaaucagcauccaugcauuccuuucuguuuaccauuaggccuguucuuacucauuuuuucaguaagugccuuuuaauggcaagaucaugaacaucugacaauauggcagauuguaaaauggaagaauuuugugaaguugaaauacagugauucuggaagauggcuuaagccacacacacacugacagaugagaaucagauaagguuagacgacuuuaaaguugaagggauugugugcaguuaguauaguuaagcugaaaauuuaaauacaacugggaggaagauuaaugugcauaauaaaauaccaggagagucagaagacacuauuuaaauaacaaaggauuaagaggauccuggggagaaauugaugaagcucuugaauauuuuuauaaaacugaucuuacacacauauuuuguaaacuaaaugugaaaugacagguguucuugaaguuuuuuuauuaguggcaauuacaacuuaaauuuuaguaaugaugaaaaauugauuuugauuuauuuuaauagauuauuaaagccuuucucuaacaaauuuuuguuuguuuuuugguaggaggagggagguauacuagaaauucuaguuaacuuuaagugauauuuuggguacuaguuaucauuggauaacaagaaucccucuaguguuugaugauucuguuagauacaguucugagacuggaacuauguuguguuccuguggugcuugauaaauacauggugaucaagaaagaagugagaaauaacugaguggauuugguauuguaugguucagaguguguauggcauguguuuggugaacuguuauauuguuacguccaaauggaaaaccucuuauucuuucuuuuguuccugcccaguauguacuuuaauauucagaaucuguucucugccuuaguagcucuuggucucauugaaauucuuccuagagauugagauggaaaugagaaaggccuugggcugcugccuggacauccacauucaugagaacuuagaaaugcaaagggaccaaaugccuugacugaccuagccacugccaggucagccaaucauugcuuuccugcucucccuuuguucucugugccuuuggucuucuaucuacuggagguuugugcuacagcuguuucuaccaguuaauguaaugcuaauaugccccuuagugaaggccuggacacacuuggucccgguuguuggguaagagcuccaugguacagccuucagaauaucuuuucacuaauaguuggacuagacaccuuuuuauacuguuuuugaaaccauagaagcuauaagcugaauaugcuguuuagaucugggaaguuuaauuucucaccuuauguaaaaagaaagacaagaaaacaaagcaaaaaaacccacaaaaggcucaugccaaauuuauuccauauguuauacuucaacaaagacgucgauuuaaacuuucuccucucuguaugguguagcaguuaaaccucugccccuggccugucucugaaagcugagaugccgccaugucuugacugguauaggagugcuaaauccagcaguuuuaguuucuuuacuaaagcuguacugauuguacugcuucauagguuugcauuaggauacauggagaaguaguuacaguauauaacacuugugaaguucagggccuugucuccuugcugcccugaaguauccugaguaccuugggguuggggggguggggugguaaacaccauuuggauucagcuuuuuuauuuuuuuaugcuuuuuuuuuuuuuuuuuuuuuguuuuuugagacaggcuguguagcccuggcuguccuggaauucacuuuguagcccuggcuguccuggaauucacuuuguagaccaggcuggccucgaacucagaaauccacuugccucugcuucccaagugcuggcuuuaaagguguccgccaccauugccuggcucaacuuuaauuuauugaacaaaacuggcauauguuguggcaucauuccagauucuaggaaaugaaucugucgguguaguccucaguggcaugggguaccucauugccucuaugaagguuguucuuuauacuugaaauaauccuuccugucucuuaucaguaugacacugguccuuucuucagugcucacuuauuuuugucaagucucuuuucuucuuuuccucuguaaucagcuuuuuuuaaugcagguugucugauugugaggggggacacuacauuaaagacuugaugcaaagauaugggccaaguguuuugggaauauuauuguauuguguuauuuuuaguauggggcuguuuaucagcauccuuucuaauuaauugagggaaguaacaggaucaauucuagugacuucaagcagcaugaauucaauacaguuuugagagagggguuaaagucuacuucugauggcuaaggaugcagcucaaugauagagcauguguuuggcacacacaagguccuacauuuaauugucagcacugaaaaaagaaaucuaaagaaaaaaaugcauccagguugaauuucuuugaauaaacucuuuagauugcaauuaagaauugaacuccuaacuccuaagaauggcagauuuugcuggaagcuguugcuaugacaacuaaaucuagaguugugcuuucucugcugcaguuuguucugcagaaaaauguucuauguccagucuaauccuuuaucuaaucuuguuccaaauugguaucuaguuugagaguuaucuacuuggcaaaccuaagucauacuuauaagagaguaaaacaaaucuaauuuuguuucccaaacuguaguaccuaggagauugaaauagauuugagaaaacuaguuuacauauugguuauagagaguauucaggugcuagugcauuuuucuaguaccaaaucugaaauucuuuuaguacaaaaccuuacuuaaauuuuuuguaaauuauguugauuuuuauaucaugcuuauguuaucuucccuauguuuguuuaguaaacuggcugaaaccagcaaugggaguggggaguagggggagagagagaaagagaaaaaauaugaaugaguuuauguguguguguagaaacuaugaauacuuucagucuagccacuaauuuggucuggugcugggaauugagccgggauccucuguaagaacaagugauuuuacuacugaaccaucuuuucagccuccuaaaguggacucucccccacuucaaaaaaccuacuauagagucaaauuguacuugccuaucucuugaauuacaaauuuccagggaucuagcacuugcugauugguuaaacuuaaucauuauccaggaauuaacuacuagcaaaaugggauuaauaggccugauuugcuuauauaaucaacaccgaucucuuaguuggagaucagauagaucacuuuuucccaaggacauugugguuuucaaaagguaauuucuuuuuucuugcuuuugauauuuugagacauggucucauauugcuuaggcuggcccugaauucuugcuauguggucagggaugacucucugagcugaaacuccagaucaccuugcuucugguuccuugccugccucuggagcauucagauuauaaauaugggccaucaugccuggcaaaauacuaauuuuugaaccacaucccagaccaaagucaaaauauggggccuaaauuuguuuuuauaaauucucaaaaugauucagauuacuuacuuguuacugauaagggaugauaagaugaggacucccuuacaaaaagaagacaggaauaagugcuggguaggcugacaguaccaguuucaaaauuguaaugguggauaagggaccaauucauuagggaucuugaauguguauuuuauaaaguugugaaauauaaaguagauaaguguguaucugaggacuugguggcgacagaauauaaaaagggugagguugaaguuguaauuucaggggcacagauuagauuuucaucuuggguucuuuuucucauucagcuuuaaacucucuuucuauaagcagagaauaugaccauuaggaagcugagaauugaaugaacaacaugcacuuccucugggaucaacucaccucauuagguucaucagcaaccaucauuccccauugagccaucuugauggcccuuuucuuccuuucuugagauuaggucucacuacauugcucaggauggccucaaacucacuguccuccugcguuagccuucuguagcuagaaucaagcaucauuccuuucaagauucaagauuacuuccugauucucagugauuauuucaggucuuggacccuugaucagauucuccagucagcuuuaguuuagcuguaggaacauguauucugccucuguagucuuauccuuugguauuaugugaguuuuuuaauucaguugucauagggauauuacaauuaauauguguuaagggugaugugaccauccauauuuuauguucugccuuugcuuuuaccucauugcuuuauuuuuauuuuuuauuuuguuuuuugagacaggguuucucuguauagcccugguuguccuggaacucacucuguagaccaggcuggccucaaacucagaaauccgccugccuuugucucccaagugcuggaauuaaaggcgugugccacaaccgccagcauaccucauugcuuuuaaaauuugugcuacuauacuuauuccuucaaauuuuuaucacuuauacauuucauauuuuguaauauagacuaucuacugggacacaaaugggaaagguauuaagaauugacuuggauuuuuccauaccuauauuuaaugaaacuaaaacagagaaggacccaaaaauuuaaauaucuugcuacuuccucuuuuuccauuucuugauagaaaaaauuacauccauguuuaaagauaauuuuaaaaauuauuuuguuuauggguauuuugcuuacauguaugucugugaaccauaugcauaccugguauccacagaggccagaagaaggcaucagauccucuaacucuggaguuacauaugguuaugagccaccauguggauucugggaauugaacucgaguccucuggaagaucaucuagugcucuuaaucacugagccaucuuuccagccccaugauuuuugucuuaacuguauuauuuuaucaaaagcuacuguggauaccagguaugcauaugguucacauaugguuguaaauuccuugguuuauguuaucacacugucugauguaaaugaagcagagcugaugucugaacuuaggaaaagaaauuagcuggugacuagaaguguaaaucuagcugagagacaaaggguccugaucccuuuuacccucacauauuugguauuagauauucuagcacuggguuacuggauaguaugugaucuuuguuugcaucuaaaguauuugagaaaaaaguauggcauuaaauguguaauuucauguaguaguaguaaaguguagugcugaauacuuuauacuguaacuaaaaaucacuauuguuacucuucuuuuagaauguaacuuuuuguggaagggaaacaaaagaaauugcuucuuguaaacuuguugguacuaauuaaauagaugaccagacuuugggguuuggcuaaucagauauuaauuuuacggaugaaaaaaguggggcuaagagaagaaaaacuacugauuuacuguuacauaaaaguuggggucaaggccacauuuuggcucuuaugccuccuuguuuugugcauuucuguguaagaggaaccaugaaguagcagaaagagagagcagggaguuggaggcagaagguccaucugcauauaaaucgguucugccucuucugacuugguucggagacaguagcauuacuuccuuuaccaguuuccucauuuguaagggggaaaugaugcugcuaccucuugaaacugccacacaaggcuauaacuauaauacagugugaagugcaguagaaaaagaacagugacuuuagaguaaaggcgaccaauuugcuuauaaauuuaagcguucucgccauuuugugucugauuuugaaaaugucacucaauuuuguaaacuuguuuuuucuuccaaguucuccuuggacaauaguaguucucuaacaagguugcuuucaagacauuaguaugagagaauauagggaaaagcacuguauuuucuuucuguugcuggguucauaaagaagcuccccauaaacaaaaguggaauuaauaagagaagagcauauagacuuuauauaaauuuuaggugauaguaaccauuagaaggaaaugaagaucccucaaacuagguuuauuuguguauuuuauguuuagguuuguagaagaggagaguagaggagaauuauuggaagaaauauauaaucuaaugguaauaaauuaggaagaaauuugcaaagcuuauuuguuaagauucuucucuauaucuguguggcuugagacauaaagagggucucuucucugggaauaauacucuggggaauagcucuuaaauuagggucuuagaaaaagauaaggaaaggugagucugaccuuccugauuuugcugucuucucaaaugacaaagguacacauuuuuuuuuuuuuuaaaugugguguuuuuuuuuaagauuuauuuauuuauuuauuuauuuauuauauguaaguacacuguagcugucuucagacacucuggaagagggagucagaucucauuacgggugguugugagccaccaugugguugcugggauuugaacuucggaccuuuggaagagcagucgggugcucuuacccacugagccaucucaccagcccaaagguacacauuuugggaguaguguuuuauuaaauuuauaaacaacaaaaugguaccuagcuugugauaguguuugagaacuucuuuggagacaguucugcuuucucauaaucacuccuuuaaaaucuuagagauaacagugcuugauugucuaugguuuuauuuuuauguauguauguauguauguauguauguauguauguauguauguauguauuuuguuuuugggaguggaggcucacacauagcaaggugugcauaugcauagaauucagagagguaagcauggcuuauggaguugguuuuuuagcuucuaucuuauuugaaacaaggccucuuguuucugcugcugugcugccauaaauuagacuagcuaaccuguaaguuucugggugagccuccugucucugcccccaucuugcuguggaggggugggauuauaaaugcaugccaccacaucuaguuuuuaucaaacuuagguugucaggcaugcauggcuagugauuuuguuuccugaaccaucucccugaccuuugaugauuuuuugcagugcugagaauagaaccugagacuuuccccaugcuaugcaagcauucuaccacugauaaccacuguguucauuccuacucuuuaguuuaauucuggagauacuaaggauggguucggcuguuagguuuccauucuauacuguaguggcuuauagucagggcucuuguucucugagaagggccauuagauaugguagguucaguuuugucauuguuuuucuuuggggauagggguggguuggggcaggagacaagagucugucugucacccauaguggcuuugaacuauguagcugaaguuggcuucaaauucugaagauuccaccucccagauccugagguuacagguaugaacaacgacacccaacuaugacgguaaguuuuaugguaaauggauugaaaaagaggaggaaauauuuuaggagcugauaaacuugggaaggagaauaagguuacuccugucuguggcucaccgaagugcugagauuucuuauuaucaugacuauagaugugccaaaaguuggagccaugccucuguccuuugucaaauaucugccccacguggauauaccaguauauuuuauauuuuuauauuucuuauugaaaguaugucuaucugaaguagagaauaccuaggaccugagggucucauuaauccuaguggagcucuaaucucucacccuccauuuuguagagauauuuguauucaaucaggcuuuaaucugaagaaaugcaggauuuggggucuuggauuuuuaggcuuuauuucgauggccacuuuccauuguuaucuuggcuaggucagacaagcucuuuccuucacucauaaacacuguaugagaucugcccuguuccucuuuucuguuuguuaguccuaggguagaguuugagguucuaaugcaugagagcuucagaauaugaaaucucacuuccaggcaaacagcuuuuccuuggacaguccauaaugaugagaaaauacaauguugagagcaugucucuucacuucuaccuucccaagauagccucacauaagacaucaauugauuaaauauguauguacuauacauuauggaucaaacuuuugggggguauauguaugguaggggaucaaacauggugucuugguacuuauuaguuauauauccaaccuuuggagcuaacauucuucuaggugauuuaaauauuuuaucccaugaaguaacauuuuaaguuagauggauaauauugucuucaguuucauagaugaggagucuggaauuuagauaaaagcaauuauuuaccauagcuaguuaaagguagaucugggauuugaaccaauuuaaaacuaauuuuaaaauguguguauauggcauguguuuaugaguaccagagaugaccagaagaagaggguauuggguuccccuggaccuggaguuauagggugucauaagccauuccacauggauguuuggaacugaacuuggaucaucuggaagagcagcacauaauuuuaaccacugagccaucuuuccagcuucuugaaucuacuuuguuauuauugauugccuaugaacauugugaaaucagggauuuugucugguucaacauuuuuuuucauuggauauuuuauuuauuuacauuucagauguuauccccuucccuaguuuccccucuggaaacccccuaucccauccucccuuccccugcuucuaugagaguuuuccccacccacccccuuacucccaccuccccauccuggcauuccucuacacuggggcaucaagccuucacagaaccaagggccgaucuucccacagaugccugacaagaccauccucugcuacauaugugacuggagccuugggucgcuccauguguacucuuugguuguuaguccauggaaacucugggggaggggggggucugguugguugauauuguucuuccuauaggguuguaaaucccuucagcaacuucaguccuuuuucuaacuccuccauuggggaccccaugcucaguccaaugguuggcugugaacauccaccucuguauugucaaacucuggcagagccucucaggagacaguuauaucagacuccugucagcaagugcuucuuggcauccccaauagugucuggguuuggugucuguauaugagauggauuuccaguuggggcagucucuggauggccuuuccuucagucucugcucuauacuuugucucuguauuuccuccugugaguauuuuguuccuccuccugagaaggacugaaacaucuauacuuuggucuccuucuuguauuguauauuguauuguauauuggguauucugagcuuuugugcuaguauccacuuaucaaugagugcauaccauguguguucuuuugugauuggguuaccucauucaggaugauauuuucuaguuccaucuguuugucuaaggauuucaugaauucauuguuuuuaauagcugaguaguacuucauuguguaaauguaccacauuuucuguauccauuccucuguugaaggacaucuagguuuuuuccacuucuggcuauuauaaauaaggcugcuuugagcauaguggaacauguauccuuguuauauguuagagcauccuuuuuggguauauccccaggagugguauaucuggguucucagcuauguccaauuuucugaggaaccaccagacugauuuccagagugguuguaccagcuugcaauccuaccaaaaauggaggaguguuccucuuucuccacauccucaccagcauuugcugucaccugaguuugugauccuagccauucugacuggugugagguggaaccucaggguuguuuugauugcauuuuccugaugacuaaggauguugaacauuucuuuaggugccucucauccauucgaguuuccucaguugagaauucuuuuuuuuuuuuuagcucuguaccccauuuuuuaauagaauuacuugauucucuagaguguaacuucuugaguucuauguauauauuggauauuagcccucucucagauguaggguugguaaagaucuuuccccaaucuguugguuguuguuuuugucccauugauaguuucuuuugccuuacagaaacuuugcaauuuuaugaggucccauuugucaauucuugaucuuagagcauaagucauugguguucuguucaggaaguuuucccuugugaccauguuuuuaaggcucuuccccacuuucucuucuauuacauucaguaucucugguuuuaugugaagguucuugaucuacuuggacuugagcuuuguacagggagauaagaauggaucaauuuacauuuaucuacauguugauugccaguugaaccagcaccauuuguugaaaaugcuguccauaggaguguggguucauuucugugucuucaguucuauuccauugaucuacuugucuguugcuguaccaauaccaugcaguuuuuauuacaauugcucuguaguuugaggucaggcauggugauucccucagagguucuuuuauuguugagaauaguuuucucuauccuggauuuguuguuauuccacaugaauuugagcauugcucuuucuaacucuaugaagaauugaguuggaauuuugauggggauugcauuaaaucugcagauugcuuucagcaagauggccauuuuuacuauuuaauccugccaauccuugagcaugagagagcuuuccaucuucugaggucuucuucgauuucuuucaucagagacuugaaguuuuuuuuuuuuuuuuuuuuaagauuucuuuauuuauuaugugaguacacuguugcugucuagagacacaccagaagagggcaucagaucucauuacagaugguugugagccaccaugugguugcugggauuucaacucacaacccucugaagagcagucaaugcucuuaaccgcugaaccauuucuccagcccgagacuugaaauuuuuuuuuuuuuugcuucaagacaggguuucucuguauagcccuaguuguccugaacucacuuuguagaucaggcuggccuugaacucagaaaucugccugccucuaccucccggguacugggauuaaaggcacacgccaccacgcccacuugcuucguuagagucacaccaagauauuuuauauugcuugugacuguuguaaagggugucguuucccuaauuuccuuuuuagccuguuuauccuuugaguagagaaacugauuugaguuaauuuauaccuagccacuuugcugauguuguuuauuggguuuagaaguucucugguggaauuuuuugggucacuuaaguauacuaucauaucaucugcaaauagugauaucuugacuacuucuuuccaauuucuaucccuuugacuuccuuuuguugucuaguugcucuggguaggacuuugaguacuauauucaagagguaggcagcccuuuuuuagugggauugcuucaaguuucucuccauuuaguuugauguuggcuacuaguuugcuguauauugcuuuuacuauguuuagguaugggccuugaauuccguaucuuuccaagacuuuuaucaugaagggcuguugaauuuuaucaaaugcauuuucagcuucugagaugaucauguaguucuuuucuuugaguuuguuuauauaguggauuacauugauagauuuuuguauauuaaacuaucccuucauuccugggaugaagccuacuugaucaugauggaucaugauggaucauggauuguuuugauauguucuugaauucauuuugcgagaauuuuauucaguauuuuugcauugauauucauaaaugaaauuggucugaaguucucuuucuuuguugggucuuugugugcuuuagguauaaguguaauuguggcuucauagagcaaauuggguagaguacuuucuguuucuauuuugugggauaguuugaggaguauugguacuaggucgucuuagaaggucugauagaacucuacuaaaccagucugggcuuuuuugguugggaggcuucucucucucucucucucucucucucucucucucucucucucucucucucacacacacacacacacacacacacuggauauuuucuuauuuacauuucaaauauuuucccuuuccaggucuccccuuucuagaucccuugucccauccuccaucccccugccucuaugagggugcucacccacccaccuacccauuccugucuuccugcccuggcauuccacuacauugggggguagaauaccuucaggcccaauggccucuccuccugauguccaagaaggccaucuucugccacauaugaggccaguaccauggaucccucaauguguauuauuuggauagugguccauuccccagaagcucuggguggucuggccuauugacauuguugcucccuucaugggucugcaaaaccccucagcuccuucagucccuucuccaacuccuccaucagggaccccugcccucaguccaaugguuggcugcuagcaucccccucuguauuugucaggcucuggcagagccucgaaggaaacagccguaucaggcuuccaucagcaagcacuucccuggcauccacaagguugggagacuuuuaaugacuucuauuucuuuagggguuaugggaauguuuagaugguuuaucugauccugauuuaacuuuaguccugauaucugucuagaaaauuguccauuucauccagauuuuccaauuuuguuauguauaggcuuuuguaauaggaucugaugauuuuaaaauuuucucaguuucuguuguuaugucuuccuuuucauuucugauuuuguuaauuugaauacucugugcccucugguuagucuggcuaaggguuuaucuaacuuguugauuuucucaaagaaccagcuccuaguuuuguugauugcuuguauaguucuuuuuguuucuacuugguugauuucagcccugaguuugauuauuuccugccaucuacuccucuuggguguauuugcuucuuuuuuuucuagagcuuucaggugugcugucaagcugcuaguguaugcucucuccaguuucuuuuuagaggcacuaagagcuaugagguuuccuccuaggaccgcuuucauugugucccauaaguuuugguauguugugccuucauuuucauuaaauucuaaaaagucuuuaauuuuucucuuauuucuuccuugaccaaguuaucauugaguagagcguuguucaguuuccauguguaugugggcuuucuguuguuuuuguuguuauugaagaccagccuuagucuguggugaucugauaggaugcaugggguuauuucaaucuucuugugucuguugagaccuguuuugugaccaauuauauggucaauuuuggagaagguaccaugagaugcugagaagaagguauauucuuuuguuuuagggugaaauguccuuuagauaucugucaaauccauuugauucauaacuucuguuagcuuuacuguuucucuguuuauuuucuguuucugugaucuguccauugaugagagugggguuuugaagucucccacuauuauugugugaggugcagugugugcuuugagcuuuauuaaaguuucuuuaaugaauguggguucccuugcauuuggagcaaagauguugagaauugagaguucaucuugguagauuuuuccuuugaugaguaugaaguauccuuccuuaucuuuuucaauaacuuuugucugaaagucaacuuuaucccauauuagcauggcuacuccagcuuguuucuugggaccaugugcuuggaaaacucugagguaguaucuuucuuugucacugaggugcauuuccuguaugcagcaaaaugcuggguucuguaucuauccagucuguuagucuguguuuuuauuggggaauugaguucauugcuguuaagagauauuaaggaaaagugauuguugcuuacuguuauuuuugcuguuagaggugguauuauguuugugauuauuuucucucguguuuguugaaagaagaauacuuuguuucuuuuucuaggguguaguuuccuuccuuguguuggaguuuuccaucuuuuauccuuuguagggcugaauuuaugaaaaaauauuguguaaauuugguuuugucauggaauaucuugguuucuccaucuauguuaauugagaguuuugcuggguauaguagcuuggacuggcauuuguguucucuuaggucuguaugacaucugcccaggaucuucuggcucuuauagucuggugagaaauuugguguaauucugauaggucugcuuuuauauguuacuugaucuuuuucccuuacugcuuuuaauauucuuuccuuguuuugugcauuugguguuuugauuauuaugugacaggaggaauuucuuuucaggucuaaucuauuuggaguucuguaagcuucauauauguucaugggcaugucuuucuuuagguuagggaaguuuucuucuauaauuuuguugaggauauuuacuggcccuuuaaguugggaaucuucacucuguucuauaccuauuauccuuagguuuggucuucucauuguguccuggauuuccuggauauuuuggguuaggagcuuuuugcauuuugcauuuucuuugauuguugugucaauguuuucuaugguaucuucugcacugagauucucuuuucuaucuccuguauucuguuggugauguuugcaagcauuuaugacuugugaucucuuuccuagguuuuucugucucccggguugucucccuuugugauuucuuuauuguuucuauuuccuuuuucuuagauccuggaugguuuuguuccuuuccuuugccugccuaauuguguuuucuuguaauucuuuaagggaauuuuguguuuccucuuuaagggcuucuaccuguguucuuuuguauuucuuuaagggaguuauuuauguacuucuuaaaauucucuaucaucaucaugagaugugauuuuaauccagaaucuugcuuuuccaguguguuaggauauccaagacuugcuauguuuggagaccuggggucugauaaugccaaggagccuugguuucuguugcucagguucuagugcuugccucucaccaucugguuaucucugguguuaguuggucuuucugucucugauugcaaccugcccuccugugauccugugauccugugauccuaagggugucagcacaccuggagaccauuucucacugggcagauccugucccagggugucccgugguuccugugcccuauggucucccggagggucccucuucagccaguuauuuuagcaaaaguuuuggucucaccugugaauaaguaguaggagugacagcacucuugggagaucagcucuuuuugggcagaauuugggcauggagggcuguaccagagggucaaccaugguucaaauuuuuauucuuucuucuuagcauauauaauauugauucauaauguuuuuaauuggaugauugauacacugaagaguuauagacucaagagaguaaugcauuugggaugaggauguuaacaguuugcuaauuguucuaguuuacuuuuuaauucuguguaagcacuauuaccaaaaauuauuugggagaaagggcuuuauuucauucuauaguuuacaguccaucauuaaggaaagucaaagcagcaacucaagguaggaaccuggaggcaggaacugaaucagaggcuacgaaggaaugcuucuuacugccaugcuguccauggcuugaucagcuugguuuuuguuuuucaagacagaguuuuucuguguaaccuugacuguccuaaaacucaagagaucuaucugccucuguuucuucccaagugugggauuaaaagugagcuuucuuauggaaccuagugcuacuugcccaagggagguacugcuuacagugaacccuccuacaucagucauuaaucaauaaaauaccuacacagauuguguguaguccaauuugauggagguauuuucacaacugagagaugacacuagcuuauaucaaauugauaaaaaccaguaaguauacuaauucaugucauuuaccauaacucuuuguuuauuuggagauaggaucuucuguagcuuaggguggucuccaucuuacugauucaucugucuccuccucuucaguggugggauuauagacauguaccaccauaucuaguuuauggaauauugagcaaucacuuugcuaacugagcuacauucucagccccucagugugaacugucuaucucugucugugaguguuuauguauguguguguguguguguguguucguguccaccugcccaucuauccaucuauccauucaugucucacuuuaccaauugagcuacauucuuagcuccucagggaacucuuucucucuuucuaucucucuguuucugucucucugguguguguguguguguauguauaaaccaugguagaaaugagaaacaauauuuaguccagcaaaccuacaaggauugucuuaguuaggguuuccauugcuguauagagacaccacaaccaaggcaacuuuuuuuuucuuuuugguuuuucgagacaggguuucucugcauagcccuggcuguccuggaacucacuuuguagaccaggcuggccucgaacucagaaaucugccugccucugccucccgagugcugggauuaaaggugugcgccaccacgcccggcccaaggcaacuuuuaaaaagcacaacauuuaauuggggcacaagauuuaauuuaagagguccaaaccauuaucaucaaagugauagcauggcagugaccaggcaggcauggugcuggaggagcugagaguucuacaucuucaucaaaaggaagucaggagcagacuguuuucaagaaacuaggaggaggauauuaaagacuguccccacagugacauguuuccuccaucaagaccaccuccuaauagugccagucccugggcuaaacauauucagaccaucacaaggauaacuagcauaaacaucacaaauauacuucaaagguauuagcuaggugccagggagacagcuuaguggguaaaaucauaucuaacuaagccugauuaccugaguucauuccuggacccuggaucgcaugugagaagcuagauaccaucuguaauuucagcauuccuuuaucaagauggggaauagaaacacaggccuggaagcucacaggccagcugguguagaaaacuuaucucagcaagauagaagagagaaucaauugcugaaaauuguucucugaccucccaugcaggcuguggcacuuacuuccccugguacauguguuuguucauucucucucucuuccccccacccccucucucuugucaauaaaaucuuuauugggcaaggugauacauacuuauuguccccucuacucugaaggcagaaguaguaagcuugcuggacuucaggacuuucaagccaguuuggacaauuacauaagauugaucagacucaaagaagcagaggguguagcucagggauugaucauuuggauaguauggcacgugcuuuaccaccacaccaccaccaccauugucccccacgcccacaaaaaaauauuucauuaggaaaaauaauacuuccuucacuggacuauuuucugaaaauucaagaugagaaagagccuaccuggauggaguaugaaguguuucauuguuucagguccaacuuuuccugcucacugcccuucugguuuccagucuuccuacguagguaaaggaugaacuggauguucucuuuggccuugagagcacagauaauuagauaaugcucuugcuuccuuccuucauuuccaugguaacagagauguuuuacagcccccuugccuuucucuucaacccucugcuuaguuucaaguuccuugccagcagguuauuuauuuauuuauuuauuuauuuauuuauuuauuuauacuuauuugcuuuuuuaacuguuucuguguggacuuguguucccuuuugagguugaguuuugcaaggccucaggaaaugguggaaacaccuuccucaaaccugguugcaccgaaagcccaucaagugaagucugguccccaaagaggaagagaaagccuaaguuccuuaccagucaauaagagcuucucauuuaccauggagacauuuucuuuuaagugacagcauuuauuguacuguguauuuuauacucuauuguuaucauucucauacccugucggcaccuaaacuucucucucucucucucucucucucucucucucucucucucucucucucucucucucucucucucuuucuuucuuuuccgagacaggguuucucuguguagcccuggcuguccuggaauucacucuguaguccaggcuggccucaaacucagaaacucagaaauccgccugccucugccucccaagugcugguacuaaaggcgugugccaccacugcccggcuaaacauuuucuuauaacaaccaacccuucuaaaaggucagaggaacuaguguguaccaagugaucaguaaugagaacacaccauauguuacaugauaacaucauuauaacaucagaacugauuaagcuagguuguagacucuaugguuaaaaguuauuagaacucuuauugugauuccuaauucacaaauacagaaauugaguauauaauuuuauuuagacaggaguucaaaugggaacaaauugaaaugggggaacaaauaggcauagugcacauguguuaaccauauuuuaaaaaauugcccuggaaucuuuuauguccuaauuggaauugugggcaauccuauaauuuggcauuuaaaaaugauuauuuagcugauuagcagauguaacagcaccaaccuuugggcauguucuguucuagaaagugaugagaaucugcuacucacuaccaagggcaagguaugugagcucagcuuugauuggaaacaguuugugcuucuguuuugcccccaagcuuugucauuuuuuuuuuuuucuucuuaaagucaggugccaauaaccuacauuuucagugcuguagaaucacaauuagaacaugggguucuugccucaacagcuuuaguucucauuauagaguucagaaaugaagcaacuuugugaaauugguggcuaaaagguagaccuugacaaacaacuugaccuccuuguuuuguggcauggguuaaugauucaaucuguagacuccuaagaguacuaaguuauguuguguauaaagguaaugaaaauaacaacuggguucaagcucuuguuaacucuauguggguuugaacaauugcuuuguacuuucuaagccuuugccguuuguuuucuaggccuuuuccuuuauguguuuuaagguagugauucuaggauucuaggauuccuguugucuguccaggaagcacacacccuguagcccagaggccuguuacaauucuagacuauacauucagcuguuccauagucauaagugcuccacuugcuaucuguauucuaaacauuugcugaagccucuuaccauuagaugucuucauuauugagguuuaaacugucacuuuagcaugacuuugagagggaacaugguuaaauauguuuuuaaucugccaacuugaauuagaagcaaacugcagaagaaguuaaagggaagaugaaguuggauucauauccagaguuuuaaaaaugagacgagaaugaaugauaugauaguaaaugcagcugguuuucuccaagaagugaucugagagagaagaaaacagcaagacagaagccuagugccuguuuccauuuagcuuuggaagugccaugccaccacuucuguuguaauugguugucacacaggcuaaccuuuuucuaggugggugaagauugcuuccgucuuugagaccuggguuaucuauaauauuuguuaagggagugaaccuuaaauaagcaagcucuugauucuguucuauuuuccagucuugguagacauggggagaauuccuguaugucuuuaagggauggcuucuggggaugcagggaucagggacucauccuucagaagccuccuggggcucauuuaugugccaaggaucuuucuaaguuaauaacacaguuaugccuguuucuacaaacaacaggacacuagugagaguuggaagcaccaaggauuucuuugcuguuuuguauuaucuggugaaaucuuccucacgagucugaacauuuuaacuuuuuuuagcagugaaaauuagcugaaggaacuguacuugucuuuaguacuugauacuuuuaaaaaacggguuucauucaucuucugaucaucuuaaggaagaagugugaggagauggaaacagacuggccuugaagucagugugggcuugcauucccauuuggcaucguucaccaugugacuuuaaagucauauucuuucucugacuuuagaauauuaagcuagagugucagggcuuugaaagggacgcucacagguacuggcuaaguuuaggaagugggaagaaacuggggaaguggacuuucugaucuccguuucagacacaguaguucuacuuuuguuuaaauguugagguuacugugagaucugauuggaaagagacuuugaggcuuuuuuaaaaaaaaaagucuuggaaauggauggcuguagugauuaaagucuuaaaguuuucagaaaaaggaaaaaggcugcuuuuugaugucacagggcaaggagucgauuucuucaggucaagcaacagaacagcacuuggaugacucuucagaaaccuagauuuuagccuggcguaguagccacgccuuuaaucccagcacucgggaggcagaggcaggcggguuucugaguucgaggccagccuggucuacagagugaguuccaggacagccagagcuauacagagaaacccugucucgaaaaaccaaccaaccaaccaaaaaaccaaaaaacccuagaucuuuuuuuucuuuucucuuucacuuucaagaauuuuuauuuauuuuaaaaggguugguagacauaggcguuaguugccaauggauauaucuccugucccuaaaaugguacaguuucuucaggggucagaauccaugucuugagggauaaacaccuuccuugggcauggaacaggucuucuggguggaguaggagaggggagggcaagagaagggaggaaugcaguugauguuguuaggaaguggcacccuuuuaaaaauuuuauuuauuuuuauuuucucaguuuuguucacuucucuccucuccucuccuccuagucucuuccccccacuccucacauuuacaagggacaucaacuaaauauggcaucucaaguugcaauaagucuaggcucauccccuuauauuaagggugggugaggcaacccagugggagaaaaagggucccagaagcagacaacagagucagagacagcccauacauccauuguuaggaguccacaagaagaccaagcuacacauccauaacauguaugcagagggcagucccaugcaggcucccuaauugucaguucaguccuugugaaccccuaugaacccugguuaguugucugugaaugguuguuguugcuguuauuuuaauguccuugaccccucugacaauuauaugagugcugggaacugaacccagguucucugcagccacugagccuucucuccagcuacaucucuuuauuuuuuauggcuccaauauuuauuuagacuacagcugaaugaaacuaauguuauacccucccaccauucucuguuuucuuacuuuucauguaaacaucguguuucugaauagaaaccuagaaaauaaugguuugguagaaucaguagagcuaggagaaauuccaugucuucuauuuauccgugugaccuugggaaggcuuauaacuuucucaguuuguucauuguguagccuagggauugcugugaagauuaaaggugauaaugaagcacuacacuuacuuccaugcuaagugacuacuagguacaaauauuugcuauuuucauucauaugucuugugaaguuuggauagaugguaguuaaacauuuaaaaauaguucaugccagaguagcaagaauuaauacucaauaaaguuuagucuuuucagauacauuuauuuuguuugacuuggugguuugucuuuggaauuguucaggcucugagugaagcaacaaauggcacaaggucaucuaguagagacaccuggcaacucagcuuauaauaccugguuuaccagugacacggauaguuuauaauaguaugggugucuggggcuaguaauuauccauacuggguucuucuaucugacagucuuuuaucuauauagcuauuuagguagccacugacuaguggcugccuacuguuugauagagcaguauuuuauuauauauuccugcucucuuuagcugcuuucuuuuugaauuuuuuuaauauuuuuuuauuacguauuuuccucaauuacauuuccagugcuaucccaaaagucccccauacccuccuccccacuccccuacccacccacucccacuuuuuggcccuggcguuccccuguacuggggcauauaaaguuugcaaguccaaugggccucucuuuccagugauggccgacuaggccaucuuuugauacauaugcagcuagagucaagagcuccgggguacugguuaguuccaauguugauccaccuauaggguugcagaucucuuuagcuccuuggauauuuucucgauuuagcugcuuucuuugguguagaucuagguacuuaccugcaaauacaccuggcucuuuuccuuuacaauuuaacucuucucuguaauuuaagaaaaagagcccugaaaaagagaagacaaguauaaucguguugcuccugggagucgauggaauuguguugggguagagacauaggagagagggaugaaaaggaccagaaaacuccuuaggucuuucccuauccccagcauggucuguuaaaaguuaguccuucaacuauugugguccaagagaauuggagaauuugaaacuagaaugauuucuucaaguaggcauuuagcacagccuuuuccuuauguuuugauucaguguguaggguucuuaccaaguaguuccccacaugugcugucauucugccacaguagagaacuguacugcuguggucauuuucaugccugggaguuuugucucugaaaaugaaaauucaccccucuauggcuucuaaucacuggccucucacaugcagaagcaggcuuagacagaugagcuaauaccugugaaacagaacauugacuuugacuuuuccauucuuccuccagcugaaagugucaugcaagggacagacagaucaaguaguucuagaaccucagaucagccuuaucuucugcaaagauuguguugcaaguuuuuuucucaauuuaguaguagagaugcuuuccugauuauuagucuugcuacuguuuuguagaugaauaacucaaggccauacagaaauucucuuauaaacugguuggaauucuugcuuccaguagcaguucuugcguuccuuuccauggguaguucuuuuuagagacgccguuagcaaucuccgaaacucaaucuuuaagcaccauguauguggccuguguaccuugagacuucuauuaggaaugacagauucuauuaaaacacaacaggaguggggauauagcucagagcacuuauuuagcauuuguaaggccauggguucaauucccagcacugcaaaacaacagaacaaaacaaaauaaaauauccaauguacacuucauccuaaaaauaucaagcuauuucaacuuuauaagagaagguaaagaauuucaccuacaaauauuuauggaucacauauagagcuuauagacugcuuuagauauaaacaaaauguuguauucuaacuucugcaaaaacaugggaaauuccaacuucuagacaggggucagaaagcucagucccuuuugcuccuuuccuuuuuuuuuuuuuuuuuuucuccuuccuucagacaggguuucucuguguagcccuggcuguccuggagcucacucuguagaccaggcuggccucagauucagagaugcuccucccucugccuccugagugcugagauuaaaggcgugcaccaucacgcccaguuuacuuuagucucucaauggaagugugccucauuagggaaauuaccaccugcguuggcacuguguuguacugaaagaguuuugacauuugaucucagcaguagaccuggguuagauuuuggauugaaguacuagacauacagucuugaaaugcuagcucugcuguaauuauuauuuuuuucaugucuuuugucucuuuuaaucuggaaguuucucaagguuaguguuguuucagacuauuaagcuacaauuguuaaauuguggauuuaaaguacuagguugguuuuaagaaccuauauagaaaaaaacaaggcgggggcuggcgagauggcucaguggguaagagcacccggcugcucuuccgaagguccagaguucaaaucccagcaaccacaugguggcucacaaccaucccuuacgagaucugacucccucuucuggagugucugaagacagcuacaguguacuuacauauaaucaauaaauaaaucuuuaaaaaaaaaaaaaagaaaagaaaaaaacaaggcgaacuuuagugcuguaauucuacucuagcaucaggaguuccacagcuggagcuucugcacccuccugugugcaucuccuacccccaauugagcacagacuguuuugugaagcuuuguugcaguuuuacauuuagauuuuuguguaugcaugugcaugcauaggugugugcuaggacucaauguaaaauguguucuuauuguagguuggugucaaaacaguuuaggaauuucuuuuaggaaaaagauugcccaauuccucugccucccuuucucuuucucuuucucccuccauccuucccucucuuuuucucacucuugauuuuuuuuuccagaguuucaguauguagucagccuguagcccagguuggccuuucuucugccaaucccuugguugcuggaauuauaggauugaaccacaaugcuuuguuuuaggacuugugacagagucuggaacaaaucuucugaugcacagagagcuaagacaaagcuuauggaauugcuugcuauguaauacagacagcaaguagaauaaauauucaaagaagacaguauugcaaaaguuaaguauuaagcugauaacauggcucagcagguaagguuacuugcugccaggccuggugacuugagucguccucugaccuccacaugcagucuguauuucccuucccccacuguauugagauccugccaucuaaagacuaaaauuucccaagucaaguuuauccugagaaaccucaggagaaagugcuuuuccagccuucucugcaagauguuagagucucauuaaaagugcgaagguguagggcuaguagugcucaugaucuguaccuuggucacauggcagaccuaagugagucacugcauaagugagguuaagauuuuuaguaacauuuaaguuuuagggauuugggagaugagcagaaacaaguauauaagaauuuuauguuaaauagccauacaugaggaaauauaaugcaaccccaauauaagcuuguguaaggcuaaauuauuguuuaaaauuaugcauuaaaaaguuuccaauggaagccaagagugguggcauacaucuuuaaucucaacaccugggaagaagaagcaggcagauuucugaguuugaugccaggcuacauagugaguuccaggacagcccaggguauaaagagagcuccugucucuagaaauaagcaagcaagcaagcaagcaagcaagcaagcaagcaagcaagcaagcaagcaagcacagaaacaaaaaaguucucagaaaaaccaaaaguuuuuauuauaaacaaacaaaaaacauuccacuagguaugccuagcauuaaguaggcugaggcaggaggauuucgaugaguuugaggccauucugggcuacagagaaugccucagaaaaacaaaacaccccuuccauaguucaggaaaguaguugaaagcuguaucaauggaaguucuccuucaaauguuauuuauguggcuuuggcuuuuacaauuauggaggaugcuacuuucaagcuagaaacccaggaauccagacguucaucagucggcaucugaaggcugauggacggggcagcaguugauguaaauccuuuucugagggcuggcaggcaggaauugaaagaagagaauuucaucuuuugucucauucagguucuaaagggccuggccaaugcccauuugcagggcagaggaugcucugccgaguccauggauucagaugcugauguaaucuugaaauacccacaaaugcaccaacaauauaauguuuaaucugggcaaccuguggcacauaaaauuaauuuucauagcaguuuaccuuucuggugccuaaaaaguauaugaauaaacuucaccuguaacuuauuuguaugggugaccucaggcaaguuagcuaccucccuaaccucacuuucuucaucucugaaauuaagguaaauaauaaucucagaagcuguuugugaaaauugagugaaguaaguuuaugacaguggcuggcacauaacacuugcuuaauauuuucaucacccuagccacucccccccacuccccaccccguaguaaagcauuugcccgugaaauacugauaagaacuagaugugagaaaugcuugaaaaauaccuguauguguugguugguuacucucuaaagccuauucucucucacuaagauacccacugucuuucucuucaaagcuacuuccuggggagaaaguccaaagugagcuguuacaacuugccuuuggccccucccugagcccgguucauuccuguaagcugggaaaaggaaaugaguucacauuguccaacccaggcuaaacuucucagggaaacaucugccuaaccuugggaaggagcagcagcagguguagcucugcaggaaagggaccccugggcaagguaaggaggaaggaaggccuuucugguucacagcacagacuugagcucggggcaauucgggaggagaucacuagugucuguucucugaugaaggaacuagaucuugauuuuaaacccguggaaugguggagagaggaagaggagaagagagaauacuuguaagguaccugagacauagcuuuguguuagcuccugggaaaacaauagccugggcacaggagaaagaauagcuauucucccacugaucuuuguucuuuuguaaauuucuugcccauucuuaguuuugguaaagggagcucuaaaauguuuauccccauuuauuaagguauagaaaauagauugauguauuaaaccaguucagagguagucagaagguagaauuucugugugacuuuuuuauauauaaaccuugaacucaugauuuucuugccuucugagugcugggcuuuacaguuguauuuaaucuauauucauuucucaaccucaggauuuguuauuucagguaauagaauucucugcuggguggauguaggacacaguccuguuaauaauaggaugucuauuuuuuuuaaagauuuauuuauuuauauguaaguacacuguagcugucuucagacacuccagaagagggagucagaucucgcuacagaugguugugagccaccaugugguugcugggauuugaacucuggaccuucggaagagcagucuggaagagcggucaggugcucuuacccacugagccaucucaccagcccccuaggaugucuauuuuuauuuuuuuuaaauugugugugugcgugcgugugugugcacaugugugguauauuugugugugugcauaggugugcuuacugugcguuuguauguaaagaccaacaguuaacuguggguuucuuccucuacuguucucuacccuuuuaaaaaaaugaaacaaaacaagacuuaaaaaaauauuuuaccuuaugauuuuuaucuacuugcuuguauguuuacuaaguguaugucuguuggacccucuggguuauggaugguugugaauccaccaugugggugcugggaauugaaccuggauccuuugcaagagcaacaaguacuucuaauagcugagccaucuuauuuuuugagucagggucuuucacugaaccuagagcuagucuuaaaguaagcuacaggaauuucuuuguuucugcuuacccaguucuggcauuacagguuugugcugcuauguguggccuuuaccugggugcugggaaucugaacucagguccucauacuugugccaaaagcucuuuuugaaauaagccaucuucccagcuccauuauuagaucuucaguagugcccuugucaucuaucuaguagaagccaauacaccacaaagucaugacaaucagcaaugcuuagauacuguggccacugucagcugucagacacugugggccaaaaucagcuauaacuaagacucaguacucuauguuuauaaauugcuaggauaacuagaagauaaaaauaauauuaauuugaucuccuaaaguauuuacugugugccaggcacuguacuaagccuuaauuauaauugcuuauuuaauuaaccuaauaauucuaagguaaguacuguuauugcauuuuauaggucagaaaauggaggggaaaaaagguuacaugaauugauagguguuaauguuguuacaauuauguguuguuaaggauugcccuaagugccuuaccugucuguuauuugacuuaaucuuuacacucagucugugagguuguucugauauugucauggguuauagauuuuguuguauaccuguugcuaaucauugauagcacacuggguaaaggcuuaaugucuuucuaaggcuuuaaucuuguuuaucuaauaaaacauuuucagaguacuuuucucuauuuuuuucuccuaacaauacuaguauuaucucuaauuguuuaagagacugagaaagaagccagguggugguaugcauacuuuuaauuucagcauuugggauuaaagugcugaucucugaguucaaggccagcuaguuuaugaaaugaguuccagaucagccagagcuccauagugagacccggucucaaagcaagcaagcaagcaagcaagcaagcgagcaaacagagagagaaacugaaaaagaggcuuguguagauacaugguaaaucauugagcuggcuugcacuuguugcacaucuugacuauuuaggacauaaagccuucagcugaacuggguaguaaggugacaaagaaauacugagccuguuuguguuggaaggagagcugagagaggcuacuucugguuuguagucugaaauuuguuguaaaauuuccauaucugauuuguauuggcucuggaauacaaguuacaauuauguuauaauuggaguguuuuuucuuuuucuuuuuaacauccagcuuuaguauucugucuuguaaacuccgugagcauagagacaauuuuguuauacauagacuuuugcaugcaguaguugccuuauuugugaaaauacugaauugccaguaagcacaugggaaggaaagugaucgacugagguugauuuaguuaagauuauagagcaauuuaguaauaguuuaggacaaguucugauuuuuuuccuguccuugggcccugaauucuuuauaacccacgugcugcuugcuuguaugugugugcuuaucaugacuggagcuaaaugauuugaugcuguugacuuaguuuuccuuuaacaaaagugacaaacaaugguucuuuucucuuuuccauuuuuguuugcucauaaauaauguccuucuaguauagucucugaccacggaaugaaugucucuaaaggaccagggaggcugugcugucccucccaauccagaacuagaaauuauguugcagcuacuauucuuuuuguuuuguuuugguuuuuuuguuuuuucgagacaggguuuuuccguauagcccugcugccuguccuggaacucacuuuguagaccaggcuggccucgaacucagaaauccgccugccugccucugccuccccuccccagugcugggauuaaaggcgagccaccaccgcccuuacagguacuauucuugacaacuucuuccuauuuuaguggugacaaaguggucaaaacauaccagcuaaaacagaaaguuaguuuauagggaagaagcuuuuuuaaaaaagacucacuguuacccuugauuggccuggaacuugcugugugugucuggaacuugaccagacuggccucuaacucacaaagaucugucuguuucuauguuccaaaugcuguaaagacacucacugucauaucuggguaaccuuuuugagggcaaggggguguggucagggcugaaugcaugaguacguauaccucaaagcuuucuuauccuucauaguaauuugaauaccuuucagucugucugcagagccacuuagguccagaaggacugcagacuuuucagugacuuaguuuuuguucuucugcuuugugucaaauuuguauggagaaaggaagcaaucuaggcuggguuuuuuacaggaugguggaggugucugggaaggaagagaaaaagaacgcauccauagcagcauguugaacuucucuuauguaugcauccauuccuccaggcccuugucuuuuccauccugaguuguaacuuuuugaguuccuauccuuauuuguugguguuuugcuaucauagcaaugacuaguaaagaauggaugguuugagauuguauuuccaaucaagguuuuguuucuugagacagggucucacuccuggcagaccugaaacuuacuauauggcacaaauuuacagagauccaacugccucugccacccgaguccuggacuaaggcaugcacuaccacaccucccagucaaguuuuuuuuuuuuuuuuuuuguaaagaaaguucaaaauugagauuaggaaauuucugucuccucaggaauggagucaagguguuuaucuuuaucuauauggcucuuaugauucauccuaagggacaagaaaauguuccuuacucaaaauggcugccuaguaguaauugaaacuaaagaggaauaaaagcuuauuuucaguaauuggaaaguagcauagaaaucuaguauaguggaguggauucuguuucaaguugugguauuauuuagguuuauagucuuugucaaauguuaagcuuuaugaaucucauuuguucucauuuguaaaaugaauguaauuaagcuaccuugaaaguguguguguaagccgggcguggggcaugccuuuaaucccagcacuggggaggggaggcagacggauuucugaguucgaggccagacuggucuacaaagugaguuccaggauagucagggcugcacagagaaacccugucuugaaaagccauuaaaaaaagaaagaagaagaaacucucuguguguguguguguguguguguguguguaugugugugugugugugugugguguauguacaaauaaacaugugcuugagugaguggaggucagagguagcuuuugagucuuccuuaauugcuaucuaccugaaaagaggguuucucacugaagguagaauuaaucaauuuggcuagauuguugggccaacaagcuccagggaucuaccugugucugucccucaccaccuucuggugcugugauuucagauacauccauauauacauacauauaugguacugcaugugccuuguacaugagugcuuggaucugaacuuggguagcauguacuuuuuaaagucaucuucccagccccuaaaauugauuucuuaauuuuaauuuaaaaacauauguucauuuauuccuguguguguguuuguguguguguguguguguguguguguguguguguguguguauacaggggagaguagagaguauguucugugguaugaauguagguugcugugaggcacaggccuagacuuuacuagucuaauaugccuacaucacacuuagaacuugaaaaccuaaguaagaaaguaauggguacugaguuucagugaagaugaaacugugguaucaauucuagaaucuagugagcugaaguagugcaguaguuacuucauuggacuaguuugucaguguagcuuugugcuuugcccugaaauuuuagucuuaagcccucucucccuucauuuccauaauuugugagccacccaguauacuucagcaaguucauuuucuacuuagucaucuaggcuaguacauaaccaaagaauccuuggcugcugccucugggacacaucugacauguugccugguucugucauaaaaguuuuauaggauuacagcuacauuguucauuuauauauugucuguggcuaaccuuaugcaaagaaaguagaguugaauaguugagacagauaaauaacccucaaagccuuaaauaauuugccuuuugcaaaaaaauucccagcucccaccuuuuaauggauaauauuuguuucuuaacagaauauuguuugcuuuauccaacagagaguguuuggauaguguggaaguuuuggcuugacuuccaguuuugucagaacaaaauuuggcccuguauuguaauggcugcuuuuagcaagggaaguugguaguauaccacaguuuguuuguuuauuuguuuguuuuaauuuuuuuuuacuagaguaauauguuguauauacuuuuauaugcauaaauauccuggaugucauuuuaaaaauagguuaauguuuauuuuuucugaaugcuuuguuuaaagggccuauugggaguauaaaaauuauaaagaauauuuauuauauauucuuagcuucuguaaucuaaugguauuaagcagaauucacuuauaucuagggaccaguaacuacaaacaauaauaaugacaaaauaauugagaaaccagugguuauuaaggaauuuguguuuuugacuacuaagaauaauuuuuucucaugagauuuucuguguuuugcugcuuuagaucagaaguauuuucagcuuuguguaguagaaaaccuaacaguaauuuaaaaaguaaaaauaaauuucuuuacuuaaagaggaaggugguugauggcuggcaugggcucaaauauaccagcaggcgggaaccaggugcuuucuuuuucucuagcgggaaccuuccgaauauuggcuuucaggcauugugcuaaaugucuggguauuugaacuccacaaagcauguuugaggaaggaagaaccagggaaaggcagaauggggcaaaggaggaacuagcaccacuucuguguccuguuuuaaaauuaaaaguaaccauuucccuugaauuaauaaaaaguguccuggcuagaacugugucauaucagcaccuuaaaccugaagggaguuuggggaaagagcauagauguuuuucaacuuaaaacgauggggguauacccccauaaaguuauauuuauucauuuaaaaucuuuuugaggugugcguaugcguguguguguguguguguguggguugcauguauacuguugauguuguggaggucagaggacaaccucaguugucagucuccaccuugcaccuucgucucucuuguucacuguugcacuggacagguuagcugaagugggcuucuggaaauuccuuugucucuacuucccauuucacuguaggggcaugcugggauugcagauguguauguuacuguauucauuuuuuguauccaucuuuucucaugugggugcuggggguuugaacucagguucucaggaucacacagcaaaagccaucugcugaacucccccuuucccuccuccccuucuuuaucuuuuccuuguuuguucauuuuuuugaggcagggcaucauguagcccagaaguucucaaacacauguagccaaggaugacgcugaccuccauuccaccugccucagucuccugagugcugggcuuauuuacaggcauguuccaccauaaagccauuuuaaauaguaagcauuguaaauuaaaaguacauuuaaugcaaccaacuuacugaacauaauagccuagcaucauagugcacucuauaguaucaauuauuuauuauugugauugcauguugucuugggacagcacaagauaucauacuacauauaauaaccugugaaagaucaaaauuaaaaugugaagggcaaauucuacugauuaugaaucacuguuaugcuagcugugguggagaaugccuuaaucccaacaccugagaaguggaggauugagaguuuaaaauaaguuugggcuaacuuucaguaaccuguguaguaguuuaaaugaaaauggccucaguagacucccagggaguggcacuaucaggaagcauggugguguuggaauagguuuugccuuuuuggaggaagugugucacuagggacaggcuuacaguaccucuugccuccaccucuucaguauauccuaugaggaugcucuaccauaaggcuuggugcuucuugucugcuauguaaugugacuagucccugagaugugaucagcuguaagcucuggcaaccagggcuggagcccuaccuuccaugccuccugcaucuugaaaaaauccuuccugcuuuaaguugcuucuugucagguauuugguggcagcaaugagagcaguaacuaacacacuaacugagagaguaggaaugccauuuauuguggagggagauaacugaaagaggaagagacuuuggaccugaugacaguuuugucuccagucuuaacaauuauuagcugacagagaguaagagccaggucuugugaucuuuguauauauagcacuguaucugguguguagaacauauucuugaauggugacuggaugugagauuauuuauuauuuccaugaaacauuggacuauuuccuaaacagugucaugcucuucuuuuugggcuuuauauguaaugucaguaccuuugucuaugaaauucuaccuuuucauuaagguagaauuucauagacaaauauugggaggucagcuuuccucuacucucacauaucugagauaguuucuaaagagaaaaguuuaucuugguuuauaguuuugagguuuuguuucuuuugggccuguggugaggcagcacauuaugucagggagugcauuguggaucauagacauuccccucaugacuaggaagcauaauugaggaagaagaaugggcuggaucccaaucaucuccuucaagagcacaucucucaugcuaucaaaaucuccuacaaugcccuaacuguuaaagguccuaccauuuuccaacggcaccaagcuggggaccaggcguuuaacacaugggccuuuggauaaauucuagauccaaacugugauaagcccucuaccucccuuucccuuuuaccgccugccugccugccugccugccugccugccugccugccugccuguauauuuuuguaguguaaaugugucauggcaugagagucaggacaguuuuguggagucaguucucuuuucccaccuuuuuguggauucugggaauugaacuuagguugucaggcuuuucugcagccaauguuuuuaacccaccuagccauuucacugguccuagaauauugccaguguaaugucagcucauuaguugguggaucuccacucuccacccccaaccccgagccugggauugaaccuaggaccuugugcauuuuagucagguguuccacugagcuacacuccccagcugcuuucccuuccuuccuuccuuccuuccuuccuuccuuccuuccuuccauccauccauccaucuaucugucuuuguuuugauuagauuuguuuucuuuuuuauuccccccaccccccccccuuuuuuuuuugagacaggguuucucuguguagcccuggcuguccuggaacucacucuguagaccaggcuggccucgaacucagaaaccugccugccucugccucccaagugcuggaauuaaaggcgugcaccaccaccacccugcuagguuuguuuucuuauugcugaauuuuaagacuucuuuguguauuuugaauacaaauccuuuauguucuuuaugugcauaaagcacaaucuguacauguacuuugcaaaugcuuuuucgucaucggugucuucucuuuucauuucuuaacauugucuuuugaagaacaguuuuauguuuuaaucaaauucaacuugucuagguuuucuuaaaugaauugucuuugauaauggcaucuaaaaggcuauugcaaaaucaaggucauccagauuucuccugcauugucuuacagacauuuuauagucuugaaauuuagaucuaugguccauuuugaguguguguguagcuuauaaagucuaugucuagguucuuuccuucuuuucugucacuaauacuauauaaaucagaaugaagaacagaguaugaaguaugaccauuuuaaaaccaauuuagaacugaguaaugguauggaacuauaauuccaguacucaggaagcugagauagaauuaucaggaguuccggguucuccuaggguccauaaguaaauucuagacaagccuggguugacacacuguuucacaaaacuaaaccaaauuaaacaacaacaacaaaaaaacaaacguagcaacaacaacaacaacaacaaagagaucauaagagggagguuagauuuccuggaacuggaguuacaaaugauuuugagccaccauguacgugcuugggacugaacccagccaggcaacaagugcuauagugcugaaccaucucucgagcauucugucugccuaccuaccugccugucugucugucugacacucucucucucucucucucucucucucucucucucucucucucucucucgugugugugugugugugugugugugugugugugugugugagugaggggguggaagauggagaaugggaaugaaucaugugucacggugugcaugugaaaacagagaaaaacauguaggaaggaggaguugguucucccuacccugugucacaaagauggaacuaaggucagcagucuuggcagcuuggcaguucuuuuaccuacugucccaccuugcugggcccaguuuuuuuguuuuguuuuguucucaaauguagaaauucaugucuccuuuuccaaauacuguaaguauucagggcuuaggaaggguaaauaauaaaagagcugaguucuuuuuauauagaguucuuccucugcauuagacuaauuugggccaaugagugguagugcagacauuugucaggaaagauggcugcauguuguauaagucaggcuucaugguggucaccgacucuuuggugaccaacaguuaguuaucuguuguaaacaaaacagaaauaaauaggaggacuaaaaagaaacauaggcuuaagauucagucggcaguacauacaugguuacgucauuugcugguuguauaacccuggagcagucacugugcuuucucauccauugcuuccugucuuacaccugcucugcugggcugcuuuccagcagcaucuucagcauguguuacuuacugucaucuuagacguuuguuuaaguuaguacaguuucugcuuuccgaugccugaagcucuaaaaaacucuuuaacuguguacuugcccauacuucuuuccauugaucaaggaucuuuuaaaacaucaauuguuguuauccuguuuuuucccagaacccuuagagcagaaucuaaacuucugagccugugagauggcucagugcauaaagauuucuggcacuaagccagacaacccaaguuugaaccuuaggacacaugugguagaaguagaaaauugauucucaugaguuauccucugaucucuacaugcauaccaugguauauaugugccaccuacccucaccccauaacaaauaauuaaaacccucuaaacucauuaguuauggccuggaagagauaacugcauaacuugauuccagucaugcgccucaagggcaagggaugaguugggugaguguagugagugaugaugggagauacugacuucuggguguacaggaaauaugugaagguacauuuuuuaacauuucagucuuaaggaagcaccguuuauugggauggggaagaccagaguuguuucuuuaaugugucauccagcuccaaguucuauuguagugacugguaucugacaagugcuaaagaaauucugagagugguguagggccuacuucauaacucugugaaauagacauagguuuguaaaguguggggacacauaguaaauagcccuuaacaaauaguagcuguugcugaacuuucucuguucaaaggaggugguugguauagggaccaccuuauuaucuuucaugggacacauuuuagagagucagcagaaaagaauaauuucccccucuccauucuagucugaaugaaucuugaaucuaauuugaguaggucuugauuccgggguucaagaggacucccacaggcucuagaacagcuguucucagcuuauagguccagaucccuugagggguuguugaacuacccuuucacaggggucaccuaagaccauuggaaaugucagauauuuacauuacaauucauagcaguagcaaaauuacagaauuacaaaauuaugaaauagcaacaaaauuaauuuuaugauugggggucaccacaaugugaggaacuauauuaaagaaucgcaguguuaggaagguugagaacuacugcucuaaaaagccugucugguaccucuuguuggagccuggguugggagaacagcagagacaaucagaacauugguuauguauuuguuucccgccccucagcgccucuucagaaaaaaaggggcgggggcagcgcucuccccgccuccuuuccuuccuuucucuguuccucccucccuccccgccccuucacuaagccucugugucuuugcugccgcccuacgugggccugagugugcugcgccuugggagcuggguggcugcgcugcggcgcuuagccgaauccagccugucaggcugguucagcccgggcuuugucccaacugcugagcagggagaggugcggcucugcgacagauacacaagaucaucagagaugcugggccccggacccaccgccagguaaugcuggcuuucccugggccuggcauagcuagacugagagcugggguagaaggagcgggugucuuucugccuuccggggaagggaauggggagaacauuacauuucacuuauauuaagggauucuuaauaaggaaagggccuggugguguaacauugagauaagccccucagggcuaggccugugcuggaauaaggcaucuggcuagggaagguuaugaaggggaagcuggauuuuuuggggaacugcaugccucaggggccccacuccuuuguaagcaugcuucugcaugguggccagggugaugcuuuucugugccuugguuuagcugcgguuuuccugggacccggaauacuguucucugguuggagauguagugaagauaggagaccccugcagcuguuccuggucaggcagucucuaugagccuuaauuuccuuauuugaagagaagggcuuagcauucuguaacugugccuuuccuaggcuguaaaauuuaccuuggaaaggugagcuagguagagacagaggagccagccuuccauaugcaucuugccggucuguuuagaaccagugacuucauaaagugcuaaugcuucuguuggggcuaagaguagauauguugaguguggggugugggguugagaagaaacaggugaacgcaugcuaauuuuuuuuccugaacuggccaauucuuugauacuuagaucacugcuauaaacuaggcugucuucucuggugcacuguuauugaucugcuaaguaaauaacagaccuugacacuauguaauaucuuaaucacuguaauuccuuccuuuauuaucuggcaccaagaaauacaaauacuaaccuaugcugauuauuuuggaccuuucucaucuugguuacagaggagcuaugcauucccucugggaagccuuccugcucuuccuuucuuccuccucuuccugcuggucggcuuuccuugccugccccucaccuguuuucugaucucaccaguuuccuuucuuccuuuccuugucuucacgcuuuccacuucuugucucuuuuccuuccauaaccaugguuucuuuuuucuguuuuccuuuuucauuucuucccuggguccucuucuucuugguuaggcucucuucucuuuuccuuuuagaaucuuuuauugugcuuucucauugguaguaaguugcugacuuggagggaccuuugcugugauguuuguaagguccaaacauucuagcuuccuuguuuuggaccuaagcucuguuuuccuuaugugucaggcugucuccuuacugcccucaagcuguguuuugaggcuuccuaauaaguaguuauuuuuccuggguuuauuccccauccuuuuccuugagaaccaaggcagaaugugggcagaaggaaaaaaucaugguaggaagucaggagcuugaaggcucgagcuggagaacaaguacaaauacagcuagcuaggagaccuuccugagagccccucacugagaugagggcugggagauagccaguuuccaggggcacagugggaugaagagaagaagggggagucuuggggcaagaguguucuuuaggaagaagaggguggcguuggcaucaagauggggguuauuaggggguaaggguagcuguagagggaacgauuuauaggcuauguaaaagauguguagccauauagguucauuguuuucccuccugaugguaggcucucugaagaggauuauuuuugcucugcaucuuucucccccccccccacccccccgcccucucccgccccguaguguccuaaagugagagagucagaggggaaacagagaugagacugacaggguuauuguuucauugacacucacuaacuaauauaugcaaugugugugcauguguguaugcauauauacacacacacauacaagauaucaauuugguauccaucauuaacuguucucucugguuggugagaacauuugccaccaagcaugaugagaucugaguucuauucccauguuuuauaugguaggagagacuaauuccuacgagaugucuggauaugugagcuaugguauggucucaccacuaucccaacgcacacauguauaaauagauguaauuuuaaaaauaaacauucucucagucaccuguaguauauuaguuauggugcugguugcugaguacuguugguuuuuaaaggagguauuuagauucauuugcuguguucagaugcaggucuagggguggacccucauguguaguguagaggggagcacagggagcuaugauaauguaguggaggaagacuaagguucaacaaaucagugccagggcugcacuguaaacucaagucuucuuuaauugugauacacauuuacuuagacuauguuaucuugugacauuaggugcauguuguauauaaagaauuuucuuguuuuuuuuuuucugucuuugggaauaaaauguagauauuaaugaaauagaaaacaaauuuacaugugguagguuauuacgcccuggccaaacaaauucucagaaggaagcagacuuugucccuguuuuuuucuggcugcaggccauuuaggugacucacugcugagcacccucucugaguuauuugaucccuuucucuucccugcucucuuauauucaauuucgggcacaagauagagagaguccagagaccagauaggcuagguguuuacuucacagacuucuguaagauaagaauguaacacccuguagggcugguaggaaccagugaggcaauggaugcaugaacacacuuugugcagugauccacucauauucuuguuauucuggaugcauuccuaaaacaccuaagaagaugcuuagaugcuguagcccagaagcccaaagaugcaacugagaaaucuaaauuauuucucaauucuugaggaauaaaagaaaaagagggaauauauagaaaaagcuuuuaggauugguaguccagcuucaugcucaaaauggaggucagcugguaccauagugcuuuauucauggcagagagacgguagggggccaguauaaaagauuucauuuugagugccuaugauaaguagauaaauagaagagaaaguaauuaaggucaaaucuucauguaaugguugcugguuaccugcuugcuuauccaaguuucauauacuaaaaugaaagauacuuauauuaacauugaaaaguugauuaugaagauaaauaaguaauuuuauaaaaaauaaaaaauaugaugcuggagagguggcauuggcugcuuuuccagaggacuugguuucaauucucugcaaugacagcucaaaacugucuguaacccaauuccaggggaucugguacccaaaugcagacauacaugcaaucaaaaugccacugcacauaagaaauauuaaaaaaaauuuuuaaaaaucacacaguugguacuuauagcuauacuuauucuuaaucuguaaaaauaaacuccaaagucaccucuuaagcaagucuuccuuuggggcuggagggauggcucagugguuaagagcacuggaugcuuuucuugaggugcugaguucaauucucagcuaucacaugguagcccacaaacauuuauaguaugaucugaugcccucuucuggcaugaaaguauacaugaggaaagaguauguguguguuaaaauaaauaccuauaauaauauauuauauaauaaaaaucuauaauaaguaucuauaauauuuuuuuaaaagaaagucuuucuuuacuguuagggccucucuucuggauuuauguugugccucucuucacucagugcuggcacuugccauuguuguauuauuauguagauccuguaucuuuuccucccauuagucugcauucauuggagggcaaacucgggucuaguauauuuaagagucagcugagugccuuuuuaguuucuaaauauagguuaguaaauaaaacaaauauagucgcuacuguuuauuaaggagauguauaauaaaugaguauaauuaaaaauugugauacuugcugugauaaucaagaguaccuuuugaucauguuaagucugucugugagacaacugccacucugaccaguaccugcagcuuaacagaaguuuagguagcacugacugccggacaagagagcuguuuggugaaaagguuaaaaccuuggugucaucagcaacaagggugguaugugaggccuuugggcuggggaggucacuuggggagaguguauuauaugaguaaaggggucuggagucuuggaauugugaaaaauacugaaggaaguguauacagaggggagaagagaagacagaaagauagcaaagcaagagaauccaagauaguaggguauuuaaaagagaacugaaguuaauuauauugacugcugaugagacauugaacaagcacggaaaagugaccauuagauuuuuuuaagauggaaaugauuggcaaucuugacaagaguacuuuugugaaauaggaagcaugccacuuggcacagaggggaagguaguggagacaguacuucaaauauuaauagauaauucuuuugagaagcucugcuucugagggcaagcaaagauauagugguguuuggaagaggaagauggugucagagaagaguugugugcgcauguguaggguaauguagaguacuugauauauuuuucuaauauuucuugggucagguaaaaggaaucauuuaguuaugauuuugaauuucuuuuuucuuugcuauucuacaucaguuucuaaacucuuuggcucuacuuuuuaagaucaauuuacuuuuguuuuguuuuguuuuuucaggcuggauuucuguguguaguccuggcuguccuagaacucccuuuguagaccaggcuggccucgaacucagagauccuccugcuucuaccuccccaguacugagauuaaaaaugugcaccaccaccacuugguugucaacuaacuaaguucuuaacuacucagccaucucuccaguguuugucaucuuauuucuuuaggucuuaaguguuucuucucgacaaguccuuuccugaccaacccugguuccacacuuacacacacauguguaccaacccugguuccacacuuacacacacauguguaccaacccugguuccacacuuacacacacauguguacuuggcacuguuuaauuucagugcuuacuuuuugucggcaucucuugcuagacacauaauuuaugcaaacauaggaguuuuguuuuacccaacacacacacacacacacacacacacacacacacacacacacacacacaaagaagugguuugcaaauagcacggaaaauuaaggauaaagccuguaggaugagugugaaaagaaaagacagccuccaguuucuuugggucagguaggggcugcaguggcagcuagagaagucucuucaggugauaggcagcuuucuuuuaaggcaaaaggagcuagccaaugacaaauagaacguagaaggguuuuaaucaggagaagaauguuaagaguaggaagguagguagggguguguguguguuuugaaaaagcuguuugugugugaaucaccucugcuggcugcugucacaccgcuguacauaaguacagggcaagacuaagugaauuuuaagucuuuuuguuuguuuuauuuuuuauuuuuucaagacaauauuucucuauguagcccuggcuguccuggaucucacucuguacacuagguuagccuugaacucagagauccacuugccucugcuuccaaagugcugcgauuaaagaugugugcgagccaccacagcccagugaauugucuuuuacuucaaaucucugccauuuucauaucuuuauugccucucauuucuuuuagcuuuaggaagguucucagcauaacccuaugucucaauucugucucaaauuaucauuagugucuaaagagugcuuuuaagauaaucaaaauaauuaagaagguguucaugaaaaguggggaggggacaaaaaaagaagguagucaugcccuuauaaauauuuaaguuagaagguuagguaaauuguauacccugauaaaguucagauuccuuuaaaauaaagauuuggaauugucuggcucuugaggagccuuccaguuuauuccacaaagacagauugucuuagaaagugggcucuugcucauuaccugaggcacuccaugucucuacuggaucaaggccauggagacauagaaauuaaucauaguuuuguccuuugaguuauuccuugccuagugaccacaagaagugaagaugaaacuuggcauugcuucauagaaguaugaauaaaaugcaguuaaguguaguaaaaaauauuuaauaaaauccuggcgugaaguuuuuuucuaccuuagaccacuuguguucccagaugaaagacacauacagccuuauauuuguaaauaugccuuagacagcacaguagcugggcagcugccuacccuccaugcuguuaggauccacuuuccuacugaaaaaucccaguuacuacugacugguuucuauguucccucugggcugcucuuaacuccaauuggccagcccucauggucacguguuuauggcucagccaucccacugcaguccccuccucucuccugcacacacuuccucuuccaagagagacaucuccuuccuccuuccucguaguggucucaagcccugggaaaccuaaaccccaccuaugucucuucuccccagcuauuuaucagucagaauuaacuaggggcagggucccucagugucuuacacucaguguguuacguguacacccuauagucuuuggggcaaacaauuuuaggggacccaaauuagcauuagaauacaagcagcauuaggucaacccucuauaguuacauuuugaaggaggauaaguagaggcuucuuugaagguuucuuagaggaagugaguccaguuggaccuugaggaaugaguaggaguuugcuaggcacauugaggugucuuaggcagauagaaccaugaagguaaagguggagauaugaaaguauacugauugaaugaugguuuggggaaugguauagguaaaacuagaaacagaugaggaagaaacaaauauuuguuggacaucuuuuuguaucaagcagcauguuagguacugucuuuuaaaaagcuuuuguguuuuuucauucuuaugauaacucuaagguagguagucuuguuugcaucuuacauaagagucaacggagcaucagaaaucaaaguagcuuuaaaccaccuacaguuuucuucccugcugccccagcaauugcuuucuuguugcuauacuagagcaaguagcuggcuggagguugcauagugggagugccuuugacgcauuagaaggacaucucucagcaaauucaaggcuacaguauuccagguuccugccaaagcaaaccucuuggcacgauuuaauuaaagaucagauucuaauaaccaggcaccaagggcauacaguacuccucaggcaugaguguuggccaugucaauauugcagcugcucuggguuguucaaaguuagaaauguaguugguauguggaguaggucuuauuucuucuuccuguccuucuuucauuuuguugacuaauuuauuguaaacuucuagcauuucguucccuccuuccuuccuuuuuucccucccucccucccucccucccucccucccucccucccucccucccucccuuccucccucccucucucccucccucccacugugcugggaauugacuugcauacuauucugccacugaacuauauccacaucaccuucccucuuuuauuuaaauagugaucugagggaucuggugaggugguucaguggggaaaggcacuuguuaaaccugaugcacuuaguuuaauccguagaacccaccggugaaaagagaacagacugcuauacaucccccucuggcaugcucaugcauauagugcacaagcaugugagcacaugugcccaacaaacacauguaauaacauuaaaacauuuacauuuaagugaauuagaaguuguguaguauauuccuuuguuucuagagguuaccaugauaugugguacugugaucacacaaauauuuuucaggucuuugcgucuugugcucaccacauacauguuguggauggcuggcaacaucucugaacuaugcuucuuuggauuuguuucauuguucuauucccagcaccuagcagagccuagaaaaaugaugccuaccaaguagauuuccaagcuuuuuauaaauucugaagugugaucugguuacuaaaauaccuguuccaaacaguggcugaaaucuuauauguaaagguaauuuauccagcuuguucuccagggaaacuguuucauaggauuucagcaacucacuugggaaauguaaaggacugucuuguacccuaagccccauauuguaagcucaagacaccccagaauccucagugcaaauggauagcaacugguuucuuccuuuagguaauaccucuuuucucauuguaguuucucuauagcuguguucuuuaaucaacagcuuuuuguuuuguuuuguuuuguuuuuaaaccugacacauuuacuguccagguacagaacugcuuagaaaagucuguuguccccccccccccccccccccccgccagauauaugugaggcaaaaaaacccuuggguuuuuuccuugcuuucucuacuuuauuuacugaggucucuccaugaaccugaagcucaccaauccagcuaguuuagguagcagguuucucuggggucucaucuuuacuccucagguacuggaaaugauuguaaaaacagagaggacuuggauaaaacagagaagaacuuaugcgaaaacucuuuucagaggaggugacuaaagguggaccagcugcuuuugagguuauagauauccuacugguggagaauuucagguauaguugggacaacucagaugccaucaucagguuucagacaauagauuccaguagaguuuugcuuaaucuacccauuaauaauucucuuaaguaugauacagugauuaagaauaaagaaaaauauggugauuuccugguguaauccuguacugugggccuaaugggaguuacauuaaaugaggcugcugguugaaggacuugggaggccagagagagccugguuggguaagguagcuaggagaguauaauuuuggaacuggcagccuagaguaggagggcauugccaguugagacacuggaugcucuuggaagagcuaagggaccugagugggagcuggaggagaaggcaaagcuaaauaucuggggagugaaacuagaagaaaugaaaaagcagccgccuagcuagucaguuccgaugaacacaggcacccuugguuuugauaucguuuguucaaaaaggaaaggagcaauuguuuugucaaagguuggucaagaugaauuaaaauccaguugaagaggcaggcagauuucugaguuccaggacagccagggcuauacagagaaacccugucucaaacaacaaacaguuaagauuuucuuuagugaagagagaaaucauugcauugacauggagccuggcuccuuccccuuccuugcuccuuuucucuuuccagggugauuaagaauauuuaaugauggccagguauacauuuuuaagcuuaauacuuaggaggcagaagcaggcaaaucucugaggguuugaguuuagccugguuuacauagugaguuccagaacacccagaacuauauagugagacucugucucaaaaaacaagaugacaacaacaacaacaacaacaacaacaacaggagaauauuuugugagcuaacaggcaguauagcuuagugauaaugcccagaguuucaccuuuagcacaagaaggaaggaaggggaagagaggggagggaagggaagggaaggaaggaagaaagaaugaauacuuaggaaguucaggacuuuuuagacauaaauugaauguggauacccuuacuuuguaaugccaauugguaucuuacuuaaggacuuugaauuuuaucuguacuaguaaauucaagaccgcauauaucuaucuuucuguaaacuguauauuaacuuguaucuacuauaaguuaaaaagguaaggcacuguugaucugcaaagauggcuccuggaaaagauauaucuguaaacaaauuauaacacuacaaagaaaugugauaaccuggaaauaaacacauugccuuggagcauagagaaagggcaccugccuuuuuggagguuggaacauuuucuaaaggcagcauagaaacaacagaguuaauccucaaaggauggaugaauucacugauaggaaaauaggcagaugaaacagcuugugugaagggauggaggugugaaaguuagggcauauuuaaagaaauuaaagaaguauauagcuauacuguaaagggaauuaaaaggaguggagauacagaaagugagacuggugaaugggccuggucaaauaugagauacguuuucuacuauuucaugaauuaauaaggagaaaauauaagcucuggacacauauuuaucuguugucaagaacaagaacauuuuaaggcacuaaucccuguucuaauuaaaaucacuugucgacauaucaugggguuuuccucuuuuaaauuuuauucuguguucagaggagggauauccagaagaacuggcacaugggcagcaucuuucuugugaaggaccaaaagguuuaagcacuguacauuugugggcguauggucauuauucugccagugugaucugaaagaggguauagguauauguaaaugugugaauguuguuuagucuugguaaagcuagccacaaaaccagaaguuucaccgacacucagccauauagggaaagauaacuuauauaaaguuaucaaguuaaauguugucagcagacucacuguauggagugcugcuggagguuuuaguuaagcuucacggagauggaugaaugggacugaagaagcugugggguuucucaacaucuaguacguguuauuggcuuucccaucgagguuuugucugguccauaucugcuuuucacuuauauuuguucuuuagacucugagggaagagacugcagagaaaaacaaaaucuuggugaauuuuuagcaguguuuggaacacauuagggauuuacaucuggcugacuaaauaggcuagcaguauucaugacaagugcagaauggcuguaugauuuuaauuuuaaaacauuuaaaauauguaauuacuuuuucuaaaaaauaugaguguuauuauuuuuuucuuuugauucuaguagcugcugcugcugguggugacaaugucaaauaacggcguagacauccaggacaaacccccagccccuccgaugagaaacaccagcacuaugauuggagccggcagcaaagacacuggaacccuaaaccacggcuccaaaccucugccuccaaacccagaggagaagaaaaagaaggaccgguuuuaucgauccaucuuaccuggagauaaaaguacaguacuuuguuuauuuuaaucauuuguaugcuuuaagaagaaaaaaaccaaagcaaaucagcuuuuucccuaugaauagucugaauagaagaucuuuccuuccaugacuuaauucuccuucaguaccuuuuauuuucuuguuaacaugucuuccuucuuagaguggcuaaagccaaaugcaaaauugacucauugcucaggauuauauuugaacaaaaauuuaagaauaaauuugcucuugccagcuuucagauaaauugaaaauauuuguaucuauuucuuuuuccuuuuuuaauuuuuaaaaaugcuuaucaaaucauaagaccuaaggacuuuugaagugucuuuggaaacuucuuuuucccagauuacuuucacuuggaaugccaccuuugcaaauuuugaucgccuuauuuuuuugucuagaucuuuggucccauuuucaagauuuaguauuuaguguuaguaagaauaggaagggauaguggaggaaugaugauggagguaaguaggaaucacugugaguucaguaugaguaagacuuacuaggcaaccucauuuccuguuguuuuuaaagucuagaucucacucuguaucccuggcuaaugcaugacguucuccugccuuaacuuccaaguagugauauuacugacauacgccaccaugcuugccuuucauuacccucuuacuaauaaaacuugaaagaauaaucaaaaaucuuaaugaugaaccugaaaaagucacugccaucuuuauagaaaaaaacaguggaaacauaaaaguuugaguguuuccauagaugauuuuuaaaaaagauuuauuuauuuauaauauguaaguacacuuuaguugucuucagacacaccagaagagggcaucagaucucguuauaaaugguugugagccaccaugugguugcugggauuugaacucaggaccucuggaagagcagucagugcucuuaaccacugagccaucucaccagccccccauagauuuuuuuuuuuuuuuuuuugccugauacuaacaaugcuaacuuaggcugggcagugguagcacaugccuuuaauccuagcacucaggaggcugaggcaggcagauuucuuaaguuugaggccagccuggucuaccgagugaauuccaggacauccaggacuacacagagaaacccugucuugagaaagaaaagaaauaaaagcuagcuuagauggcuuugaugacugcugaucuuagggaaagcucccagguauccacguagggcucuuuuuguggugaggcuuucuaucuguggaaggacaagcuucaggauccgauuuaccaccaucaagaaagucacaggguaacagcaaagcaggaggcagcuuucugaaauuauauaucuuaugagaaacuuguauaacaguacagaaagaacuacuacaacuugacuaaaaaucaggcaacucaguuuaaaaauagacaacggaucuguauagacaucucuccaaagaagauagacuaauggaaaacguuguuaucauuaguugccagggaaauacaaauucaaaccacugcacacuaggauggcuguaacaaaagcuggaugauaucaaaugucggugagaauauggaaguauuugagccucucauaauugcugguaggaauguaaaaugguacagccuuagggaacgcauucuggcaguucuuuaggugauuaaguggagagaaaugauacuagccagcauuuucaccaaggagaaauaaugcuuuagccucauuuguuugugauucccaaggaacuaucuaguauuaaaaauaaaauauaacaucgauauaaugaauaauauuuaauuuaaaaaaguaaaguccugagccauacugcaucuaugggugaaccuugaaauaugggguuaaggaaaagaccuaguccuaauggucacauaguguguaguuccauucaugugaaaugucuagaaauguaaauuccuagauuaaaagcauguuagugguugccuacggagacagaguagguaauaaacagaugagauuaagggggugauggcuaagagauaggaaauuucuuuuugaaaugaucaaaaugcauugaauuaugguguuguuugucuggcucugugaaaauacuaaaagcccaauuauacuuuauagguaaauuauaauaguauguaaaugauucucaauaaaauugguguuugugugugcaugcaugugugcgugccugccugucugcuugccugugugguguauaugcauauggguauccuaauguauuccauucuaccuuauucccuugagaaaggucuuuuacugaaguuggaacuagguggacagucagcaagccccagcaauccuccuguuucugcccccccccccaaauccucuacaguggugggauuacagaugcacaugggcauacuuguuuuugaaauggaugcuggcaauuuuaacucuuauucuuauucuuacauuacucacugaacugccacccuagccucuuuuuguuuguuuuuaaagauuucccaucuagaacaggauagaaacagcaccuucauaugucauugcaaccaaaagaguaguuuuacaugcccuaaaucuagauaccuagguuguaaucuugcuucuuucacaagcuggauaucauauuugugucagugacuucucuguagacuuuagugcuuucaucuaaaaaaaugagagccagagcaacagacacaguucuuuuuuagcucugcaacccugaauuuauauagaugagguauugcaaagugucguuggaucagguuuaucuauguagauggaaagaaaccaggacauugugagguauuuuuauugaugaugaagcuguagacuuggaggcucuucuggaaaucucaguuccccuaggccaaauuuggucugaaaaaaaaaaaauaaaucuuuuuuuuuccuuuuuuauugucugccugccugccugccugccugccugccugccugccugccugccugccugccuuccuuccuuaauuccuuucuagacaggguuucucuguguagcccuggcuguccuggaacucacucuguagaccaagcuggacucgaacucagaaauccgccugccucugccucccgagugcugggacuaaaggcgugcgccaccacgcccaguaaaaaaacuaaucuuauccucaagaucaagucugcaucuuugugguugaaaaccuagagguugaaaacagcuacaagaaauuuuuguaagaucuaauagccuguauuuuauuuucuagcuaugaauuuucuauagauucccuuaguacauugguuuuaccccugcuuuaagagcugugucaacugugauuaauauguauauuaagauggaaaaauggcugaguuucuucccuuugcaaucuuaguuucagucagcaaucuuuacuuaacugcaugauauacaucagaacuagcagucuuugacaugcucugccuuuauguaguauuugaggauuagcagaggcugcauagauaacuagucuaaaaaugaacuccacuaaccaugacugagaucugccccucgcaucagcucugucauuaauuauuuuuaaauauuguuauagcaucaccuguaaagugggaguaacaacucacgcccauuuaugucauuaggcauuuguauaccacuuuaugucaugaaaguaaauuauuuucuaaacugcaaagccauacagaugagagguuaacuuaucuuuaugaaaucucauuuauucuuuuaucauuauccaauacccacaaccuauuuccaguaggaaaguugaagcuuagagaauaguaaacaaugcccaaggucucauugguggaaagugagaugaaugaauguagagcuaagucuucccaaagugucuauugcaucuacuccugugcuccuguuaguucuucucauagcagaccauacauggcacucuuaagaaauauguaccuguucccacccagauguuggagacagaauuucuagagaugcaguguugugacucuaaggaaaacgagaaugaaaaguucuuuacagguuacgguagugguuuagacuagagcuggcaguggguggugcugucugugggcauuaccuaaugcugaccuccaggauggccucaguuugcucuugagggaaugcauacaugauuggaaggagaagcuauaauugaaggcuuguaauaggugaugcugaguugcagaauuccaugugggaaggccugguuccugugguuaggauuuggagccuuggguuuauucuaagaagucacauagcauuuaguuugcaaccucuuucuggcugcauuuucaugaccaaagugaaauucccugagcuugggaagagguuggugaaguuaauuuuaauacugaacuacaggaguguuuaucucucuuaaguuuggaauguuuuacugccuuuugcucagauuaguucaguugagccaaugaaacgugcuguuuaaaacgaauuuuaaaaugggguuaauuaaucuugcugaaacuuuaauguuuuugguaaaacaugggauuuuguagucagcugcuuucuccaagcuaagcccaggcugaacuaagacagagauaggagguugcaagcuucuuuucuuauguuauuucuucaaacuuaaggucuuuacuuauaugaaagcaaggcgauucuuucucuuuuccuuucuguccucagucauaucugaguucuuugucuugaucagcuuauugagaacucuuacuucaguaguugcaaauauuaauaauaaaacuuguuuuuaagguucuuuauaaaaccauauauuguaauugauucacagaauaguaaauugugcuguuuuuuucuuuauuucaucccuuuuuuucuuuuugacaccuuuauuacuguguugaauucuaauggugaugaaugucacccuuauuuuguuuuuaauuccaaaggagaggcauccaauauuuuauagcuauauaauguuuuuuagaggcuuuuauaauuaguuuuuauuagguuaaauaaauuuugugaauacuaagaaguuuuaaugauguuggauaucacauuuuagcaaaggcuaaauuaauuauuuaauuuacuauauauacuccccuuuuuccuuuuccuuuuuuacaguucauuuuauuuuauguauauaugugaguaccuacauauguguaugugugugcuuggaauccauggaagccaggagagaguguuagauuuccuggaacuagagcuacagacuguuauuagucaccauaaugagugcugggaacuaaacccaggucuucggaaagagccccaaauauucuaaacugccaagccaucucuuucuuccucccucccucccucccucccucccucccucccucccuccuuccuuccuuccuuccuuccuuccuuccuuccuuccuuccuuccuucccuccucuuugcuucuuuuuaagcuucuauugauuaauggauggugauggugaugaugaugagggggaggaagaggaggaggaggaggaggaagaagaguauuuguuugugucccauggcaucuguguggaggucagagaacaacuuuguggaguugguucuccgcuucuagcacauggguccuagggacugaauucuaggcuuauauggcaagugcuuuacccauugagccaucuuauuggcucuuucuuugccuucuuaauaugguaaauugcauuuacuuaaaaaguugauguauaacuaauaccauauaguucaccaucucagaauauuugauauuuuaguauauuuacaaaauuaaacaggagcuaugaguauaacauaaugguauacauuagcauaaacaugcauaaauaccuauguucauaucucagcaccaaaaauauuuguucaaucauuacaguaucaguacauucuuacuaaaccaaaaagaaauucuauucuuuuuuuuuuuuuuuuuuuugguuuuucgagacaggguuucucuguauagcccuggcuguccuggaacucacuuuguagaccaggcuggcuucaaacucagaaauacaccugccucagacucccaagugcuaggauuaaaggugugcaccaccaccgccuggcagaaauuccauuccuauuaagucagucuucauuugucucuucucucauccucuguagacauauguauuuucagucugaguuugucuguucuagauauuucaauaaauggaauuacaacauaugcuguguuuugugcuuuuuaaaauuuauuuuauuuuuauguguaugaguguuuugccauauauauguaaaccauguauaugucuggugccuguggaggucagaagaggguaugggguguucuggaacuagaguugcagaugggugcugaggaguaaagcuagguccucugcauuaugcuaauugaugcaaguuuucaaaguugucaucugaucugcacaaaaaaugccaaggcauacaggaauacugagacauauuuccaaucuuuccagcccuccucccccagcuucuugcacuuagcauaaugcuuacaaaguucauccauuuuauagcaugaugagggcuucguuucuuuuuaucaguaaacuucauuauaugaaucuuauacaauuuaugcauuuaucaguugauggaauguuuuauuagguucacucaaucacaggcuagagagauggaguuucuggccuuggacuauuaaacuccuaggagcauagauuugcauuauccaguuuuuuucuucaaucccaaaucagaguauaugucuaguaaaagauuacucuuaucaaaguugguugguuuucugguggcaaaauccugagcacuuugcuuccucuaggccuuugcuuacucuguuucuggauuguccaucccugccucugccuagcuaauagcuauuuauccuuaaugauuucuuucagaugguaucuuuuacagaaggguaacucauuguuuacuuuaaucuauauucugagcaguaauugguguccuauaggacuugaaauucagagacuuuucuaggauuucuagagugcaugccaagaugauaagaaauggguauagugcauaaaaccagagacacugaaauuuauagaggagaaagugggaaaaaaccucgaagguaugggcacaggggaaaaaaauuccuaaacagaacagcaauggccugugcuguaagaucaagaaucgacaaaugggaccucauaaaauugcaaagcuucuguagagcaaaagauacugucaauaagacaaaaaggccaccaacagauugggaaagaauuuuuacaaauucuaaaucugauagaauauccaguauguacaaagagcucaagaagcugaacuccagaaacucaaauaaccccauuaaaaaaugagguacagagagagcuaaacaaagaauucucaacugaggaauaccaaaggccugagaagcaccugaaaaaauguucaacauccuuaaucaucagagaaaugcaaaucaaaacaacccugagauuccaccucacaccagucagaauggcuaggaucaaaaauuugggugacagcagauucuggugaggauguggagacagaggaacacuccuccauuguuggugggauugcaagcuuguacaaccacucuggaaaucagucuggcgguuccucagaaaacuggacauaguacuaccggaagauucagcaauaccucuccugggcauauacccagaagauguuccaacugguaauaaggacacaugcuccacuaugcucauagcagcccuauuuauaauagccagaaccuggaaagaacccaggugucccucaauagaggaauggauacagaaaaugugguacauuuacacaauggagacucagcuauuaaaaacaaugaauuuaugaaauucuuagacaaauggauguaucuggaggauauccucuuuagugagguaacucaaucaccaaagaagucacuugauaugcacucacugauaagugaauauuagcccagaaaccuagaauaccuaagauacaauuugcgaaacacaagaaaaucaagaagaaggaagaccaacgcguagauacuucauuccucccuagaauagggaacgaaauacccauggaaggaguuacagagacaaaguuuggagcugugacaaaaggauggaccauccagagacugccccacccggggguccaucccauaaucagcugccaaaugcagacacuauugcauaugccagcaagguuuugcugaaaggaccguguuauagcugucucuugugaggcugugccagugccuggcaaacacagaaguggaugcucacagucaucuauaggauggaacacaggacccccaauggaggagcuagagaaaguacccaaggagcugaaggggucugcaacccuauagguggaacgauaauaugaacuaaccaguacccccagagcuggugucucuagcugcagauguagcagauggccuagucggucaucauugggaagagaggccucuugaucuugcaaacuuuauaugucccaguacagaggaacaccagggccaagaagugggaguggguggguuggggagcagggcagggggaggguaggggacuuuugggauaguauuugaaauguaaaugaagaauauaccaauaaaaauuaaaaaaaaaagaaauggguguaguggcacaugucuuuagucuaggaggcagagacaaguguaucucugagcuccaggccugccugguauacagagcaugacccaggacagccagggcuacacagagcaacuuuaucuugaaaaagugaagaaaaaaaaaaaggauaaauucugaccucaguuuucuuggcuguggaauggagauaauccguguugucugccuugccuccagggcuuguugugaggaggcagugagcucuuuaagaccugugcauauaugaaggagauaguuauuuuuuucaagaagaaaugacagauuuggcuuuuucucuaguucuuucuccuauauuuuugucuuaggaacucuguuugcugcugggguucugccugguagucuaccucaaccugacguacuaccuaggcuaugucggucagcuauauucccaauuccccuucuccuuucucacuuccucuucucaggucugguuuauguuaagcugcuauuucaguuagcaguugcuuucguucaagucagaaaggauuaggauggcacaguggagggaaagacuaucagguagacugaguuuuacuaucaugugcccugggacucaggacaaggcaguuucuuuuucagggaugucuuucuucaggaguaaaaugagaucguuucuaagacuacuuccuaaccauuuccagaguguucuuaaaguaaacucuguguuggguucuguuugagauuuauaaauauaacaaucaugauuauaagccaugacuugguuggauccuuaagaagcuuacauuuuacuucuuaaaauuuucaaggaauugugugagauaaugagugacgagguguaugaugguauaacagaccuuaugccuuggaaauucacagggggagaaguagaagacaaucauuuucugaaagaaaugggacuugagucagucuuuaaaagagaagaaaaagugagcaccaaguaggaggggggagcucugagguguauucagaggcuguaggcagaaaacagacuggcuggaagagguagaguucacuucagaauuaacccugcucucuccaugugguacaugauuucauuucuuugacacucuuuucucuaaaccgcuuucucccucucuuuggaucuuuauuaccauuguaccuucuuggcuuagcauccaugucugggauguuauauacuuuaucaauauacaaugggaaugaauuauaaauaauaagauauauaaauauaacauguuuaaaucuaaauuaaacaauauaauuguaauucucuaaaaccuuuuaagggauuaguuuggaagggauuuagaaauagccauuugaaacagaaagccuuuccaaagcccugccacauguccuauacauucuagcuuagagugagacagacgcaauuauaucauaagucacugcuuaucuggggccaugguguaauccuuagccuucucauucucaaagcagcugcucuagaagggaaauugccaaguuuauaaauagcccaacccuuagcaacuggaguguaggcuagagguucuuuugaaguuacugaggaaaacaaucuuugggaccagaccuggguucaaaucacaccccuugcagcaauauuaauaaauuacucuauguuuuuaucuauacauagguaguaguaguguuuagcuuucuuaaaucagcuugcaguucuuuagcagugguagaguagaaggauguaagggcuuaggcucuuauuucacuugcuugaugaccaggcagaucugugcugcaaucucuuaguuuacaaaugaaaguugaccuucaggccuguggugaucauguacaaaaauauguaugaaauaccuguuaaaaauuauggggugucaucuugggagcaucucaggaacaucuuugagaguacuugccauucuuauuucauagauuauugugaaccauagaagcuagaagggcccuuaagaucaucuuauccaucuccucaccauuuggaugagaaagcagaaagcaaaagacauugugagguagagguaaaaaugacauggacucuagaucuuuucccaacuccccacuuuauagccuauuuuuugcucuauaugcauacuauauauaugcauaccagauagaacuugcccuucacaggagcuuaaugaaaagcuaaaauaaggcuagaaacagaauaauaaucucuuguucuuuuuuuccccccgcagcaaauaaaaagaaggagaaggagcgaccagagauuucucuuccuucagauuuugagcauacaauucauguugguuuugaugcugucacaggggaguuuacgguaaguccuggguguuagucuuagaguuugggcuauaugcuauuagauucaguccuuucuuguuuucuuaaagccucuuucuuugccaguaacuuuucaagaacacuuuccugaucucaaauuucucuuuuaauuuucuugguuugauuguuugcaguauuugaaauugaaaacaaggccuugcacauguuguauaaaggcucuaucaacugaacuacaucaccaacucaaacaaaucucuuaagaggccccauaagagcaaguucuagguggggcacuaaugcaggaauaaaucagacuuggucccuguucugaaggaggaaaagccugguaaagggcagaccucugaaggaagacacauaaaaggagcuuguguaaauuuugagggaccaggaaaauggauaauaaacaguguuauuuuuaucugauauucuuucagggucccccaaauccaugacuuccugaaaacuuuucauguuuuucuuuaagggaaugccagaacagugggcucgcuugcuucaaacaucaaauaucacaaagucagaacagaagaaaaacccacaggcuguucuggauguguuggaauuuuauaacucuaagaagaccuccaauagucagaaguacaugaguuuuacagguaugaagauugugucucugguaaucacagcagaagcucccacgugcuuauggguuagcaagaaaaaagaaagcgccagugugauggcacggucgcuaagaugcauguuuggaagugacaaccaaaaugaagucuuguuugucucuauucugaagcugcauguauuaauuacuguuacauuuauguauuuuuuguggguuggggccaugcaugccauggugagcauuugaagauuagaagacaacuuccaggaguaggcucuuuucccacugugugaauucuugaguuugaacucagguuuucaaacuagguggcaagugcccuuacccacuaagucuccaccauccccuguauauguuaguuuuaaaaaagcaggguauuauauauaccuagacucauauauagacucauaucauauauaguuauaaagcauggacacuaaacugucauuguuguuauuucugauaucauuuuuuaaaaaauuauuuauuuauuauauguaaguacacuguggcugucuucagacacaccagaagagggcaucugaucucauuacagaugguuguaagccaccauguggcugcuaguaauugaacucaggaccucuggaagagcagucagugcucuuaacuucugagccaucucuccagccccugauauuauuuaauaacauuaauaagugucuuuaaguugcaagcccaguuucuuuuuuuuuuuaaagauuuuauuuauuuauuauauauaaguacacugucccugucuucagacacuccagaagagggagucagauuuuguuauagaugguugugagccaccaugugguugcugggauuugaacucuggaccuucggaagagcagucgggugcucuuacccacugagccaucucaccagccugcaagcccaguuucuuaagaaauguuuuuguuuuuguuuuucucuuuuugggcuaguuagggcugguuuaggcuuggaacucaugguaauuuuuuagcaucagccuucagagugauuauagguaugaaccauuauaguguguggaaaggacuagauuuuaucauuugaauggaaaucaggugaguaguaauuauaaauguucuuuaaugcacuuucugcguaagggacuauguuuagaguguuuuuagugguggaauugggauuagacucaggucuucucacacuuagcuccauauauuuucaaguaauaauugccuauaguaaucuuauuuguaucauguccuuccauaccaaagauauuuuuuuuucuaggcuaaaaaugcauuaaaaaccuguaauuuuggaaacuugucuucuuuauaguaucuuaagaauguuaaagcgaagcuggguauuguacacucuccuuaaacuagguagauagauguaauacaggaggguuaggauuaaauauaauucuuuugcuaccuagcaaguucaaggccaaccuuagccaaaugagaauuugucucaaaaacaaacaaaaaccucaaaacagaagccauaacacaacaaaaacaacgggacaauuagaacauacacacacacacacacacacacacacacacacacacacacaugcacauacacacauacauacacacauacauacauacauacauacauacauacacaccaacuccucacuguuugcagauaugaaauaaagagguggccuuuguagugugcuuaaauuagugucaggccuagacucuuaugucuuagucugguguucuuuguuucugcggccuccuucaaaggcagaauuguuggagaaggugagagccaggaugaacuggcugacuuugagaggcgauuuccccagcuaguaucuggcucguaucaaaggguacagaugguuggaugauggacagcagcuucacucacgaugccacaguagugcucaggggaggccaugagucuucccagcagcauuuccuuccucucaucuguccccacugggucugucugucuuuuuccauugaaagauuggaucauucugagaaagagcuggagugagaaguugcuaaguagcuaaguuuucuaguaucaggaaaucggaacuuaauauaagggaauuuaauacagagauaucauauuggaagcugcugucuauguacauguauauagcuauaaggaaguugcauguaugcauaugcauuauugccccgguggacuuuguauaugguucaaauuauagucccuuuaaguauuuaaggaugaguguauauagcuauacacauucauauauuuauauauauggucaucuguguaugcacauuaaaguuauaguuuaaauaauuauuguauuuccacagaaacaauuacauacuuuuguguauuaacauagacacacguauauguacacacauguaugugcucacauaggauuuaaaauuuuaggguuguuaaaggcaagaaccaacucuaagcagguuuuauguuugacauaguuuauuuuuaaugugaucauuccuguuuucuauuuccucuucuuuuguauuguuaauuaaguuauuaccaugucaguuuguguauacucuuaugugacuuaucuccuacagggauugucaaggcaaaaucuuauuauccucauuuuaaagacucaaaaguuaauuaaguuuuagaaaaauuucaacuuauucaugaugcaaaugguauauuuauuuuuauuuacauuuuuuggagacaggauuucauguauucauggauggcuucaaccccagagauccuuuugccuauaccuccugagugcugggaguagagccauuaaaggcaugugccagcacacuagcuuuggaagcguguuuuuaauuuaggcuccuaaacacucuggucucuguuacucacaacucuauuccacccccccaccccccacucuaccccaacacuuaauuuuuuuuuuuuuuuuaauuuugguaguuacuaugguauuugauuuucugugccaguuaauauuagggagaaaguagacuagauuggcaucccacccaagucuuggcucugcugugacacaaacuuauauaacccugcaccaguguuucuugccuuugugaacuucaguuuucucguuuguaaaauaaaauguuugaaagcaccuucuacucuuugcauucugugcuuugaaauucaauuuugaucuauagaaauuauacagucuuuaaaaggagaaauguuuauuaaaauauuauuucauucauauguguacuugcaccuagauuugcuugccuugcauauguguguagucagaggacaauucauucuccucuucuaccaugugaguucuauggauugaacucaggucaucagguguaagugacaagugccuuuaccugcuaagccaucuugcugaccccacuuucuugauuuuguuuguuuuugcuuuuuauggugucagagcauauuuuuaaccauaaugccuaguucucaaaagagcuaggaguguucguuaguggcagugcaguaagauauaguuuuguucuguuaagcugaucccauuuuuguuuucaaagaugauuuuucuagagcuuaaccauuuaguuguuguuguuguuguuuuguuuguuuguuguuuaauuuuuuauuuuaugcguaugaguuuugccugccuauauguuguugcaccguauucaugcauggugccuggggaggcuagaagaugggucagauuuccuggaacuggaguugaaguugguugucacuaccuuggggaugcugggaaccaaacgcuggucaucugcaaaagcagcaaccccccugccccccgacccccuagacaggguuucucuguauagcccuggcuguccuggaacucgcucugaagaccaggcuguccucaaacucagaaauccaccugccccuuccucccaauugcccggcuaacauaucuuaaaaauggcccgggauugaacucaugaccuuuagaagggcagauggugcugauaaccaccacacugagccaucuccccaaccgcagcaaaaacucuuaacugcugaguagucuuucuagggaacaggauaugcucuaagauauugucauaggucaccuugcuuccuacuuuguggauccuuuauguauuauagaaccaaaaagccauacugggcccuuuuaugaauagaacugggaucuuggacuuucuuuagucuugguucuugaugagaaauaugucagauuucauagaaucuuuuucugaaucccauuggugaugaacuggcaaguaaauucguaaaauuuaaagaaccaaauuaaagacaacacuggaucuuuuuuuuuuuuuuuuuggucuuuucaagacaggguuucucuguguagcccuggcuguccuggaacucacucuguagaccaggcuggccucaaacucagaaaucugccugccucugccuccugagugcugggauuaaaggugugcgacaccacgcccagucaacacuggaucuuuuaaacaacuucaacaacuucuccuucuccuucuccuucuccuccuccuccuccuccuccuccuccuccuccuccuccuccuccccuuuuuuuuuuuuuuuuuuuuuuuuugcuaaaauuucuuaugggcacauuucaucaagucugagauaauagugguuacaagaugacaguuacuuuaucacucaguccaucagacugaaauuucuuaaauaaauggugauccuccauugcugguuccucaggcacauguguacuuguguguuuaaaggacacaggacaaccuuggguauauuccucaggcacuguccauguguuuuuuuagaugaggucucucacugagcuggaacucaucaagcagauuggccaggaacccaucucccucugcuucuccagcacugggauuuuaaucauauaccauccauucagguuguuuguuucuuuguuuacauccuuguauuugcacagcaggacuuuacugacugagcuaguucccagccucuaaaagauccuuucuggaagcugaagcugaagcaugauuuauguggguaacauaguguggauuucuugccuuuaucuuagaacguaggaaauauucucacccauugaaaacuugugauguggguacuguuauggcaugguauuuagauuagaucagaauuuagauuuugaaucaucuauuuaaccuguguacaugcugggcaaauuacuuaacuucucucaacucuaaagucuauuaaagugaauauaauaauaauacucagaacccuagugaagauuagagaggaccaugguagguguagugugcuuagcauggcuucuguucacagggccaguugugcuguuacccuucugaagcuggcaaguguuuacucagaucucagcaguagcuauacuuuacuacuaaaucuuucguuucuucuucuuacagauaagucagcugaagauuauaauucuucuaacacuuugguaagucuguguuuccuccauucugaaauaaguggguauggaaguaagguucaggacaguguaguacagacagccuggcuucagcgacacucauuuuggucacugucaugccuuagauucucuaucuacaguaaaggaacuggagugguuaacuguuaucccuguuugacuguagucucuuucagcuuuacagugcuguagaaauucuaaccuugaaaccugagauguagcuuuuaggcuguuucauuugucgguuugaacauuggaaacccaguuugucuuucuguggcucagaguucucaucuguaaaaugagaaugauucauucuuccuuaccuggauguguuucuugacaacugaauuuaggagggaauccuaaaaaaguuaaaagauggcugaagguccaagugagugguagaguaccuguuuaccaugugagaagcugcagguucaauccccagaaugucaggaaauucaaacagaaggugcuguaccauauugauucauuaaacauuuacagaaaccucuauucucugacagguccuuuguguagcagacagacaguguccuauagacuuguaccuccuagucuuauagagcauaugaagacacauacaguuaccgcucauugugcuauaaacccccugaggucagggacuguaucugucuuguuaauagcuuugucuuugguacucagcagguucugacauuugcuaaacauuuauugaauuaaagagugagugugucagugaaagcaucucaacgguaacaucuaugcugaaugaguuaccuagaguaagaauuagagagacgacgaaauuucagauagaaaauuauaugcaugggaaaagagguucacaagguauguauauucugggaacugcuaguaguuugauaugucuggaugugccagaagagagguuggcagugaagaggcauaguaaaguaggccaagucaguaggaguuuggcuuugucuaaaagcuaaugaaaagcuuagaagaauuuuaaacagagugaauaguaauauauaacacaguacugagccgcugucaaacuuugcugccagcgucagaguuauuugugcucuuggcaaguauaaaagguaccagccuaguacuuugcaauguauugaguccuuuuuauucauuaucucuuuuauuuuucacagcaguguaaugaaauagauugcuacccuuguuuuauggaugauaaaacugaacuagagaaagguuaauggcaguacccauaggauuccuacucuguccuccuuucuucucauucaugcugccugcaacaaauggaagagauaaugauuuaaaaaugggggaaguauuugcagauacacugucuuugaaaaaugaauuauugaccaguaaguuauugaagaaaagccuaaacaaaguggaguagugaucuguggguuaaaugucuuuacacuuuuguaaaaagaguggcuguuaucuauuauugaauggccacucuaugccagacauaguguuaagauuuucaucuuuaacauaauuaguccuuacaauuaccuugggaagaaggaacuguuguuuuuacuuccuggacagaaaaacaaaucuuccgaauaacucacaaauaagaaccaaguuagaaaccaguuguggugcaagccuguacucccagcacucgggagguagaggucagaguuucaaggucaucauuggcuacauaguaauuagacuggcuuggguggcaugagacucccaucucaacaaacaaacaagugaccauaaaaccauauaagaauaagaaucuucugagucucacagucuaggguuuuucacugggucagggaacagagaaagacauagaaggacuuauaaagacaaguacagugaggcaacagcucuguuguuagugugggagaagggcccuguggcucaugccauauggcuuagauagagaguaacaccugcuugguuagugucuacaaguagaaccacucacacugucaaggacauuuaccccuaacugagagcauuuccccuauaagucccuguuuuauauuuccuuauuuguauguacauugaugugauuuuauaauuguagcauaucauugauuucucuauugguuucauacauauuguuguauuuaauucauaaaauaauuaagcagaauuacuaucucccuauuacagauuuuaaaaauguggcacagacaaauuaugaauugcucccuccuauugaauuaauaauaaaaaucaguuaaaaaauuccauucucuugaacauucauguauuuacucauuuuauaaguauuuccuuagcaucuuuaugccaaagcacaggcaacacaaaaaguaaugugcacucuccuauaccuugauacaaaucuuaauaguggauuaaggagauaugagccaaaagaauaauaugcaagaauaauaugcaauggugucauguuugauuugugauuuguucuuucugauaguugaaggaaguuuacauacuaaguccuaaagguuugcucauuuaacaaacaugaucuuguagagcucuuucuguucuaaacacucuuaucugugccuaggaucugacucuuaagauucuaugcuauuuuuaucguugauucuuauuuuuagaauucauaccagucagguauguugguacauaucuguaaucuuguucaggagggagaaauaguuccaagcuacuguggacugcauagccugacaccaucuuaaacaagagacuauacauugugugauagguucuuugggugcugagaaaugaaggccugguaagggcuuugcucuuaaucucacaaguuagugauaaaccagaacauauaaaaaggauguauaacauagugucagguaaaacuagguaauaagaaaugggcagugcuuuccugucugagggguaguguaacaaaagccuguuuauuaaggcuguuuauuaagggcucauuaaggguccagaauauaaaauaagagcaauuggaguuugaguaaacuauuuuaaauaaaaugugugugugugugugcauguguguguguguauuuggaugugcauuuuaguguaagcuugagucuuauuccucuucguuuaagaagcuuaggguaaugaacugaauucaugugcucaucuuuuguuagccuaaagauauauuucaagagggauagcauuccaaaacaacaacaacaacaaaaaucaggucauaaccuaaccauugugaagaauucauaaaagacacaaagccuguuaggaggaguucagaagcagcuucaaguaauuggaagccagguacauggcacaugccugaauucuuaguacaggagaugacacuagggauuguggcuagagagagacagagacagacagacagagacagagacagagagacagaccaaacacuaggagauuucuaccacaauguuaagaaagggaaauauagcucugcaguugcaagaaaauacuuguuacuuuuucugauauauuuuauuuauugacaauuucauuuugauacaauguaacaugaucauacucacccucaacuccacuuucuuuuucuguccucucccaggaucuccuaaaaaucuaccucccacuuucaugucuuuuccuuuuuuuuuuuuuuuaaaccugcugagaccaauuagugcugcuugauuagaauguuugauugaucuuguugacuuuagugugucggaaacuacagcugcagugagcucgugaaugcaagugguccaucauauccagcagacagcaugucagagcacuccuccccguccucuagcuuuuacaucuuuuccaccuccucucugcuaugguuccuugagccuuggguaggguagcagguugcuacagagcugaacacucaguggugggugaccuauuuucagaacuuugaacaauucugagucucuguauaacuguugccuacugcagaaagaagggucucuggucaugguugagagaaacacugacccaugaguauaaacguaaauauuuaggaggcaguuugacaacuuguccuuuuagcaaaacaacacaacagcaguaaguccucacuguggucuguggccugaggcaggggcuugugaccagguucacagugccagguggggauuccuuucugagaagaaaauaccuuuaaaauucggcuucucgagaggaggugucucauacuucuuaauacccaggagggagaacuccucccucauaugcuuuuucacgccuaugcuaucuuaaagaaaaacuugucacgaaucacuucucuacaauguacauauuaaaucagaccugccguaaauauauuguuggaauaaucaaaggguaaaagaauucuuaaaauuuaaaaaugcaaucaaucaacaaacauuaaaggacaauuacacacaaaugaaguucagaaaauuaauaggacagauggagaauuugaaaauaaggggcaauaagcacaagucgggaagacaaaucagagaacagggaguagaagagaaaaaccaaauacaacacacacauccucaaaggaaaagaaauacagcagcucccuagguaaagaaaagcauaagucuucagaugaaaggccugucaaccaggccacacaaucagagacuaaagagauagagaaaauucuuaaaagccucuuuaaaaaauugagccagaguagagccaauguagacauuaguaucagacuacuuauuaacugugguagauauaggaauaucuuuauccuuugaggugugaggaaaauuauagagucaaaaaauucuauaccuaauaaaaaucagcauuugaucaugucauaauaaaaacauguuuggauaugugaagaucgaaguuuauaacacacagaucaucuuugaaaggcuaaacauuauauaauaauuaacucacagagaugauggugauuaagaauauucacuuaaaauuuaucauuuuauccaaauuuauauuaaaaaguccaguuguuaguauacaggcauucagcuggccuacucucggggaccuagcaauugcuuacgacaugaccuucuuaccacgugaccuguugcaggucagguacaacaggugugugcugcgaauaaaagggcuugccacuugccugccuccaucauuuuguggguccucacuccucucccuucccccaauaaaccucuuuuacaccagguccuuugcauggcauaauuucccagggguacacgguggcgugggccugccaaagcuacccaccucgcuacauuauauuucauaauaccaguagacuagaaacuaucaaauaacacuauuuccaagacuucucuucaccauugucuuggcaaaccuguuuugguauucuauuuucuguuguuauuauuauuauuacuauuacuauuauuauuaguaguaguaguaguacuacuacuuuugacauuuggugaagcacaugcacugguaguuuugagaaaguaggaaguagauaguuaauaucuuuuaggucuuggaauuggaguuucuauuuccucauauuuuauuaacacuuuugcugauuacagaauucuagguugauaauuuuuuaauagaauuuggaaaauaauauauuuuugucauuuguuuaaaguacuacuaauuccaaagccauuuuuauuuuugcuuuuuuauauguaguuuuuugucacuugaaaaguuuauaggaucucaacuaacgcucuugacuuucaaaauuauguacacauuuucauguuuuauuaugaaaagaacaaauacauuuauuacaaacccuuucaacaugaauacuccagauuucauguacucggaaauauauuugaauuguuuucuuuauuucuucuuucauuuucuucguucucuuuuucuguaacuccauugauuuuuguuuuaauuuuugggauauuuucuuauuuuucauuauacauauuggguuuuauuucuauuacauguuuaauuuccaaaugcaucuucauuuaaaaauuuaauaucguauuuugugucuagaauuaguaucugcucuuaucuuaaagguauuaaugauauacuugauuuugauuuuuuuuccuuccuauucagucugguguguauauguguaugugugugugugugugguuuuuguuuguuuauuuucugggugauacuuguuuuguuuuuucuccuuuauguugaaguuucauauuuaaaaaucuuuggaggucucuuauauuuaugauugcgauacuaaaagcuuaguagaauuuaagcucaauuuaaggucagugauuucagcaacuuacaguuuuauaaccaccuccauaauucagaccauaggauagugcauuaguuuucuguugcuguuauagagcaccauaaccaagcuuacaggacuuacaggaagaaggcuuucuuugggggcuuucagaggcaucggaguacaccaucaucauggcagggaguauggcauccacaggugggcgugacacuagagcggcagcugaaagcucacauuuauaaacaggaaacagagaacauagagguuaugacacuagucuuuugaagccucaaaaccugcccccagugaccuucuucugucaacaaggccacacuuucuaauucuucccaaacaggggacaaggcauuuaaauauaggccagaacauuuagaaaaaucuuucauacuuucuuuuuagaacuuuucuuuuagguucuagguuagacccagagaagaaucuucuaauuuuucuuuguugauaaagaucugacuacaaaaguagcuacgagacuguuucccacaggguugucaucauuuuccaucccaccagcaauuaugaugguucuaauuacccugaccccuucuuguuuucugucucuugauuauagucaucuuggugcaugugaaguaauaucuuauugugguuuuauuugcauguccgaaugaguaauggcuucgagcaucuuuucguugaccauuucuacuguguuuucuagacaaacuucuuuccuacuauuugauaacuuuauguuuuucaaguuuguugagauauguuuucauggccuagcauuucuguuguggaauagugacucauguggugaaauguuuuuucugcauauauggaugggaugugaaggucaaauugaauguuuguguuuucuauaacuucuugggcucuuaauuauugagagcauagaaauggaauccccaagaauaauugaaaucucucuguacaauagaauuauuucuugccuucaacgugucauuucuugcuuuacauaagaugacugguuuuacauaaguauuuuauuuauaaucauauauuguaugauuuuguuuauaauuauuauuucaauuguuuuuacuucuuacacauuaugaaaugaccuucuugauccuaguaauauuucugugucucuguaugucugucugucucucuaccccuuucauuuucucucucucugcugggauuaagcugagggcccuucauaugcuaggcaaguguucuaccucugaggcacaucuccagcaugcuaagguuucuauacaauguuuguuuuaguuacuauaacccacuguacucuuuuaugacuacucuuuuauguacauauauuuucuaguugucuugcuuaaacuuauauaggaaacguauguuuauauuuuguuugcuguuuuucuucuaguguggcaauuucugcucuaugggguauuuagacuauugauauuuaacagaauuauuguguuuggauuuuuucauuugcuuccaguuuuucauaugaaucuuuacuuucucuuaauucuucuucuacugcuuuguguugaaaaaaaauuuuuuuagugugugugcauaugugguauguucauuccugcauguucaugugaaagccagagguugaugccaguuuucuucugucacucucugauuuaugacagcgggucucuuacuaaccauggaguucaacguuaguguuaaacuggauguucagugaaccccuaggguucaccugucuccaccuuguauuucugguguuaagagauacaagaagacaagucuugaugcaggaagacauaccugacugcugguuuguuuuaggucaacuuaauguaagcuagagucauuggagucgaagauucucaauggagaaaaugccucuguaaggcauuuucuuaaucagugacugauggggggauggcccaauguuggcauauuuguuuuaucuguuuuaucauguucucauauaccucuuuuuccuucuccauacuuauccaccacauuuccuucuaaucccccagcacuagguaggggagagagaagguuagagggaaagggaguguagaccuccuuagacuacuuccugcagacuagggacuucuuguuucuuggggcuggcccagucuucaucauuaggauaucuccagcuucucaucagauucuccagcaacaacagcacuuaggaggaagcagcagcugucuucuuuggacuaccucccacccuucucagggcucuugcauuagacugucuccagaguccccagucugcagcuggcaaagaucaugccccccuagagcacagggcaaucauaguuaacgguuguggacaaucugaagcagccccauauuccagaccugagauuaaacaaacaaacaaaaaaauguacagauuacaacugggcuuuuaaagaaaccaagcagcccaggccauuggacugauagauggugaccuccuugggcuggagguccaagaaaacaggcugaccaagccacaaggaacaagccacuaagcagcaucccucgauggccaaugcaucagcuucugcccaguuuugaguucuuguccuguuuuccuuugguaaugaacaaugguuugaagugcaagccaaguaaacccuuucuuccccaaguuccuuuggucaugguguuuuaucacagaagugauaacccuggcuaggagacugccuuuuaacauauugcuggggaucucugggucuugguuuaugcaguaagcacuuuccccagggagcuauccuccaacccuuugaaaaaguacuucuauuauauaagcugggaagguggcuuagccauuugccauuaaagcacugggaccuaaguuuaauucccaugaauacacugcauauauuagaagcccaacaaugcaauauuguagauuuugcuuuauacgaucuuuguuaauaaaaaagcaacaagaaaguggaugcucacagucagcuaauggaugaaucacagggcucccaauggaggagcuagagaaagaacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuguaugccccaguacaggggaacgccagggccaaaaagggggaguggguggguaggggaguggggguggguggguaugggggacuuuugguauagcauuggaaauguaaaugagcuaaauaccuaauaaaaaauggagaaaaaaaaagcaacaagauuuguuggguaccuuuaaucuuagcaaucaggaagcagaggcaggcagaucuaugugaguuugaacaucucuggucuacauagcaaguucuaggacagcgagggcuauguagagagaucugucucaaacaaaugaauauauguguauauauuauaucuguauauaacauguauauaauaucauauauaauaugaauuguauauaauaauguuauauuacauucuauauaauauuaacauauauaauauguuauuucuacauaauuuaugcauauaguacauauauaauauacauauguguguauuauguauaaauaaacaauauacuuauuuauaugauacauguuauauauuauauauaauaaaauagcaacaagaaaucuaaaaauguauauuuguugaauauuucuuuuuucuuuuuuaaagauuuauuuauuuauuuaauguaugugaguacacuauugcucucuucagacacaccagaaggaggcaucagaucucaucauggaugguugugagccaccauaugguugcuaguaauugaacucaggaccucuggaagagcagucgggacucuuaacuauugagccaucucuccagcccaaauauuuauuuauauauuuacuauuucuugugcucuucauuuuggcugauggauuugaguuaccauuugauguuauuuugagucuaguagaaugacucucucuguauauaaucauacacacacacacacacacacacacacauaaaaccucacuaguugcaaguaagauaugcuaacauucucugguuuauuuuuuuaaccccaaauguguucaucuuuauuaaauaauuuuauuucuuuaguucuauuugagggggugugcacaugcccauguguguguguugggggcagugguagaggaccauuuucaggagauaguucuuuccuuccacccuuugggucccugagaucaaacucagguugcuggguuccguggcagauguucuuaguuguugauauaucucuccaacccucaucuccauuuuuuaaagguaguuuuauuguauauagauuuugugauuguuaaguuuuuaaaauguuggcucuagauuauaucauccuauugccuucuggucucuguuguuucauuuacauuuuuuuuucuugagauagcaucguauaauguaaccuaccacucuccuuccuuccucuucccuuccccucauuuuuccuccuuuccccucaaauuauauaacucuuguuucacauuuccucauaauauuuuagaggaugauguacugccuaugguggucauaacuuggugcuuauacgugcuugacacugucaaguuuugugcucuauuaugauguguuuuuauuguuugagauugcgcuuucuuuaguguaucaaauguucagucuuucuggauucuucaacuugucacuuguugggauucuuggcuuuccuuucucaggagcuucaggugguaggcaggagagggccucacccucuggcucugucuagugauggugaccuacuucagaacuuggaccaucuuuuuucauuuuuaugccuuugauguugacagaauccaccacaguauucuaggcacucugaaaauaugugaaauuuauguccauuuaucugaaaaauccauauugccuuucugguccuacuacuaaaacaauaacaauaagaacaacuacucauguuuuagauccacuuaucuugagucugguuauuuuugucuagcuuuauuacaguuugcaugggaaaaucaaguugcugcagaucauuugcagaucuaacuaguggugcaguaaaguucauccugaggcaggacugaagcucggggaaacccacagggucugccacagccauacccuauaauauaauagguucaggaguuuggagaaaggaagugggggugcuauuuagacuuuaaguuacuauauuaagaacaaauaaucacagugauaaaguauagaaaauuaaauacuuuuuauuuuccucuuuacacuuauuuucugcucuuuauaaagaguaaaauucacagaauaaggagaaccugaacauggcuuugaguauuugauuguauaaggcagguaaggaaacuauaagcuggcuuacuacucuuuagucuuuagaugggaaaaggaagcuuucagagugaauagauagugauggcuaagagagaaggaagcugucugagugagacagcugacugcacaaagauggagagccuugguugaugaccuuucagaagaggugucagaauugacuaccuucuaaagaacuagcagaccugggaucuggaguucuauguccacuggaccgguugauuuuuguccuuucugcauagaaugugaagacugugucugagaccccagcaguaccaccagugucagaagaugaagaugaugaugacgaugcuaccccaccuccagugauugcuccacgcccagaacacacaaaaucugugagucucuggggaucuugaaggcuauacgauuuauucacauaagggguggcagaagcuagggagguagugguacuaagacuggugcauagggguccauagacuggcacuggugaagucauugaacuacuuuuuuucccccucucaugugaauggucuugauucauagugauccuucugccucacucucccaagugcuaagauuacaggcaugcacuacugugcccagcuggaccacuuucuacaugacuaaagagauguggugugcuuguuauuucaguuauuccuaaaguucucuagguaauugguguuuauaucagucuaaccuugguuuaccuacccuuuucuuuacugguuagguauauagaauggugcauuucacuuucagaauaaaauaaauuauuccaguuucuuaggaagcaguaaauugccagagauuuuauucuuuuguuuuauauuauguaguggucagccucuccagcauuuuugauaauccugaaagaccugggagaguuuauaaauacauuagugcuauuaauaugcuggacauuaggaaugcauuuugaugccagauauugguagugauuucucuuuuaacuuccuuugagguuccugcauuuuagaauagccacacucccuccuucugcacuuugcccacucugcaacuuugccuuuugauuuagcaucauugaauagugaucucccaucugaugauacucugaaauacuacuaauguuuguuuuggcuguuuaguaugagaacuccauaaugaaagaauccucugagacuuaagcucuguguugauuaaaugucuuaauggaaggugcuguggaggaaauucaguuagauggccuaccucuuagccuaagaacuuacaaauagaaucuggauuuccuugucuguaagucacaaaguuaccuuaaggaaaguagccuucuaaaucagugagcugucaauaucucccuagaguguccuguuugugguuugcaggcauauuuauuuaacaguuucucucuaaaucuugaacuccucuaaauagaaaagaaaucuauuuaccuaucagucuauccauccuucuaucuaucuaucuaucuaucuaucuaucuaucuaucuaucuaucucguauuuaaucuauguguuauuuaucuuuuuugguaauauaguuugggcagaaggaucagagagaggucaguaaauauugaauaauauauugauuaauuugcuuuucuuagcauucuucucuaaaauaaauacugcuaaguccuauuuuauagaagaagcaaaugagauuugagucaguagauugaucuauccauaguuacuuaguaaacaaacuccaggguuugagagcagauaauuaaauccaaguccauauugcauuccaaaguagugcacauauuauauauauuguuguguguguaggcaugcacugggaaccagguaaggagaaugguauagagggaacagacagaauaucuuuccucaaggcaauaugauggaaaagcaaagaaaguuuaaguaauugggauauaauuguucuacagguauaagaauaaaaauugagaaauuuacuuugcuagaguagucagaaagccaguccaguugaaagaucugauauguacauuuguuaauucauucuauuuaaacacuuaucugaaugcuugcuuuuuauuggguuagaguuagaggacucagggaggaauaauauguguucuuugucucaguauacccuauagaugaucaaaaaauaauuaugacuuuuuuaaugauaaaaaaaucugauaaauacacaucuucuagaaaaggaagugcagccuggaaguacuugcuucuuaaccuuaguaguauauaguugcuccuuucuuaguaacaucucuccuuugcuuuuguagcaguuacuuucucacuuccuucuucagaaugaguagggcaguguuuugaauagagcuaggcuuaccagggauucucaguaaauauuuguuaaacaaacaaauaaauaggaaauacaaugucuuuaaaagcugagguuugaaugcuuaauaucugcuguucauggccaugucauucacacauguugauuuauuauuaaauaaggugguuauugucacuguuuuauagacagggaaacugaagcacagaggugcgaaguaaacugacugaaguaauucagauaguaauguuggcugagaauuaagcccaggucaucaaguucccaaguuuguuuuaaauuuuaaaacaaaauuauuauauuacuauauccuccugucucuugaugaauaaaaguaguucaugguaagcgcuaaacagcucaagagggauaacuccauaaaaguguuaaguuuugcaaagugacagaggauacaaaugaguuucagcucagaaaaaaagcagaguauugugggugagaaagguuuccaucuaaugauaaaaucuccaaguuuuuacugagagucaccuaguggcuuugaagugauuucagugcuaaggccaucacuaacccuucuuguaaagugagaguaaacgaagguuguuuuacccagggcaaaugggcuggggcucagaagaggaacagugcagauuuuggccuugaagagaagggaugaguggugaaggggagguuccugggauguucuaacuagaacauuuacaagagguuccacuaugcuaacaaagguuggcuuggcuaaaauuucccacugauuaugcagguauauacacgaucugugauugaaccacuuccuguuacuccaacucgggauguggcuacaucuccuauuucuccuacugagaauaacaccacuccgccagaugcuuugacccggaacacggaaaaacagaagaagaagccuaaaaugucugaugaggagaucuuagagaaauuacguaaggacuuuauaucuuucuugagucuucccuuagucugugccugauuaaucauugagauggagugcuacaauaaagaucugaaugcuccugggcuggagagguggcucagcgguuaagagcacugacugcucuuccaaaggucccaaguucaauucccagcaaccacauggugccucacaaccaucuauaaugggaucugaugcccucuucuggugugucugaagacugcaacaguguacccacauaaaauacauaaauaaaucuuuaaaaaaaaaaucuagauccuagguuuaagccaugugccuggcuggcucuguuuaauaccugaacuaugggcuguacugcuuacucaucaucugaccuuucaccccuucauuguuucaccagcucugggugugcauuaccuuaggguagagacauaauaagagagaaugugggcagcucacuuugaggguuaugggcauagcuaaaggcuuuuauuuugagaguagucuagaguauuguauggagaaagauugagguauugacugugucugguggaaaagggugcucuuguugaugcuuucuaacccugaccuaggagaagacagcucugccugccaucaugguuguagaaaaagacgggaagggagaccaauguuuuaucauccuguucugugugacaaaugacaagcaagauaguuucuugaauuuuuaaauuuuauuguaguugcucucugaagauacucagguaauccucauuuaugcaguuaagguuuuuuuuuuagacccaaagaaucuauauccugguccagaucauagagcugcaaaguggcacagcuaagguuagaucaagauguguuuuguaaaaagaacauauugccuauugcaguagguauagguugauuuuuuuauuuucauuuuucuuugagacaggguuucucuguguagcccuggcuguccuggaacucacucuguaaacuaggcuggccucgaacucagaaauccaccugccucugccucccaagugcugggauuaaaggugugcgccaccacugcccagccuaggucgauuuuuauuuucuauuuuauuuuauuuuauuuuauuuuauuuuauuuauguauuuauguauuuauguauguauguauguauguauguauguauguauguauuuauuuauuggcuuaggagaccauugaaaaaggauuugaugugacuggcuugauuaaguuuguaugcucacauugcuuucuaaagcugagguuugugguucuuuaguuuagugguuuccuauuucuugcuaauaauucuuguuuaacuuuuuuguuuguuuguuuguuuaauuuauugucuuuaagaauuguuuuuguagccaggcgugguggcucaugccuuuaaucccagcacucaggaggcagaggcaggcggauuucugaguucgaggccagccuggccuacaaagugaguuccaggauagccagagcuauauacagaaacccuaucucaaaaaaaacaaaaaaacaaaaacaaaaacaaaaaaacaaaaaggaauuguuuuugcuagggcccucauaugaggaaguaaaccacucuuaggcaucuguguaaucacaugcacuccuguccucuaaaccaaauuuuuucccuaaauaguaauacaaugcauuguaagaauauucuggccuggacaauuuccucuguucuuugagucuccuuuccucuucauaccuuuuaaauagugauauuuacauuugauuuguuuuaaauuaaaggauauaauaacauacgugagaaguaccaaauccuagugguugggguaucaguggaaaagcuaguagggcugagagauuuagaacuggacucuggcaccaguugauagaugaguuuggagaaguaucuuucuucuguggguuuuaguuccccgccucuagaauacugcugugagaccuguggccucucaugcuucucuguuuuuuauuuaaaguauccccugcuuaagagcucucuuggcugacuuguacuuacaauaaaagucagcucagacagugccuuucugaagccuuuccggucucuucccuaucccgucagcacucacuacagcaaucacuguauuuuuauagcaccuuccguuugcuugucuuuuccauagauucagccucuugagaguagugacugucuuaaugugccucaucuuucucuuuaucuguagcacucagcauauagucugguauguaauaaaugaauaaauguuaacgaauuaauuuaaaaaugauuagcucuuagaaguuuagaaguggaauaaauuacuauuaaaaagaacacagucaaggauauaauacuuuugguugggauuuauuggggaaaaguuaauugccuggcugguaugcuuuuggggaacuggacacaaaaauuuaucaacuuagggaguuaagaggaucaugggaucuuguguguaucuugagcuggaacaaaaugauucauggucucuguuucuuucaaagggagcauagugagugugggugauccuaagaagaaguacacacgguucgagaagauuggacaaggguuaguagcggcauucuguuucuuuggagaaaugucuuaaaguuguauuuacugacauguaugaacuugcuugguuuugguggugguaguuuuugccucaccuaucuggaaguuugauacuaggaugacuuccaaauuuugcagaauuaugccuuauaugagaaauguacgauuaccuggccuuacuaaaguacuccugcagcaagaguaaacgagucaccuauugucuuagcauaaaaccaguuuuucaaacuauaauuaguuuucuauauuaauccuaucugcccaaguauugagaccuaucaucacuaguaugaaauuuaagguccagaucuauagaguguguaguagugagaagggaucuaauuuucuagcuuggugacagauuuugugacuguuacucuuuaguuucaucuccauaaugcauaugcugucucgcacgauugaacucagcaaaucuuaacugaguucuuguuguguguugaagugugaauauggauaugaaucagacacagucugcccucaaggaucucacaucagcaggagauagaaaggcauauaaagaauuauagaagucagcuuuugucuggaaggaggaggucagaugggacaaagaaaaggggaauagagaaaucgugcaaggagcuuaguggugaacaugaguuguauacaaauauuaaaaucaaacuguaggcuuaugauuuaaugcaaaauuuuagguaaguuauaccucuauaugaaaaguaaaaauaaugagauuucuauggaaauaugucaaaagacaugaaaugucaaagaaacuaaaaaaauuaaguuuggcucauaauagguucuaauuggaacaaaguggucuuuuuuguuuguuuguuuguuuuuuauuuauuggaaaagcauuuuuuuaauuagguauuuucuucauuuacauuuccagugcuaucccaaaagucccccaucccccccccccacccacccacccacucccacuucuuggcccuggcuuucccuuguacugaggcauauaaaguuugcaaguccaaugggccucucuuuccacugauggccgacuaggccaucuucugauacauaugcagcuagagucaagagcuccagggguuacugguuaguucauauuguuguuccaccuauaggguugcagaucccuuuagcuccuuggguacuuucucuagcuccuccauugggggcccugugauccauuuaauagcugacugugagcauccacuucuguguuugcuaggcccuggcauagucucauaagagauagcuauaucaggguccuuucagcaaaaucuuucuaguguaugcaauggugucagcguuuggaggcugauuauaggauggauucccggauaugacagucucuagagaugguccauccuuuugucucaguuccaaacuuugucucuguaacuccuuccauggguguuuggaacaaaguguucuuauuaauucaaacuuuuugucuugauuuucauaagcuaccagaaguuucuaaaaaugcauuaaaggauuguaauauaugggugugggguguuacauuugcacaucauuuuauaguuuauaucuguuauuuacaucgagcuuuuuauuugaucuuuuuagcaacuuuuggcugaagagaugucauuuucccugauccaugugguuuuccuacuagauaauacuuuugugagucuaaacugguaaaagauagcuuacuuuuuuuaaaaagauauuuuauuuacauuucaaaugcuauccugaaaguucccuauacccuccccccgcccugcuccccuacccacccacccccacuucuuggcccugguguuccccuguacuggggcauauaaaguuugcaauaucaaagggccucucuucccaaugauggccgacuaggccaucuucugcuacaucugcagcuagagacacaagcucuggggguauugguuaguucauauuguuguuccacguauaggguugcagaccccuucagcuccuugggugcuuucucuagauagcuuacauuuuugugaagaaauuauuuuaccuaccucaaaaauguagauaaaauuuuguauuuagguaauuaaauugaguaucuaguuaagaauauagcaaaaagguacauggacaaguuucaguaaguuccugcucuugguuugaguuucuuuaucuguaauuggaggauuguggauuuaggacauuucuccuccaaaacauaacuuuaaaaauauagauguacaacaucuaugaaauguucuaugcuuuguuucucuggucugcuagggcuaaggcaagaauggaguauuuauuaagcaccuauauuaauguuacuggauuccauaauuuaagaguauuaaauacuacacugguauaaugaaucaguaccguuauaauuuuugcuuguuucccugucccucccuuuaaaaccugaagacugucaagcugccugcucuuauguguguuugccugagauagaaauaauagagugcuacucagucugcucauuuagcucucuaagccuuuguaacauagaagacacagucccaaaguguuucgccuccgagaccuuaauauauuugcucuaugaucaugguauauaugugguagcuggaaagaugacucagugcuuaagagcaguuuuuguucuugcaaaggccuggguuugguuccuaucaccaacaugguagcuuacaaccauccauaauuccaguugcaagugauccuguucccacuuucugaucucagacaccaggcacacacauggugugcauacauacauguaggcaaaauacuuauacacauaaaaccuaaacauuuuuuaaaaaaagaguggugaguaguagcaggaauacagaggucuauagacaucuguagauauacauucuguaacuaaagaucucauggugaagauggucagacagugaagaaagagcuaccaguaaacauauucuuauuuaauagccaauaucuuaaaauuacacuuuacaugcagguagcugggcucucaaagaguggugguuagggagcugguagcccuuguuucuaaccagaagguguacauacaacuaacuuccuccuaaauuggccuaacuucugugggaagcauaaguuuaggauuugcugagaacaucuuauaaaagaccagaauucaacaugucuacaaguugcauuauauauauauaugacauauaguuuguauagcuacaaguauguauguauuacagauuaccuggacacauacaggauuugugguuuuagguaagauuaggguuuuaguuacuucauauagacaggguuacauuucuaccauucucuacaguaucucucacucuuugugaaacccuuucacaucuucacuacacccaucucuguguuugaguggacauauaaacaucugcaugccugucaggaacuauugguuuuuuuuagggugaaguggaaauaucagauuuuucugaaauuauauauauuuggaaaaguaugugcaguaucauuuuuuuaaaaacugaaaaugcauuuuauucaaaccauaggacucuuuugaucaaacucuuuugauuggcuaugauugaaaaguaugcuuuuaaagugucaggguauccuauaauaaggagggaaaggauucuucagaaguauuuagucuguugcauauagguuggucaaauuuucauaauucuuaaaaauuaguucuauuuuaaaaagauuaauuuguggacacccgacucgccagcaaggaagaugccacaacaggauucuucugcacaccuuuauuggaagagcuugauagcaaaggcaaaagaccccgagccccagaacuggcgcagcuucuauaggccuaggaguggcgugucuauaccugauugguugugcuuucagugccucauuuacauuccccaggauuggugagaaacccuuaugcacaugcgcacauugguuguuuacccgaauuuacaggcuguggccagcgguagcaaacgccauguggcuuuccacauuaauuguagaauagaaucucaaaagcugacuaucaauccuugcagcucucugcuacccucuccuaauuuuuuugaggggaggggucuuguccaucgucuucucuugguuuacugaguugcaggauuacaggcaaauaccaccacaccucacuaguuguagguuggguuuuuguuguuguuuuguuuguuuguuuguuuguuuguuuuuauuuuuuuaagaaaggaucuuauacugcaguacaaguuggccucaaauuugggcaaaccugccucagucuucugaguugcaaggauuauaggcagaugccaccacaacagacccuaguuguaguuuuuaaugugaauuuuaaucaaagauaacacauaaguuuauugcucaauaaauuuucaaaaaguaaauuuuguacauaagcugcauccaggacaauaaggagaacauuacugauauuuuaauaaguaauaguccucuucuccaccucauucugaaauucccauccccgccccucccccccucccccaccccccauccucucacucccaguugaaacuauacaaaaugaaagcaaguucucaaagggaguagacaaaaguagggcaaauuguuguaagaaaugaaugucuuugaacacuuuuguauuuuauggacuuggccuagugguuaucaugaacuaaacucuuacauaugcauggaaguacagcucagaguaaaaacuugcucaagaucagacaaaguaaagguucuagacugcugguuaaaccuuuauucuuuacuaccacauacuaccuuucaaaugugagacuaggagggcugcaaaaaaagauuucuuuuugucucuuuuguuaauguauucccagguugguguaaaggugcauagacaaaugcuaugucauugucuuuugucaaugccuguguuuguuucccuuccuuuccugucuuuucuuucagugcuucaggcacaguguauacugcaauggauguagccacagggcaggagguaaguguucaucaccaacuguuguuauuucuacuucuucagguuuuuguuuaauuuggaguuaauuuuacuccccccccccucuuuuuuuuucuuuucuuuucuuuuuugacucaacgggacaguuguaguuucuuuuuuuaccgggcuaguacuaaauaagagacuaauaugauaagacuuaaaaauuuugcaaaagcuaacaaagcuccacuaaggagaacaguucagagcaggaagaauggacaaaguaagcuagguuguuguauaauugcagguaagagaugauguuguagaaguuaguagauuugagaaguaguuaguuaucagguaucuuuuuaaaaauauuuuuuauuacauauuuuccucaauuacauuuccaaugcuaucccaaaagucccccauacccucccccccacuucccuacccacccauucccauuuuuuuuuuuuuuuuuuuuuuuuuuuggcccuggcguuccccuguacuggggcauauacaguuugcguguccaaugggccucucuuuccagugauggccgacuaggccaucuuuugauacauaugcagcuagagucaagagcuccggggcacugguuaguucauaauguuguuccaccuauagaguugcagaucccuuuagcuccuuggguacuuucucuagcuccuccauugggagcccugugauccauccaauagcugacugugagcauccauuccuguguuugcuaggcccuggcauagucucauaagagacagcuauaucuggguccuuucgauaaaaucuuucuaguguaugcaauggugucagcguuuggaagcugauuaugggguggaucccuggauauggcagucucuagaugguccauccuuucgucucagcuccaaacuuugucucuguaacuccuuccauggguguuuuguucccaauucuaaggaggggcauaguguccacacuucagucuucauucuucuugaguuucauguguuuagcaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguuguacuccauuguguaaauguaccacauuuucuguauccauuccucuguugaggggcaucuggguucuuuccagcuucuggcuauuauaaauaaggcugcuaugaacauaguggagcauguguccuucuuaccaguugggacaucuucuggauauaugcccaggagagguauugcuggauccuccgguaguacuaugucaaauuuucugaggaacugcuagacugauuuccagagugguuguacaagccugcagucccaccaacaauggaggaguguuccucuuucuccacauccucacuagcaucugcugucaccugaauuuuugaucuuagccauucugacuggugugagguggaaucucaugguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuuuuugaguucuuuauauauguuggauauuaguccccuaucugauuuaggauagguaaagauccuuucccaaucuguuggugaucuuuuugucuuauugaaggugucuuuugccuugcagaagcuuuggaguuucaugaggucccauuugucaauucucgaucuuacagcacaagccauugcuguucuauucaagaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguuaugccagcaccaauuguugaaaaugcuuucuuucuuccacuggaugguuuuagcucccuugucgaagaucaagugaccauagguguguggguucauuucugggucuucaauucuauuccauuggucuacuugucugucaguaguuaucagguaucuugauagaacuuagugauagguugcgaagacaacuuccagaugguaacucuauuccaguagaaagaauaaagugagagauauaaguaugaagaagguagauacugccugagaaauuuugcugaauugccuaguuauaggagauuuaaacccuugucugucaaccauccaacuauaugcuuuagaucccaauggacacuggacuccucauuuauuuagagguaccuuauuuuauuaagucaugagaaugcugaccuuagcuaaagcccacugacccaagaucagcaaaaggaauccagaaaggcaauaucaagugguugaaugcuuuuuugcagacuacucuuggcuacaaaauaggaauccugauaggugguugcuaccugggauaaaucuuaguuaagaguauuggaacucagaaauugagcaaggaaccuccucuuugagugaaaauaaaguuuuguuccucugagagaggcuucuuggaucuacuuguguaauuuugauuaucaaaaucugguaucuguccuugagggacagcacauauuuuauuggguucuuguuaacuuacaaauguaaaagccaaauauuugauguucugugugagcaagucaauucuuuaaauuaccagugugagaacuggagagaugguucaguaguuaagaauacuugcuacucuugcaaaggacucaaguucaguucccaguacucucauuuggguggcuuaagaacauccuguauuucuaaggggaucuaacaccuucuggccucagcagaugcuacacuccugugcacaaacacgcauggacacaaacaaaauauauauaaucaaaaaauaaaaucuuaaaaaaagucaucauuaucauacuuaaaugaucagagcuguguuagacucuuugguuuugagucguguguauuuugggcugcagaaucccagcagagcuaagguauuaaggacucccuccugcacuguuucuagccucuugggucuuguaacccuugaugggagacacacaugaugagugguuccuggaaguccuggagaugccugugugagagugagcgacaggaaagcuugacuuugcugugugccugucuugugguuauaaaacuaugaauggaagcaaauccauuagaguggcuaaugcaguguggucaggaaggccucguuuccugcccaagggaguauaucgguagugagacuagugugcugcucuuagucuuugugaaugauuaugggguuguuagccagcuggaagaaagggagcuuuugucugucacacauagauggguuagcauguuagugcuuggaaaucuacccauuagaagucaaucauuuucaagcuuguuuuuaaagguaauguguauaauagaaagaacauacuggaagagcuuuggagucauagugaucugagagcauugacugugaucagaggugguuuucuuacaugucguagcuucaaugucuaucuaaacauacaacacuuugaagagugguuagguuuaccuaguaaguaaucuugugaguaucuaagaguuagauaagguaaauacaccagcgaguuccaucgucauucuugcuguucucauagucauugcuggcuucuuuauuaccuauaucuuauaaggaaaaguaacaugacgccuauuuuuuuguacucagaacauaguuugaguagauuauuacuuucaguguaucucugaggagacuuagguucagaaaacgggugauucgucaaauuuagaaaauaacagucaaaaccuaaagcaaagaucuuuaggguuuaaguccaguuauuuuucuuuuauagaagugcuguugccuauccuggauggaucugguuuccuguucuauuuaaauuuuaaaaauuacuuaacuaugaaaucaggcuggucaucaauguacaguucuucucuaucucagccuccugggugcuagaauaauagguaguaccaaguauuuuucuagugacuuuuuaaaagugggguuuuuuuguuuguuuguuuuuuuuacauugagguaucaaauuuugauguauaugugaauagcacuggggcuuauuaaaaguuugugcuuuucaguagguuuugaauggcaccugagaacauuuauuuucagccuuugagacgauguuaaaugccacuggcuaagagacucccuuuaaaaccauuuaacauugauaaguugugaguuacuuucgggguaagaccaugucuuccucaucauuguuuuccuuaguccuuaaggucuaguacuaagccucugcucaggaaauguuguaggacccuuggugcacauugaauuuacuccuguuucagguggccauuaaacagaugaaucuucagcagcagccgaagaaagagcugauuauuaaugagauccuggucaugagggaaaacaaaaacccaaauauugucaacuaccuggacagguauggcauggguggguucugucacagaaguuucaggccuuuggaaccuaaguguuagaggaaaagaugaagguagcaauuggaacugcuucuauuuaauuuuccgugcugagcucuuugauugcuggaaauccuucuaagugaugguuaaccccaccacacugaagcuuuuuagcaacuaauucuuuacuguuucuaaugcuuucugcuaagggaaguuggccuuuucagcccaucuuucugauguccuuauuucauucuauauuccaaguauuuccuuauccugcucaccuuccugaauaauucguauugucuauauacucuuaaaaugcaaugcucacuacagucucggaguuguuuugaaaucugaccaccauggaaagaaugguacucuuugcuuuucugccauucccccagcucaaugucuguuucauugcuaacuacuaguaaguuuguagucaacugaaauugauuaccauucccuccccguauaaacuugcauuaaacuggaaauaaaaaacauuuuagcuuaccagccucaaccuccugacugcugggauuaaugccugcaucaccauuuuuacuauguauguuuagucuucaucaccuuaaaagcuuccucuugagcugggaugugcuuacuauugccgcuuagugauacaaugcuugacuagcgugugugagcucugagcuugguucccagcaccaccagaggaaaauuacagaacaggauuaaaagcuuaccuuuguuugagauaaguguuaaacuaucucagguguccccaucugccaaguaagagucccauuaucaggaugaaggaaagaugacagaucauaccuuaagccaacacguuuuucuccagcagagcuucuuugcugaagguuaccacgagucaguuguccgcuuuuucauuuguauacagugagauuuuuuacuuauccaaaaacuggggcugagagauacagucucugagucaaaaucagugcuaacucaggccaggccacugaaccacagcuuugguuuauuugaagaugcuagaaucacagaaacucaaagaaaaagucauuaucagcauaguaaccuuguguagacuuuacagcuuugaaaagacuuauuaccacccuuucacuuuacauauauauaauauauauaauauauuuauauaauguuaugcuauauuacauuaaaauaauauauauuuaacauauuacuuuacucauagauuuauucaguaaauauugguaucugcugugcuggaccuuggggcuaguaaugaucuuguagauuucagaucuaauagaacucucaaggagguuccauggcccucccuucugaugguaauguggcuuucagaccccuccuuucacauguguguauugccuagaugcuuugcagcaugggaauaaagccagucucuaauuuuaggagauagccucugauauugugauaagaugugauuuuauauuuuaacuuaguauucuuaguuuuaguguuugggacuucacagaccaugguuuuuucugggcuaucccuaaguaacuuaagauuacugauucuguccuccaaauuuuguaguuuuccagaguaaggaauuguagacuguucaaaagcuggaggagauaguuuccuagguuuugaucucacuucaguggcuuaauguguucugacuguuccuucucacccuacacugucuuucugcaguuaccuugugggagaugagcuguggguuguuauggaauacuuggcuggaggcuccuugacagauguggugacagaaaccuguauggaugaaggccagauagcagcugugugccgagagguaaggaaggccaacaaucaaacaggaagugaccuccauauuacuguccaugaaaguucacaccuuaaagagacuucaauaugggcucugugggaguaggggaagcuaguucugggacuuaacauucauauuguaugcuuguguuuuauaauuucuacaaucaugacuuauuucuuugaagcuaacuauucugaccauggcagaaaaauuagaaaauacccaacaguaucuauuuaaacagucauaauuucaaucuacaguuauaacuauucuaacacauauuauuucucuuuauccauuuuuuuuggacauacauuuguccugccucccugauuuguguacugugaaggaaguaacauugguaagaagguaguggcauaguucagauagucagaaaagguuucuuccuugauuugaauaugcaccuaaaugacauguagaggcaagccagcaaaauucuaggauaaaguaacuccagacaaaaagccuggugugcuggcauaugccugucauccuggcacuggagguggaggcaggaagaucagaaguuuaagauaaucuuugauuacagaguaaguuccaggccagcaugagauauaagcaaaccaguaaauaaucaaagacaaaauaaacagaaaaaagaagcauaaauagauacucugucuuuccccccucauuauaaguagauaccuagaggucuguacugcuauaagaagccuuccagaagauucccaugugcagcagugucugcagaggaccggcacauucucacguucccugauaaugugggaaagauagugauggcaauagacaguggugaagauugaggcaggcuuucucugcagagcccuggcuguucuggaacucucucucuguagacaagguugcccucaaacucagagauccgccugcuucugccucccaagugcugggauuaaaggugugcaacaccacuaccuggcccugagagauagaaagcuaggagacugacaaaaagagugagauuaaaaauuuuaugagucugacauagugucugaagguggaaagcuuaaggcauauggaugaaauuauaguuauauauuuagccaguguuaaugagaaagaaauacauuagcaacauuuuaauuccuagcugggauuccuagaaguucauguuucauuuacucuaccacuaauacaaggaccuuuuaaaaauaauucuucccccaaaagcucccccccaucacauucuuaugaaauuuuauuacuacagauacgauggauaauuguguacauacagcugccuuuuggagggucaaagucauuauauuauuuaauuuguuuucuccucuaaccuugaagugcaagccuggugacuugguuucaauccucugaacguuagcacuagcagagaagcaaagccucagagcuguccucugaccuccacagaugcuccacagcggcucccacaccccaaccccugugagggaaauagaaucaaaucuugacagaaacccuuaguuugauccccaaaacuguaccaacaaaaaacuugggaagaaacuacuuaaauaaaugguauuguuauucuuaaaauauaauagagaccauuaucacuuuugaaacugcuuucugagacacaguucauaugccauauaauucauccccuugaaauauauaguucacuguuuuucagcuuauuuucaaagugacuauuaaaggauauggauuuuuuuuuuuaaaaaagcacuugggagcuugagaguauagaccagcagaaaagaguaguguacauaaggcccugaguuugaccaaguauugugccaaagccagaaaaaacauggccaaaaauuuaaacauuauauaauaggugcuauuaucauucuuuaaauuuaaagugaugccucuucugaccuucaugggcaccaaacacguacguacauauauguaugauacacauacacacaugcuggcaaaacucuuucacauaaacuaaauuauauaaaucuuacuaauuuuuuuaagauacugcuuacuuuuaacuaaaaaguucuuuugcauuugugugugugugugugugugugugugugugugugugugcauaugguguguucaugccauggugugcauguggaggucagaggacaacucuaccagguggauuccaggaaucuugcuccggucauaacguuugguggcaaacucuuuuacccacuaagccaucuaucucacuugcccagaaucagacauuuucauuauaccauuguaacauuagucuguuuggcacucauucuguuggauaaguauaaguguuuaaguuuguauguguguauugggggaaucaucacaauagguguuuuguuuuauuuugauuuuuaugguuuccucucucucccucucucccucccucccucccucccucccuuucuuccuucuuucuuucuuucaagauuuuucucauguccuuuaccaauuguaaucauuacuaaaacuuaaaagucuaucggugcuggcucugugggucagugaaagauguaugcuuggugaggccauggucucacuucucagcauuugaaaacaaagcugucuuuguaaauaucucuguauagaacuuaagauaauuucaggugcccaaugaacauuugucuucaugcuucauagcgaugucaaauucagugugucucaaacaauacagacguccuuccccaaaauaaagauugucuacuaaagucacuuccaugggucuccuuuccuagacguagaaauauauuguuaaaauacuucugauuaaagaaaauuauaagacaaaaucagcauccaguuuuuaaauuaauuaauuaaaauuuaacuuguguguguauuugagguggaggguuaagugcacauguauguggaugcccaaggagaccaaaggcauaggauccccucaagugaaggaagaggcaguuuguccacugcccaggauggccacugaggcuucucuucauucuccuuuacccccacccugccucauggaauuuuaaaugcgcaguuaggagucagaagaagauuugguuauauagcuggcuuugccucuuuacauagggcaagucuguuuauuucuggaggccuuacuuccuuugucuuaaaauaacgagguuaaaucauuguuagucuuguguauuauaagucucuuucuucugugcccacuacuucaacagugucuacaagcuuuggaguuucuacauucaaaccaagucauucacagggacaucaagagugacaauauucugcugggaauggauggcucugucaaguuaaguaaguaggagucuuaggagugguaacacuuaacucugcacauggggcuaaaucucuuuugggaugguaauuaaauaauaguaacuauaacagucauuaaauagacuuaaguauuuuguaaaauaugagauauauuucucuguauuauauugugucuuacagugucuuuucacuauuuuuucaauucuuuuacacauuauaacacuucccuccugaaggccuacuucugagguucucugauaggcgcugaggguacauuuuaccagcuuucaagaagcuuucugucuaguaugagagacuuguaaugaauuagaaaaacggauuuauguaacuuuacuuauucuguuauuuauucagcaaauguuuuacaugccagucucuucugggguacagagaagauagucuucacuaucggcucuaucaauuuagauaaauguguagcuucaauauagugugaaugaacuacagguaguuuuuuguacaaaggagugaaagcaguugccgagacagaggcuaugccauaaguggguaaacaguuuaugagaggacuauuggugcagggugaggacuuguuaaaaguagggccauacuuacguguuggugguuggguuuuaauucugagacuuuuguccagaggauaauggaaugaguuaauuauaagacucugaguuauaggaauguuuuuuaaccauuugguuugaggaaaaggcaggaggcuagagauauuguucuuaauauuucuccuacuguucaugguugaaugagcaguggacuaguagcagugagguguguccugcuuuggugagacagagauugcagacaaagccugcugcccauguguaaggacacagcacuuacugauggaguauccuaagugugucuuucuucucccccuuucuagcugacuuuggauucugugcacagauaacuccagagcagagcaaaaggagcaccauggugggaacuccauauuggauggcaccugaaguugugacacgcaaggccuauggacccaagguugacaucuggucccugggcauuauggcaauugaaaugauugagggggagcccccauaccucaaugaaaacccuuugagaguaaguguucucaucuucuugcaaaguauuugggcaacugacucuaauccuaggaaauuguacucaggcucuucucucuguauacccgggcauaguuauacauucuuguacuccuagacuuacaagacugggauaagaagauugccaguuuuugagacaaacuugucucaaaagcaaaaauauggaccugguaagaugacucagugaguuaaggcucuuccugccaagccugaugacuugaguuuaauccagggacauacauggugaaaagagaaccaauuaucacaaccugcccuuugauucccauaugagauauaugguacacaugugcccacacuaaauacauguguauacacuaaauaaauaaguauauauaacaugcauucaacagauacuguugaauuuaaaauauaaaugagccgggugugguggcgcaugccuuuaaucccagcacuugggaggcagaggcaggcggauuucugaguucgaggccagccuggucuacaaagugaguuccaggacagccaaggcuauacagagaaacccugucucgaaaaaccaaaccaaaaaaaaaaaaaaaauuguucugauaauaccaagugauucuagaguagcagaugguaacugcuauggagaaaaaaaauguagaauaagagcaauugacagagugauagggaaggcuuuauuuagaggaacguuuucuuuuauuaguuauuucagcagaaacaugaaggaguuaaaggaguaagccaugagauuuaguuucaugcaaguguuuacagguaucaagaaucccauuugguuuuugccuggaaaaaucaucggaggcuauuauuucccaaaaaggagagaggagaaaguagacugguagccagagucagcaauaagaaagggccagccacuaagucuugugggccagugugagaacuuggcuuuuauuuugcaucauuagaaaggauuuucagcuagauaauaagaggauccagucuguacuugaaaugaaugaaugguuaggcugcuucuuuaggaaauagacaaugagagacuaacaggauaguucagacaagagugguugcuugggucagaauacaggugagaaguagacuugggaagagcugccaggaugcccugaauaguaaagaaguggaaucagcagucaccacggcacgcagugcugacaaguucaguuguccuuuguuacuucucuguuuggucugcugugaugaaaguacugggaccgaggcaaguuacaggagaaaggaauguaugcuuauguuuccaaggggauaagaguucaugauaauaaggaaguggcaaguauguuagcaggaacuggaugcugagagcuucuaucuugaaauacaugugagccagagaacaaacuggaaguagggcaaacaaaaccgagagcucugaaacucugccuccagcaaggccuucauggccaguuaguagauugaugggaacacaugccuaacuugaguaaaacccauaagagcagaaaaggagaaaacugagauggcauuuacaaguguuuucuccucuuacaugaguuuuguuacgaagggugacagggaaauggagcagucucucucuuucuuuguuuuuguuuuuguguuuuguuuuucuucaaaacaggguuucuguauagcccuggcuguccuggagcucucucuguagaccaggcuggccucgaacucagaaauccgucugccucugccucccaagugcugggauuaaagacgugcaccaccacugcccagcagucucuuguagaguugaaaagggucagcuaaaggcuguguguuagcuaguggaagggaauuggugguaaugggagaagaaauagaguauacaauaaagaugcaaggaaggcggugacuucgauuguggacaaauaggaauaggaaguuacuuuguuuuuacuuucucacuuaguucaucuuccuaucuagugcaggaauuccccuguaagaauaucuacgcuuaacuacaugcucagaucacccuuggauaguuccaguugcuggaaagugcuucauugucucaaaaggaaacuuucuucucuaguuucgacuuuauugucccagcuuugcucucucacuccacauguaacacaaccuccucugccucagauaugaagguaaucaguguggugugguggaaauaaaacugaauuagagucagcacgugcacucagaacagugaaugcaacggcuggagagccuuacaugugaaaugggaauaaccauuuugccccaccucugaguuacuguggucacuuaaaaugaguguagcugggugugguagugcacaccuuuaaucccagcacuagaagucagaggcaggcaaaucuccuauguucaaggccagcgagggcuauacagagaaacccuguccugaaaaacaaagcaaacaaacaagagugagagauggggagagagagcgagagcgagcuuuguaauuaaagagcuuaguguuuaugaagguuuacuauuacuguuuuucuucucccaagagcugcuucauauuagagcagggaagcagcagcgaaaccguugcugucucgccaagcauggcuuuuuccucuuggguggaagccucagcagcacauuucugccaacaacuaaacaaagggacguuuaccuugccgugcuaagugaagaauaaacccuuagguuuguaacaccucauacguuuacaaagugcuuuccaaaugcacgcuaaagacauuuuuguggcuauauaaagcauuauauagcaaagaaguuauauguuaggugcauauauacagucauaugacugugaaugucaagccugauuagguuaguauguucucuucaggacauccccgcugaucagagcugugugucagagcacacagaagcuggcuguauuuuagagaacgugucucgauaguaacagaaagaaccucagggagagcaccacgugacucuucauuuguauugcuaggccuuguaccucauugcuaccaaugggacgccagagcuucagaacccagagaaguugucagcuauuuuccgggacuuccugaaccgcugucuugagauggauguggagaagagaggcucagcuaaagagcugcugcagguaacuguccuucugcagggaggugccuacccaaaccuuuucaucucauuuuugucugcguuugcugauuuuaggcuucuuuccuaccauuucacuuuguauuucuagcucccugucacucuugggcuuugccaagucugcccucuguuccucacccuauaucccccucccccaagucccuggucuccaagaggauguccccguccccaccccaccagaccuccccacucacuggggccucaaaucucuugaggguuaggugcaucuucucugacugagucuagacccugcaguccucugcuguauaugugucuggggccucauaucaccugcuguaugcuuccugguugguggcucagugugugagagcucucuguggguccagguuaauagauacugcuggucuuccuauugggggucgcccuucucagcuucuuucaguuauuuccuaauucaaccacaaggguucucagcuucuguccauugauugggcauaaauauccgaaucugacucagcugcuuggugugccucuuggagggcagucaugauaggcuucuguuuguaagcacaccauagcaucaguaauacuguaaucaggccuuggagccuccucuugagcuggaucccaaauugggccugucgcuggaccuccuuucccucaggcucuucuccauuuuugucccugcuguucuuucagacaggaacaauucugggucagaauuuuugacugugggauagcaacaccaucccuccacuugauguccugucuuucuacugggaguagauucuacuaguucccucuucccacuguagggcauuucaucugaaguuccauccuuugaguccuaagagucucucucaccucccaggucucuggugcauucuagaggguaccccccaccuccuaccuccugggauugccuguuuacauucuuucugcuggcccucagggcuuuaguccugucuccccccacccccaauacccgaucauguuuccccuuuucccuccuugucccuuuuuccacccagguuccuccccucccucugugucgccccacccccacccccugugauugcuuucuucuucucccaaguaggauugaggcauccucacuugggcccuuccccuuguuaaccuccuugaguucgguggauuguauccugguauucuguacuuuuuuggcaaauauccacuuauuagugaguacauaccaugcauguccuuuugggucugaguuacuucacucaggaugauauuuucucauucuguccauuugccugcaaaacucaugauguccuucuuaauacuuaauugcugaguaguauuccauugugaaaaugaaccacauuuucugugucucuucuuccauuguggaucaucuggguuguuuccagcuucuggcuaucacaaauaaggccacuaugaacaugugcuccuguggcauggugggacaucuuuuggguauaugaccaagagugguauaacugggucuucaaguagaucuauuuccaauuuucugaggaaccuccugauugauuuccagaguaguuguaccaguuaucccaccagcaauggaggaguguuccucuuucucaacauccucgccaacaugugcuguuaucugaguuuuuuaucuuagccauucugauugguguaagguggaaucucaggguuguuuugauuugcauuucccuaaucacuaaggauuuugaacauuucuuuaaguguuucucggccauucgagauuccucuguugugaauucucuguuuagcucuauaccccauuuuuugauuggguuguuugguuuuuuggagauagcuucuugaguucuuuauauauuuuggauauuagcccucuauuggaugugggguuaaugaagauuuuucccaaucuccuuaacuugucaguguuaucugguaaacguucaaauccuagacuuuucagaaacuuuaaucaugaaguuucauaucugcuucuccugugagaacauauggauagaaagauauaggaagagauauuggaauucauauauuuaagcuuuauccaugaucauccauaguucucaguuccucuguguauccucacucugucccaaugaaacuugaaucaacuuucagcaaagagugucucuguauauaucuccaugugagugucuguacacauacauaauaaugcuaacuauaggaauuauaagaaugauaaaagaaugagauguguuaaguaauuacaaaccucacauuugcucagacaaggaaauuuagcucugaucuuuauuaucaaauggaagaaagaaucuauaucuucaagauaaauguaaaaaacaaaaaucaaacccccaaaacaauccaccaguuuaaguaagagacucugaguuacauaaaaaauuauuuccuauaacauuuucauaugauauuuuucucuuaaauaauuuuuuaaauuggaaguauggcucaaaguacauuacaauguaacauuguaaaggaccuuaaaguccuuacuggaauacuucgccuugcuggagucaaagagugaacaaaagauucuuagccacauauggugcaugcuuauaguuccagcuaacaggucgagggcuggaguuuaagacgaaagauaggugucuucuccagaaagaauaguuacucuguuguugccagaggugaauuuuacccaggaacaaacaaaaccauguaaaaugaacuucuugucuuacuucuuucacucaaaaugucuguggauccauugugcuuucaguguguuaguuacugugcuaauauucuauauaauggcauaugacuauggaacuauuaauuuuuugagcuuuuuuuuuucuuacaguuaaugacuuacaaauaaaacuuguauacuuggucaaugagauaacuuacuggguaugagcaccugcugccaagucugacaacuugaggacaauuuuccuguaccuguagucgugaaaagaauuccuucuugcaaauggaccuacacacacaugcacaucauggcauggaugcaccccccccacacacacacaaaaggauaaauaaacaagucaauucaaggaugaucugucacugaggcccuuacugucugguaauagcugcuauguaagaauggcaaacacucaacucauuugguuuuuucuucuucuagcaucaguuccugaagauugccaagccccucucuagccugacuccacugauugcugcagcaaaagaggcaaccaagaacaaucacugaaaccacgcucaucccagccucaugugccaagccuucuaugaaauaaacacuuguuucaggaacuccgaccccucauguccucuucuccuuuccuugcuucucccauuuccugaucuagugcucccaagacuuugauccuuggaaacugucuagcacugaagagaauugcaacuggacgaguaauccagcagaggccauuucuaaauaggaauucccuuccaguuugugggcauggagggaacugaugagcaaggguuuacccgaauaaaccuguuucuacgaaacagaaucucagccaucccauuccuuaccccucacaaucaguucuuaacuauauaaacuuuugguuugauagcauuaucgauuugagaucaguugaaauugcuuuacuuuuuuauuucugugacuaaauugccugaacaccucauuguauuugaaaaccauaacagcuuugaaaugccacggggccugauaaucugccagggacaggaagaggcucuguuucccgaaccaugcccuuggugcagcugauccugacaugggagaacgaccauguuuuucuuugugugugcuucuagcagcuguuuuggagaaccaugacccaguaguguucccugugcuauuucuagugaaauggucuuagcuauguagcagcuuuugauucccugcauccccuaggcugcugcuugcauucuguccuuauuuauagcauugagagauuuccuagagcacaugcugaguaagagaagugugagaagucagagggaaagugcagcuacuuuuagcacauggcuggcuucagcaccuguccggcuauacuugugugauauuucaagaucucagccucuguuucuaccugggacucagaucuucugguagcuuaacuauuucagucgaaagagaaggucucuaaauccgagaugaugugcuacuaguaauaaggggacccuguuuuuaagugcaugaccaagcucucugcaaguggacaugcuuacucucugcaaauggacgcguauugcggguguuugcuaccuccugcccuccucaugguuuugguucuccugcugugguaggaugcuuggccagcauuguggcuugucaugccagccccauugccuaccuugucaugcucagagguccuacugccucagcagcacaaguuucuauuuccuucaauaaaaggagaugaaaauauucuaca

SEQ ID NO: 3950 - RNA, 2110 nt, Mus musculus
cugacgcuggugguagugguggcaguggcaaucgcuguagcacuugggccauggcagaggaugggccgcagaagcagcagcuggagaugccgcugguucuggaccaggaccugacccagcagaugcggcuccgaguagagagccugaagcagcguggggagaagaagcaggauggugagaagcugauccggccggcugaguccgucuaccgccucgauuucauccagcagcagaagcugcaguucgaucacuggaacgugguucuggacaagcccggcaaggucaccaucacgggcaccucgcagaacuggacgcccgaccucaccaaccucaugacacgccagcugcuggaccccgccgccaucuucuggcgcaaggaagacuccgacgccauggauuggaaugaggcagacgcccuggaguuuggggagcgccuuucugaucuggccaagauccgcaaggucauguauuuccucaucaccuuuggcgagggcguggagccugccaaccuaaaggccucugugguguuuaaccagcucugaugacagcccuggcugcccuaccccuggccccaccucucccuugccuggaucuccuuccucauguguauuuuggggacauucuucuagcugcuccuccugugcucaucuuggccagaguucccccgagugcuacauccccuccuuuucccuggugccagugcugcggcucacagugaugucccauggcuccguagucuagaagccggaugcugcuacuauagacuguagaggccuuuuggguccacgugggaagauggaugggcccccuguggugaagagcgggacugagagauaaagagacugaccaagagaugcaaacggccagcacugauuccucccuucagggaugggagacugagacuggacaggaacaccuuccggggaaccuggcaagaaggcguuugcccugcuggccaaagcuggagccaggaggcgaaugcccagccucuggcagcaggaagguucuccucccagugucggcagcagcccgcugugaccuuagggccuucaagacacugggcaggaugacagcggggcuugaucugacugcuuuuccaggucugggccugguuuuuauggagaagugagagagcguguagaaacugaaacaacucuagccacccacgcucauauggguauugagagauggcauaacuauuuguauggaugugggccugagggcuaguccuggugaggaguaaggcuaacuuuaguuuaauuauugagcugguacuggcuuguggacuugguggaggugauccugacugaggcguccuuggugcagugcuuuuugaacugggagacugagacucgaaugguguagcagaguuagagggguccagggcucugagcuagcaacagugaugucccuguuaggaaggcuggcauuugcugcucgcugguguugugcccugcugucaccccccugggcauauccuggcuguucuccuggagugcagaccccuaaguaaggcuugggugggggcaguuaggaugccugacgucugaagugggcuggagcuaucugacugugaugccuaaacugacaggaaaacgguggcacaguuagcagguucagcucuaccccaagucucauugucccucgccuugcacauccugaaagccuuccauugccuguuaccuagcaucagccagagguaccucagcaguguccccugacugucucaaggcugccucccucgggcauacugaagguaggaucugucccagcuggugagcugccaggacugcaaaccccagcucaggugcaggauucuggaggcaggagauaggcugugguaccggugucucuugagccggugccucugcuccauaacaugcuugccgaagcacuggccggugcuucuggacucugcugacucuagggagccacacccagacagugccucugccuuucugcuucucuuccugaccucucccuacagcuuuagagaccccuuugguucacacugccugugccccaacucugccucacucggauccgucugcccuguggggacaugagugucucuguugugccuguuucacaauaaagacugugugcccuc

SEQ ID NO: 3951 - RNA, 10663 nt, Mus musculus
guucagugguggaaagaacucuuacauguguuuauuaaaccaagaaccagucgcagggugggcugggcugggcuagcaugagaaggcauagcuuucacugacuuucgagcaucucugggaccagccucaaugcccacauggucacugacagccagcuucuuucuaagaccuccuggcccacacccagaacagagucuuacaaaagugaacaaauaacauuuaucuuccuuuccaucccccggccagcagaggaggggguuaaaagugacaguucauuaaaaaaaaaaaaaaaaaaaaaaaaagggcaacaacucauaaaaugaagacaggaaagaauccagggcuggagagcugagauguggcccugggggugagcacagcgugccugggagacccuuccugccccacuccuuggaggggaaaaugggucucugggcucuggcccuugagcuuguaagucccuuggagcuuguggccagauggccacaauugcauugacguagaaaagcaucguaagacagggucccugggggaaauguguacguuuccagucucgaugcugcgggacucccaucccagaggaagaaacugacaggcuugugacugagguguuccaagcuuccugaggcucugaaagggggacugacuuugcuccugccauaagcuggccaccggaccuaggguccccacccaugugaucuuguuguugcuacugcugggcacaaugggaaacagcacagacaaugaaugguaacaggguacccagcaggggagggauggcagagcccccaaccucagcaggaggcugggcuccaagacaccaggugagcacguuugcugcucuuggucccauauuaccaucuuccccacaaggaggguggauuugauuuucucucuaaguccuucuauuauuaagauucuacccaggauuccaugagaaaaggaagaaguaggccucaugggcccagagcaaaaaggugugacuagacacugggcuccaagggaccuucagcccaguggaccugagucagcuuugcaaugcgggcgcucaccuacauguaguccaaacaucaugggucaggucaguccagacaaaagggaaggcacuuagggacaacuggagcagggcucaggaagggaccaaagucugguuuggcaucacagucccuuugcucagaguucugggaggugagccacugugacaaaccggcagauuuuguuauuggguauaggccccagguacaaaaacuauccuuggcccauaucuuuacugagauggccgccacuuaggccuguagacucuccacaggcauuggcacauuaaaauauuaguggggaccugagcaagcccaggcagcagucugucaaguggccucaggccacaccauucgucacaaaaugucugggccccuggcagcagauuccugggugucuccacaguguaggacuaccuuagggcuggagccaggcugccggugguaggcgcccucccgcaccaggcgccggcacugcacauccuggccuacgcugacacuuuguaaagcagggaggugaugcagcagcaucucaggcaggggcaccaagcuggagccugacaggucuaguuccugcagcaaacccaggccugaaaacaccucagcuccugcccacuugagcuugggguugccugacaaguccaggaccugaaggccugggagcucccggaagccguggggugguagauggaggaugcccugcaggcuggccagugacaggugggugaggccugccagccccaugaaggcaucuggguugaugguagccagaggguucccauccaggcucagguaacgcagggguaggucucggagaucgggcacagcucggaaucgguuccaggacagguucaggcucugaaugguaggugcaggcaggcuggcccgggcuggauggggaagcaggcgauggauaagauugugggauagguccacgugcagugcccggcccuggcuguggguggugaaggcagauaucgagaccucucguagucgguuauggcucagauugaugucacucaagggggagcuggugaaaaucucugccggcagggcugccaggccauuguggcugaggucaagugacuccagguagcgcagucgggagaaggcagagggcaugaugcuggugagcagguuguaacugagauccaggccagccagugugguauagccuggcccugccaagacugacucauucacgguuucuagccgguuggaagacagguccaggugggcuguauccaaagggaugggcacaggcacaaugugggggcccaggcugcugcaguccacacggaucaggcugaaacugucaaagaggccgaaugucucuucuucacacuggcagccagggaaacacggccgagucgucugcacucugcccacggccagcagcagcaggaacagagagcacagcauggugacaccuggaaagagagcugcaggugagggguggguguaccagacacuggcauccuggccuauaagagacagcccaguguagggacacagcuggaacuugucaccgcuccuggaacacucuuaaccccuagucccuauuuuucuuugcccucaguccccacaucuguacgguuaagcccucaguccccacaucuguacgguuaagcccucaguccccacaucuguacgguuaagcccucaguccccacaucuguacgguuaaggguuggaccagguggguggaccuccaaccaggagcaugagauccaaguggccugcucugaccaaaguaaggguacccggacaucuuacgugaaaucuguuagaccggacggucucuuggcugcuuuuacuauaacuacugaucugaaguucagaggcugcuggagacccguguggccagagaggacuucacagcacaaguguggaguugggggcuucauucaccuuugcugaaaugaaaccacaggucggcugcugaguuggcugccuccgaacacugucuccucuaacccuuaccauccaucaccuacaagacagagucgugucuccaucccacuaagggagaacugagcuuugaaggguuagagacaggcaugaauacagcuaagcauggugguaccauguggcguagacaccagagccaggauccuuggcugacugcccucuaccuuagcugguucucaaugcaguaaguaacaucuuccuuucuacuugagauccaguguccagacucccaaagaugcuugugagacauccaccauccuaacuaagccucuguuuucuuacccaugccuuacuucccacuaacauagccagaucgccucucugcucucccucuuuuaacugugaaagguggcuggcuuguuaccccauuguacaggaaaagaaacggaggcccagagagaacaagugccucgccaccaaaacuagcacaaaacagggcagaauuagacggaggccugcucagugcuucuaucucugucgccugcccccagagggcugcugggaaguaggcagaauccagaaggggcuuugcugcgacccaagccacucaccccuuccccucaguuccuucugugaaauuacaacauaagccgcuacuuaugucugacgcuaugcaugcugucauaucuaagggucacauggguccguauaggcacacucaagguuugcaaucacgugcugggugguauuagcaugagaaccagaggguuauaaacugagaaccucuaaguggcccccuccccugcuagguagccacucaggagacagaaggcucuucaucuggguggccuguccuccugccugucucccuuccacgggccuccagagaaagaaauaggggugaagugagaggggugaggaccugcccaccuucuaggcuggggguuggggagcagcuggguagcauuaccggcccugcaugaaacuuuaaaggggcagccacuugaucugcacucuggcuccguccuggucucgccuccccuacccaacccuggggcccuucuugcccaccccuuucuuuuguagagaccaauucgaggauuaaacccggcccaggugcauccugggcuuagucccagccaaggcaggacagaguguuccaauguuugcaccaagaggaaaauauuaaguugcuccaggcccccuuuguuccccagggaacucucccagagaucauuacucccaccccuaccccgcccucuagcuaggcugaucugcuccaacccacccugccugggguuuaaauaaacaccgcaaggggcccccaaaucacccuuuggcucucagaggugauuauacaauggcucacaaaaugccaagaggcuucuccugagcucuaguuuauguaaccagcggggcaaauacagcccagauguugcucuccucugggcccuggcccuggacucugcacagggaggcaaagucuauccugccauccucacacaagccaacaaaccccugcacccucaucugugaagagcugugcacagccuucccuggagaaucuggaacauagcagcgguccuugccacgagauaaaggagacaggacugcagguggagacccaccuaggcagccugggugauacaugcucuaggccagaaccuugcucugcugugccaugaacaucucccagggcccuugcuuaggcccuggggaacucuagugggaaacaggaagagacaagccccuguccuguagaccucaaguuugcccaaugagaccaacccucccaucucccauuaaaggaucugaagagccacuugcuaauauuuuggagauacuagagaggaaaugaaaaggggaagacaguccuucaaagagcugcuguaaggacuagacaugucccccuaugggggacaugcccaauguagccaggacacugacagauauacagcaugggcuacucugucucuguaggguagaugucagacagagggaccccaucgugcuucacuacacuccaggacgcugacaagaaagcaacagggcaacucuguguugggacaagucccaggggagagucagaagccauuggucucugucucuguucugcccuggacuguugugaccaccagucaagucccacccuucugcaagccucugcuucccaucuucacaaauacaggguuuagugccaaccccagaguuacagacuuuuaaagcugaacaaaaacgcuaagcacaaagcauguggcuaagccucgcugggugugagugggagagauuguuagggcccccucucacccauagcaacaacacuaacaucuuggacgcaggaguucuugugacucuucacaguuuuauguccaggaguuugaguuccucaucugugcagcaguauuaauguugcucagccuccauucagggacccucugccccagggagaaagggcagaggcaggcaggcagcgcagacaggcauccaucaaggaugucuggggagaagagcgaucucuaggucaagagaucuuuucuacaaagccugaccugcagaugaaagacauccggaggaccaacagaacacaaggcaagauacuucacacagcugguagacagcagguccugugaggccagacaugaacuauuuagggcccacgaugucaucuccacagugacccuaaagacaguaggcugcugucccgugaggucaagcaugaacgguagguauaaaugcuacgagccuggcagcuccaagcggcucucucaucauaucccgaaccugccaggagacagaguuggccacaucacugcccuaggggaucguuguaaagccacagagaucaacugcucccauacaagaggccucuggaaguuggagaugcccuucucccuuccuucucugaauccccuuagggacuggacccucuuugucuucuggguagcagcuuuccuacacagucagcuguuguucacacuguccacaaacacagagaauuccaggcucgugagcugcagagcccuuggagaugaugguugacugaggcccagaggggcauuaagggaaaugcagacagcauagcaagacccaguagcuggggcccaccgccucacacgguccuagcaucacauacaucuacuggccugccccugccugguggaacaaaucgcucucugucuccacagucucccacuaccccucccuccuggccucucacaccucaggcuaccaacaggccuccuucagaggguacugagaaaauucaaauuucaaacauaaggugccagcagcuugggacagagcaccuccuuuuuuaaccuagguaucuuucccuaacugaagucaaagucagacuugguggcaggguggcagcaacagagacccagcaagaaagccacagggguggcuacuagaaccagacccagacaugauagcuucaaacccacaguuggccucaacuugcaaacuuggcaguguggacagcugcucagagcugguaaugcugggcuguaauggcaugcuuaccuagccauccucugugggcagaaaaggggaguuaggguuucuuaauuuuuuuagccccuggaucagguaauauauuacuauauaccagguauuauuggcuggggguugaugguacaugccuuuaaucccagcacuugagaguggcgggaggaucucugaguuuggggcuagccuggcucagggcagcuggggcuauauaguaagauucgguuucaaaacaaggaagcaagcaaacaaacaaaaaugccuaaaaggcguucaagcacauagaaggugacagugucaccaaaggacacuucggccugucccaugcaugcucagcaauuaugucugaccacccugcaaaaccaggaaggucaaaggcacugcacuggucuuaagacugucuagagagucuagagagguucagcgacuuguccagagucacauggccacugacgagacaaagguuggauccagguauucugaaccuagcaccuggccuccuucaugguaugaguggggccugggacuucagcacccucccaccagaagaaugucacccacagggugauagacaaggcccuaaaugcuauuuuccccuuccagcuaaucuuuggggaaauugucaaguucccacugaucugcagcagcaugugagaacgcagggagagguugcauggggcaggagagaggggaccugaaggcuggguccuuacaggacuucaugugacaccccagucucgaaacacggagagcuacuggugcugcucccggcagggcccuggacggauuacuuaagauaaaggaaggacuuagccugagcuggccccagagcgucucagugaguguugucuugccucugugagugacugcagggccaaaaaagagaugcuaagacacaucagaaggaggagaacccagaaguuaucccuggaggucuuggauucugugucacauccagggcccugaucaaguuucccugggaucugggaaggugacugacagaagccagagcaagcugaaguagggggugccaccuauggucaaaugagaagcuggcaccaaaucagcagucacuccugggcagguaggucacugucuguccucuuccucacccugcagaggucauacucgggagaacucuguagcccucuggccucuggccuccacuucuaaacacugccaaagcucuacacaagugcccaguggcugggcaccagaguacagccuccaacugaagaccaagcccccaccacagugccucaucuaaacccaauuccacaaagacagccucucaggcugaauauccgucacuccccagggacuucuuucuuugcacaggcuacuucuuuugacaaagauggcaaagcccucccgcuuugucuuccacaaauucccacuuguuugauucaaaagcuaccuuuucgugaggccuucccagccuaaccuggcuuucauccccugaagggccacugggcuauggcugucuaagaaugugccgagcuccucucuagcguggauacuagcauggugggggcagaaaccagaggaggaaaaugacagggacagaaaggcuuccuucugcuugggugcuuccuggaacuaaggguuuggcuaagugguuaaaccagguuuaaaguugaggguucauguuauuucugccuccucuuguauucacacaauguauguaaccagacacccaaaaaccaaucuccguuuauuagcacauguagucauuuguuaugcuauuuaccagucacaacaccaucagugaacagggaucaaaauuucccuucaaaggagccugagaaucagacaggugacaggacacaugccaggugauagaggcuauggaaggagagcacaacucccagacuuccugacuggaagacaugcagcacccugccuucagacaggccucccagacuccaucaccguccaaaggccagaggaaaaaaugaucaaacaccccccaccccagccccaugguucuguuuucuccagcagcucucugcacucaggcucaaaugggagaucagacugaugcucagcgacuggccucugccuucccucccagccuuuggguaacuccuauuccccaacacccugaacccugacaggaagagaaguacccgugugcuguuuccagaacacacagaacccugcauguacugugggaggccuuuccagcuucugccaccucuuggcaaacuucaaaccccugaguagagagagucaccugcucagccaggucugcuccuaugggaccugccugucuuagcacuugcuuuggcaggacacuuccgaaguggggccagaugucuucaggaaacucccaggcucagcguccugagaaaggauagggaacccaaucaaguacauugucucugcggugagccagaaguuacaauuaaaaagaaaauuggucaggauuccaucucuugccgagucugucauguaaaagauaagcgacaccagcuuuugucuuuucacuggucaguacuccaggcuggugcauuccagccucccuaggaacaaacugaugccugggaacacaguuguuuccaggcucugcgaucucugguaaucaggagaaucaagagaguacagagaccguccacacucccuuucucauaaggaaggucuagaaacgaaaagaaagugaccaucguugccuuucccaaguuugucccccacucccacuccgacgggguaguacugaccaaaguucuaaguuacaaacugggguggaugguuggggaaaaaaaguguuugacuuaucuuugccacccaggaucaaaagcucggacaggauggagccccucccacucugagggcuuugcaagucuagacuuauccgaaaggcuagcauggagcaagaaaggaucaaaguuugagucaccucugagccuggccaagugugggcgggagccgcuuucagcuaagcucgccacgcugguuaccaccacggugcgcuccgcucccacggcauagaguucuucucacuucauccacaucagugaccgaaucucaacgggcucugcaacacgcccgugcccuacgugagccauuggccaucccuugggaaacuaguguguggaaagccccuuuucaucacagcccaaucagggcuaggggccgcgagcaggccggaugcagacaaaccguggcuuuucucaccuacuggauuggaagguucguccccucacucuggggucggguuaaagcagagccggaacucaaagccaaucaagucucuccaccaaacagacugaucucaguccgcacucacucuguccccggagcgcagagcagacuacugccagcaguacgcuauucccgggucucuggccucaggccggagcccagaccagcgguguccccucccuccucccacugggguccagugagggugucccgcacgcuccgcccaguccuggcccgggccagucgccaggcacugcagaucacccccaacccaccaaauccaucucauccccucccggcucaaaggaccuccggaggugagacagagaagggcugccaacaggcguugccggaggaacccagagaaaaguuugaagccaaguagggggaaaacgauggacagaaagggagcagagagucggggcagcuucagggcucucagugcgcacauaccccacagauacucaacucagacacgucgacaagcauagaccacguaugcggacacuaggagcgcccaccgguccccacaaccaaacgcaaggcugcaaaacggggacacuggagcgagauagccaugcaaagccacgcacacacaaaggcaaggcagaugcuggcuuccgaacccaaauccacaaaagacccaguaccgugagaugcacguguucuuacaaagacccuggaggcgccggcccacgcccacgacccccaggcagagccuuugucuccugaaagcccucacccuugcucccccgacucuauggcucggugucccggaaaaguugaggggccuuggcaggacccggacccgccccucgcgcuggccugcucacgggauggggcggugagguuggagucccgggcuccaaaccuccaaaugcgcgccgaucucgcugcgccucccgacagcacccaccuggcaggucugcaguugucgccucggcacgcucaccuaggcgacccggcguuggcccaugggccggcgcuuuucuccgcgccgcucg

SEQ ID NO: 3952 - RNA, 10663 nt, Mus musculus
cgagcggcgcggagaaaagcgccggcccaugggccaacgccgggucgccuaggugagcgugccgaggcgacaacugcagaccugccaggugggugcugucgggaggcgcagcgagaucggcgcgcauuuggagguuuggagcccgggacuccaaccucaccgccccaucccgugagcaggccagcgcgaggggcggguccggguccugccaaggccccucaacuuuuccgggacaccgagccauagagucgggggagcaagggugagggcuuucaggagacaaaggcucugccugggggucgugggcgugggccggcgccuccagggucuuuguaagaacacgugcaucucacgguacugggucuuuuguggauuuggguucggaagccagcaucugccuugccuuugugugugcguggcuuugcauggcuaucucgcuccaguguccccguuuugcagccuugcguuugguuguggggaccggugggcgcuccuaguguccgcauacguggucuaugcuugucgacgugucugaguugaguaucugugggguaugugcgcacugagagcccugaagcugccccgacucucugcucccuuucuguccaucguuuucccccuacuuggcuucaaacuuuucucuggguuccuccggcaacgccuguuggcagcccuucucugucucaccuccggagguccuuugagccgggaggggaugagauggauuugguggguugggggugaucugcagugccuggcgacuggcccgggccaggacugggcggagcgugcgggacacccucacuggaccccagugggaggagggaggggacaccgcuggucugggcuccggccugaggccagagacccgggaauagcguacugcuggcaguagucugcucugcgcuccggggacagagugagugcggacugagaucagucuguuugguggagagacuugauuggcuuugaguuccggcucugcuuuaacccgaccccagagugaggggacgaaccuuccaauccaguaggugagaaaagccacgguuugucugcauccggccugcucgcggccccuagcccugauugggcugugaugaaaaggggcuuuccacacacuaguuucccaagggauggccaauggcucacguagggcacgggcguguugcagagcccguugagauucggucacugauguggaugaagugagaagaacucuaugccgugggagcggagcgcaccguggugguaaccagcguggcgagcuuagcugaaagcggcucccgcccacacuuggccaggcucagaggugacucaaacuuugauccuuucuugcuccaugcuagccuuucggauaagucuagacuugcaaagcccucagagugggaggggcuccauccuguccgagcuuuugauccuggguggcaaagauaagucaaacacuuuuuuuccccaaccauccaccccaguuuguaacuuagaacuuuggucaguacuaccccgucggagugggagugggggacaaacuugggaaaggcaacgauggucacuuucuuuucguuucuagaccuuccuuaugagaaagggaguguggacggucucuguacucucuugauucuccugauuaccagagaucgcagagccuggaaacaacuguguucccaggcaucaguuuguuccuagggaggcuggaaugcaccagccuggaguacugaccagugaaaagacaaaagcuggugucgcuuaucuuuuacaugacagacucggcaagagauggaauccugaccaauuuucuuuuuaauuguaacuucuggcucaccgcagagacaauguacuugauuggguucccuauccuuucucaggacgcugagccugggaguuuccugaagacaucuggccccacuucggaaguguccugccaaagcaagugcuaagacaggcaggucccauaggagcagaccuggcugagcaggugacucucucuacucagggguuugaaguuugccaagagguggcagaagcuggaaaggccucccacaguacaugcaggguucuguguguucuggaaacagcacacggguacuucucuuccugucaggguucaggguguuggggaauaggaguuacccaaaggcugggagggaaggcagaggccagucgcugagcaucagucugaucucccauuugagccugagugcagagagcugcuggagaaaacagaaccauggggcuggggugggggguguuugaucauuuuuuccucuggccuuuggacggugauggagucugggaggccugucugaaggcagggugcugcaugucuuccagucaggaagucugggaguugugcucuccuuccauagccucuaucaccuggcauguguccugucaccugucugauucucaggcuccuuugaagggaaauuuugaucccuguucacugaugguguugugacugguaaauagcauaacaaaugacuacaugugcuaauaaacggagauugguuuuugggugucugguuacauacauugugugaauacaagaggaggcagaaauaacaugaacccucaacuuuaaaccugguuuaaccacuuagccaaacccuuaguuccaggaagcacccaagcagaaggaagccuuucugucccugucauuuuccuccucugguuucugcccccaccaugcuaguauccacgcuagagaggagcucggcacauucuuagacagccauagcccaguggcccuucaggggaugaaagccagguuaggcugggaaggccucacgaaaagguagcuuuugaaucaaacaagugggaauuuguggaagacaaagcgggagggcuuugccaucuuugucaaaagaaguagccugugcaaagaaagaagucccuggggagugacggauauucagccugagaggcugucuuuguggaauuggguuuagaugaggcacuguggugggggcuuggucuucaguuggaggcuguacucuggugcccagccacugggcacuuguguagagcuuuggcaguguuuagaaguggaggccagaggccagagggcuacagaguucucccgaguaugaccucugcagggugaggaagaggacagacagugaccuaccugcccaggagugacugcugauuuggugccagcuucucauuugaccauagguggcacccccuacuucagcuugcucuggcuucugucagucaccuucccagaucccagggaaacuugaucagggcccuggaugugacacagaauccaagaccuccagggauaacuucuggguucuccuccuucugaugugucuuagcaucucuuuuuuggcccugcagucacucacagaggcaagacaacacucacugagacgcucuggggccagcucaggcuaaguccuuccuuuaucuuaaguaauccguccagggcccugccgggagcagcaccaguagcucuccguguuucgagacuggggugucacaugaaguccuguaaggacccagccuucagguccccucucuccugccccaugcaaccucucccugcguucucacaugcugcugcagaucagugggaacuugacaauuuccccaaagauuagcuggaaggggaaaauagcauuuagggccuugucuaucacccugugggugacauucuucuggugggagggugcugaagucccaggccccacucauaccaugaaggaggccaggugcuagguucagaauaccuggauccaaccuuugucucgucaguggccaugugacucuggacaagucgcugaaccucucuagacucucuagacagucuuaagaccagugcagugccuuugaccuuccugguuuugcaggguggucagacauaauugcugagcaugcaugggacaggccgaaguguccuuuggugacacugucaccuucuaugugcuugaacgccuuuuaggcauuuuuguuuguuugcuugcuuccuuguuuugaaaccgaaucuuacuauauagccccagcugcccugagccaggcuagccccaaacucagagauccucccgccacucucaagugcugggauuaaaggcauguaccaucaacccccagccaauaauaccugguauauaguaauauauuaccugauccaggggcuaaaaaaauuaagaaacccuaacuccccuuuucugcccacagaggauggcuagguaagcaugccauuacagcccagcauuaccagcucugagcagcuguccacacugccaaguuugcaaguugaggccaacuguggguuugaagcuaucaugucugggucugguucuaguagccaccccuguggcuuucuugcugggucucuguugcugccacccugccaccaagucugacuuugacuucaguuagggaaagauaccuagguuaaaaaaggaggugcucugucccaagcugcuggcaccuuauguuugaaauuugaauuuucucaguacccucugaaggaggccuguugguagccugaggugugagaggccaggagggagggguagugggagacuguggagacagagagcgauuuguuccaccaggcaggggcaggccaguagauguaugugaugcuaggaccgugugaggcggugggccccagcuacugggucuugcuaugcugucugcauuucccuuaaugccccucugggccucagucaaccaucaucuccaagggcucugcagcucacgagccuggaauucucuguguuuguggacagugugaacaacagcugacuguguaggaaagcugcuacccagaagacaaagaggguccagucccuaaggggauucagagaaggaagggagaagggcaucuccaacuuccagaggccucuuguaugggagcaguugaucucuguggcuuuacaacgauccccuagggcagugauguggccaacucugucuccuggcagguucgggauaugaugagagagccgcuuggagcugccaggcucguagcauuuauaccuaccguucaugcuugaccucacgggacagcagccuacugucuuuagggucacuguggagaugacaucgugggcccuaaauaguucaugucuggccucacaggaccugcugucuaccagcugugugaaguaucuugccuuguguucuguugguccuccggaugucuuucaucugcaggucaggcuuuguagaaaagaucucuugaccuagagaucgcucuucuccccagacauccuugauggaugccugucugcgcugccugccugccucugcccuuucucccuggggcagagggucccugaauggaggcugagcaacauuaauacugcugcacagaugaggaacucaaacuccuggacauaaaacugugaagagucacaagaacuccugcguccaagauguuaguguuguugcuaugggugagagggggcccuaacaaucucucccacucacacccagcgaggcuuagccacaugcuuugugcuuagcguuuuuguucagcuuuaaaagucuguaacucugggguuggcacuaaacccuguauuugugaagaugggaagcagaggcuugcagaagggugggacuugacugguggucacaacaguccagggcagaacagagacagagaccaauggcuucugacucuccccugggacuugucccaacacagaguugcccuguugcuuucuugucagcguccuggaguguagugaagcacgauggggucccucugucugacaucuacccuacagagacagaguagcccaugcuguauaucugucaguguccuggcuacauugggcaugucccccauagggggacaugucuaguccuuacagcagcucuuugaaggacugucuuccccuuuucauuuccucucuaguaucuccaaaauauuagcaaguggcucuucagauccuuuaaugggagaugggaggguuggucucauugggcaaacuugaggucuacaggacaggggcuugucucuuccuguuucccacuagaguuccccagggccuaagcaagggcccugggagauguucauggcacagcagagcaagguucuggccuagagcauguaucacccaggcugccuaggugggucuccaccugcaguccugucuccuuuaucucguggcaaggaccgcugcuauguuccagauucuccagggaaggcugugcacagcucuucacagaugagggugcagggguuuguuggcuugugugaggauggcaggauagacuuugccucccugugcagaguccagggccagggcccagaggagagcaacaucugggcuguauuugccccgcugguuacauaaacuagagcucaggagaagccucuuggcauuuugugagccauuguauaaucaccucugagagccaaagggugauuugggggccccuugcgguguuuauuuaaaccccaggcaggguggguuggagcagaucagccuagcuagagggcgggguaggggugggaguaaugaucucugggagaguucccuggggaacaaagggggccuggagcaacuuaauauuuuccucuuggugcaaacauuggaacacucuguccugccuuggcugggacuaagcccaggaugcaccugggccggguuuaauccucgaauuggucucuacaaaagaaaggggugggcaagaagggccccaggguuggguaggggaggcgagaccaggacggagccagagugcagaucaaguggcugccccuuuaaaguuucaugcagggccgguaaugcuacccagcugcuccccaacccccagccuagaaggugggcagguccucaccccucucacuucaccccuauuucuuucucuggaggcccguggaagggagacaggcaggaggacaggccacccagaugaagagccuucugucuccugaguggcuaccuagcaggggagggggccacuuagagguucucaguuuauaacccucugguucucaugcuaauaccacccagcacgugauugcaaaccuugagugugccuauacggacccaugugacccuuagauaugacagcaugcauagcgucagacauaaguagcggcuuauguuguaauuucacagaaggaacugaggggaaggggugaguggcuugggucgcagcaaagccccuucuggauucugccuacuucccagcagcccucugggggcaggcgacagagauagaagcacugagcaggccuccgucuaauucugcccuguuuugugcuaguuuugguggcgaggcacuuguucucucugggccuccguuucuuuuccuguacaaugggguaacaagccagccaccuuucacaguuaaaagagggagagcagagaggcgaucuggcuauguuagugggaaguaaggcauggguaagaaaacagaggcuuaguuaggaugguggaugucucacaagcaucuuugggagucuggacacuggaucucaaguagaaaggaagauguuacuuacugcauugagaaccagcuaagguagagggcagucagccaaggauccuggcucuggugucuacgccacaugguaccaccaugcuuagcuguauucaugccugucucuaacccuucaaagcucaguucucccuuagugggauggagacacgacucugucuuguaggugauggaugguaaggguuagaggagacaguguucggaggcagccaacucagcagccgaccugugguuucauuucagcaaaggugaaugaagcccccaacuccacacuugugcugugaaguccucucuggccacacgggucuccagcagccucugaacuucagaucaguaguuauaguaaaagcagccaagagaccguccggucuaacagauuucacguaagauguccggguacccuuacuuuggucagagcaggccacuuggaucucaugcuccugguuggagguccacccaccugguccaacccuuaaccguacagauguggggacugagggcuuaaccguacagauguggggacugagggcuuaaccguacagauguggggacugagggcuuaaccguacagauguggggacugagggcaaagaaaaauagggacuagggguuaagaguguuccaggagcggugacaaguuccagcugugucccuacacugggcugucucuuauaggccaggaugccagugucugguacacccaccccucaccugcagcucucuuuccaggugucaccaugcugugcucucuguuccugcugcugcuggccgugggcagagugcagacgacucggccguguuucccuggcugccagugugaagaagagacauucggccucuuugacaguuucagccugauccguguggacugcagcagccugggcccccacauugugccugugcccaucccuuuggauacagcccaccuggaccugucuuccaaccggcuagaaaccgugaaugagucagucuuggcagggccaggcuauaccacacuggcuggccuggaucucaguuacaaccugcucaccagcaucaugcccucugccuucucccgacugcgcuaccuggagucacuugaccucagccacaauggccuggcagcccugccggcagagauuuucaccagcucccccuugagugacaucaaucugagccauaaccgacuacgagaggucucgauaucugccuucaccacccacagccagggccgggcacugcacguggaccuaucccacaaucuuauccaucgccugcuuccccauccagcccgggccagccugccugcaccuaccauucagagccugaaccuguccuggaaccgauuccgagcugugcccgaucuccgagaccuaccccugcguuaccugagccuggaugggaacccucuggcuaccaucaacccagaugccuucauggggcuggcaggccucacccaccugucacuggccagccugcagggcauccuccaucuaccaccccacggcuuccgggagcucccaggccuucagguccuggacuugucaggcaaccccaagcucaagugggcaggagcugagguguuuucaggccuggguuugcugcaggaacuagaccugucaggcuccagcuuggugccccugccugagaugcugcugcaucaccucccugcuuuacaaagugucagcguaggccaggaugugcagugccggcgccuggugcgggagggcgccuaccaccggcagccuggcuccagcccuaagguaguccuacacuguggagacacccaggaaucugcugccaggggcccagacauuuugugacgaaugguguggccugaggccacuugacagacugcugccugggcuugcucagguccccacuaauauuuuaaugugccaaugccuguggagagucuacaggccuaaguggcggccaucucaguaaagauaugggccaaggauaguuuuuguaccuggggccuauacccaauaacaaaaucugccgguuugucacaguggcucaccucccagaacucugagcaaagggacugugaugccaaaccagacuuuggucccuuccugagcccugcuccaguugucccuaagugccuucccuuuugucuggacugaccugacccaugauguuuggacuacauguaggugagcgcccgcauugcaaagcugacucagguccacugggcugaaggucccuuggagcccagugucuagucacaccuuuuugcucugggcccaugaggccuacuucuuccuuuucucauggaauccuggguagaaucuuaauaauagaaggacuuagagagaaaaucaaauccacccuccuuguggggaagaugguaauaugggaccaagagcagcaaacgugcucaccuggugucuuggagcccagccuccugcugagguugggggcucugccaucccuccccugcuggguacccuguuaccauucauugucugugcuguuucccauugugcccagcaguagcaacaacaagaucacauggguggggacccuagguccgguggccagcuuauggcaggagcaaagucagucccccuuucagagccucaggaagcuuggaacaccucagucacaagccugucaguuucuuccucugggaugggagucccgcagcaucgagacuggaaacguacacauuucccccagggacccugucuuacgaugcuuuucuacgucaaugcaauuguggccaucuggccacaagcuccaagggacuuacaagcucaagggccagagcccagagacccauuuuccccuccaaggaguggggcaggaagggucucccaggcacgcugugcucacccccagggccacaucucagcucuccagcccuggauucuuuccugucuucauuuuaugaguuguugcccuuuuuuuuuuuuuuuuuuuuuuuuuaaugaacugucacuuuuaacccccuccucugcuggccgggggauggaaaggaagauaaauguuauuuguucacuuuuguaagacucuguucugggugugggccaggaggucuuagaaagaagcuggcugucagugaccaugugggcauugaggcuggucccagagaugcucgaaagucagugaaagcuaugccuucucaugcuagcccagcccagcccacccugcgacugguucuugguuuaauaaacacauguaagaguucuuuccaccacugaac

SEQ ID NO: 3953 - RNA, 7612 nt, Mus musculus
caugagccaccagauccugcuacuccuggccaugcugacccugggccuggcuaucucucagcgucgagagcaagugcccuguaggacgguaagacacagugcaggcagagugaggggucccacagcccaguccaggucaaagguuaguggggccagcaaaggauagagcuuugccucgguauuugucgcgcauacacuagacaguugagaagccugucuaccuaacaaucgcauuuguuccuauuuuacagaaggggaaguuuggagaggccaggugaccuaagcaagguuauucaguuagggaccguggggccacuggcccucuauucccuguuacaagugauuggucuuuugggacauccugggggcuacacaagcuggaaaggcuccgcuguacuguucuucccggguacauagcccuucccuggcugggacccugaacuuggacugccugcuagaaugcuccucccucauugcagccaggucaaaggccaccuugcucaggaaaccucucccaccguugacugcugauuucuucuguugcuccuuccucuggcucuguguccucccccaucuccaugcugagcagacggaggauaugugcuacuucauccauagccaaaaacugucuuacccagccgaccaagggcuccuagggggcagaaaccauacaggcugaagacauugugacccugugagguauagggagaaaaacccucuaggcuagugguucucaaccugugggucucgaccccuaaggggguuuagcucagauauccugcauaucagauacuuacauuagaauucauaacaauggcaaaauuacaguugugacguaacaaugaaauaacuuucuggccaggggucaccacagcaugaggaacuguauugaaggguuacaggguuaggaaggcugagaaccgcugcucuaggaauacuugcaaagcaggacaggcacaccaccagcugcacuugggcauagaauggacuaacuguguaaagaggccagaaaugccagcagccauuuccuggggucugugugcccugcuguggccacuaauucuuucuuagagacauccugagagucucacacccagacuaaugagagcaaagaccucagauaucaccauaugcccacagccuuggcggacugaggucuuaaauggugaggacucuggcaccuguagacagagggcauggagcaggggcucucugagaagcaugagauaggagaagacuuucugaacugucagaaagagcucuagacccagcugcagaaaagacaugugacccugugggcuccgacagcagaaaugacagagacaggauucaaacccuguucccccugugcaguucacugccagaaccucuccucuuguguauggaugggaagugaaguuggauagcauguuccuuccccccucaggaagagggcagaucagugacugacauggcagagugaaggaggaugcuaaaccccagccaagaccccuauaucucugcaccagagacuucuagcagucagucagagcucagcaauaagggcagggagggugcugagaugguccaguccuucaggcuccuucugaagucugggcuggaucaaagaggaggguaccagguacuccccuggaccucugcaguuucugauagguggucucagguuaugucaccuccugucauggucccuuuggagcugggguccuggagagccucugcuuacccagaagggagaguccaugggugugggcuuacauggggaagcguggcaugcacccugcaaaugcauaguaaauagugucuggugguguuuguucagccagccugaguaccugggcagcugaaggcuccguuuacacaaaaagaaacucaugcuugcauugagcucaucucaaugcugcuuacagcagggugguccaggagcuaagugucaaguaggugucuaguuucuauggguguuggugagggauguuauugggucuccuagagccucagguggcagcuuuuucuggaaguacaaggcuugucaagguauuuuaugcaguaggcaguugcacaggugcccauagccagacggugcccggccuggggggucuggggggaaggaggcucagagcuaggucagacagggaugccaggcuuguguuucuuccuugcuaccucagccacuggaccccugugacacaggcaaguuacugccagggcagacccugaccucagcaucuggacagcaggugggcuggcucacuccguucuaaugucucucucuggcuugaauaugaauaucuggguuagcucuuuucuuuccggcauugauuggaucaaggcccuuugcuuaagcacagaugucugcaacucauucauaaaagacauuuccggaggacuuucuuugggccagguccaagacauccaugucaaucaaaguagccccuguccgugcagagcucacugucugcggguccccauuccaccauuguuccaggacacugagcuguagggagaagacacaguuagggagggccucuguggaagacauguugggauuccccgugaggaauucucauacaggucugcuccaugcauguccagggauggcugugcaagggggugggaccagugcuaggcauggucacugcauguaaacuggacugcagugagucagucgacagguuggucaaugccacagacagacuugauggacccugcucuguguuuaagccaagaguaccauaggcaaaguggaguuugaacagucugugggccuuucgcagguaggcaguucagugggggucgauggagacaggcuaggggcagggguaaaacuaagcuggcugauguagacauuacacucuuugcuagggagggcaggggcaccuggggugagaaucugggagccaccagauggagaugugcauuugcauagaauuaugacccuuaacgaugcauuuuguggaaggaaacgaguugcuaagagcccuguguucgaaucccaacucccaccauaucagcugggugguccugaagucucucuuacccucuccaaccuggauuuugguaaaaaucuauaauuacaucagauuacccauaugcacugggugggcuguuguaaggcucugacaagaucgccagucugaaaguccugauguauuaaguaggugcugggaaggacaaguuaauuuugggauaaggaacuggagugucaauguugauguguccuguuaaugaucuuucaguuaaauugucaucagauaacccguuggguucugguaucccuuuauucuauucugucuccuuacuccuacgaccuggaugcugugcuggaccagagcaggccacugauauggugguauuuagcagcugcagaaaggaacgagucacagcaggaauguggucugagcugugcuggcuggaccaaaucaaagggcuggcacaaaagccugcugguuucccuguugcaaacaucuuuuccugaugacgcuuccagccuaaagcuagaauuuuaucugggauguggcaaggacccaggugugaaacuggaagcugugggccauguugccccucuguucugcaucacugugagugaaauauggcuuaguuucccauagaacaggauacuagucaacacauacguauucuuagagcucucuacuaugucucugucuacugcucccuucugcccagcaccagcaggacugccagucagggccagagagcagcuuggggcaucagcuuggguggaggcaaggcuaacauccugggacucugggggaagcaccccaagcuuggggagagggcgagucaucuuuccuacagaacccuguccccaccuacuguccuguccccauuaaugccagcaucucugccacccuugcucucccuaggugaacaaggaggccuugugccacggccuuggccugcuccagguccccucggugcucucacuggacauccaagcucucuacuuguccgggaaccaacugcagagcauccuggucuccccacugggcuucuauacagcgcuucgucaccuggauuuaagugacaaccagauuagcuuccuccaggcuggggucuuccaggcccugcccuaccuggagcaccuuaaccuggcccacaaucggcuugccacaggcauggcucucaacagugguggucugggccgccugccccuuuuggucucccuggaccugucugggaacagccugcauggcaaucugguggagcgacuguugggugagaccccgaggcugcguacgcucucacuggcggagaacagccucacucgccuggcacgccacaccuucugggguaugccagcgguggagcaauuagaccuccacagcaauguccucauggauaucgaggacggugccuuugaggcccugccccaccugacucaccucaaucucuccagaaacucccucaccugcaucucagacuucagccuccagcagcugcagguacuagacuugagcugcaacagcauugaggccuuccagacggccccggaaccacaggcccaguuccaguuggccuggcucgaccuccgggagaacaagcugcuccacuucccugaccuggccguguucccgagacucaucuaccugaaugugucuaacaaccucauccagcucccugcggggcugccccggggcagugaggaccuccacgcacccucugaaggcuggucagccucuccacuguccaaccccagccggaaugccagcacccacccucucucccagcuccugaaccuggaucugaguuacaaugagaucgaacuggucccugcuagcuuucuugaacaccugaccucccugcgcuuccucaaccucagcagaaacugccugcgauccuuugaggcucgacaaguggacucccugcccugccuggugcuuuuggacuugagccacaaugugcuggaagcauuagaacuggguaccaaaguccuagggucccugcagacguugcuucugcaggacaaugccuugcaagaacuuccacccuauaccuuugccagccuggccagccugcagaggcuaaaccuacaggggaaccaggucagucccuguggggggccagcagaaccaggucccccgggcuguguggacuucucugggauccccacccuucauguucuuaacauggcagggaacucgaugggaaugcucagggcgggcagcuuccuucacaccccacuuacagagcuggaccucuccaccaauccuggucuggauguggccacgggagcccuggugggccuggaggcauccuuagagguacuggagcuucaaggcaacgggcugacugucuugagaguggacuugcccugcuuucuccgucucaagcgccuuaaccuugcugagaaccaguuaagccaccugcccgcuuggacgcgggcugugucccuggaggugcuagaucugcggaacaacagcuucagccuccugccaggcaaugccauggguggccuggagaccagucuccggcggcuguacuugcagggaaauccacucagcugcuguggcaauggcuggcuggcggcccagcugcaccagggcagaguggauguggaugcuacucaggaccuaaucugccgcuuuggcucccaggaggaguugucccugagccuagugcguccagaggauugcgagaagggagggcugaagaaugucaaccucauccuccuccucagcuucacacuggucucugccaucguccucaccacgcuggccaccaucugcuuccuccgccggcagaagcucagccaacaauacaaagccugacaggcucgggaagccagaggggcagagaaguugggguccaacucagguuacucagugaccagggacuugguguccugcacacugccgcgugggcagguuccuucccaggcugcaucugugggccagcugugcagcucgaaguggggcaguuuacugcacagaggaugccaaccgacagcucgacgcugaguaucuguuucaggccacacccgucuccggguacuaguaaaugaaacacaugccuauccucaggcaagagaggccgucacugaaccacacagugaccacauaggcuugagguggggaagcaguaggcuggacauggagaacccacccugacuuagagcaggagagccagcccgugagaggauuugucugaguccuuuccaccccgagcucugucgcaucugcugauaaugacuuucagccucucuggaaaugaagaacuugugaccugaagagagagccagaaccucuccccagaggucuuaagucuaggcuccuaggcuaggggcugcaccagcuuaaagugugaucaccuaggcuuccacgcaggccugggccguccuguguccugcuuuggacaggccuucucuccagugcacucuuguaucacacacacacugacccuggugcugccuguuccccaacccccugcucaggccuccuucuaucccagccccacccugacuuuugagccaagagggagagccucagcuaucugguucagcuuagcagcugcagaggcaaagucaagccaacucucagagguuucuguguuaucuggguuauacacaagaagaaaacaaauuuccuuaugcauucuccuuugagagccucauggcucagagagcugacgaagccaaaaugaaucaaguccauguccucccaucucuggggccaaagcuuugccagugcgguaccugcaggcugucaaguggacaggaaguggcccugcccuaaccaggauccaagcacacuugcuacauauacccccucccucucagacaggcgcccacagacccucugccucucugccucagugucccuucuuugcagaagaguaugaauucuuccuuucucuuucugcuccccaaaaucucauugaguguaaucuccccacugaacagauagggaaaguuaggugcaggccuugcucagaaucacgcaagucaauggaagaaaacugggaacaaaaguagcugggcgguugcgccaaggcagaggguuugcuuugugugcucaaggcccugagcuggaugccagcggcuguacccguguuucccuacgcucagcagucacagcacgagacaaggccagcuaccaugccaguccucaccaggcauggaaaaauaauagggacacacacacacacacacacacacacacacacacacugucuccacucauucuccaggcuugugggcugcagggaggaaggggaguccuggacccagucacagagccugcugcaucagaucccugugcucggcccacagucagccagagcuuccguaauguacaagaagacgaaaacgccauucucucuaccccacucuacaggugaggggacugaggcccagagaagguuaaaggcuccgaggaccaauaggcagauccagaccuagaaccuucccucacuggugcugcugcgcacacagcucuucuccucggccuggaggccaaggcgugguggccccugggccugaacucugaaaacacuaaucaaugcugcucucaccucccaggacuggccucuaccgggcccugggacccgcucuuuguauaacucacaugaauguauuaaaguauaauuuuggagaaac

SEQ ID NO: 3954 - RNA, 7612 nt, Mus musculus
guuucuccaaaauuauacuuuaauacauucaugugaguuauacaaagagcgggucccagggcccgguagaggccaguccugggaggugagagcagcauugauuaguguuuucagaguucaggcccaggggccaccacgccuuggccuccaggccgaggagaagagcugugugcgcagcagcaccagugagggaagguucuaggucuggaucugccuauugguccucggagccuuuaaccuucucugggccucaguccccucaccuguagagugggguagagagaauggcguuuucgucuucuuguacauuacggaagcucuggcugacugugggccgagcacagggaucugaugcagcaggcucugugacuggguccaggacuccccuuccucccugcagcccacaagccuggagaaugaguggagacagugugugugugugugugugugugugugugugugugucccuauuauuuuuccaugccuggugaggacuggcaugguagcuggccuugucucgugcugugacugcugagcguagggaaacacggguacagccgcuggcauccagcucagggccuugagcacacaaagcaaacccucugccuuggcgcaaccgcccagcuacuuuuguucccaguuuucuuccauugacuugcgugauucugagcaaggccugcaccuaacuuucccuaucuguucaguggggagauuacacucaaugagauuuuggggagcagaaagagaaaggaagaauucauacucuucugcaaagaagggacacugaggcagagaggcagagggucugugggcgccugucugagagggaggggguauauguagcaagugugcuuggauccugguuagggcagggccacuuccuguccacuugacagccugcagguaccgcacuggcaaagcuuuggccccagagaugggaggacauggacuugauucauuuuggcuucgucagcucucugagccaugaggcucucaaaggagaaugcauaaggaaauuuguuuucuucuuguguauaacccagauaacacagaaaccucugagaguuggcuugacuuugccucugcagcugcuaagcugaaccagauagcugaggcucucccucuuggcucaaaagucaggguggggcugggauagaaggaggccugagcaggggguuggggaacaggcagcaccagggucagugugugugugauacaagagugcacuggagagaaggccuguccaaagcaggacacaggacggcccaggccugcguggaagccuaggugaucacacuuuaagcuggugcagccccuagccuaggagccuagacuuaagaccucuggggagagguucuggcucucucuucaggucacaaguucuucauuuccagagaggcugaaagucauuaucagcagaugcgacagagcucgggguggaaaggacucagacaaauccucucacgggcuggcucuccugcucuaagucaggguggguucuccauguccagccuacugcuuccccaccucaagccuauguggucacugugugguucagugacggccucucuugccugaggauaggcauguguuucauuuacuaguacccggagacggguguggccugaaacagauacucagcgucgagcugucgguuggcauccucugugcaguaaacugccccacuucgagcugcacagcuggcccacagaugcagccugggaaggaaccugcccacgcggcagugugcaggacaccaagucccuggucacugaguaaccugaguuggaccccaacuucucugccccucuggcuucccgagccugucaggcuuuguauuguuggcugagcuucugccggcggaggaagcagaugguggccagcguggugaggacgauggcagagaccagugugaagcugaggaggaggaugagguugacauucuucagcccucccuucucgcaauccucuggacgcacuaggcucagggacaacuccuccugggagccaaagcggcagauuagguccugaguagcauccacauccacucugcccuggugcagcugggccgccagccagccauugccacagcagcugaguggauuucccugcaaguacagccgccggagacuggucuccaggccacccauggcauugccuggcaggaggcugaagcuguuguuccgcagaucuagcaccuccagggacacagcccgcguccaagcgggcagguggcuuaacugguucucagcaagguuaaggcgcuugagacggagaaagcagggcaaguccacucucaagacagucagcccguugccuugaagcuccaguaccucuaaggaugccuccaggcccaccagggcucccguggccacauccagaccaggauugguggagagguccagcucuguaaguggggugugaaggaagcugcccgcccugagcauucccaucgaguucccugccauguuaagaacaugaaggguggggaucccagagaaguccacacagcccgggggaccugguucugcuggccccccacagggacugaccugguuccccuguagguuuagccucugcaggcuggccaggcuggcaaagguauaggguggaaguucuugcaaggcauuguccugcagaagcaacgucugcagggacccuaggacuuugguacccaguucuaaugcuuccagcacauuguggcucaaguccaaaagcaccaggcagggcagggaguccacuugucgagccucaaaggaucgcaggcaguuucugcugagguugaggaagcgcagggaggucagguguucaagaaagcuagcagggaccaguucgaucucauuguaacucagauccagguucaggagcugggagagagggugggugcuggcauuccggcugggguuggacaguggagaggcugaccagccuucagagggugcguggagguccucacugccccggggcagccccgcagggagcuggaugagguuguuagacacauucagguagaugagucucgggaacacggccaggucagggaaguggagcagcuuguucucccggaggucgagccaggccaacuggaacugggccugugguuccggggccgucuggaaggccucaaugcuguugcagcucaagucuaguaccugcagcugcuggaggcugaagucugagaugcaggugagggaguuucuggagagauugaggugagucagguggggcagggccucaaaggcaccguccucgauauccaugaggacauugcuguggaggucuaauugcuccaccgcuggcauaccccagaagguguggcgugccaggcgagugaggcuguucuccgccagugagagcguacgcagccucggggucucacccaacagucgcuccaccagauugccaugcaggcuguucccagacagguccagggagaccaaaaggggcaggcggcccagaccaccacuguugagagccaugccuguggcaagccgauugugggccagguuaaggugcuccagguagggcagggccuggaagaccccagccuggaggaagcuaaucugguugucacuuaaauccaggugacgaagcgcuguauagaagcccaguggggagaccaggaugcucugcaguugguucccggacaaguagagagcuuggauguccagugagagcaccgaggggaccuggagcaggccaaggccguggcacaaggccuccuuguucaccuagggagagcaaggguggcagagaugcuggcauuaauggggacaggacaguagguggggacaggguucuguaggaaagaugacucgcccucuccccaagcuuggggugcuucccccagagucccaggauguuagccuugccuccacccaagcugaugccccaagcugcucucuggcccugacuggcaguccugcuggugcugggcagaagggagcaguagacagagacauaguagagagcucuaagaauacguauguguugacuaguauccuguucuaugggaaacuaagccauauuucacucacagugaugcagaacagaggggcaacauggcccacagcuuccaguuucacaccuggguccuugccacaucccagauaaaauucuagcuuuaggcuggaagcgucaucaggaaaagauguuugcaacagggaaaccagcaggcuuuugugccagcccuuugauuugguccagccagcacagcucagaccacauuccugcugugacucguuccuuucugcagcugcuaaauaccaccauaucaguggccugcucugguccagcacagcauccaggucguaggaguaaggagacagaauagaauaaagggauaccagaacccaacggguuaucugaugacaauuuaacugaaagaucauuaacaggacacaucaacauugacacuccaguuccuuaucccaaaauuaacuuguccuucccagcaccuacuuaauacaucaggacuuucagacuggcgaucuugucagagccuuacaacagcccacccagugcauauggguaaucugauguaauuauagauuuuuaccaaaauccagguuggagaggguaagagagacuucaggaccacccagcugauauggugggaguugggauucgaacacagggcucuuagcaacucguuuccuuccacaaaaugcaucguuaagggucauaauucuaugcaaaugcacaucuccaucugguggcucccagauucucaccccaggugccccugcccucccuagcaaagaguguaaugucuacaucagccagcuuaguuuuaccccugccccuagccugucuccaucgacccccacugaacugccuaccugcgaaaggcccacagacuguucaaacuccacuuugccuaugguacucuuggcuuaaacacagagcaggguccaucaagucugucuguggcauugaccaaccugucgacugacucacugcaguccaguuuacaugcagugaccaugccuagcacuggucccacccccuugcacagccaucccuggacaugcauggagcagaccuguaugagaauuccucacggggaaucccaacaugucuuccacagaggcccucccuaacugugucuucucccuacagcucaguguccuggaacaaugguggaauggggacccgcagacagugagcucugcacggacaggggcuacuuugauugacauggaugucuuggaccuggcccaaagaaaguccuccggaaaugucuuuuaugaaugaguugcagacaucugugcuuaagcaaagggccuugauccaaucaaugccggaaagaaaagagcuaacccagauauucauauucaagccagagagagacauuagaacggagugagccagcccaccugcuguccagaugcugaggucagggucugcccuggcaguaacuugccugugucacagggguccaguggcugagguagcaaggaagaaacacaagccuggcaucccugucugaccuagcucugagccuccuuccccccagaccccccaggccgggcaccgucuggcuaugggcaccugugcaacugccuacugcauaaaauaccuugacaagccuuguacuuccagaaaaagcugccaccugaggcucuaggagacccaauaacaucccucaccaacacccauagaaacuagacaccuacuugacacuuagcuccuggaccacccugcuguaagcagcauugagaugagcucaaugcaagcaugaguuucuuuuuguguaaacggagccuucagcugcccagguacucaggcuggcugaacaaacaccaccagacacuauuuacuaugcauuugcagggugcaugccacgcuuccccauguaagcccacacccauggacucucccuucuggguaagcagaggcucuccaggaccccagcuccaaagggaccaugacaggaggugacauaaccugagaccaccuaucagaaacugcagagguccaggggaguaccugguacccuccucuuugauccagcccagacuucagaaggagccugaaggacuggaccaucucagcacccucccugcccuuauugcugagcucugacugacugcuagaagucucuggugcagagauauaggggucuuggcugggguuuagcauccuccuucacucugccaugucagucacugaucugcccucuuccugaggggggaaggaacaugcuauccaacuucacuucccauccauacacaagaggagagguucuggcagugaacugcacagggggaacaggguuugaauccugucucugucauuucugcugucggagcccacagggucacaugucuuuucugcagcugggucuagagcucuuucugacaguucagaaagucuucuccuaucucaugcuucucagagagccccugcuccaugcccucugucuacaggugccagaguccucaccauuuaagaccucaguccgccaaggcugugggcauauggugauaucugaggucuuugcucucauuagucugggugugagacucucaggaugucucuaagaaagaauuaguggccacagcagggcacacagaccccaggaaauggcugcuggcauuucuggccucuuuacacaguuaguccauucuaugcccaagugcagcugguggugugccuguccugcuuugcaaguauuccuagagcagcgguucucagccuuccuaacccuguaacccuucaauacaguuccucaugcuguggugaccccuggccagaaaguuauuucauuguuacgucacaacuguaauuuugccauuguuaugaauucuaauguaaguaucugauaugcaggauaucugagcuaaacccccuuaggggucgagacccacagguugagaaccacuagccuagaggguuuuucucccuauaccucacagggucacaaugucuucagccuguaugguuucugcccccuaggagcccuuggucggcuggguaagacaguuuuuggcuauggaugaaguagcacauauccuccgucugcucagcauggagaugggggaggacacagagccagaggaaggagcaacagaagaaaucagcagucaacggugggagagguuuccugagcaagguggccuuugaccuggcugcaaugagggaggagcauucuagcaggcaguccaaguucagggucccagccagggaagggcuauguacccgggaagaacaguacagcggagccuuuccagcuuguguagcccccaggaugucccaaaagaccaaucacuuguaacagggaauagagggccaguggccccacggucccuaacugaauaaccuugcuuaggucaccuggccucuccaaacuuccccuucuguaaaauaggaacaaaugcgauuguuagguagacaggcuucucaacugucuaguguaugcgcgacaaauaccgaggcaaagcucuauccuuugcuggccccacuaaccuuugaccuggacugggcugugggaccccucacucugccugcacugugucuuaccguccuacagggcacuugcucucgacgcugagagauagccaggcccagggucagcauggccaggaguagcaggaucugguggcucaug

SEQ ID NO: 3955 - RNA, 15145 nt, Mus musculus
ugugggaaggaggcgguagcgucccgggcgggcuggaggugcagcagcggcggcggcggcgguaaauccucccggccgcacacagcacuguggagccgcggccccagcccagccucggcccgcgcgccccuccugccccucgcggcuucgcgcgccagccccuccuccgcgcgcggccuugcggagccggccggccggcccagcuccccuccccggccccgcggggcggccgcgcugcccugacgaggcggggaggggagggcuggaccggccggcggccggacgaccaugccgaacuucugcgcugcccccaacugcacacggaagagcacgcagucugaccuggccuucuucagguucccgcgggacccggccaggugaguggggcgcggaagcuucagggacuugcgcgcacgugcgcucgcgggcacccggcccagugggugccacccgggggcgcgaaggcggaugaagugggcgcuuagcgccuuuggugguccgacgcgguuccuuagcugucaaagaaguaacccuucuccagggcuguguucccaggggcccugccuucccccgcgucacuggucucuucuaggacaguguuucuguuuggaggcgagccgcuuucuuugaucuuaaaucaggucacaacugccuccuucggacuugucaacccaguguucaaaugccgaccguuacucauugucucccuugguuguugggaccacagaggacaagugugagggcgugggaauaugguauugcaacuucacuuuuccuugggguaguuuauaaucugggacguagucugagaaucauagggacuuagugugauagacugcagguaguucucagagcucuccuguuggcucauucguuuaaaaaucagugcuuaaccauguuugaaguacucaugucaggugcuggagacucgagugaauuuugucacggacggcagaaagcaccuaauccacagagagagagagcagaucuaucaacgagcgcugaauauagcaugauauuaauugagcaaauauuuauugaaagccgacaguugguagaaauuggucagaguaugagaguggguaacaugaaccaaugaaaaucccucuucucagagguuacauucaagucuugggaaauuggcaaguaaaauauuuauaauaccguguccaauaaugaaaaauauccugaagaaaaauacagcagggguuggaagggcuuuuagcuagggaacagguggaaagauagcucaaugcugaagagcacuuauacucgcagaaggccuggguucuauacccacauuaggugacuucaguuccaggggauuacacaaccucuucuggccuuccuguguaccagguaugcucaaagugcaaaacgcucgugcauauaccagagcagauuaaagaaaaaagcauagccagggagcugagcaguggacauugucuguuaucccagcgcugaggaggcagggagaauugagauuugaagcaggccuggguuagaguaaguuccaggccaguuagggcuguagugugagucuugucucaugaacccguuuaaaaaaaaaaguauaaaaaacggaggcacaguuucuauuuuaaacauaacagaaaaaagucucaccauaaugaaucugaacaacaacaaaaaaaaauugaauuggggaaggggagagcugugcaauauguuggaaaagcaucuggaaacaguaagagugaagucaaggcaugcuugcugaugagguuuauaugggagacggaaauuguuuaggaaauuguuguccauggaagauauucuggugguuauccugagugaagugggagaguuuagagcugcaagaguucuuaacaggauuuuuggcugcuuguuaguuguagggaaguaaagauaugagcaggaagaccaagggaagacuguugcaauaauccagaucaguagaagaggaugaagagggaaauugaugccuuuagauaagguuugaagaugaagccaacaggauuuacuaguaauuuggaugucguuuauaagagaaaagagucaagacuaacuucugagauuauguguggguaugggguguguguauguggaggccagagggcauccugugucuugcucuauuccuccuuuaagaaggaucugacugaaccuguagccagauucagccaaccccagcaauccuccgucuccacuccccaaaguguuagaguuacagaaguuuuuaacauaaaacaguuacugacauaagaaagauuggaguauuagucuguucggaagauauuauaguuugauuuauagugugauaccugguaggcuuggacaggcagagaugucuucagccagaggauggaguuuagcacuaaagaaccugauuagcaugcaugagguucucgguucuguccccuguacugggggaaauagaaauaccuucauaccacaugugaaaaugaacuucauauggcugcuuucucuuuuucuacauugucaucaauauuugucucuuuuuuccccccuaagaugguuucucuauguaacccuggcuguccuggaacuuacucuguagagcaggaggucugccugcuuuugucuccuaagugccgaaaucaaaggagugagccaccaugcuuggaauagauuucuguuuugguuuagaucucuuuauaaauauguuuauauauuugaaucgccuuuggaugugugguugauggccuuuuaaaauauauucauuuuauuaauuuauuuauuggagacaaggucucauucagucuagccuagaauucacuauguaauccaggcaggcuuugaacuagcugcaauccuccugcuucagucuccucagugcuggaauuauaggcaugaaccaccaugccuagcuuguuuugauguuuaauguuuagauuugacagucacuugaaauuuauuuuuguuuauguuguaaaauuacuagucaagguuuaguucauaaagauaucauauucaguaugauuguuuaaaggacaaauacaucuucacuucuguucaagcuacuuugagguuuuuaaaagguuuuuuuuuuuuuuuucaguuuagggauucaguugaaucaguaaaucaguuugggggaaauaauguguuuagaguuuguuuuuguuuuuaugaacuuauguaccucuguuuguuuuuaagagagacauuauacaucuuucccaauauuuauuccuacauguaugauauggaaacacauaggauuaaucacuugggcuuuucuguuccauacucacucaguucuugaguugauauugguaucaaaacacuuuuaccuuagagauacuguggacagcagugugucuguuugugggaucuccagagauuaagaauuuacaaauguaacuauaagcuggguggugguagcgcacgccuuuaaucccagcacuugggagggcaggggcaggaggauuucugaguucgagaucagccuggucuacagagugaguuccaggacagccagggcuauacagagaaacccugucucagaaaagaaaaacaacaacagcagcaaauaauaauaauaauaauaauaauaauaauaauaauaauaauaauacauauuugccuuaaaacaaaauuuggauuuuugaggucucacuauguggcauugccuggcuuggaacucauugggaucucccuucuucugcuuuuuagguacuaggauuaaaggcauguacuaccaugccuggcauaaauuaauuauguuuugaaauagacucuucuauauagcuugucucaaauccagagucucccugccucaaccucccaaguacugagaguauaggugugugccacuacgcccagcccagaugcuaaaauguaaaguuugaguuuauaguucauaauuauauuuugauuuuauuuauagaugccagaaguggguugagaauuguaggagagcagacuuagaagauaaaacaccagaucaacuaaauaaacauuaucgacuuugugccaaacacuuugagaccucuaugauuuguagaacuguaaguaauagccagcuuggcuucucuucucuccuacagucugguuugcaguguaaauuuuuauuuauuauuggaauguuaccuauauccuaccauuuaaguugaagauaguuuggaguuuaauaguaucuuguucucaaaaaugugauuuuuuuuuuuaaaacccucaguuccugaugccccaucccccuucacuagaaguaacaacuuuuaaguguauagaaaauauacuauggguauguaucucaagcaguuuuccuagaguucuguuucuuuaaugugguucuggggauagaaccuggagucuucuacauuaggcaaguguuuuaccacugagucagccccuguuccucucuagagcauucuugugaaugacaguuccauuuagaccauugacuuuguguuuaugauuugaauguccucuuaagaagcaacacuuauuuuguuuccacuauuuaauuuuggaaggcuagcuaaaagaagagucaggaucacacaaguaacaugaaaaauauucuccugccccgauuuuucccuuggcccugauuuuaaagauaccagaucagguagccuuuuugaaaucuuacaauuucuaauguucuugaauucuguuauuacuaugauucauaaaagccagugccaggcagauuugauugacauguaugaaccacuauagaaacuaauaaggaagagcuuuguaaauccuuaguguucuuacuuuaguauaacuaacauuuuauguuagguuugguauagaaauaaacuuaaagguacacuauauauuacugugcagcaauuuauuuuaauauuuuuuuucagaugcauuuugcagaggcaucagaaaacuaaagaaugauuggguuauuuuauuucucaauauuaauugaagcagauacuugugaagucauugggaggugagccaauucugguucaacaauuuaaucacaaauacuugagggauuuuuuuauuuuuuuauuuuuuugccuuguuuuauuacaagucuaauacucuucaguccaaaagucucauauguguaaaaggcaaacuacuuuuguguucuugacauucaguaaaaauaucacaaaucauuuuaaaauauacaagccuugcuuuuuauuuuaguauaguaaauaucucuuaauuuuauugagagauaauuucaaugagauuaauuugaaauuuuaagauauagcucacuauuguagcugacuuuauucagcguauauaucagaaagauuagcuaguuuuguuuuucccaaaagauucuuucaucuuauauaaauuaacccaaaugugggaaaauuuuuuuucuaaauguguagaacaagcagauguugaaagccagcuuguacgauaauuguauuaaaauauguaagcccuuuggcuucauuaguuuggcauuuaagaucuuguuaacauacaugaguaguucugccaaaaccacaauuuuuauuaucuuugaugcuagaguaagaucaguguuguuccuuuaaauugccaaagaguaaaccuugguauggaguuaaaauuguucaugugaguuagauacaaucuuuugacauauguauuuauacauuaauauagaaugucccaguuuucauucacagucuaguuuuucuuaucuuugcuuugacugcuagauuuaaaauuuuuaaauuguuuagaauaucuuaucccucccucaaucacccagccuuuugauguugacuguguuuauuuugagacuuuggcuuagugagaaaguggaaaaacuuggggaaucauggaguuugcuuuccucuguagcuuuguccacaccaaucccaacucagacuuucaggugacucagaguucuaguccagcauagaaguagaguaucacuuagaacuuacauuucagcuuggcauggugacucauaccuguaauuccagcagucgggacgcggagcuagaugggauuaugaguugagauccaucugagcaaauacagugagaccaugucccaacauaccaagaaauuaaauauaguaauaauaauaguaauaaauugagacuuccuuuugucuucugugaugugugagacugaauuagaaaacauuuaacucugaguagcaguucucccugaguauuucaguacucuuugaauggaacccagagaauauguuccacauacauauauuuucccgugcugucuucccaaucucccuuaccaagguaaaaaaaaauuuagagagaucauuuuuucagaagucagcuuugaaaucgguaguaccaaaaguucuuucaaauaaaagugugcuuuguguuuuucauuguagcuagagggagaaauaaaaggcacugucucuuugaauuagagagcaggaauaauaguuauuuauaaguuacucuccuuaauuaauuucuuguugucucagcuuccucuuggcucacuauagaagacugucacuguguagguuugauugaguccagcuucuggcaaggcacaaguaacaaggcagagagagucucuucuccagugauaagaccauugggacaagaagggaguugagacauuccugauugaauggugguagaauugugauuauguauuuuguuauccuuaauuuguuaaucauuucauuuuggaaaauauugaacugaaccugacucauauuuagaaaaagaaacuggagucuauaaacagugaguuaauuuaacuagagccucuuagugagucauuggucaaguuauuguuauuuucacugugucuugaaauuucccguacuaacaacggcaguggagugaacagcagguaaggagggagcauugugauugaauaagaagggcauagauaaauuggagacgugauuccuguagacuugauagcucauggaagggcagaacagccaugaccuccauaagggcagggaauuuuucaagucuauacuuagagacagguaaagaaauacugggaagucauuaguguagaauuuuauuuacuuuuuuuuugaaagaccaucucugaauugauauauuuucuuuuucagaguccuuaucggacaguccuucgagauaaugcaauaccaacaauauuugaucuuaccagucauuugaacaacccgcauagcagacacagaaaacgaauaaaagaauugguaugucuggcucuccagcuuucccaucuccauaauccuauuaaacaguguggaagcauuuguuaacaguuuauccaaguuauucugcgucucacagggagcgugcagggaaaugagugcugggcuuacuaagaguugguuaaacuggaaaggcuucuccaguaccgcugguugguguuguugaguugggguggacgcacgcuguuggcuaugggccacuagcucccagcuuuccugagcucgguagcaaagagaacaaaacugccguguuuccagaaggcagcacaaagaaauaaagaaaaggacaguauuagaaauggagaucuagauuguuuuagagauaaggauuucacuguuauuuuugacagguucuagaaaaaguugaaaagguuuugcauguuguaugcuucacucaugugcuuucauaaucuccggguacuuuuuagacuugauagcuaaaauagacuuauuuuuuguugaccuugggugaacacaauacugacacauugccacuaucaagacccuuuuuguuuggauugguuuauguaauuauuagugugcacgcacauauugccaugcuauguauggaaaccagaggacacauuuuaggaauuggucuguccuaccucguaagacaggagacauuaccugcuaagcuaguuuacuggcucagcuccucuuaucugguauugaagacaagauccuguuagcuccucagaggacugguugguuugguuugguucaagaaaaacuugccuguuguagacacugcuccugaaaguuagaggagacucacugaaguccucaggacuuggaauggguguggggugguuuucuuugcuugcccaguuucucccuuuucucucucuucuugugguuuaauuuuguuuccaaaaguuuaugaucuuuaucuagaauuuuuuagugcuucucuuucucuguuccugaaacuccuucagcaguguuuuggaguugguaguuagucagcgucuacuguacuuguuugcuuccuaguguucucuugauuuggggacauacuuuuuucuaagcuuccugaauguuuuggcucacaugucuauacccaagccuguuugaaggugugaugcucucccugcuuagcuggcaguauuuuguaauuucucuuaguucuuuagcuacagcucucguuuuguuuuuaaaaccuucuauuuuuuuuucaacuguuaagugaugcauagauaguuuugugugucuccauuguccuugaagucuggugcuauccugauuccccucuuccugaaggcuuccuaaaguuuuuuauugugaacauuuucauuuuauugaacuggccagaaauguagucuaauacagugcuugccuggcauuugcagggcacugacuucaaucucaagcacuaccaacccccgccccuuuuuuuaaacaacaagugacauaguguauuuucauuuccuuuauuauccagucuguugaccauuuacaucucgugacuuaaccguacacacuuuaguuuuguuuucccauccuuuucucuggcgucguuguaggugagguggcccucgcacagcagucaucugcaccagauuucuucugagugcucugucccacagugaagagcucagccucuucagguuuccagcuauugcaucccuaacucugccuuucacagcaggcaacuuccacuuggcgugcuuuagcugcugcccuccggauuaggagggauguuccaguuagccagccugcuaaugcuucuuguuaguagcaguguccagagcugccauuagguaccaggcuguccgagguucuuguugguacuguuguuuuccugccacagauuaugauauaaauauuagauagccuugaggcucggagaguaaaagacagaucuggaguucuuucucagucuagcugugauuguauguuugggacacacagaguaaguacacucuguguacuuaauucucuucugcacugacgcugucacuuucugcuuccuaggcacuucucauugguuuuuuuuguagguucugugaugcagaaggcuucuuguuuugugacaucuuuaagacuagauuuggaagaggaaucugcuguguccucuugaauuugaugcuaagugcuauguguaguauaucuucaucccauuuauuacuuaauacacagucaucuaguuaggauacucagggagaaaguaggugaaagagcacgcgcuuucucuucuaguacuuuacucuagcuuggaaucaugagcacauuacacaguugguucccuagcgucuguuugaagaauguguuccauauggagaauugaugcucuuuggagcuaaggaugaugaccaguugauuaaagugcuuguauagcaagcaugaagcccuggauucaguuccuagcaccacagaagccagcaccugagagaugaaggcaagaggaucagacguuuaaggucauccucaguuacuuagugaguucaagaccugccuggaauacaugagacuuuccuuaaacagcaacaguaacagaaccccucaaacucuugaaugagaaauuuuuuuuuugcucaaaacagccugguauugaugauugaugauugacuagaagugauuuucuuaaaauguuuucuuuuuuagagugaagaugaaaucaggacucugaaacagaaaaaaaguaagugauaguguuaaugacucagcuucucaaggccuuuuaagaaggccuugaccugguaagaacaacuaaauauguuuucuuucuacagccuccuuuaagagugaauguaaaagagugguuggcucuauccccgcagccuggaauuauuagagacuacagucuuugcuuggaauugcugugcuauguacauugcuguugcagagcacagagggagcgagcaccuucuguccucgaggugcucucagcgugguaguagugacagaccacagagugucccaguacggaaggaaaggcuccaguaaagccagccagcccaauuacacccauguaccuugugguccguauuauuucuuggcuuaaggaauaaaugcuguggaggcaguuggugcauugggugucaugguuacaaagucuuuuuaugugcugauguguaagcugugccauuaaaaggagaggcuggaaguuguuucuguucuuacaguugaccccauuucuccuuuaacuucucuugcuacuacagcugugcguuuggauugaugccauucuguccuucugguacuuuauuugauuuucacaguagcuccgugauaaguaauacuguuuuccuucuuuguagaugaggaagguauucuauacaaucauagaguaguguaaaacaagcugcuagauugaaguaaccgcauuccuuuagaugccguuagggauucugauagccuaagguguuuagcaggugagccagaagagagagcacagcauucagaacuugcugaccucugagcucaggugacuggaagugaaggaguaaaggagggcagaggggagguaaggauggcaaggaagcaggcauccaggguagccuuucuugcugggugguuauacaaaggauggcuggaggaggaacuggcccuggccucccugagcccugcugagcucugagagccugggaugccuagaagcacggcuugcgaagucucagucacacuggacuuugcucaguccagggaaccugcuugucucugccaccuuagugcuuugacuggaguauuugugccuucccugcucguguccuucauacucaugucauugucaaaugcaaccuccuguucagcuguuguccuaguuaggguuuuaugucuaugaagagacaccaugaucacaauucuuauaaagggcagcauuuaauugcggcuagcuuacaguuucagagauucaguccauuaucauggcagaaagauuggcagcauguaugcaggcaugguacuagaggagccaagaguucuaccacgugauccacaggcagcagaagggaacuguacugcaauaaggcuacguuuccuaauagugggacucccuauggccaaauauucaagcaaucuaugggagccacuccuguucaaaccaccucagaugcuuucucagugaugcuauauaauuuuugguggccuucucauagaucuagacuauaagaacuugguuuuuaaugguucuucggauuuuaauucuuuuuccugaagccauuauugaccugcauaucuauagacaggacacuuucccuguucagauaugaagagacuaggcugagcuggcuaauauuacauuagccccaccccaucaugaaucuauauaucaucugguuuuauagaacuaucuuacauauagaagugugacuuagcuguuagauagaaguggugugucucugauuuguggauuucauuucuaucccuguaacugucuguaucuguggccuugggcaaguuauuuacaguccuuauuugucagagggauugauaccaucuuccugaagaaaguaacgugauccccguaaagugcuggccacagugccuguaggaaugguuguucuccucaccuuccuuuuucucauggcauggauuuuguuuauuaaaaucugucugcagcauuugucccuuucuaacuuauuuuuguguccuacuuuguuaauguucuauuaguggugaaugaaugcauuuguggauuuuaaauauuuagccaaucaaaaguaauuuguuuugucguuugugguucuucaugagucuguuuauaaaaguaacuuuuuguuuuccaguugaggagacuucugaacaagagcaggaaacuaacaccaaugcucagaaccccagugcagaagcggugaaccagcaggaugcaaaugugcugccuuuaacccuugaagagaaggagaacaaagaguaccucaagucuuuauuugagauucugguucucaugggaaagcagaacauccccuuggaugggcacgaggcugacgagguccccgagggccucuuugccccagacaacuuccaggcgcuccuggagugccgcaucaacucuggcgaggagguccuaaggaagcgcuuugaggccacagcggucaacacauuauucugcucuaaaacucagcagaggcacaugcuggagaucugugagagcugcauucgggaggagacucucagggaagugagggacucacacuucuuuuccauuaucacagacgaugugguggacauagcaggagaagagcaccugcccgugcuggugagguuugucgaugacgcccauaaccugagagaggaguuugugggauuucugccguaugaagcugaugcggagauuuuggcugugaaauuucacacuacaauaacugagaaauggggauugaauauggaguauugucguggucaggcuuacauuguguccaguggauuuucuuccaaaaugaaaguuguugcuucaagacuuuuagaaaaauauccccaggcugucuauacccucuguucuuccugugccuuaaaugcaugguuggcaaagucugucccugugaucgggguguccguggcuuuaggaaccauugaggaggucuguucuuuuuuccaucgaucaccacagcugcuuuuagaacuugacaguguaauuucuguucuuuuucagaauagugaagaacgggcuaaagaacugaaggaaauuugucauucccaguggacaggcaggcaugaugccuuugaaaucuuaguggaucuccuacaagcacuugucuuauguuuagaugguauaauaaauagugacacaaauguuagguggaauaacuauauagcugggcgagcauuuguccucuguagugcagugacagacuuugauuucauuguuaccauuguuguucuuaaaaauguguuaucuuuuacaagagccuuugggaagaaccuccagggacagaccucugacgucuucuuugcagccagcagccugacugcaguacugcauucacuuaaugaggucauggaaaauauugaaguuuaucaugaguuuugguuugaggaagccacaaauuuagcaaccaaacuugacauucaaaugaaacucccagggaaguuccggagagcccagcaagguaaccuggaaucucagcuaaccucugagaguuauuauaaagacacucucaguguuccaacaguagagcacauuauucaggaacuuaaagauauuuucucugaacagcaccucaaagcucugaaaugccuaucucugguacccucagugauggggcagcucaaauuuaacacaucagaagagcaccaugcugacauguacagaagugaccuacccaacccugacacgcucucugccgagcuucacuguuggagaaucaaguggaaacacagagggaaagauaucgagcucccguccaccauuuaugaagcccuccaucuuccugacaucaaguuuuucccuaauguauaugcuuugcugaagguccuguguauucucccugugaugaaaguugagaaugagcgcuaugaaaauggacggaagcgucucaaagcauaccugcggaacacucugacagaccagaggucaagcaauuuggcuuugcuuaacauaaauuuugauauaaaacaugauuuagauuuaaugguggacacauacaucaaacucuauacaaauaagucagagcuuccuacaauuaauucagaaaccauugaaaauaccuagaagauuuuaaaaauggcuguuaucuuauuuugcuguuuggaagaaaagcuguaagguauaguaggccagauaaugacuugcugauagaccuccaguuuaacauacuauuagcuauugguaauccacguguuuaaauggccccuguuugaacacucaugcuuucaauaccugucuguucuuccagaaguuggcauuaggagugccaaaauaccucugcugguggcacucugaaaauguuuuacuuaaaagucguuuuaggggcuggagaaauggcucagcgguuaagagcacugacugccuuuccagagguccugaguucaagucccagugaccacaugguggcucacaaccaucuguaaugggauccgaugcccucuucuggugugucugaagagagcaacaguguacucauauacguaaaauaaauaaaucucuuaaaaagucauuuuagauaugacauuaucacugucgauccaguugucaguuauuaaguuaucaggucuuuggaaaaugaauuuugugagagaaauacauuuuauaaugugucaugaugaaaaacaccauugacuuugacuuggaguuucagguguuuccgagcugugguagcagcacuugggaggcagaggcaugaggaugacaggcuuuaggccuggaccacauagugagccugcuucaaagaacgagugagggcugacugggguggagccuaguguggagcucuugccucaguacucaaaagcaaaaagaacagcaaaagucacaggaaguaacgagcagccuucuguguagauccugucagggcagaagaaccucaaaggaacaaguuacaguagcagagccagcccugcugcuccucacuugauugcugcuguuugcauuucuuugcugagcccacauuuucauaggcuuguuugcuauucacuugugcuucauggagaagaaagacccagaggccaucccuauaggcagcugacuugucuguugucuccuuacaugacugugucugcugccuuggcucgguuauaagcaaaaccuacagaaauaaauguuuugugguuuaucuaaaaauaauacagaaaauauugcuguuauuuuuggugaauaaaaucaauuuuguauaguuuauuucaaccuaaauaaaaugugaauuuuguuuaaauuucaggugagguguuuuuggugggucagaauacauccuuguauauuuucuuaaaaugguuauuucauaaucagccucaugccuuuuacgauucaagaugaaguauuuucuagcuuuucucuuuucuuuuuuauuuuuuguuuguguuuuaaaguguagaaaaauaauuaaaaucaagaaguua

SEQ ID NO: 3956 - RNA, 69693 nt, Mus musculus
ccuugcugagccgcaaaaaaggguggggccgccucucugcagcagaagacgacagcggcagcggcugcggcaucaccggggguauagauagaggccguuuugcucucugcucugucuggguuggaggugaccgcugccaagccucgcuaggcggccggcugaaccagacggaaaggagauaaaagccugcuugcggauccuucccugcgccauggcuuaagcccacagccucuuugccaagcaucuccuugcucugccggggucugcuagacaccgcagucgcagagagggcgcgcccagacgcccuaggccuggacucugggacgcugagccucgcuccuauucuucacugcccacagcagcuccucugcagcaggcguuugcagccggcaaucgagggacuuuacggacuuuaucucagcgguaccuuguccccgggugcucuuugaggguggaggacgaggcaaagggcuucuaagggaaggaagcggugggaaccacauuggcgggucuggguugggguuaaagggagauuggagauuugauuuaggaccacaaaaaggcuuuguggcuaacauggcguggccgugcaucacaagggccugcugcaucgcccgcuucuggaaccagcuggacaaggcggacauugcggugccgcugguuuucaccaaguacucggaggccaccgaacacccaggcgccccuccgcagccgccagcuccgcugcagcccgcguuagcgccccccucgcgugcugucgccauagagacgcagccagcccagggagagucggaugcaguugcccgggcaacagggccugcgcccgggcccagcgucgaccgcgagacuguagccgcccccggccggagcgggcugggcuugggcgcggccucagccuccacuuccggcucaggccccgcggacucggugaugcgacaggacuaccgcgccuggaaagugcagcggcccgagccaagcugccggccgcgcagcgaguaccagccguccgacgcgcccuucgagcgcgagacccaguaccagaaggacuuccgcgccuggccgcugccccggcgcggggaccaucccuggauccccaagccggugcaaaucccugcgacuucgcagccuucccaaccuguucucggggugcccaagcgucggccucagagccaagagcgcgggcccaugcaacuuucugcugaugcccgggacccggagggugcuggaggagccggggugcuggcggcaggaaaggcguccgguguagaccagcgcgacacacguaggaaggcagggccagcauggauggugacucgcaacgaagggcacgaagagaagccucugcccccagcccaaucccagacccaggagggugguccugcagcuggaaaggcguccggugcagaucagcgugacacacgcaggaaggcagggccagcauggauggugacucgcagcgaagggcacgaagagaagccucugcccccagcccaaucccagacccaggagggugguccugcagcuggaaaggcguccggugcagaucagcgugacacacgcaggaaggcuggacccgcguggauggugacucgcacggaagggcacgaggagacgccgcugccacccgcccagucucagacccaggagggcggccccgcagcuggaaaggcaucuggugcagacgagcgcgacacgaggaggaaggcggggccggccuggauggugcgucgcucggaggggcacgaacagacacccgcugcccaugcccaaggcacagggccugaaggaggcaaggggcgcgcgguggcagaugcccucaacaggcaaauccgggaggagguggcgaguacaguaagcagcucuuacaggugagacuggggcagcaggugaugcuggucacccucauccccucgcgaggaccacccauucuacccccacaccgaaagcuucgcauucagcuucuucuccagggccagaccacacccucuucagccacauuccagaacccuuucaacccagacuuuacugccccacccugucggaaagcccuuaacaguuuccacacugguuuucccagcuuguuuuuugugccaccccuaagccacauuuuccucuuggcugccuagcucagcucccuaucugccccacagagacccugucaguuucccccugucucaucaguucgccugcugucccagccuggcucccguccccuagucgccuccacucauucacuucucacuuacuuccccgugagacccuuucuccuccccagucucuuacauuguccuggucucuuccuauucgauuccucccccaguuccuggcugacacucaagcgccacacccuuuuccagauuucucuacaugcuccuuaauaacuggcucuaguacuuugaagucauuccccuccugccucuucaguagcuuugacacauugggcgagcuuuuuaaccuuccugggccuucacauucuuaucuguaacugggaucaauaauagucaacuuagaacuauccacacaggacugauuuaagcugagauauucuguacaguuuugaggauagacuaaaugccaaacauggcucuagcugauggaaagauggaaagagaugacucgggaugacuggccaugccugagauguagugagaggucuuguuuccauuuauacucuccuaugugaugcccccuuauucuugauucugcuuccuggaugucccuagcccucuucccuguugaggcagcuccuuucuuccuuuguguucagauguuucuauuuuuucuuuuaauuaauuaguuaauuaauuaauuuacuuauucccuuuacauccugcucacugcccccuacaguccuucuccccaugccccacuucuucucuaaguggguggggucucccccugaguaucucccuacccugguacaucaaguuucugcagggcuagucuaauccucucccacucaggccaaacaagucaacccagcuagaagaacauauuccacgaacagccaacagcuuuuugggguagcccccauuccaguuguuugggacccacaugaagaccaagcugcacaucugcuguauaugugcagagaggucuagguccagcccauguaugcucuuugguuugugguucagucucugagaaccccuaaggguccagguuaguugacucuguugaucuuccuguggaguuccuaucuccuuaggggccuacaauccuucucccuauacuuccacaagacuccccaagcuccauccacuguuuggccaugggugucuguaucugucugagucagcugcuggguggagcuucucaaaggucagacauuaaugugucccuuauccucuggcacauucacguuccuugaaaaugaacgcuuucaaacuuagaaacaucccccaucuuccuccacgcacacccuguuuauacaauucucccugugcugcaugcagccuuggccugcuuucucaccucacauccauccagugcacaucucugaauguuuagcuuuugggccuuccuuuauguuucuaccaacaucagcuagcugauagauccuaguugacuugaacauguagcagcaccgggcuuggguacugaggaagcagaugugugugauaaugauggagcuggccuugugcagcugugacuucugaggucuucauucagcuccacagucaguuaggugcccuuuuccuaaguguggaaggaagggcuacagaguuagugucuucugcuaacccugugugugggcgcuucaguaggcucugcaggcacuccucucaugcagccagaagacuggcauaaauagagacucuauuguuaaggcaaaagucagagcccugccucagaauuccauggcuuccugcauucugguucccacuagguaccucucucuggguuaacugauaucacaaccagacugaccuuccagcauuaguauauuacuuccuuuccaaggucugggucaaacaaggacgaagcuccuuuuccuuggacagccacagggaagugggguucucauaauaauguuuauacuagcacuggaggaucaaaagagagacagaaacaaacacccacaagccaagaugaaugugaguuucugauucugcccugguacuuguguucacaaauccuaguucauuuaucugaaagguuggucuguggguacccuggcauuggauuccugcuuccccuuucaucuuccacucugccacgcccugguggguggaaccuuacggguggaaucuggcgaguggauccacccagcaggaucugccccuucucaccuucauagagaucaagccaguuggauucagagagccaaggcucccacaccgccuugggugauccugcucaguuuauguuucugagcuggcuggaguuguucuauuuguggaagcugggucagacagcucgagaaugagcccgccccucagaugcgacgacucacuucaaauguuggucugugccuuuguuccaaauagcacucuacccugcaacaaagccuuaccugugguaggcaugcaugcccuuguccacuuuccaauuacacaaauacuggcugcuuagacucguguaggggacacgagucucuugaagaucgcuuuuaucugcugucagaauucuaucaacuuauuaugaacaaucuuugaacaccucgauucuuuuuaaaucacauuuucuguaaaguacauauauuugacuuugugaccauccaugcccuuuuguuguauuuugaaauauuaagaacaugugucuuucuaaaaaacagacauuucuuuaaugaacaauuugaauuuaugacaaauuuguugcaaaacuuacuuuguugcuguuguuccauaagaaacacuaaucaauuccagggaaauggacuuuggguggaaguaucuguaaagaaguaauauguucuauaaauuaacauaacauaguauagauaaaaaaaugucugggauguauagaccuauuuggaacauuguuuuuuuccccuccccuauugucugacuuucuuuuccuugcuaugauucuggagagcucuuuaguuuaaauauaccccauguccauuguaaaggggccuggugucaccauagaagccaaauuaggcuccacaucaauggcaauuugauuuauacgaccuucucuucucgccauggcggcuguucccucuccugggccuuacaagugacauccaucacauggcagcagugugagagaaaaggacauguccuccaucaucgccaugcacuggucugugauuuaaugcacauucuauucuguaugcagaaucguauaugugcaaaugcgcagucagugaauaacaucagcuacccugggcugcucuggcuuugaaaaauuguucuuaucagcagguauaaaugguaucuggggguaucuuugccauuauccauaaucaugagguugauaaaauuuuaauguauucuuuugacauagauaauacuauaaaaucaagaaccacgucuuaaagguagauuuuauuggggagucacuugugacauuugaccuugcauccucaauuaggagauagaugaaucguaaggaaggcauuaaaauuccccucccaguuaaccccauugccuuggcugucugcuaacaggaugaauguggcaccaggugcuccugcagcgaugcuaaugacaaccucuuccuagauguaaucaggggaggcucugggaggugaaacuaguaaaccagaggcaaauacuugaaagaugaaaacaguagcgggaagucagaaggaaaagagccuuugguuuccagccuugugugaagguuagagaaggcaggucugacuuggcuuacacccuaugcaccaacugcauacuucccuaauuuuccucugcccaaguucuagcaacaucucaagacaaccucagaugcugaccucucagcaccuucuucugcccggccuuuccaaacgauuccuuccuuuguagucacaaugugugagacaaacucuauguguuggaugugcucgcccacaucuccccagcuccugagggcucagaugaagggcuuuguuuuguugguauauuucacagcuuaauucuuucuaggaauuguuggucauaugggacuuuuagggcuuagugaaaaauuuauucacuuccauauugauaaauuuccuucaauuuaaugugguugaacuuacagcauaaaaugacccccaagcccugcugaugccaaccaaggugcugggggugggggggaaccaaugagugagcuuaaauccuacguaaggaagggggucaugucuucuuuagaauaaagccugaauucugccacauuauuccagaaggaaaugcucaucuggggaaaggcagauagacccacaggccucucugcacacaagucuucaccuagggcaaguggcucaaucucucugcauaguacaaucucuaagaaugcuaaugcagggcuuggagagaugguucaguuaguagcgugauagcugugaaagcaagagaaccugagcccggacgcccagaacucacauaaaacugucagguggggcagcaugcaucuguuacuccagcccuggagcaaacagugacauccauggagcucaguggccagguagccuagucaagugagugaguucuagguucagggagagaucuucugccaaaacguaagguggagcaugaccaaggaagauaucugcuauuaaucucugaccuccacaugcgugugcacauguguucagaugugcacaugcacacaaaugguuauacacacuuuuuuuuuuaaagaaaaugcugauguauagaugccccacccagaaguucugaugcagugcaucuuggguaucuagccgggacaucugaacauucuaaauucuuggugauucuguagucaggguucucaaaccucaggaugggaagaaagaaccuccugaagaacuuuccaagcuucggauccccaggcuauguccucagauccuguuuggcaaguuuaaaguggaacccccaaauccauucuuguuacuaaguaagacuuaaggcuuucuuuguuaaaaaugcacuguccauuuuuaaaguacguuaaacacacuuuuuguucaagucggcuacauccuucacuuacguaauuucccuccacaagaucuuauaugaauauauaaucaugcauacaggguuuuaaauuuaucuucuuacaguuaagccuguagcaaacucauugaauuuuugucuucguguauagacuauguuagggaucugaucccccagggcuggagagauggcucagcaauuaggagagauggcuguucuugcagugggcucaaguuuccagcacccccaauaaacaauucauaaggacguguaauucaccuccaggguauccacacacaugcacacacacacacacacacacacacacacacacacacacacacacacacagacacacagacagacacacagaaauaaaguaaaucugaaaaaaaaaccaacuucccccucuccccucgcaggugucauugucccacccccuuuuuaaggcuuuccuuucccccccugauuaggucucucccagcacauaagugucauauauacuuggguaucauuucuggauccccuuuuccguuucauuagccugagcgaauaccacacacucguuuucucuuauuuuguacuauccuuuaauuauuguuccucuugggaggagcaucuuugcuacauccacuaauuuauuauugcuccaauacauuuauuucccuaaguuaaucuugugauugggaaccuuaccacauuguaaucagcucugucaaggagaugauuauguguuucuagcaaguaguaaucuguugccaugcuuccaaugugucugcgccuuguuuguguuguguuuugcauugauuagagugcaucuguuguuucgagcgguccguggcaacagaugucugucuagggacacaggacggcuucuaacaguuuaucuuuaaggaugaagucugcucugcuuuucagggaacagcuugggaaaccucucauucuccuacauugcuccgaguuuuuaaaaaauagggauggcuguuagauccuauugaguaauuuuucuauaucaacugaugucugguuuuacuuuuuaauauugauagcucuuccugaggcuaagccauauuauuugucuugagguaauccuugcuuagauaaaagaaauaucuuuauuaugcugaacuuggcuugcuguuuauaacuuaaaauauuggcauguguauuuauaagugaaacuggucugauauuuucaauuuuuucacauugugcucaaauaauguugggauugagguuauaaaucuagaugaguugauuucccuacuuuuaaauuguuuggaccaaguuguguagaaggggcugucucuugacuaucugauaaaauucuccuguacaccuacuggucuuuuucaugaauuuuacuaccauuuagacaucuucauuuugaguuauuuauucaggguuguuuuuuuuuuucauuucuucuugagccaguuccagcaauugauacugacauuuucugguuucuaauuucaaguguuauggacauaaacuugguaauagcauucuugugacauuuuaaauauaucuauuugccuguagcuguguuuuucacaccuggcauuaauuugugcuuucucuuuuuuuuucaagguuggucuuguugggguuaauuaggucauuagucuguccuguacaugucaguuucagggguguaauaccaagacucccccagagaaaagaaccugcacagguaauucuagagaaucauucagacaugcacuaaacacaaacaaacaaaagccagucaaacugguauaaagaaucacucaguguuccagacacaacauggaaacaauccaacaaauguccguuaggauuaaggggucucccuacaacagcauuagcaucacagguuguaccaguuaucuucugacaaauggggucaauaucaggaugggcuugaaccugcaaaccaaaagaucucaagauguucccugagaagcuagagagggccuccugugugccugucagaagucuagaagccuuaugccacucuauaagcccugcaagaguagaacugucacuucuggggggucccuaugagcugucaggccuuguguauccuaagguuucuagaccauuagaagcuccgacuuuguguauguuggucuucccuccauuugggacuccucuucccaggucacauuaauguauguguuuucagcuuggauucaagccaccaaaugcuugugucuacucugucaggcucugaauuaaguucuuggaugaugaagagucccaugcuugcaagagcuugugugagccaaagcacaugugcugagcaguuacuggugcaggguggggcagggcacagagacaaguucauuccacccugcuggaauguuacccagagagugcucgauagagaaugugaccaguaugcucagacuugccccuaagugggcacuaagcagggaagggcuccaucugaggaaaaguacuagcagagauaugggcaguucucaaggcaggacucucaggcuccagccagcuccuuauccuauaagcaaagggaaggccagaaucaggugggagauuuuaggaaaggugacuuugccagcagugggaaggauagacuggagggauaagucugggacucgcggggucaaggaaauauguuccacucuacacaguccccagugagaucucuuacgauggcugaacagcacaacuuccuaauaaauuuguauggguucucuguucuuucuuccuccuucucucccuccuuccuuaugucuccuugggaugcaucuagggucuugugcauguugggcaagcgcucuaccauugagcuacaucaucaagucuauuuuuucuagaccaggucugacuaaguuaccccaguuggccugaaagucacugaagacggccuugacucgugaucuuccuuaccaucucagcucccaaaguagcugggauuacagauuccugcuaccaggcccagcuuuguguauuuuucggaccauuccauccuggcaguuuguuuuggcugcuuaggggacugaugcacagagauauucuguuucggcauuuagacauuuucaacuggacaauuccuuuuuaugaagggcugcuuuguacacuggcuuuguucacuuaguucccuggcuucuacucacagccucuacccacaucaugccaguggaauuuccuauccuccccugcccugaguuguagcaauaaaaguaucuccauaaaauaauccuguuggggcaggaauuuauucccaguugagaaccacacugcuacacagugauaaaaaagacaccauggcgagugaaagagaauaaacacaccuacaucuacugcaugccccuuuuauauaaaguucaaaaacaaacaggaaugugggcauugguuagaauaggggugcucuggggguggggguggauaguuggcugaaaaggaagucgaggaaccuuccaagguguuggagaagucugucuucugucuguccuccugagcgauagugcauuaugggucuauucaagccagcagucaagacggguagacuuuguucuaggugcauuuuuuaaaucaaaauaccaagugacuaaauaaggauauaguuugaugcucaggagaaagggcggaagagaagacagaucugagcaacauccggcuguuagugagaaccaaccccauggaugcuagucuggcugagagaagggcagggaaggacgcugaggucagaguucagcaugggcugaucucccaggcauggagggaggagacgugaaggauggauaggcuguuggcuuccaugauugccuucccacccaagaguagagcaaggcccaccacuggcuacucuacauggcugccuccuauuagcaagacacauugacuaaggugaaggaaggaauggcucuccucucuuagcccgcaccgauguguaauuauuugcacaugaaugaaagguuuuugcagggucuagccuaauguggugagaaacugugcccagaccucaagccacaaaacccuuaagagcuggguaaacauggccuccuccacugugcugugcccugcggucacugucuguuuccugcagacuucagaaaauuggcccgaguggugacauuuccuagagugcauuuucucgagccuucuaccugaaggcuccacucgcaauuaaaugcagugaguaggagaaaggcagacgaggcuaacgugcaagagagcagcguuggagacaguggggacaguacugcgccucaguuguauuugcugagggcguaugcucugccaaacucauucaucgaucuuuauuaguuaggaguguguguacacgcuagugccaaaggacagccuuggcuggcacacuucaggugaggucaacauuuauuuuuauuuuuuauuuuuauuuugagacaaguucucuuacuagaaccugggguuugcuuaccagguuggcaucccuugccagaaaacucuagaaaccuccugccucugccucuccagcacgugccacaugccugguuuuugacgugcuugcugggcauugaauucaaguccucaugcuugugacacaagcaccucacugaccggguugucuuccaagcuccuauuuggguuucucaaugaucaguuaaggaaaaucuauguaguccugguugaccuugaacuugcuguguagacaagcccucuaacuaaccgaaguccacuugccuucgucuucugaguuagucaggcuaacguuaccauguaagaauguagagucguuagggaaagguggggacugagaccucauagucggucagugguuugacaggcccagaaauucacauccccucauuccgcgccauggcccugucugacuugugcagccucagcaugucccuggugucccccggcucucuaguucagcacacuguucuagaaagagcugcugccugucuuccuaaaccucugcugguccccccucuccuaaccacguauaaccacccuccaucaaccuuguuuguguguuggaguuggguaaaggguaucucccuccuuguccuaagcugucugugggcccugucccuccagggugaggcccagcacuucggcuccagguccgagcuuucuaggagcaggccuagcuugugugucuagccuuccugcuuucacaccugacgcuuucccuggggguucucagcccuguuugcacauugacauccaggugcucuggcccaaucccaucauccugagccccacacuuagcuaaugucaauuucacucgguuuucccccugagccucuuccaucuucuuucuaaauccuuccuauccugcggggcuuuuagucuguugugaaagaggcuuaugcuguaaaagcggggaauuagguuggauuuacguggucuuaauucccuaauaauaaugcagggagauuaauaguuuuauuccaaguucacugcagcaucuuaaaagcaugaaaggcuggggcaccgggucucucuguucccggugacaagagcaggaucccguuugcaggggacugcugucaugagggaaaacacaugaauucaugagucuggguuacaggcagaccaccaugaaggugaaaaucaggggcagaaucggaguccugcagggcucuguaggggcugggggauucuauuggaagacugagagaaggaggaguuguuuguaucugagaggugcccugguauuugaagaaggaguugguggccaucagaaccagaaguuugaauccugcacuuuaacuuaaaaaaccuguguggccuuggggaggucaguucuacggggucaguaacgcaguagugaacucacagagucacgaugacgguggaggagguuauugcccacacaggacaacaggcacaguuagugcaggcugccuuuguuguucuuguuuugagagagagaggaacagaguaggcuaggagggaagucuaccauuuauucauccaggcaacgccuguggccucucacuggcgccucucacuaggccaggacauggugguguggagaugaauuacacagauaccugucugugggagcaucuggucuagugagagacguggaagggaaaggccaggaggaagcacagaacuuaccuauacuccagcuccucucacauaucuaucuuugcuuggggcuuuaggugccauugcugucugacguguuaacuacaagacauugagcauagacuuaaccucuuuccucauugguaaagcagauucagugacacccacucguagguuggugaaagacccaauauucuaucuaacccaugccucucuuaccugccucagucaccacuggcagauugcucagaaccuagcuugguacuuaauagcagguuuucucugccgacaaaauaagucauuagaaguaucaagguggguuuuuuggaggcagcgcuccuguggguucacaggcccuaaggaacgagcccaggggaaucggccacgaagacaggaaaacagagguggggggagagaaagugagagagugcauacagggagaaagaaaugcagagacagacagacagacagacagacagaccagaaugaaugucuggcuuauauagggaagagccucggguggagggaagccuggaauguucaagguagaggugggauaugccagccauacucuguaacaauagggacugagggaugccgagagaacuuggagguuagauccacuuugguaugucaaauagucaccccagccgcuuguuucagaucugaaacccaacaaguaguagauucuuucuuuuuuuuuaucuuuuuuuaauuggauauuuuauuuauuuacauuucaaaugguauccucuuucccgguuuccccucuggaaacccccuaccgcaucccccucucccugcuucuuucuaugagggugcuccccacccacucauccauuccugccuccccuccauccuggcaugcccauacacuggggcaucgagucuucucaggaccaagggccgcucuucccacugaugucccacaagaccauccucugcuacuuauguggcuggaaccauaggucgcuccauauguacucuuugguuggugguuagucccugggagcucugggggggggggcggucugguugguuaauauuguuguuccucccaggggguugcaaaccccuucagcuccuuuaguccuuucucuaacuccucaauuggggaccccaugcucaguccaaugguuggcugagagcaucugcaucuguauuugucaggcucuggcagagccucucaggagacagcuauaucaggcuccugucagcaagaacuucuuggcauccacaauaguguuuuggguuuggugucugaguggggcagucucuggguugccuuuccuucagucucugcuccacacuuuguuuccauauuuccuuuagacgggagcaauucuggguuaaaaauuuggagaugaguggguggacccaaccgggauccaugccuaaccucuggauauggucucuacagguucucccuccccuuuguugggccuuucagcuaaugucaccccuguacacuuaguagauucuuaauagauuguguuugagacacucuagcuauguaguuaagucucaauccucccaacacuggcauuaugugugucaccaugcccugcuuacugcuagauuuuuuuuucauuuuacuuuuucuuuaauuaugggaauauauguguguggaguggucuaugcaucugugagcucaaaagcccaugggggccacaggaagggcaucagauucccuggcucuggaauuacaagugguugugagccauucaucaggggugcugggaacugaacuagugagccaccucaccagcuugcagcuggacuauuaaacaauugaauaagugaugugugcaguauuuaacacagugucuugccuauaauaaacaauagacaagcccaucacuguuacucugggauugagcaccgcuuggcuaucugggauucuuggauuucugggaaaagaauccugggaugccccagugggauuuucuauggguguaugucguccaucagcauccaagucgcugacucauacuuugucguugcaaauauaaauuaaaaggggaaggugagggucuugcuacuuuauauucaugaaaacauugcauaccucaaacaagaaaaauauggggaagaagagauggcucagagguuuagagcucuuccagagguuccgaguucaauuuccagcaacuacauuguggcucacaaccaucuagaaugagaucuggggcccuccucgucuugcaugcaggcauaugugcacacauaauccuauguacauaauaaaugaauaaauaaaucauuuuuuuaaaaagaaagaaagauaaacugagccuuaaggacagcaguuagcaaugaacgacugcuaacaagcuccaaagucucugaaaauggacgcagagcuguaauuguaguagaaaagcucgguguucuaauuuucacugaugucugauucuuuucuucagacuuuuguuuguguguauuuugugcauauggguacuuugucugaauguuccucugcacuccaggacagggcaucagacagcugugagcugccaugugggugcugggaauugaacuuaggaccuucagaagagcagugagugcucuuaaccacugagccagcucuccagccccccacccuuuuguuuuuucaaggguuuuucuguguggccuuucuguguggcccugggacuugcccuauagacuggguuagucucaggcucagagaucugucugccucugcuuacugagugcagggauuaaaggcauacgccaucaugccuagcaucucaagucugauuuuuaauauuugucaugaacauaccuuaauuagacauaauaauaaauuuauuuacaacauuuucauaaauguauguaauacauuuuuacccuccucucuucccuuuaccucugaccuccccaugcccacugguccccuuccucuacccagcuagucagaguuuaggcuuuuaacuccuaggugacagcagucaggaugugaauggauugugcacaaacucuggauagaaagccccucuccggacugcaaugaugcccuagcuaagcauacauuugcacuugaagugugaguuaauugugcgcaaacucccuagacuauaaagacaucccaguucagcauuccauuuguacuucucugacaacuuuaucccuuuauaucuccaagagcccaggagucccagcgagcuuucuagggauuuggcaucuaucucaggauucugcaggguguaaaauaaagucuguuuagggaucagagagauuguucugugguucugagaacuagcucuugcaggggaucuggguucgauuuccagcacccacauagcgguuacagccauuaauaaccccaguuccaugggguccuagaugcauacaucugaugcacaugcaugaauacagugauaagaugcuuagucagcauguacacaaugcuggguucaaacccuaauaauauucuuuuaaaaacaucuuaagccagguccaucccagccaggucaucaucguuguaccucagccagauaugugucagccagguaugccccagccaugaagaucccagcacuugagaggcuacaguagaaagauugcuuuaaguuccagaccagcuauccuacaucgagaccguguaguacaaucaauuuaagcuuaucuccaacuagcuuaaaaauaaaagacuuagagcacgguuauuuuauuuggccuugacaauuacugggguaaccucuaaucuccuuuucuaacugcuggccuggcuaccuccccagcaguguaccccagacacuugcuguuuuuccuggccaugugcucaugauaucucuguuuuuauggcgccucuccucuccucuccuccuuguucucugcuuucucuuucuucugccccacucaagcagguaacuaaaaaaccugccuaccgcuaaucccuccagaaauuggcuguagccuuuuuuuuuuuuuuuauuaaaccaauaguuuuaaauuaagguccaagauuugcacaacaagagcugguaaacaugagaauucacucguaggccuaaaccuuuagguacagaauuuagcaucauaacacauagcaauagaccaaaccucaacaagaaccuaucuuaagaacccaagaagauugccuagcaugguggcacauaccaagaaucccagcacucgcaaggcugaggcaggagguuugugaguucaaggccauuugaucuacauccaaacaucaccucugucuggauagaggacuucaggcagacacuguugcuguagucgcuuuuucaauucaguucguguuagcugagcucuuucuaugaacaagacaccaaguuaggcuuugaggagauauuuguaagauccguguuuggagauaucccaauugacucugcugacugcugcucuaaaagucaggggaaauacggcaaugcaaugaugguguuguuguuguugauggugguggugauggugaugguacuguuggugaugaugauaguguugguggugauaaugguggugauggugauagugaaugaugguuguugauaauagugguaucagugguagcgauagugauggugcuaguggugguggugaugguucugacuguugccuggaaccaaaaaggacaaaucagcagaaguaugaauauuuucagauaacagacaucuuuaauaguagcacuaugguagaaaagggaaaaguucuggaaaaaaaggaaguaucagaaggaacuuaguacauagcccuccucucuccaugguuaauuguggucaauguugguccaaaagcauuaaccaaaaaauuccagaaauaaauaacauacauuuaaaguuagauuuuauuuugaaugauauuaugaagucccauaccauuccucucugucucacuuggaugugagucaccucugcucagcguauccgagcugugugugcuacccuccuguuagucucuugggaguagcgugguuaucagucuggcuguuggauaucacagagcuuuacuuuuugaagacacagaauaaggguagugauguuggcaauuuuauuaccuuguacuaugcuuacuuuauuuuauuaauaguuauuguugcuacucucuuaccaugccuacauuauaaauuaaaacuucucauggguacauacacaccacauuuaaauaguagaugucuacccaccauuucuggcauacucugagaaucuuagggcaucucccugugcauuaggagggacuacugcaaucauauacugaucuggcagccgugguguagaggaccaaugaaauguccuaggcugagaacacaccagcuugagcccaagccuucccauuuacuguuuauuguguggccuucaugaagggacuccaagcucugacccuuuaauccuccauuaggagccauuggugguuugaaggagaaugccauuuaggcucacauauuugaauacuggguuuccaguuuuggaacugcuuggggaggauuaagagguguggccuuggugaaggaggugugucacuggaggaagagcuuugagauuucaaagcuggguugggaaugccggagagauggcucagcaguuaagagcacuuucugcucuuucagagguccugagacuauguauguguguacaauuccuaguacccacaugguagcucauaaccucuguaacuccaguuucaggggaucagacaugcucuuagagccuccauaggcaccagacacauccauggugcaaagacaugucuguagacaaaacacucauacaaaugagauaaauauuuuuccagguauaguggcacaugucuuuacuuggcauucucuuucaaacaaucacgggaucuuaauggaggauuaaagggucagaggcuuggagucccuucaugaaggccacacaacaaacaguaaaugggaaggcuuggguucaagcugguguuuucucauccuaagcaaucaggagguagacacaggaagauuccugaguuagagaccaggagugaaugucuacugugaguuucaggacagccagggucacacaaugagaccccaucuugaaaaacaaagcaaaacaaaacaaaaggaaaaagaaacaaaacaaaacaacucauacccagucagugcucccccuccuccuccccucccccucccuccucccccucccuuccccccgucucugccuccugcuuacagaucaagauguaagcuccaacuccagccaugccugcccaucugcugccuggcuccuuaccaugaugguggcagacucuaacucucugaaacaguaagccccaaauaaacuguuucuuugauaagcugccuuggugguggugucuuaucacagcaauaaaaaaaaauacuaagacaaaaccuaaaauuaaguauucuuccacauuccuuuauacauauccauagacaacacuaacucaaaaagaucuuagucuaaaacagccauuuguggaagcagucagaaaaagugcacuccacaaacugucauaugaaaguguugucuccuuuugaauguagcacacaguucaugcuuagacuguggaugcuacacaaauguuugaaaugcuaucagcucccugugaaaaccagaaucaagcaugauugugugaguuguguauggauguguguguugugugucuguguguaauaugugugaaaguguuuauguaugugugcauaugugugugaguguguguauaaauguguguguguuuggauauguaugcaaguguauauucauguguguuucaugaauagguauguguguaaauguguguguguguguguguguguguguguguauguguguguguauguguguguguugggaggagauagacagaaggaucagccugcuagauaauucagagauccuccagucugguccccacccaugcaggcagccaucugcucugagccccgacugucugagaguggaggguauccaugggaaccaguguggaaguuaccaagaggacacuguggcagcuggccaugagggaaaguggaaaucaagcggaaccaagagugauagauugaaugagaagcgguuagcugggggugugggaggguggucucagccacugugauggcccuugugaugcagaggaaaccucuaguaaggcugaguagcuccacaacagugccccagagcaucaccagggaucugcaauuucugucucuaucucugucucuucucucccucucuucccuuuuugccuguuugucuguuugcuugcuugcuugcuuguuuguuugagacacuucucuguacguaacuucugcuguucuggaacuugcucuguagaccagguuagccuugaacucucagagaaccuccuacccauucucccugagugcuaggguuaaaggugugugucaccacgcucagacucucuuccuuuaguaggaaauguaguauguauaguauugaaaaguuaaggaagaaaaccuuauuuucuuuucuuuuuaaaaauaaaauuuuagggccagugagauggcuggcagagagucagguuuggcgggggcguguaaagugccagucauacaaacaugaugacaugaguucaacccucagaaccaacauaaagaugggcacaggaccaccagccagggguggcaccacccacagugaccugacacuuccacaucaauuguugaucaagaaaauccccucacaggccaaucuggugggggcgucuuuucaacugauauucccucuucccaaaucucuccaauucuuguuaaguugacacaaaacuagacacacaguggugugugugcaugaacacccccccacacacacacacuacagcacacacacauauauauacaucacacacacacauauacauuacacacacacacacacauacaucacacacacacacacaagaccacaccauauacacaauuuuuuugaugaucaggagcaaguucuaaaccaaagguguuggugggaccccagguggggaguggggcgucacagcaacaugaggacaagucugcucccagccucagaugcuaccuaguggcauucuuagcuuuggguugcugcaagcuggggucagcugugguauguccucaaaaguugacacaaguuugaaaugaguuauacgaaccuagaguauugucuccugaggaggugauggggcucuuuccacccaggcugaagggaggccuccaugugcugccuucuuuaauugagaaaaucaccuggguuuagguuugacuuguuaguucuucaucuccugaagcuuaccaugugaaaaccacccaauucuaaaucgguacuuaucaucuuaaguauguaguuuucuuuuuagcauagguggcucauguaguccuuugccagugcucacaggaugccuggcaauuauuuuauaaggagacaauuaauuuuuagaaagaguuaaagcauugagcuuugagaaugaguaguggagucauuggcuuggaaagcagaaagcuuuagucaaauuugaauuaaaaguaauuuagacgacgggcggugguggcgcaugccuuuaaucccagcacuugggaggcagaggcaggcggauuucggaauucgaggccagccuggucuacagagugaguuccaggacagacagggcuacacagagaaacccugucucaaaacaccaaaaaaaaaaaaaguaauuuagacuaaauuugaucacauaaauacaucacaaggcaugcaccuaaaggugcaugcaaaaacacuuacaccaauacaccaaggugaugcaaucuuuauguugcaacacaguccuaagacaaagcaguaaugauaagggggguggucagucagacacgagcagcaaggcaagaaaggguuaaaauuggggacccugagguagccucuaacaccugccccugccaggauaaggaugcuuccaaugucuugugcagcagcaaacaggaagugagacuaauuaaagucugcaccuccauaauucagcugggaugguuugagaucgcaaucuugaauagccaggauaaccagguugcucugguuuucauuuucauagcuuccaaaaccccgucaaucaaucucucucucucucucucucucucucucucucucucucucucucucuguguguguguguguguguguguguguguguguagcgagcugugucccuguuucugucucugucucucugucucugccucugugucucucucugugucucugucucucucucucuguuucucugugucucucucccuguaucugucacucuuucucuuauaaacaugugauuucauccuuucuuccuagaaguuuuuagaauuuaagguaagcugcccaguuuuugguuuuguuuuguuugguuuuuuuagccuaagauuccuauuuuagcauuuaaaaaagaaguuugggaauaucagacauucucuguaauuaaccauuaaaccagcuggaguacggcaugauuuuuuuaagugcuucaucuuuccuugaauuuuuguuuugaauuuccuugaauucuuauuuaauguuuuguuuucuuucuugaaaacuggaaaauaucuauauuuagccacagggaucugugcugauagcuuuggcaugcagcgggggacucaaguacaguuuauuggacuaacgccucaguucucggaagauugcuuccugcccuggagccucagguuuuuugugcauauuuacggaaaugugagguguucaagacacuaucugaucaucuguaacauguuuccucccagaugagcuaggaagaugauuucuaccccaggagcagggcgggggugucgccucuggcuuccuuugagacucuugcacacauaccggggagcuggcucacccggccccuccauccugucagacugaagagaacaagugucuuaauuuggguuuuucuucuucuuauuuuuuuccccugagacauaauuucucuguguagcccuagcuguccuggaacuugcucuauagaucaggcaagcagccuugaauucacagagauccgccugccucuaccucccgccauggcuuaguuuuggugucuugaugaccugacacccauagaauuucuagacuaaaagggacaagauuacaguaaauaaguggagaaagaagccugaguuagaugguagagggaaggcggagggacaggccagaucuagugacaagcugcuccaaacguuaggcaucaaaccuuggaccucgaaccuuaacucugucaguauacaggcaguuccucuggucugcucucaggaaccuagcaacugacugcaucaucaucugcccucgcuaggugugccaggugugugugcuguggguaagaggacccgccagacaccccucuccucccuguccccuucccuuuucuucccccuccccccucccucucccuguggcucucuccugcaguccucuucucugggaccuucccugucugcgcagcgaccacaugcucuggaaacaaguugaguccaacagcccagaacaaaccagcagcuguggaccagacuccaggaacucucccagugccgucugcccaggaggccaucagggcagccggggaaaaggagucagugcuggcuccugcuucaauccagaugacuccuuuggugaaaguggauggcccuuaggaccccacacuggaugccaaagcugucagcacaaaacacagcugucaccacaaagggaguaagagacaguuuauucugagccaaauauuaaguggccacagccugggaauacagauucggguuucugugauuguguauucccuacagaaguggccgugugagcuuuaguuagucacaaaacugaagaaaacgauagagcaggggauuaaccaaacccguugguggggaccacaggugagggcuaccgcagguggguaagauugaacuguagguuucagaugucacagcugccgggcuuaccuucuggguugguggaagauaaauacagcccaaaagccugaccaagcaagcagaaggaugcuacacagaggugggcaguggauggcuguuaaguggcugaagacagcccaaggccauuugguucugaacugguaacauugcaacucccuacaucauucacaaaguucuaguuagucagccaacucagcagugccucuaacaugggcguggcuuuuuuucuggaaacuucuguuuauagaaaacugagcuucugugacccugcaacagggcaacagcucuuuacuguuguuacuguacccagcaccugggaaagaguggaagagguuagagagugcuaagcccccacagugaccuacgugaccgaccuaugcaugggggacaaugagaauugccugcagggagaccaggauggcaucccagcugcgguccugacuacuugcucugauccuuuuccuccaguucugcaggaccgugagccggacacucagucaguggggguuaggggugauggucacucugagcuaggaugaucuaguucugaggugguggaguggcuagcaaagacagcacaaaccaggcucaaguauggcuuccucggacaccuugcauuuccucuaggggguuaaaacucuucauuuaggaucagcaagaaagcuuaacuaaagaaggagucugaguuuagucccuaagacuaacaugguaaaagagaaccaacucccacuagaugaccucugaccucgacaugcaagcugugauacaugcauguucccccaaauaaguacaauguuaaaaaauuuaaaauaguuacaucauuuagcuuuuuucaauuuacuaguguaugcuauuuguauaaaacaauggcuuuugccaguguugucacacacaaaccauguacuccuuuagauuggacaccgaccauucugccguguggcuaugaaaugugauuaaccucucuucuaguuauuggauguugucuuagucaggguuucuauuccugcacauaacaccaugaccaagaagcaaguuggggaggaacagguuuauucagcuuacacuuccacacugcuguucaucaucaaaggaagucaggacugaacucacacagggcaggaaccuggaggcaggagcugaugcagaguccauggagggauguuacuuacugguuugcuucccuggcuugcucagcuugcuuucuuauagaaccaaggacaccagcccagggguggcaccacccacaguuagcuaugcccucucacccacaaugggcugggccuucucccuuagaucacuaauugaguaaaugccuuauagcuggagcucauggaggccuuuccucaacagaggcuccuuucugugauaacuccagcuugugucaagucaacacacaaaaccagccaguacagauguuucacuuacauucagcuuuuuaauugcuguugcuucaaaacuagcuucuuuuucuucccucccucuccccccccccccccuucuuccuucuuucugaaacugcuccacuuucaaagccacaguuuagguccuuuggugaccagaaagaguuuuauaaaugcccuccuauuuugcaggugugacaucugagucuggcaagcugcaucugugacuuguccaauggcacggagagaugguuugagaauaggaaauggacuguaagcucgugggccccugguccugugcucucaucuggcacugagcagcuuuuaugggguuuuguuugacacgcaagacuacuccaaaguuagcccaucccaggugcuauggauagcugggcuuguuuuauuagguacauuucuauuauuuuaaguguuugugucuagggcuggagagacagcaguggaugagaguuuguaacucuuccagaggaccugaguucaauucccagcauccauguugucaagucacaacagcuguaacuccagcuccaggggaucuaaggucucuggccuccaugguccccaguauucacaugcacauccugcacauagacacauaaaaauaaaauaagucuuggacauuaucgucugagucaacaccaucccgugcauggcaagugagaagguggggggagcuguagcucuuucaagcccagauaaggaccuagcauuguucaggggagccugugauaaaugugcuacauggccagccauucacgcuuacggcuuuguuugagaagagcaucacacuuacggcuuuguuugagaagagcaacaccuuugaggauaguuugagaacugaucaaaauuucuaaccccgaagugaacaagcucuagauuagcuggcuucauuuaaacuugcugaccaaguuuuucaacaaaugcaacaaauauuguaaaccucacccugaaugagacacugaacuaacuaaucuaauaacuauuuaaugagguuuguccuugcauugcuuccaacucagucuagggaagcuguuuuaaaauauguguuuuauuauuucagguguggcuugccucucguggcuuucccagccucuuuuccucuaaaacccaggaccagcagccuagggauagcaacgcccacagugggcuucaagcucccccaucugucacuaauuaaggaaaugccuuacaggcuugucugcuucuauccuagucuucaggaggcauuuucuuucuucucagaugaugauagcuugugucaaguugacccaaaacuagccagcacacuaagacccccccaaaugccaaaacaucaaacaacaugccuaaaaucagaggcaaggcagucauuuaauucuagcuguguguguguggguagacagcuguacuuaacaaaaagaagcacacacugagagucaagagggagaaauccuuauuugcucuugagugugcuugauggaagaaugacuuuugagcagggcagacaagggcaaggagcccagccaccaucauucacuggcaagcugccuaccuagggcaaguuaccuucugugguguuuaaauagguacaucccccauagacucaugcauuugagugcuugacccacagggaauggcacuauuaggagguguggccuuguuggaguggguguggccuuguuggaggaagugugucacuguggaggugggcuuugaggucuccuacgcuuaagcuccucccaguguggaauuccaguccccuucuauugccuguggauuaagagcuccuccagcaccaugucugccugcaugcugccaugcuucccgccaggaugauaauggacugaaccucugaaacugaaagccagccccaacuaaauguuugcuuuuauaagaguucccuugguccuggugucucuucacaguaauaaaacccuaacuaagacacccucugaccuggguuucuucugugucuguuucaaggcuaggacaguaugucucucacuauacaucacccaugggccuggaccagaaucccccagaaugcugcuuaaacagccuccuggaaccagaauccacccaacucugaagugggagccugugcuuuaacaagcccuucauuccaacccugcgugauucaggguagccuggaagcaugagacugguccagagaaugcaaugcuagcagccuucuaggaugcgucuaaagagcaaacuucuacacauccacggagauuuuauguaccuuugucacacacucgugucuuacacauaagcuaucauguguaggcugccucccucuguccaguccgcuaagcucagcauuagacacacaagugggaauuaccccgcugccccaaacaaagccuccuguggaggcuuagcugucccaggccagcugugcagggaggcuaauguuacagauguucugauaucccuccgaaggcucgaagccaagcagccaaacccucagacugcgaggacacuccagucacaacucagccauggaagcaucugugugauucaaacgccuuauuuagccuuguaggauucuauuuuuaccucagaguuuuaaaaauaagaacugacagacaaaaugaaagcgauuugggucauuucgagggaaaauacauggguaaaaauaacugcacauaugcuaagccuuuugguguuagggagugggguccucugcugaugggugcuaugugugucuuggugucugucaguccucguggcacagcuagagggucuguuucauauuucacugcacuacagugaggcuaagucauaucaucuuucccaagauacuguggagauacugccugggagauaauuucuggacaguucuugaggcucuuuuauacccauccagguagcccccaaauaccaggggagaccugaaaaugucccuuccccugaaccuccugaucuggcuaccuuuacaguccucuggugagucccauuuuaugaaaugauaaccguucuccucugacuuucccugagcgaagccucagcccacaccagcugcuugcuucauucugcauuuuccuucccaccucccuaguaauuauauagcaauuauuaugcuggcaauuaccucauuaguaauuuggugugagaaagcucaaugaauuaauaauaaaaaggccuuuauaguucaaaauuacgaauaacaaagccaguuugaaugccccaaacacucauuaagagguuuccuguacaauauuuugaaaaguguugguaucuuucuugaucaaugcacgagucucugaagagcccacacuauucuuaucuggagauuuucaaggaagcagaggcacauuggccgugcuggagagaaagacuggcaacucggguggacucacaguccuauaaccucaugcugauggaucuugguggagaucagcggaggugugcagcuuccccagacuauaaaagcccauccucagacccagcauuuagaaggcuaaagcaggaggacuguaaucaugggaccaacuagucuaggauauggagaccaugucuuccagugacuccagcuuuagccacgugugguagaaccaauuuucacacucacggccaugacgagccucccacccccccacccagugccuccauuguagggaaauuugugucaccaauguucaacuccugcuuccuuugucuuuuuuuuuuuuuugcuacuguccaacuucccuaaguaaaauaaaccucccaugcacaccuacauaauuccuauguccuuaacacagccacacacuccuguguccuuaacacagccacacacucuuguguccuuagcucaguuacacacuuccuguguccuuagcucaguuacacacuuccuguguccuuagcucaguuacacacuuccuguguccuuaacacagccacacacuccuguguccuuagcucaguuacacacuccuguguccuuagcucaguuacacacuuccuguguccuuagcucaguuacacacuuccuguguccuuagcucaguuauacacuuccuguguccuuagcucaguuacacacuuccuguguccuuaacacagccacacacuccuguguccuuagcucaguuacacacuuccuguguccuuaacacagccacacacuccuguguccuuagcucaguuacacacuuccuguguccuuagcucaguuacacacuuccuguguccuuaacacagccacacacuccuguguccuuagcucaguuacacacuuccuguguccuuaacacagccacacacuccuguguccuuagcucaguuacacacuuccuguguccuuaacacagccacacacuccuguguccuuagcucaguuacacacuuccuguguccuuaacacagccacacacuccuguguccuuagcucaguuacacacuuccuguguccuuaacacagccacacacuccuguguccuuagcucaguuacacacuuccuguguccuuagcucaguuacacacuuccuguguccuuaacacagccacacacuccuguguccuuagcucaguuacacacuuccuguguccuuagcucaguuacacacuccuguguccuuagcucaguuacacacuccuguguccuuagcucaguuacacacuuccuguguccuuagcucaguuacacacuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuccuguguccuuagcucaguuacacacuuccuguguccuuagcucaguuacacacuccuguguccuuagcucaguuacacacuuccuguguccuuagcucaguuacacacuuccuguguccuuagcucaguuacacacuccuguguccuuagcucaguuacacacuccuguguccuuagcucaguuacacacuuccuguguccuuagcucaguuacacacuuccuguguccuuagcucaguuacacacuuccuguguccuuagcucaguuacacacuccuguguccuuagcucaguuacacacuuccuguguccuuagcucaguuacacacuuccuguguccuuagcucaguuacacacuccuguguccuuagcucaguuacacacuuccuguguccuuagcucaguuacacacuuccuguguccuuagcucaguuacacacuccuguguccuuagcucaguuacacacuuccuguguccuuagcucaguuacacacuuccuguguccuuagcucaguuacacacuccuguguccuuagcucaguuacacacuccuguguccuuagcucaguuacacacuuccuguguccuuagcucaguuacacacuuccuguguccuuagcucaguuacacacuccuguguccuuagcucaguuacacacuccuguguccuuagcucaguuacacacuccuguguccuuagcucaguuacacacuuccuguguccuuaacacagccacacacuccuguguccuuagcucaguuacacacuuccuguguccuuagcucaguuacacacuuccuguguccuuaacacagccacacacuccuguguccuuagcucaguuacacacuuccuguguccuuagcucaguuacacacuccuguguccuuagcucaguuacacacuccuguguccuuagcucaguuacacacuuccuguguccuuagcucaguuacacacuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguccuuagcucaguuacacacuuccuguguuuuuagcucaguuacacacuuccuguguccuuagcucaguuacacacuccuguguccuuagcucaguuacacacuccuguguccuuagcucaguuacacacuccuguguccuuagcucaguuacacacuuccuguguccuuagcucaguuacacacuuccuguguccuuagcucaguuacacacuccuguguccuuagcucaguuacacacuccuguguccuuagcucaguuacacacuuccuguguccuuagcucaguuacacacuuccuguguccuuagcucaguuacacacuuccuguguccuuagcucaguuacacacuccuguguccuuagcucaguuacacacuuccuguguccuuagcucaguuacacacuuccuguguccuuagcucaguuacacacuccuguguccuuagcucaguuacacacuuccuguguccuuagcucaguuacacacuuccuguguccuuagcucaguuacacacuccuguguccuuagcucaguuacacacuuccuguguccuuagcucaguuacacacuuccuguguccuuagcucaguuacacacuccuguguccuuagcucaguuacacacuccuguguccuuagcucaguuacacacuuccuguguccuuagcucaguuacacacuuccuguguccuuagcucaguuacacacuccuguguccuuagcucaguuacacacuccuguguccuuagcucaguuacacacuuccuguguccuuagcucaguuacacacuuccuguguccuuagcucaguuacacacuuccuguguccuuagcucaguuacacacuccuguguccuuagcucaguuacacacuuccuguguccuuagcucaguuauacacuuccuguguccuuagcucaguuacacacuccuguguccuuagcucaguuacacacuuccuguguccuuagcucaguuacacacuuccugcaucagauuauuccuuugucagugucuuuccugggagucuccucugucaagcuggguagaguaagaugacggacgauuaaaucagaaugcucagggaauugaauucacugucccggggcccucagagcugacaaugauccccaaggccgugaacguagaaaugaauguagaagacauuaaaagcucuuagaauuuggagauuuauugaguacauuaacggauuuaaagucagagcuauguccuucgugcucacaaagguaaucucaccacugguagaaauuuguucguuuggggcuggggagauggcuuggugcugaagagcaugugcugcucugcaaaggacugaguuggauuccaguacccacaguguguggcucccaaucuccugaaacuucaguuccagggaaucaacugccuucuuccggucucagguaccugcacacaugugcacaaguuccuccacagauguacacacaaacacgcgcacauaauuaaaaauaaaauaaaaaucuucuuuuaaaacauaauaaauucacucacauagaugccugguggugcaugggccaaugaaaaaagagauaccuuagcagguggccuugcuagauggaacuggaucaucccagaugagugacacaauuggaugcucagugcuuaucuccugggaccagagaugaucuuccuguagaacuggccuuuaugucccuuccuggcucccccuccguauaucaaaggagauaaguguauuuucuuccaauugaauuuccuuggucucccgccgagcucugugucagaaggaagcaugagaucauagaaucaccagccuuugaaucugccuuuuuuccccuuuguccugcaggaguuuguuagcugagacagucaugggagggccauccaucaguguccuugaggcagagaauuugggcugucuccuccugguccuggguuaaaugauuccagcugggaaggggagggggggcucuugagaaaauaguuguagagucugggaugcagcucaaugguacaauguaggcuuagccuggggagggcuacauuuaaucccuaaugaccccaaacaaaaacaacuuuuauaguacuucagaaaaacauaaaugacaucuccauuuuacagauggcagguggcaauggcagaugagaggcucagggaaaacaaguuugggcuuucuucaguuucauguuuguuuguuuguuuguuuguuugagacaggguuucucuguguagcccuugauggucuggaacucacucuguagaccaggcuggccuugaacucagagaucugcuugccucugccucucaagugcugggacuaaagacauaugccacugcacuuggcucagauucauuuuauuuuuaauagugugugagcacaugcaaggcuuagcacauaaguguaaaacccaccaaggccaaaagaaggcacugaguccccuggagcuggaguuacgggcuguugugagcugccuaaccugggugaacuaaaagcaggucuucugcaagagcagucugaguccuuaacuacugagccaucuccucugcccucuaccauaaauuuaaagggauaaaauagucaccucuuaaugcaguaucugaugcauuauaaccaguaaagugcaugcuagaagcauuagacauagaccugcacacuugauguaauuuaaucucaaaauacucuugaaggacaaaguuguuauuccaauuuaauagauuaggacacggaagcucaggaucaagugacuggccuaacgagccagagaaagcaaggcccuggcaggauucaaaccccaagaacucuaaaucugggucuucaauuaaaaaaucauuuauuuuuaugugucuagguuuuugucugcaucaugcauguccacaccagggcuuuguaucuggaguaacagaugguugugagccgcaguaucugacugagaacugaacccaggucuccaggaagagcagcaagugcccuugaccacugagccacccagcuccaauuugggucuuccuauugugucuuugcuugggacuccagcaggucaaugucaaccaauggaguuggcauccuacauuugaaguauaaucauucauuugguaaagauuucucuacaaagagaaagcugcucuccucucagugcccaugcagacugcaguccucuguuuggagauaaaagggguuggaaagaaaaacucauucuuuagcagcugccacuugacugccugucaaagaacuaauauaaacugcaguagucacagccaaagagcuaguugaaggacucaguuccaauuuguaaacagagcuuuguguuggcguggucgucguguugggggagcuagucucagagggauaaccagagucggagaaagcacacacaguuaaaaauaaucggggcuggaaagauggcucaguggauugaguccuguucuuccagaggaccuaaguuuuauucccagcacccacauuaggcagcuuaaaaccacuuauagccuagaaccaggggaucuggugucuuugucugaccuccaugcucauccccauacaugugacauacauacauacacacacacacacauaugaauacuacuaguaauaauuuauucuauagugaaguucuuucucuauucuugauaaaguguagggaaagucacaucauguaccuagugcaaccuuugggaaagucucauaacuuagugaaucaagcucuacuagcuauuaaaacauuccauugguuuuauagcuaaaaagccaaccuauuuaaagcuaucacuuuucuucccgaagagagaggagaggccuggcagagggcuggcagcaagagagcucuugcccagacugguacucaguguggacuggcagcucuuugcaguagauucagugucuuggggcguuuugcuagaccugucagagugugcucccccucccguugcuauagagcucaccuugcagguaucuuaauguaugugaaucucuguagcuggucucaugugccuuccucaccucugagcaucccauagcccaccagcuucuuacgcugagagccacuugccccuugagaugaccuucuuaaccucuaauccaagaaacagcaccacacagaugguuccaccagagaguacaaucuaugugcucuacagccacugucccucucucuaccccuggguccacgagccagccgucucccugaccuuuggguuucucagauguguccacucccaguccaucacaguccuuaagguccacacucccuugaacucucuacacagccccccagaugcaguguccucucuccaccuuucaaaaucccaaaucuagaacauaggccucacccuggaagauggagcugucuuggugccugggugaaguuucccugucaggcuagggcacugccauuacuugaacuguuccuguuuaaucccagcagcucuuauuguccuguccaaggucaggauaccugacucccucagcucagguggccuccacuguagcuaacugugaugacaacagugccugcccacauggccuuugugagagugaaggaagacagugugcaaggcuguuacccaguuucugucucuuaguaggcugcaggcuggucaccuccacuucugucacuuaucccagugugacaaagcaaacaagacaccuauggggaagacccugcuuucauaucuaaugucaaccuccggucuccuaccacaauucaagaaaauacacacacacacacacacacacacacacacacacacacacagaggcaugcauaccacacacacauuuaaagcuagcuuggucaauugucucaaauaaacacaaacuuaaaggccuggugacacagcucagugguagaaugcuuaccucgaaugcaagucccuagguucuguccucagcacugaaaaacaaacaaacaaacaaaaagagcaaaaacaacaaccauauaaagaaggccacagagccagcccugggcucaagguaacagccauuugagagcagcucucacaaccaccauccagguuccucucuaccucuaauugguuuaucuuucuauugucucugguagcugccuaauuaaggguugcucuugugagagccagcugcggcugguuugccggacaucuuucccagaaucccuggggcuccucuaauggcgcaguuuccgcagggaggccgagucugggcuccuggcccugugcugagugaugaguggaagauugcuugugaaucucucugugaugcuucacguuuccccuucugcuuccucuuugguuuuuacucaaucugacuuuacucuaaaaagagaagaguggaacaguaagauagaagaccugagacugggcagugguggccuguuccuuaaucccagcacucagaaggcagaggcagaggcagagagagaggcagagagagagagagagagagagagagagagagagagagagagagagagagagaggcagagagagaggcagagaggcagagagagaggcagagaggcagagagagaggcagagagagaggcagaguggcagagaggcagaguggcagagaggcagaguggcagagaggcagaguggcagagagagaggcagagaggcagaggcaggacaucucugugaguucaaggucugcauacugaacuccaagacagccaggacuacauaaagagaaccagucucagaaacaaacaaccaaaacaaaauaaaacaaaaaagaggguagaggugcauucacccuguuacaauuuuuuccuguccugucauggugauucuucguccagugcccauagcugggguugcgcucuccacugggccuccuuuguuucuccgggcuauggcagaagccauaccacaugacccaaaccguuugccucucugacuuggcccucacaggauuuccagcuccugucucucaugccaggaacuggcacggcaccaggguuuccaaggcccaggacaaguagcugugucucucccagcagccugagucauccccucucccuagugucucacugugcccaagugccugagucacucaacccaagcaucuccaaggccacacccaucacuccucuagccugagggccugcugagccaggcccccacucuggugauuucccagcagccacuccacuggccuccguagacccacuggccuccguugacuguuucccuguguaugagcacugucacucugggcaucucucacccacguguuuacacagcugccuucucucugagcucugcauuggcccugggcaaggucuggggaucaguagugcuccuaugcucgaaggccucccaucuagaggacaccgguuugucugaaggcaucuaaauugugcuagggggugggagguggcagcuugaguggacucaccacagaauucacauuugagggccagcagggugccuuagccgcuaagggagcuugucaccaacccuggucaccugacuuugaccccaaagacucccaugguggaagaagagaaccgacuccugcauguuguccuccaaccuccacuuguucccuguggcacuugugugugcaugcacacacaccaaauuuuuuaaaauauguaaucauuaaaaaaaaaaaggaaaucacaucugaguggguuugaaaagagaaugggaagugggugaccauuccagagggaggaaaugauauauaucaucaaaggccagagaugugagagaguauggcuaagguacaggggccaagaguggaaggcaaugguccugcuagugagugacucuggacagccagccaucuggcugggagccuggccgugguccuucagacgugaccuuaccagaguguuuaggcagauagaacaucucuuccacuguggcccaaagcgggccucuuuucuauagcauacuuugcaaauaugauuuuaguuauguucuuuaucuuguuuacuuugccacagugaagacugaacccagggccucacccacacuaggcaagcgccauaccacugagcuacacccccauuucugaauguugucgguuuucugagacaaaaggacuugcuauguagccuagguuaucucuacccucguaauugccuacuuugaugcuaagauuguauguuuucucacuauuuauuuuguugagagaaacaagaugugaacuguuuugguuugcaagcccaagagggcggugguuaggguauucugucuguguuuggauuucuuuccucuauacagaacgauuaaugucaaagaacaagaaaauguuauucacguuuaaauuugauuucuggucuccugguuuacuaacugagcaaaucuguuuucuaucugaggugugcuuucucaguuauuaaugaguagcgucugacugacaacguugucguggacguggacgguacaugccuguuugugugaagcauccggaugcucuaagccccagcaucucccucuccucucccucuccugucacaggucaccagucugagggcuugcacagcugguggcugagagugcaggguacuggcaugaaggagguuuugucaacuguucaucauuuccugaaagacuagcuauucuuuggcuuuguuugaccagcugauggcucaggacaugacugucucugccucugugcucugucagccugaaggagcucaaagggacagcugucuuggcaaggcugugggcaaggccuuccuggaacagcaacaggagcagaggagugggucagggaucacguggggucagugccucccuagcccuccuccguaaccaccuuuacauuccucugugaggcccuggagcucccacagcccuugaucucagugcccucuuggacaucucugucuuuguguuccaagaggcucacagccugcucagugacgagugagucaaaggucagcuugugucuuucugugaugcugugauccuugguguguauacaucugccagaagggcuuggagcaugcuuaaaauagcaguggaaugcuacaugcaaagcauguguccaucacauguugggugaacugugaagcaggugauaauguggcccuucuccuguggggcccguuguucauacuggcuugugucuuuagucucuuucugcuucuuucugugaucuaugaagacaaguuuccucaguaggaaaagaaagaacaaauucaaggcaaagacaggcuauacagauacacacacugaguaagugccugaggcuucugcaggcagcuuuugagcuuggguugugcaguuggacagaccugaguuccaacgcccuauuggggccucgcuggagaucuguacuucugauagagaaggaaccuccaaccugaagggccacacuggggggugcuggagugggggugugagccacccauccuccugguguggagagggagcaaggcagucaacgaggcuguaaguuauaugaaguugcacucacuagguuggccuaggcaagugacucagcguucugcugugguucuuugauggggucuagaucuccaagaacuggaguuacuuauggcugugggugcugggaauggaacccacaagagguccucugcaagagcagcaaguggccuuagcuacuaagcccucucuccaacuccaagaagaagcaccucuauauuuuauggucuaaaaaaaaaaauaguuucacauuucuguuagagaacacagcuacugcuaccaccccgccccaccccaggguagccaggccguaaagagaacugcaaaugagguaagaagaccccgccaggccccugcuaccuggagaucagaggcagccugaguauugacuaccaagcucuacucuccugcccacagagugacugcuuucacagagcuuaaaucauguauguccuauuccccugccuuggucuuauaguauaggaaagauaauaacuaauccugcuuccuccugauacaggacuucuuuccucagacgccuuauacaguaggcaccuugcuuugucugguaaggcuggauuacuucuucagacccucccacauccugccuacuguggcaauaauaaaugccuuuucaacuucaucaguaucuagaaugacaguuccuaccaauggggcacaguguucaaccucugcuacacaaaauguggugcucggccaucagagagaagaaugaacuaaaggcucugguggggggugggggggugggcagggaggagagcugggagccacuccugcauuaacauccagagauguuuuaaacugugaugauuguggacauucaacgguugcagguucaaagcugcguaaugaugggcuauccucacccuuuaaacagucacuuaucaccuacguuccuguguaaccuaacguccuugagccaagcacuccuugucuagcagcuugccucagauagugcacuccugugaaccaguuacagauguaaaaucccucuucagaagacaccccaacagauagcugaagauugauggggaggcucugaggcacccccuguucaggguggcaguuuuucuuacgcacccucucauacucugcacgagagucuccuuacuuccugcagcguggaguccaucuuuugaaagaccgggagugcuuuugcagagucuuccagugucaugaauuuccuaacaaucuucaauucccucccacauuaaaccugccuaaagaacccacugugugcagccuagauaaccaaacuggcuguccuggaacucacucuguagaccaggcuggccucaaacucagaaauccaucugucucugcuucccaagugcugugauuaaaggugugcgccaccauuucuuucuuucuuucuuucuuucuuucuuucuuucuuucuuucuuucuuucuuuuuuuuuuuuuuuuuuuuuuuucgagacaggguuucucuguguagcccuggcuguucugaaacucacucuguagaccaggcuggccucgaacucagaaauccgccugccucugccucugccucugccucucugccucugccucuuugccucugccucugccucugccccucugccccucugccccucugccccucugccccucugccucugccuuccaagugcugggauuaaaggcgugcgccaccaccgccuggcacacagguguuucuuaaugaugaauuccuauguuggaauugccagcccaagggauaacaaugugaaaggcucugcucauuaauucacacacugaacaaguagucaauaaucagcuggauguaccuggauguaccaacaccgcugugcucuccacagcccccauggugcucuggucucucccaccuccucccagcagugggcacugacaggcuucguucucuuugucagucuacuaagugcagggaugauuccuuguagcuuaaagacuuagcugcaaaugaaaugcacacaugggcaaagaaaaucauaaauaaauauugaugccauuccggggucaagaaggaugauguuguuguuguuuguuguuguuguuguuguuguuuugagacaggguuucucuguguagcccugucugucauggaacucacucuguagaccaggcuggccuccaacucagagacccaccuguuucugcaucucugccucucucccucucugccucucucccucucugccucucugucucucugcuucugccuggauuaaaggcgugugacaucaccaccuggcucaaguggauuuuaaaauagcuuuaucaaagcauaaaaucgcucacccucugucguguguguguuuuuuuuaaaaagaugugugccugcuugccugcaugucugcagaucucuauggaggccacuggaaauggagucacacgcaguugugagugaaccaucugauguggguucugggacccaaacccaguccucugcaaaaguagcaagcacucugaaucacagagccaucuccccagccucuugugacuauuuugaugaaauuuggugaacauaugcaacuguguccaaaagacagccaccuccccaucacuccacaccaaagcaaccacugcucuugugcagagagcuguuuguguuuucacuuguuaguuggacuugugagcuguuucuggcuuuuggacugcuaugaauaaugucaccaacacucauguacaaguuguuugcacauguacguuuugguuuuuuuucuucagcuuaggaguagcauccuaggucacauguuacgugugugcucaacuugaaaaacaaaacuuuuucugaugugguggcccauugugcauuuuccucagaaacaaacuccaggucuaguugucccacguccuccauagcagucgggaucaccuguguucuucauuacagccauguuagaaugucaacuggugucacacuguggcauuaauuuguauuuucuuaacuauucauagcacugagaaucucuuaugagcugguguaucccuacccuagugaaguguccccgguucuucuguuuugaaauuggguugcuugccuuagugaguucaaggagaccuuuauguauucuguguguagcucuucaccagauauugucuuucauuuucucaugguaucuuggaaacuaaaacacuuaacauucauuaucucaucaguuccuuaucugaggucuucguuugguuuacuucuuguucuguuuuugagucuuacugugguguucagguugauccgauucgcucaugucucggucucugcguacuagaaucacaggguuuggcuauuaucacaccuggccuuuuuuuuuuaaugauuucuuuuuuuuuaagauuuauuauuuauuauauguaaguacacugucuucagacacuccagaagagggagucagaucucguuacagaugguugugagccaccaugugguugcugggauuugaacuccggaccuucggaagaacagucgggugcucuuaccugcugagccaucucaccagccccacaccuggccuuuuuaagauuuauuuuuauuuuauauguaugaauguuuugccugcaugcaccuguacaugcucguuggauucucuggaacuggagccaugggugguugugagccaccauauggguggcuggaguugcaacaaguguucucagcagcuaagcccucccccacuccagcccucauaccuagcuuuuaaaagugcuuaauugugaucaucuaaauuuaccuuucuuccccaccuguguguguguguguguguguguguguguguguguguguguguguuagucccuacccaagaaauauuugccuacucugaggucacacagauacucuucugguuuguuuguuuguuuguuuuucuuagagguuuaugauuuugaggguuuuggguuuuuuggguuuuguuguuguuuuagguuuauaauccauuucuaauucauucuugucuauggcaugaguaagcaacagagauccuuuucauucggcucuccaucguucccaguguuguugagaccuuuauccucucuaugagcugcuuuagcacaucugcccagaguaaacuaaccacgucuguaaaccacaucuauaagcuagcgguuuccugggaaaugauuaacaaacacuucuuggaacaaaggaggggaccuguggguaguguuggccgcuuuccugugugacuagccuugguggcucaggcugcaaguuaccaucccugagauucugucugcuccacaagccagugugagucugccaugacccacgacugcucucuccuuccccuucccauucaugugcccgggagccuguccucaugugggcaaugccuuugguuaccauagcauucuaaguuuugaaaucgggcaccaaaaacccucaaaacuguuucaucaauuucuuuauuuacacacacacacacacacacacacacacacacacacacacacaucagcuuuccacuuucuacaaggagcucuguuaggaucguugaugguugcuuuaauccacagaccaauuucuagguaauugccaucguaacaauauugaaucuguuuguaacagcccuuuggguuuccccucagcugcugcugucgcuuuuuacuagugcagcauguaggcauacugggcuuugcacacccaugugaucuccaacagccuccuuaaauuccauucuucuaccagguuuuaucagacccccggggaaggaaacugauuccugguuucuauucucagcuaccuguccucauggcucuauccgugcugcgcacaugggcucucuuuguuucagaacccuuucccaggugugcaggggccucugagcugcaugcagccagacuaccaggggacacugggcagcuagugcagaaugucacuuccuuaaugagggcacuggugccuugacaccugucauccccagcuguuacacaugucuuccuuccauggaugaaauacaguuuugagagagagagagggagagggagagggagagggaggagaggaagagggggaauucuuuccuuguuuagaauaagauuauaacagucuauucauauaguguaaugaguuuguuagaucuuaauggauaggaaaacuccuuugcgaccagagcccuacauucucaguguggauaccccuucugcuuuucacacaaaagcucugagaggugcuugcaagccuguugcccagccugaaagcugcgcucugaccuugcugugucugugggacucagucuuccauucucuccacaagaacaaaggcucccuaagcugcucuaacacugggaccagggcuguuccguuucuuuuaaucuacacauccuccugccucuaaccagcccugacaagagcuuagcagcugacagugcucauugccugccugugccgggguucaugaccuagccuccuucccuccguggaggccauguuaauauagcaaacgcagacaagccuuuugaacagaggcaugguauguuuccauggcaacauacauuacuuaugaaaaucugcaggaagauuugggaccauuacgaguuaagugcgcucuucuugcacaacgcaacugggagauguugaaauuuuuauuguguggaggcuaggggacaaaauuugauuucccaaggauuuagauacauaauaaauaaaucuggggcaugugggaagagaaaugaaauuuuuacacggcaguaauuggcagcaauccguuauucuaagucccugccauuguaaggaacaagucacucuucuucacacaguaaaacuuguuucucaaacaauucuguuuuauuguuacucauaaaugucaguccuuuuuaaauuggaaacaaaauaacggcuucuacccucuuccuucacaauuuucccuuuccaaggccacacucuguccccgugcuccagccugcuucccccuccucccucuuuugggacccagcucagcagugucaggcguucacugacugcugcuuugugcaaucugacuugaagugcacucagcaagagguaagcccaguccuggaggcugcuguccugauucugcccaccccgggcacuagaauauugacuugcagaggucagagguauagcaauagcuggacacauagcugagugucuacaaucgcuuacgucucccguaaaggcuggaaggcggaggcugcacucaugccugggauacaaggcagcugagauaacuucucuugaaauaaauaccucuaaugaaauccaaauauauuuauuaucuaauuauccaccagugguuuugugauucugacaggaccccauauucugccucuuagccuuuacauagggccuguaauaagacaauccaccccaaauggcuagaggacuauagcugagaugccuucgccuucuccuuuccuucugagacagggucucacaguguggcuuuagcuguccuugaccucacuguguaggccagguuggucuggaauucacaaggaucuccccaccccuuccuccagacugcugagauuaaagguuaugccaccacaccaagccuauggauugcuucuaagacccaccucucugcccggguucgggcucaggugcagugucuguggcugagcuugacuugaaggcauugagcguaccugugacagauguguggcacugccucuacuauuucuaaguuggaccaacacagagugucuuugucaacuuggcugggcaggaagcuuugccaucuuguuuuuguuuuuauuuuuuugcauggauguaguuguggagaucacaggacaaccucaagcguuguuccucuggugccaucuuucacuggccuggaacucaucaaacagaccaggcuagcuggccagcaaacccaauggauccacccuucucagcaucccccagcacggggugacaagcacccuaccaugccuagaauguuggcuugcuugcuuuaacagggauucuggagauccaacucaggcccugguacuugcaagacaaacacucuacugacuggguuaucuccacaccagggcugugaagagaaacucagaggaaggaaggaaggaaggaaggaggagggaggagagagagagagaaagagagagagggagggagggagaaaagauuaauaauaauaauaauaauaauaauaauaauaauaauaauaauaauaaauagccacauagccaggccuaguggugcaggcaggauccugcuacccagcuauugaggaggcagaggccgggaaguucacagccagcuugagcaacaggaagcucaaaucuugggcaaccguaaugagguaaaaaguaagaagaaggcugucaggagacggagagcccuugcauagcacuugugaggccuuagguucaauaccuagaaccacagcucagcugggugggaaccacaagagaggcugaggcugcugugaguagaaacacggguggggguggggcagcagaugggagucacauaagggacaggauaauagccacucacacacacacacacacacacacacacacgcagagccaacacaagauaugauguccaaaugaugcagggggacaugcuuguacuaagacaugucacagucacagggauucccaucuaaagggaccugguuguuagguucuggcgacauagaaacaagcaagggaggggucacccugacgauuuggacagcaaagguucuuugcauggcaaaguagggaaagaaagacuggaggcuggaggucaucgagagagcuccugccuccgguacccagggcccugagcugaucaccaucacacaaaagaugccaaggggggcugggaacuuaaugcaaggcugcagucugucugucugaacaaguccaagucuuuagccuugcauggacaggcaccucauguugagcucccaaagcacugguggggcugggugucucagucuccuuuagagccuggaacacaagacuugaaggugagagcgguuguucuggaucccccaagucuaggucuggaaaggacccugagcucuuucucugagaucuccacugccauccccagaccugggccaauucuaagagaaaaacaaaacaaaacaaaacaaaaaaacuguugggcucuggggugcucgcucccagccacaccucagucagcgccacagcaugugucaagagccggcucuggguguagcugggguggggacguuucucugcugugugauaguucucaucacugauauuuucuuugaaucauaggaaugaauucagagcauggacugacaucaagccugugaaacccaucaaagccaagccccaguacaagcccccagaugacaagaugguucaugagaccagcuacagcgcccaguucaaaggggaggccaauaagcccagugcagcggacaacaaggccauggaucgcagaagaauacggagccucuacagugagccuuucaaggaaugcccgaagguaaggcagcucuuacuguacagucccgaggaagcaggacacggggcuccggcuaguccccaggagcuccugaugagccacacaggcccaggggcaucuccaacaggucagguccugguaagauccaagggcacacuagaaaggaggauuacaugaaagcggcuuaacauuuggcacaucugacucuguauuugagaaaugaaaagccucacccuggugcuacagccccuuuccuggcccucuucacaaccuggcuauggcccugcagcugugccccuccaccccgcuccagucccuggaccuuuccuucccucccaggcucugaaucacauucaccuucacucauccuucagguauuuucaucucaguauagguugguuaacaggagagacaggcuggacagagcuagccaagcagccucacaggccauuugcugcgugucaggccagaugaggcugggcacauaccacuuguguaauagcagaacacgucugaggagcaauauaacuccagagccuaaguggguggccucucccuccuuuugaucucaaguguagcacucaguuggcauuuccauugugugucaggaccagcuuuuagcuaagguagccucccgaccuaguuugucugagaugcaccuaguuuuaaccgaauguuucacauucccgggaaccgccgccccaguuucaagcaaaucacacugagaucacugguccucagcuagugaauggcccagccugggaggcccaauaucagcucuguacauccacagaugaaauaggucccaggauagauguuagcacugaaugaaagaagguuccagcugaggaaggagaggggauggggaaucagggauggacagcaggguuugcuguaugaacucaucaaggacaguggccucagaguccucugagaaagagaaggcaagacugccucuucagaacgaaaggaaaaaccaggagcgaggccuggagauugggugcugcuucggggaagcaggcaagauccagccagagauaagcacguggcugguaguacccauugcaugccugacaccugaguuguuccaaaacuauguccuuaccaccccggggauccaccguaguucaucccuauggauaccgaccuggccucuuucguccagaaccuggaugaccgagcaucuccucucugagaugcucaaagagucucuuguccucacucacugcaacaaaccacaugcucuggccugagcagaauaagacauaauaauucuaaggagaagggacaagagaugcuguaaccguugucuagccugccaaccaccuggccugcucaccaaggagaaauggcagggugggcaguucguggcaggugagcgcugcuacaggcugccuguggauucagaccagagaagccaggugccuauacacugugagauccuguccucucccugccugucugcuccgucacuagccacuauugugacucuuuuguuaauacugcaaugucuuucucuaaauccccucucccacucccucucuucuguguuucuauaugugugcucugucugucugucuuuccauacagguagagaaaccuaguguucagaguuccaaaccaaaaaagaccucaacgagccauaaacccccaaggaaggccaaagacaagcagguggugucgggccaggcugccaagaaaaagaccacagagggccccagugcuaccaaacccgacgacaaggagcaaagcaaagagaugaacaauaaacuggcugaggcgaaagaguaaaugucaccgcacuuccuucucuccccucccccacccccuauauuuaaaccaaccaaccaacaaacaaaaaggccacaaaacuaauuagagacuucccaucugccuugguuccaagggucccaggagcccugcaguugguuucuuaugggagaaauuauguuucugaggccaccgacucuuacuacugguggcacagcaucuagccaaggguccccugggagcccgggaagcagugugcacuggcugugcccuuccugugggucuggguugggucaggucuuaguuacugccuagcccagcuccuggugggacuuggaagugucugcugcagggcauccuccccuugaacagccccacaguuugcaucacgccauuuuggacuuaggcaaauguucuuucccaaguucacuggaugcuugcaugcugcccaaguucagcuugggcuucagcuuuuagaacuugugaaaacguuaaaaacaaaagaacaagaaaccaaccuuggccuuacugucagugaaacggaauugugucuguuaacuagaagaaacccucuccuggaaccucuguuaggagugugugccuguguucugugccuauuggugggcuuugaauagugugucaaguaauaggccacuggcugagaagugacagagagugaguauuugggaugcuguagaugguguaggaggagcucugagcaaugggagcccgcuuuucucugcccuuagcauacugcugaugugcccaacaccuaguuaagagagaguggucaggugugagaaggcacaucgcacgcuuauugugacuuuuuguuccuucggugugcagguggaguguguaggcaugacggcgaggguggugaugcacccuccagccccgaccgagcucuugcucugcuccacagaaaggucaaugugcugagcauguggccaguguguguagcgaguccugccaagcgcuuagccagcaucuuugacuuucgaagcuuagaaacagcucuugacguacuccguguugcagugucgcguguguggggcugaagcccccuagaguuguguuguaggaauuagggaaugguuaugaaaggaaccugcccuccugacuuaugaggaaacacaaacuauccaccagaaauguccuggugcgauagagauugcuucugucccggaaguucucgguguucuggguaguuggaaugauccgccccagcuugcuuucuccuguggugaaugguucagagggcagaucugauggcuccuuggucucuucaggucccugcaguuugggaagguggagcuccaaagagccaacaaagucucuccgugcagacagggaaggcuucgugugcaccuugugagccugcuugagacauguuugaaaaugaaugcaucagcacugggcaagccuuuguuuuuagcagagcagacuagaaaugaagucuacagcauagcccgaugccugccugagucuuuucugacucagggccuggacugugaaggagacaggcuagagaagggaggagacaugaugagucucauuaccacaacucacagguuucacaggccuguucagaaaugccuagagcucagcacuguuccuggcuaccuguuagccagccuuacuguuuaccagagacucuaucaagugcuccaacuguagcggccggugcguguuccucucaauccccggcgucagucagaucugcuguuagccacacuuugauuucccuguagaauaaacauauguuucauagaucaaguaagucagaguuuacagugcacagggauccuucauucgguguucguguucugcacaccuugugccaggcuuggugagcagacaggucucuauaucagcacauccagacagagcugcaugacgaccccacaugugccgugacucaguggaauugguguugugugcacuguaguuugccauagcuuaccacaagggcccccagagccuuaggggcugaauuccuuacccuguccugccugaggcuuuaggugaccuggauaauguucuucucaggcugucaggguuccccccccccuuuucacacacccaccuaacgaacaccguuugcucuugaauguuucacuccacucacaagaaaugcccuuuaauuucuacuguuuacaaacaaagcucuccaggucuuauucugucucucaaguguacuggacaaaacugaccgugguuccucaagcaauguuuggugucaccucucugcaggugaccaagcccguuccucacuucguacauuucccucuguucucuguucacccuggagcgagagagcuggaacggggacuuuuucuuuaauuuguccugccugcaaaacuccuggaagcuaugcccggcuucccguucucugccccagcucccagacagcagaagaagcuuugucacacccaggcagagaggaagugucuacuuaggauuuuguggcccggguguuguugcauaccacagauugucuauggaucauguagugcuccccucucuuggugcuauuucauuccugauguuaguaaaagaaugacaaaaacaaaaaaaaaaauucauguauagccaauugauugugacgucacguggucugugccugcucagaaagcaaaucaauggguucccccccccaccaccacucccaguuauaaauaaaugcuaaagacaaacaccacuuucuugaucguauuuccuuggugaggcccagccugaguaguauaaagacaacagcuuuuggcaucugagccucucuggacaagaugaacugugcccugcagcuuccccgggggccuccauaaugcagcuugccucuuuuagauugccucucagguacuaauugcaagcagucagagcuaaauguugggaaaggcgaagauggacccagagacgcccuggccaacaagguaguguaaaauuuucaugccgugucccugggacagugacugccugagccacccgccgccucacugcagugagaagcugcugccuaacucuccccuucuguggccagcggcaguggcagcggcugcggcagcggcagcggcccuggccuccuuucaugcgggagugcagcuuacucauuuaauccauggucaugcuacagguuccacccgggguuggcucuguguugugcaugugccugacaugggaaugaaaaaauggccaggagaguggcucagacaaggauucagugagucaggggacucggaagcucaguggagaacaguuuuucccgugggggugggaaauaagaaaaagcuuccuguuggagggcacuuagaaggguggcaggauauacgugugcugggcguguagggcaggugccaaggcaagauucggggaugggaaggggugggguugguggagugcuucagggcaagaaccucgggcgcucacucuguuguccuucuaguaaagcaggagacaaagacuuugaucccgucguuucuccaaccugugucuauuggauacuguuguaugccaggcucugugcuaggcacuagggaagccaggagacugagaccauaccucucugaucacagugggcguggaggaggaaucuguucuagcugguuccauggaugagaaaggacucagcagauggguaggugaugaucggguaaacagaacggaaccuacccaaggcaugccagacagaggggcgugcccaagcaaagguguggauggggccaugaacccgacaagcucagguugugggggugggggugacaagggcaggagagagcagaguuccauggcggaaaugccuugugucccauugugggcggcuucuaacuggggcuccaucccacguacccagguugcacccgugcccugcaugccugccauccugcuucuugcuuuuccaggccacagucgcggguccuuucccauucucccugagagcccuaggacggcacuuccauugcuggcccuaccccagcauuugggaauguaguguuaaaaaucagucuagaguauuaauauuuugaaaauuacuacauauuuguuuuccagaugaauggaagacauuugcacccagcuguuauuuuuauaagaggcaggauacagaacaaaugcucaacacauaaagauauagauaaguguuaguuuucauuucagagacuaauuaggauugggagauaggacaggagagaucagaggugcagauagaggcgaaagagagaaaagaaggaaacuacagaacaucagagcgccaagaguaagcccagagagugagggaagaggagaugcugacagaaccaggccagggcaagaggaggagguccaagggaggaggccagagagcaggucagccuggccugcuucaucugcaccacccaggugacccaacccaagcccacacacccauggcucccgacacggcccagagccccagcacaagaaccuacaacccugacucauaucacauuccuaagacaaccgacaacuaaaccaggcagguagcuuuagaacuaccugcuaguuuacuguuguaaacuaguuagaugugaguuucaauucuugcuucagguguauauauuuuuggugcgguuccacccagggucauucccaucucacaaaagcuguggaccccugugguaccucguggugguuuccagggccauggacugcucaaaugcugaaaugcucacaucucagguauccaaaguuucagggugcaccauguaggccaucaagcacuuaaagcaggcugcugcucccuaaacccuaucccagcacagccugggcaguggcuagaaccauggugacagagaugcccuuucccggggccacacuucacagucuggcagguaccccagauucuugcuccagcaucuacagggcucacaguaccccccuaacauuuaggccauccuacaucagccaugcagcaucaggagagcaagucuaaacaccucaggcauuuccucaaggaguuuggcugagauggaaagggcccucagacacuguggggucggcagcuggaagcugggucuucacuggccucuuggauggagucuuuguacccuucucuagaaagaaggacuguaagcguggggaugggacuccagagugcaagggacacagacacuaggcagauuguuucaguacuguguaguacuggggugguaugugauaaaaugaagcuaacugagaaacuagucauacaagagguugaaugagucaaacaguccaaagacaaccgccgccuugagagaauuccagcuauuggauucuuuggaguccauggacugaauaauguccaaacaauuuauacuuuaguugcuuacagagcagucucucuaugagcacagcgaggcaagcauuugcccagguaucagauaaggaagggguagcuccaaggggaaggcucuggccagcuuggcccagcuugaaagacaggaagcuuaggacuggcuggaaugaaucagguuccagacaagugggaccccuagggaaaauuacacccaaagcaggcaaaaguacacuguggccuggccgucacaagcccuccagcgagcaagcccagcacucccuuagauacuagaauccagugugaacugggaggaaaucagaauuggaccaggucuucuguuaccagcugugugauggaauccagaggaugcucugaacacuggagaguggaggccacuccuuggugcuuuuuauuccgaacacuugaguugagcugaaaugucugucucuguccucgagugaguggcucuuggccacuugcucacuagggaccauacucagcugucucaacauagagucucaggaaccuuaccuggggccaacgaaauuucaagugcauagaaaaguaaauuauugccacugcuaugggcggaagcugcuggagggcucucaaaggggccuugcaaggcugaccaugucauccccugcuugaaaccaucggcuccggcucccacggccugcagaagcuuauucucagucaccacgcugcuucucaccuccaugccuuccccacgcugucccuccuacccagaaugcccuucuccugcuucucacccggcuaacucauccuucaagacucggcucaggggacugcuccaggaagccuugccugcaccuuccaggcuggguaagaugcuccccgugugugugucuucaucguggaacucaucacauguccugugucaucagcucacaugugugugcccuccccgccccccaaaacuggaucaagcuccuccaggggaagggucagcuccuucugucaucuucuuccuggcccaaugucuaccacagagaaugucuucugaaguguugagugacuccugaaugcguggaugggugagugaccauaagcacugugugcccauguucaccguggugccuccacaaggcuccuuuauucugccucacaacuuccccugcuccuaagaaaggagugguugugguguacucgccaugucaaccacacagcagagucagcugccucuaugaccgccagccucgguuuggucugcaucccuuuguacuugauguagcuacuaccucuucuaagcagucuucaauucagaaaaucacaagcucucagauacaaaguaaucuuuuguuugguuuggguuuuuuuguuuuauuuuguuuugcuuuuugagacaagguuucucuguguagcccugaaacuaacucuguagacuagguuggccucgaacucugagauccaccugccuuugccucugcuggaauuaaaggugugcuccaccaccgcccagcucagaguaaucccguccccuucccugcucagagcagagaccucucaucccuggcauagcaaagaggcaucuccuuccaccacccacucugaauuugagcuggcagcagcccuguucucuaauccaaacucugcuguuccagcugugugaccuuggcugagucuuagaaugucuaaaagccucaaaguuguugcuguaauacuagacugucucacccucuaaacugaugugguauccaaauucaggaaaugcagauuggggcagccaggaaucuguuuggugcuggagcuugcagguggcagcuggaaagagugcugauagcaagggcuccugucacaggucccugcucucuugugagagcuggaugcagguggaccaccucuggcaauaguugaauucccagugcuuugcuagagaccacuucucucccaucuccucccucucaccuccuugguucacaguauccuagcugcagccacuagcagccacuggaggagacgccauucucucuacagcaggacugagauccaggcuggcuaacauggcucucacugcccccgacccccugccgccgcucucacugcccugccccugcuccagcccuucaugggcucccuccucucugagcgccucuauaaaucaccugugcagaucccagccuugcaauuacgcguccuuuuacacggaaucucucuggucacagagacacagaacagaccuugaugaauugcugaagauugcuaucuuuugcuuuacgggggucgggggugggggguggggaagcaugcaaaaagauugauuugcaaauucccaggagcacagaguuagauaauagcugagccauuucugucuggcagccucaguccagugcacuauauuuuuaaaagagucaauaggauuaccagguucuuggcaacucauucagagacucaauucugcccuugacuuugccuucuuggaguuaaaauaaccaaagaugcuuuugauaauacuucuuauauauacaacugggaauucauuucauucuuaggucaaaucuacaaaauuuauuuaaugauuuuuuaaaaaaauaaauaguaaauacauuuaaagggccacuuagccacuuagcugacuucagaagcccacgcccacguggagagacagagcccccaagucuuagaagaaucugggaaccaggcucugggcucucuaaguugcagggccgguccagcucacaggaagggaggaaacacugacuuuacccgacuuggucucacaauaaggcucuuuacagauaaaggaaucaaaacucagugacuaagucacaaaaucaaacagucugugagugugagccuagauuugacgccagugguugaugcuacaaaacucacucuugguccagcccuuggaugcagcuaggacuccugcuuucccagaacaccugcacccuacuauaagcaagucuuccccugcccccuucucagggaccauagcaaccucucaccagaggcccuggauuuguaggcaaauuguggguggggcucacucuccuacggguaagccuuguggaugcagccucccccuccccaccugugauuccagcuccucauccaccuguugagccaccuugggugaacucugcccggcuggugucccuucugcuaccgugcucagguaggcuagcccuugagccaggacgcugcugcuuucuggaacuguuuucucuguuaggguguguugcaugcuggagguaaacuuggggacaggacagucuggcaugguaaauucaggaagggcuaaggaggggggcgccgagcuggcacugccuagggaucugcucuagaagaugcauuucucagaaggugcaauugaggccucagagccugaguccugcagaagucauggaagacagccaggguugucagccgcagugcaagccaaacuugguucugagcagcagauguacuugggucucgguauuugcagagaggagggagcuccuccauggagccgugcuuugcuuguacugucuggggcaacucugggcaacucguaguccccuucugagcuccuuuccuccucuagagaguucaagagagaacaaucccaagcugcagggccuguacacuagaaaacaaaaagcuguauccuaucaaagguucccuuaaacuuagauagcccuguugaagaggucuggagauccugaggcaaacaaggcuaggaaaaugugcauguccuauauacauggccaucagaaucugauguaaugcaaauuacuuccuagcuccccguuuaggaugccagccccuaccguguaccagccuaugcuaugccucccuauuucccaacuauauucaguggccacacacugaguaggcaugugugagacguuaggggaaggaaagaggggagggagagaagcaguaagcaucguccauguccuuagagggcccagucuagagacagcuacagccugaugagagcagcagcuguggaggaaggaggacacacagugggagucagagaugcucucacuggguaggcagccgagaaccgagaaccgagucuucaucccugaggagggucuccuagccuggcaggcaaggagagcaggaaggcugguugguaggggugaguucagagcuaagaaguuguguucuguuuggaggucauaccuguggcuuagcugucaguucugagcucugguuccugaguggugggagcugccugagacccguaagggauaguagucugaccggagaccuguaagagauaguaaucugaccagugagagcugcugaacucuuagcuguggggcguaugcuacccagagaggcugggguaaggacgugacugcugccucuccuggugcaggcaggauggugguccuggaaggguggcuccagagugccaaacaccaguuacuuucaggucucagaaccacugagauuccaaggugggcuaugucaugggaaugcauacccaccccagagcacuaaaggcaguuaggaccaggaagaugccagcagagaccaggaggccugauggccccagguaccaguauucugguuguguggggauacgcucucauggagcaaagaggaaagacuuccuagcaaagugaugucuuugacccuagagagaacuuagagucuguuugaagagacacaggcauucaggguuaaggcaaggaagggguggcauggcuccuguucacugauggugacauuguguucuagugugucuggggcugcucuaggcacagucugggucucacuucugugcuccuggcccaggacugaauagaguguacaugccauaggguuugcccaaugagugguuaaaagagaaaaauaaaucagagaacaaugaggccacgccccagcuguuauuguccuuccaugucugcuagauuccuugaaagaaacaaagaugaacaaauccuagcccauggucuagggggaaaggcagacaaccgccaaacaacauagugacuaccaagguagaggcucccaccauguccuggcagagagggagaauaggagagccccccucaucuccauggaucuuccgaagaauaaugagccuuccaaagacaguuuccuuggcaaugccacucaggugcugcauuucccaucucuaacuuaggaacuguuguacccaggaaacacaugaguguggggucccuggagguagacaggcagugaaggaucaaagcuaugaugucagccugucugcuguucaccagcugggugcuguuggcaugguuggcauggucccuggucuucaagcucccuuugcuccaaauguauauccaagaccacccacucaccaagguaccaaaaggaucacauuucugcucauggcagaaacuacuuguccacccucaccagaugagggaaucucucuuuugggcugccauucccucaauaugaccuguguuccaggagucacgcugagcagucuaucagccaauccccuuuuauagauuuggagaccacaacuuagagaaugguguccguggcgucaucccauggcuaggaaggagaugggucaguguuugagcucagcccuuacacuucucucucugugaguuuguuucuuaacguugugugaugcaguauagggaugacgcagccuggcacacaacuuuugcucaguuagugaggcucuuuuucucccuccaggcuuuuccugggcaguacucuacacaguagagcgcauugcccugucuagguauauugggggaacuuuagaaaggaagauuaggcuuggggagccagggguggggguggggacuccaguggcagccauugaagcuucuuucccagcugcuccggaccaggacucaguagucacuucucgauucuggguugguuuuuuguuuuguuuuguuuuguuuuguuugucuuguuuugguuuugaggugcgcguguuggguuuuguuuuuaagacaggaguuuaccaugugguccaagcuggccuugaacucaguauguagccucagauaguuuuaaacgcccaacaaaucuucccgccucagccuccaaguucugggauuacaggcacacaccaccacacccacuuucacuucuagauguugggugaauggauccaguguccuugugcccucaggcucugacugucuccauggaaacaagaggcugugugugaagugucugagacccggucuuaugcauucuugaaaugcuaauuugaaauaggagagccuagcacagaaaaagguucgaguuugucuguucacuggacaaacacuuggccuuauaguuugaccuggucccugagugagauccuguuuaaggugcagaggauacagcugugagcaaaguaggccugguucccacccucugaacaccuccagauagccugggaaacaucagcccaaaagaguaugcaaguaauugccuaagaaaagagacagagaaagcugguggacccccuguggccaugccuggggucagggccgguucuccagggcagcugcagugagcugagaaacccacucaagacggguagacuuuauucaggugaggagcuaagggaacauuuggggcagagggaaggggcauuggaagacuuagccaaugcaaaagcuagaaaaugggcaggagagaagaguauacuguugucucacuuccuagcagacccugcucucuauccccagugcagagagaagucccuggaguguugaagcagggaaggggcaggacugggucugcuuuccuccagauucucaucucuguauggagcccacacuggagaacaaggcagaaggggacuauguuagugcucugcagcaggugggagggguguagacugagaggagcuggggugaugauaccgauggaaagaaggaggcgucugaggggaaagaagguugauugacucuggcugugagcccguuaucgggacuaguaucuauaaaucuuuccacuuggcccucuucauucuggauacugacuagguauuagaucuucuucagacaaggcacaugguuccacccucaggcacugagggucuaauggcagaaucgaagugugaggagagagagucagacaaggggugagcuuaugagaugugaacaaagaccuugugagcaaguuuaguccacccagccaagucuucagggacaggcagggaagaguauguggggagguuggaccaagaagcagaaaccgcagauggaggcagcaccaggaggcucuaaucagcguuagacaaucagggaggacuaggacaaaggucacaggaaggcccaccuuucugcaggguauccuuggaaguuaaaggcaauaaaccauuacuucgguuacccuaggacugggugugccggugucuuauacccaagaacuugacaaauacaguucaguucccaagagugauccucuguuucucugcccuaacaaucccugauaacugcuauccccauuuuacaggugaggaaaccaaggcccaugugguucaguaauugcccacgaccucucaggcaauaagcagcacagaagggaagaucaggccaaccugucugucucacuuccagagguuugcgcuguggggcccccaggccgggagguagaaggaauguuaucacggaagaucugaagcuggcucggggcagcagaucuagugguacagacuauccauacccaagacaaagagccgccuuguggcccagagggacuaaacccagucacuuugcuagccugucaccucccuagccuccauuggaggggcccuuugucccuuggauacagcaccgugaguguaacuccagcugcccuagagguggugggcacaugccacagaggaaggcuggcagagaugguagagccacgcugugacugccuagggauagugagggcucacgauaaccaugaggguggcucugcucaugggaaacccugucaaaaucaaccugauuuucaaaaucaaugccuaauuuacaaaaguaggaaaaccaaauauucagcuaaacauagcaaacuucauuuaaggaagauuuaugucucagcccuccucaaguauucaaaccaaaucauaaauaauuuaagcaugagaauccugcagcuugguggguuauaaauguuccaucacuguuuacacacuuuguuaaaccaccucagguucuuuaacuuuaaaugacaucucauuuaacagaugaaugggguggcuucgacacagugugccgcugcuugggccagggccaggccagacgccucucuucccauagaagccggcagacacacugggacagacuuaucucugcuucauugacaucagaacaccaagaguggcagccauucucuaauauuuaaacuguauaucugcuuguucuuguuuuuaauuauuugaggccgggucuuccuguguagcccugauuguccuggaacucaaccaaacugaccccaaacuuacagagauccgccugccucugccucugccucugccucucugccucucugccucucugccucucugccucucugccucucugccucucugccucucugccucucugccucucugccucucugccucucugccucucugccucucugccucucugccucucugccucucugccucucugccucucugcgccucugccucucugcgccucugccucugccucugccucugccucugccucugccucugccucugccucugccucugccucugccucugccucugccucugccucugccucugccucugccucugccucugccucugccucugccucugccucugccucugccucccaagcaugggauuaaaggugcauguucacacccagaguacauguuuauucaugugaccccguacugcuaaucuuuccccggucugacuggacgacucacucuccagagucacuuucgaccccagauuuuacgucugauaagauauuagagaugcuugcuugguuuuuccuuagacgcaucaaaaaucagaagguggcuuugguuuuguguuuugagguaagauuugauauagcccaggcuagcuuccaacuuuuaauguaguccaggauaaccuuaaacuugugguccuccugcugcccccgccuucacugacaagugcugggguuggaggccugagcuucuaugucuaguuuauggaaugcugggauagagcccaggcuuugcacaugcuaggcaaacaugcuaccaaccaggugacaaccccgauuccccagaagaacucuuaaaauuauuuguucauguccugauuguauuugaaauaauuuauaaaccuaauuucaucacaugcuuuauauuuuaaaaaauugcaaagcuaauuuguauacuccaguucaccaaacuaccuugaacuuuuaagucacacacuuuccuaaagcuaauaaaaaaacaaagagagagaaaaaaaaaaagaaaaggcauguuuuagguuuauauaacucauuuauaauccuuuuaaauaugcauuuugagugaguguguguguguaccacaugugugcaggagucuacugaagucagaagagguuucagacaccuuggaacuggaguuagagacagucacgagccaccaugugcgugcugagaacugaacuuggguucucugggaaaguagcaagugcucuuuaaccacugagccaccuccccagcccucuuuucuaauguuuaaaaguuuucauugcauuuauguaggugugcgcauguaugugcauggacacguacauucuacagcacacauguguaagucagaggacagcuuguggaaguugguccuuuccuuccaacauaaaggucuggagaauggaccuauguaugagugucaggcuuggagaugggucaccuuacuggccuucguuucuaacuaaaguucaugagauuuaaaguaguuaaagagauuuaacuacuaagguaaaaaguuugcuggcagaucaauaugacguuagguccguauuaaugaauaauggccuagaguguucaguagacuuagagccaaggcugcacacacccagggcacacaggucccaacccaggcucaagggcugcucuuguguaugagcuuugugucagcagggggcgccaauguccugucagugggcgagggcuggcaacuaaggcccuucacaaugccugaguuucuuuaagaucauacccaggucacccaaaagaucuaacagacuucugagucucuucuaagcccagcuuuuaccgucucucuggcccagcccugagggcguuagugccaugucuggguucugcaugucucccggccuugccuggcccucucucuucucacucuuaguuuuccuagugacagccuggccagggcagcugccuaacuauggugcugagauagaggcugugcuggccuucuccuacccccguguuguucaaugauagcauuggggacaggauagacaggccacuuacauugccacugugcaggcugcugagucagagguccccgggugacucgagaugcuaaauacaguaaagagcuuguagaucaagcaggcacugcagaauaaaaaugugugugugcgugugugcguguguguguguguguguguguguguguguguguguguguguguugcuucuaauuagauaaucauucuacugucuaaugauggccauggugcaaaaugcugugucccugcccgccaaucauauauuucuggguuacuaucauugcaaacaauaaauagaugacaagccugacacccagggaguuaaaccauagugagccaaggaaauauccugagguagggaugggcuaggaguaugucagggaguagaguauuugccuagaucaauucucaacacugcauuaaaaacaaaacaauguggugacaacacaccugugucccuaaacacuccagugguggaggcaggaggcaggaggcaggaguucaaagucagccuggacuaccaagagaccuuauuuugaaaaaaagagaaagaaaaagaaauaaagacagaaaacgagaaagaaagaaagaaagaaagaaagaaagaaagaaagaaagaaagaaagaaagaaagaaagaaagaaggaagagguggucucaguagauuuaucucuaagaagcagaagggcucagugguacaccaaauacuugccuuguaagacuaaacucugaguuccggccccaauauuaccaaaagaaaagggaaaacauaaaauaaaagaagcaggcaaaaaaaaaaauuccucuaacagccugaccaggauccuggagagcuggcucagcacuuucauucauuguucuuccauaggaucuggguuagauucucaguaccuaccaccugcagcuccaguuccagagggucugacucccucucccagccuucuugggcauggcacacauguggugcacauacaagcagacagacagacacuaaacacacaccaaacacacacacacacacacacacacacacacacacagccccugucagggucugucaaaaugcuaacagaguuuguuguuaugaaguauaaaugaauaauaccaaggaguguuuuguacugaagacugcugugagccaggcccuaugagaaaaaauucacagaccucagaaguggaaagaucuaggcuccaguuccugcagguaccucagcuccucauugcuagcucucugcagaccucagcuucuagcuccaacaagcagggugguagaccccuugcugugugucucacauccaugaguuucaccgggcuucuguguugcuggcaugagcuguaaaaagaagggauuugaaaggaggaaugugcugagauggccagggucugugacacgggcugagcaacgccgcucuuaaguggcagcugucagccuggcccacacagaaagugugugcacuguagaccagagggcucaagauuggcuaggucugaguuggcaacguuugccucagguggcaguguuugugcaugcucucugcaaugaggguagaccaagggauggggcagguggcugcagucagccacacaaggcaagaauccccugagagcucgagggaggagcuccagcacuuggauuuggagaauaaacccaggauucugggaguaagugagugcaagagucugagggaguggacguggggguagagaagggggaccagggccugaauaggaagccccagcuaguugucuaccaaaggccugugggggggggggguagacaguauggggcacacuggaugcaaagaaucaaagaguagucauauuuaaaagauucacuuuauuaugaugaugaugaugaugaugaugaugaugauguguggacuguucuaaaugugaauaaugaaauagucuuccucuugggcagugguucucaaucuuccuaaugcugcaacccuuuaauacaguuccucauguuauggugaucccaaccauaaaauuauuuucauugcuucuucauaacuguaauuuugcuauugcuauaaguuguaauguaaauaucugauacacaggaucucugguguguggcccacagguugagagcugcugcucuuggguauguggggggggguaggugagaaggaugaucuggccccuuuucugauaugccgcagaccccuugguuugccaguagccaucccuuaauagagucgggggaguggggaaagaaccuuggacaggccuggaaaaacagcagagaaguuggguaucugggagcauuggguagauaauaauacagagcuccaaggaugggcugcaauacaggaauaaguggggguacguggaguauaugcugggugggcugcgggaugcacacuggacaguucuaaucuggggacaugccugcugcugucucccaggugcugcacccuuugccaccugcagguucuaaucaauuggcaaacacauugaaugaccacuucccugggcugcccugcccccacucugcauucccuagugaugcagaaauccaauuucuucuuagcugcuccacuaagagcuacccugccccaggccccaugaggccacaucucaucaggcaaucuguguucugcucuuuucccuggcuggcacuuggcucucagugaucaucucucuuucuccuuugcaggagccgggucaaacccaccagugaugcaucuaagaaccgagguccuguaaccaaagagccacacaaggaucaaggcucuguggccccaggucuuccaaaaggccaagagccuuugaaggaucaaggcccuguggugccaggacugccaaaagaucaaguuccuguagucccaggguccuuaaagggucagagcccuacagccccgggcccuacaaaggaucaaggugcugugcucuuagggcccgugaaggaucuagguccaguggccccagcacccaucaagguucaggaccacauagcaucugagcuuuuaaagaauaaagauucuguccccuuagcaccagccaaagcccaaagcccucuguugccagagccucugaagaaucagaguccugugguuccagcaagcacuaaggaucaaagcuucccaacaccagcaccucggaaggacccaggcccugugauccccgagcccgagaaggaucgagcucccacggucccagagcguaggaaggaccagcaugucuccaucauggccucuuugaagaacgaagcuccuaugguccccgagucugugaagaaucaaggcuuagcaggcccagagcuaguuaaagauacagguacagauacaacagcccccagguaucugaagggacaugauucuguguuuguagcaccugugaagaaccaagguccagugaucccugagccagugaagagccaagaccccauuaucccagcacuagccaaggaccaaggucccaugcucccagagccuccaaagaaucaaagcccugugguucuugggccuauaaagaaucaagacccuauaaucccaguaccuuugaagggucaggauccccuggugccagccccaacaaaggaccaagguccuacagccccugacccucugaagacucaaggucccaaaggcacucaacugcccacagucucaccuucacccccagucaugaucccaacaguuccccauacggaauauauugagggauccccuugauugcccugaaaugccaugaaggagcuggcaguggaaguguuucccuucuggggaggcaaagucauauauuuaaucugcaugaaacugugcuguauagucuugcuggaaucuaauaaaauugguuccucuggcucag

SEQ ID NO: 3957 - RNA, 7867 nt, Mus musculus
cuuuuuuucuccucuccgagccacggcgcccuccggaagcguuuccaacuuuccagaaguuucuugggacaggcaggaggggguggggccagccauauauagauccagggcccggggcagugagcugagcagagccugucugaggagcgauugcccugucggucccggagcagcccagcccggcccaggugaggggcgggagcggccgggcgauuugggguugcgcauuggccaagggggaacggaucgcuccaaagcuugggguccugacacaggugggcagugaaagaucggacuuggaacugucacuugccuggguucccuggagcugcggucuaguacgcggacugccugguaaaguacggagaagucucagcucggggaagguuaaagguggugagagggaaugcguagagcugggacuaaaugcuggugaccuucugcacaacugagaggggaggggaaagaccugacugucccaucguccacggggaagggccagcucugcagucccuaacucaggaguggaggcccagggacccgcagugauugaucccagaccaaccuccccacaggcuguguaggggccucugaaccuagcacaagagguguagacuuggugucucaucucuagcuguuaaggacccccuugcuuuggggagcagucgcuuuuuaaucaguauccuauguggaagguggccggacuugaccaauuaguucugcuuucaccucacccgaaaggggugucgucaggguccacaggcccugggugacuugagucacccugguccuuccguccacccaucugguuccugcagggcgaggacuuccucugaggcuuugagguauccugccuccagcuugggggacauuccugagccuccagacgaaaggaagaaggcauccauucccuguauggucuaacggccuagcuaucaacuuccugugcuuccuucugggcccuuuggcauccagggcacgcauggaggcccuuggaaaacugggggcuuugguugccuggaaguaaggccgaggccacacccuacucucugauaguucuguacccaucccccauuuccgucugguccuuugucucucuccgaggauucccugccgagguguuuuuguaguggguugcuguguaacaggacuccacaguggucggccugggagcuuugcugaaggcagagcccccgggagaaagccugaccugcuugagccgaagaggcccaagcugggcccugguuucugccucugcaaaagaggucauccaccuccuuacuccggguacccacuggggacugggcccgaccggccucugcuccccacgucucuagggguucccauuucuucacucuucuguuuucuuucagaaugaaaaaggcaggcaaugaucucccucugaggcccuuucaagguacuuuagacccaccaagugucugagaaacccccuggugcuccucccugccuccuggcaucugcuccccuuacaggcuucccaucacaggcucccuggcccagugguggacacggccuuuggcucugugauaucuuauauuuuuuugguuuuguuuugaugguacuguaaaaugucuaaccuuggccggagggcuggcguuucccuguggcagaugggcugggcuugccugugcagaugggcugcgggagguuggcuugcuugcagagacuugccuacuuucaucccuaaugcugggcuuaacgggguggcccuucuccccagcccugccugcccccucagauuuuugaggcacaguuguaaaacuaaaaccccugaggcuccuggauucccccggcaaauccuccucaccccagguucccaagccaggccuccagguucuuacccucggcuggccuauggagauaaagcagcuuuugccugccacgucaccaggggccuugcggcugccagaggaaucccuaacuagucauuuggagcuuuuuggagaagccccucccagccccugguuggcugagcgugggggcugucaagauggugggugccacguggcaggguuagguuucccuuccuuaggcaggcugguggccucugcuggauuagugguccuuugaggaggguggccacgugccuguugauaugauauuucccaucauggaucauuucacugcuucacucucauuugugaguguaccaugaguuacauggucccccugucuuugaggucuagugaggaaggagccaaucuggacuugcggauccuaccucucuuaagagugagaggucucacauuguuccccaggcagcugugaggcuguggugcccauccccucgcccccuccaugaggcugugguccucauucccucauccccuccaugaggccgugguccuccauccccucaaccccuccagggccuuugcgcuguuucucaaggucccuagaugggaagcagccgaggagguaugggagcagcccgacccagcuauauagguuccucuccaaaaucccucacucuuucaggcaggccaggcucucaaggggcuuccagcaaaguuuggaauuuucuaucuuccuaaaagucugugaaagggggggucuucccgaucaggggcaccccgucuuccuccaggguucuuccugaacuuucggcucuguggucuacuuaccugaacugcugcaugaagcagagguggggagggcaagcugaggaggcugugggaacggagaccuuugugacccgugacuucacaaaaggggacagggcuugccuuggggacuccugcuacugccggaguuugggaugggaacuugaagggaucuuugagguucuagaagagaugaugauguggccaucccaugggagugcagaauggaaucugugccucuggcuuccuaaaggauggagggaaaggguccaugcuccacugagcugugacucacccgcuuccucaggaucuugcccuuguugcucccuuaggaaauccaugccacuugaaguuucuaaaggcuugaucccaagagcguuugucaugggauuucccauccaguucagguguuuuuuguuuuguuuuguuuuuuuuuuuuuuuguuuuuuguugguaggugggcaggcuaagucccuaaggaaagagucugaggcugguugguaaugcaugcgagugcacacucaaggucacccuaggggcagcagaguagagcaucuggguucccccauuuuaauagugaacugggcaguaacuuauuaaugucucagggcagaaugcaaggcacagagaggaccagcugacaaauccauuccacauuguguccucugcccagacaccuguagacccccagcccagcugcugccuuuccuaaccaacaaaggcccugaggcucuaugagacuagagccagauuucacaaaggccaacaugggugccauucuggcaguagcccugacccuuagaaacaguuaugccaaaugccaggcacugggaugcuguagggaaccagaugugcuagauuuccagcccuaguggcuacagccuacuucaggacaccuagagagucauaauaagugaauaauuagguauaaguguugaaugucccaugggggacuucaauagguggccuaguaauauaccaaaaacuuuguuuuagguaaagaaauccaagaaggucucugaggggcuggguagcccugagucaggucuggaauaaagaacugaguucucuuguuccuguccccuugguggcuuagugggucggcuaggaagaaaugcauaaacuucaggguggcucucucuuucucugaagcccucacagguccucuguggugcacacagcccaccucccagccaugcgcucucuccuucugggcaccuuaugccucuuggccguggcccuggcagccgaggugaagaaaccccuagaggcggcagccccugguacugcggagaagcuaaguuccaaggcgaccacacuggcagagcgcagcacaggccuggccuucagccuauaucaggcgauggccaaagaccaggcgguggagaacauccuccugucacccuuggugguggccucaucccugggucuugugucacugggugguaaagccaccacagcgucgcaggcgaaggcagugcugagcgcugagaagcugcgcgaugaggaggugcacacggggcugggugagcugcuccgcucccucagcaacuccacugcgcgcaacgugaccuggaaacugggcagccgccuguacgggcccagcuccgugagcuucgccgaugacuucgugcgcagcagcaagcaacacuacaacugcgaacacuccaagaucaacuuccgagacaagcgcagcgcccugcaguccaucaacgagugggccucgcagaccacggacggcaagcugccugaggucaccaaggauguggagcgcacggauggggcacugcuugugaacgccauguucuuuaagcgugagucucagggauggggugaaggagaggggagacuguuucccaggccccugagcuugauucuccuuauggaaaucuuucauuguuucucaugugagcacuaccacaacgggcagagucagggcuacugauaagcccauucuucaugcuagaaaccagauccaggaaccagguaggaaucucuaggguaggacuguaccacauuaggguucuuuuuuucuuuuuuaauauuuauuuacuuuauguauaugaguacaccauugcucucuucagacacaccagaagagggcaucagaccccauuacagaugguugcugggaauugaacucagaacuucuggaagaucuuaaccacugagccaucucuccagcccccacauuaggguucuugcuuguguaaguuggaaccugugaggcucgguaauuggcucugcuucaacagaaugaguuaaggagucaugcaggcaguguuagccccauuucacaguuaaggagacugaggcuuggguaggacgaaguagagacaagacuaggacaaguacaucugaauugacugaagguuagauguggggccaaugguuuugugugagcaucuaucuagguaugggggagugaccuaagagcuugcagccaggugaaggugacuccugcuuuacaaauaggugagucuaggugagaagucuaaucauaacuaguuugucuggauuaggaugugggucugguugggacuuggaccucugucacacaugcuuugcuuuuuuucuggcuacacagaacuuaaaagagaagaaauuauuauuauuauuauuauuauuauuauuauuuucgagacaggguuucucuguauagcccuggcugucccggaacucacucuguagaccaggcuggccucaaacucagaaauccgccugccucugccucugccucucgagugcugggauuaaaggcaugcgacaccacugcccgacuaaauuuuuuuuaauuaacugauuuacuuacucuucuuauacauacgugagugugcaugcaugaguuuuuguguaccauaaggaugguugagacucaagugauugugagccgccaugugggugcugggaaccgaaccugguccucuucaagagcaguaagcacuauaagcacugagccaccuguccauucuugagcuugugaagaaggcuucaggguggccuuugcugacuccugcccaagguacagaccucaguuauccaacggggaagaaagccugucccggacaccacccacgcaggaggacaggagcuucuugcaguugggagugagagaggccaacguccucagacagugaacacauacucggugcaccaaggguggcaucuagggcacgcagugggauggcugugggcuggucauaucuguggggacagagcucauugacacaugguuuuauuuuuccaccacagcacacugggaugagaaguuucaccacaagaugguggacaaccguggcuucauggugacccgcuccuauacuguggguguuacgaugaugcaccggacagguagacgucuugcuagacggucaagguggggggggucuggggugcccagaucuggcuugccccuuaccccucaguguguucagcauccucuucucuucauccacacaggccuguacaacuacuaugacgacgagaaggagaagcugcagaugguggagaugccccuggcucacaagcucuccagccucaucauccucaugccccaccacguggagccgcucgagcgcuuggagaagcugcugaccaaggagcagcugaaggccuggaugggaaagaugcagaagaaggcugucgccaucucccugcccaagggcgugguggaggugacccaugaccugcaggugagggccggaggguagugucuggggcagguuucacccaguggcucagcagguccauccuuuauccauagggcauccagacaguacugggcucugcugaugcuggggagaagugggcucugcccuugggagggaggauggacugaacauaguugaacagcgacuggcuguugucucuagccagguccuagagugggcugagcccucucaagaaaaucccucagggacaugcguacaggccaguauggucucagguaguuacugacgauggcuuuccucucagcuaacucuagacugugucaaguugguaguuaaagcuaacagggauaggagggcucagguccuggugguauacagaggaacaaaaggaacagugguuugcagcacuuccgcaccgugccuggagcaagguguccagagggugacuccagggugguguggauggagguuggggguaagagcccggcacguguguggccucaccaaccaccugcucccacagaaacaucuggcaggacugggccugaccgaggccaucgacaagaacaaggcagaccuaucgcgcaugucuggcaagaaggaccuguaccuagccaguguguuccaugccacugccuucgagugggacaccgagggcaaccccuuugaccaagacaucuacgggcgcgaggagcugcgcagccccaagcuguucuaugccgaccaccccuucaucuuccuggugcgagauaaucagagcggcuccuugcucuucauuggccgccugguccggcccaagggagacaagaugcgagaugaguuguagaguccaagagugggcguggcacggcaggaaguagccaaagguuccugagacacaugggugcuauuguggggggagggggaggcaccaacccuggauauuccacgggugggggggguuggcagugcagaucggaauucccauaugucugaguggguauuuuuagacagaauccacuccuaaguuaggacauggagcccagauacuaugauaccaaauucaggggugucacagccauuuuguucugcccugcaaguuuuagauccaaucugccucaacagucaaucaguguucauauuuauggccaggcauucuaucuguuagacaaucgaguuggggguagggcagccuagcucuuuuugucaccuugccccgagcccucuucagucuuccuguucaccccuccuccacucccuuuaaccgcaaaacuaggugcuguggccccagacuacccauccuuaaaaugauccuugcccagcggugggagcugggagacagugcaugggaggggcucccuggcaugccugcccuagaauuguuauguugggcaucacagucaugaacuuuuguuuuucucccuuuuuuaguuuuuucaaagauggggggaagggaaauaugagccuuuguugcuuucaaaacgagaacaguuuguacaaguuuuuuuuuuugaauaaaacuuuuccaaugaaauguuauaggugugugaaagcagauuaaagaaagagguucccauaucauucuuucuaaga
